United States Patent 9,328,346 (POLYCOMB-ASSOCIATED NON-CODING RNAS) - sequence listing, part 11

SEQ ID NO: 1608 - RNA, 123290 nt, Mus musculus
cugaggaggaaguuccgcuccugacagagcgcgcggcggcgcgggcgcuguaguguucgggacgccgucgcccucgcggccucggcugagggucgucgcugcuacgcccggcgccgcugcuuggaagccgcggaggcugcggagcgguggagcggaggaggcuccggaggggaccgaguggaaccgaccuacugcaacucgucgucuucgccgggcgccucccggggcgggcagccgccucugagcaucgcgccggggcgcgggcauggcagaacccaccuugcagcuucucugcgguguggcucgcccgauccacucucgggaaugaagaggagacucgcgaucauccggugaggcaccgagagccaaauggcgagaagaucugacgggacagaaaccaacgaucgcuugggaggucacccgggcuucuggauguaaucggagagcgugaaagagguggccucguaaauaauaauaauaauaaaaaagcacaacaauccuuugagaggagggaaauugaguuuauucuuuuuuuuuuuuuggccgagguuuugagaaacgguucgauguguuguacguuugauauaagaugagaacuuuauaaaguauuccguccaagagccuaaacgaugacuaccccagcgcugcugccccucucuggucguaggauaccaccuuugaaccuggggccgcccuccuucccacaucacagggcuaccuugagacucuccgagaaguuuauccuucuccucauccuuagugccuucaucacccuguguuuuggggcauucuucuuccuuccagacucuucaaaacacaaacgcuuugaucugggcuuagaagauguguuaauuccucacguagaugccggcaaaggagcuaaaaaccccggcgucuuccugauccauggacccgacgaacacagacacagguucguuuguuacuuaaauuaugguacuuccuuuugggagagcaagguacaguucacugcuuucuugucucuccccccucccccuccugccccugugaaugaucaggguguugaacguuguugguucagagcugccuggguagaaccauacauagacuggaaggacuccuaggguuccuugguuuuucccggcagaacgaaguguucagucagacucuucugcuguggacagcagggagcggagauacagggagucagcaugcgcguauugagaacguguuucugccuuucugccaccaugugaagucacugaaucuugacagcuugcuagacuuugcucagccaccaagucccaaucucuggcuugugcucugauuuuuuuuuuuuuuuuuaaauguuaaaaggugggguguguauaucccuaaccauaauuuggccaguuauucugaauugagcccuuggcaggguauaaucaagaugaaaugaaauggaagcucugcuuccagccuuuaagucauuucuagaucuuuaccuaaaaggagacuuuggagacaauucgcuuuuuccaaacaccucucuccucucauaagcuaauucuugaaugugugaaagagaaguauguaugagacuucacccgaaugguagaaccccuguagaaaauggguagugguuuuaaccuagugugaggauuuugaaaaagccuagguucaaaugugagccuaaguuaaauauuugggacaauacacuauuguaaugagggcguucucacuuugucugugaaguuaauaauuacuugcuugcuaguucauugacuuuuggccuuauuggaguacuucuaauaauacaguuucauaccauuuuucuauacuuugggauauuugauauuuucaacuuacauacuuuaagagguuuuucuuuaaaacuucccuugcuuuguaacugugaaaaaccuuacuuggucugggaaauauuugcugaaaaagaaacguuguuuuucuggaccuuauuucccaugguauguauauaugaugcaaugaacauuugggaaaaaaauguucagagcuuuuugacagcagugauguauuaaugucauuuagcuauuaugaucugcugucguguacugauaaguggcuuccuuuauauuuuauauggguagaaguuugcaaauuuuuacuuuaaaauugauauuaagagaguuaagaaaaguucucaacuaguugaaguuaaaauacauucaaaugaaaguguguuuauguucauuguacugcacaaauucaaaagaaucguuuaagucucauaaguaacaguucuuaaacuuuauagcccaggaauauacauauauuagagcccaggaauauguguguauuuauuguuacucagaaccccugguuccugaguuuggcagugggaacagaguuguaauggccaaggggugguuauugagcugcauuuucagcuugggauaggaagagucagggugacggaaaggacacugugcuguuggauuugcuugccuaccagcucagagaaucaacuccuguguggggaguugaagcagugaaggaggcagugcuaacgcuggcuguggcaggaacaguuugugcugcucuuuguuuacacuuuguuguugcuuccucucaccugaaaacagucugcuuggaauaauuuuacuuugagcaaggaauacguuuaaaaugacagaaacuaaugugcaaauaugaucuugauuaaaaguaauucagaaagauagucuuauagaauuauuuguaacuaagaucauacuuauuuuguguguaguaucuuagaagguaaaaauuguguuauguguguguguguugugugcaugcuagggacaggguuggggagccuugcaaauggagggcauuaauucuuguuacuaguguuuaagagauacucguugggauaauguuucuuucugaaugcauaguuaguguaguaccuugguguuuuaguucaguuguuagucauuuuacacugacuaaaauuugugaguuuuuuguuuuguuuuguuuuuugagccaguuuuuaaucagcucaaauuguuuccucuguaugacagcgacaucuacuuuaugggcuguacugaaugagauaauacgugcgaguccuugauauaguucacaacuucagccaguugucagggagacuuagguuauuaucacuuauaauuggaauguuugaauucugacuuugcuuuaaguguuuuauguuucugaaaaucuagguacaguuugauaaauauuuuaaagaguacaccagaauguuucuaucaaaaggaacauuuuauaaugacauuauuuuauaacuguuauuaguuaacaacaaauaaucuacuguucagacugcucauguagagccuccuguguggaugggcuaaugauucagggauucaaugauuuugguuuugguuguuagaaaguuguacucagagcaaccagaguuuguagggagugacuguccagcauuuggaguggagggggagagaaaugagaauaggaagguuucauugagggggaaggggcucugaaacggugagaaaaagaaagcuagaugaagcagugaugggaggaggcauggucaagcaggcugcacaggagagcccuagugggaaaaaccuggcguucuuacggguacaggaaauguucccgugacugacgagguagacagugugguuguguggccaggugcagagaguagacagggcagauguggauuuacaauuccugccuauccccuaguuacagaagcuugaauuaguuccuggcaugcacaacgugggagauucaugugacagucuagauuucuggcuuuucuuaaaaaaauuugcgacuggagcaacacucaagugucuauuuuccgauggcuaacacucagucggaaucuggcucccucuugacaggcgugcgcucuccauuuuaugccacucacuuaaggugucaaguaacacaauaaaucaaugcucagccugccagugguuaaguuugcaucucuaggcuggacuguugcuaaguauuuuggucuucauucugaguagcugcugggaagucacagaagcaaaaugaaaaaaaaauucauuuugaauuuaaaaaaacaaaaccaauuacuuuugugcaggacaaccaagguugagggucuaggacacagcaaauugacuguggccauauuaguaauucugugagagaagauaaauuagugagaaaugaaguuaauuuuagggaccugugguuggcugaauauagaaguuaagguaggaggagagaguggaaaguaacuucugaguuucuuuuuuguauggucuugcauuaauacaaacuuuuuuuucuauuaaugccuuuguuuauuuuuauuacaauuuuuugccuuuauuuaauaaugauuuuaugugguuaauguuugcuuagcauguucccuuuuguuaaguagcuuacacaguuuuucaauaaacuuuuuauauguuuauaaagcauuuuuaaaguaccaguccacugucaaggugauaauagcacaaauuguauuaauaguuuaaaauuacauuugugauuuuaaaucaccacaaauaggaauuuguuauacugcucauuuauguuauuacaauauauguugauuuacauaaaggguaucuuuuuaacuuguguauagacaguuuccuuucauuuuucagucuuucauuugaaacugacauugcuuauauaaugacauuguacaaaugagguugaccuccccauguguuuguuuaaaacauugaacauauauuuguaaauuauccuuuaguuaggaucauguuaguucaaauugaauacuugagaguuauguguguuuauuucuaguugcugucugucugucucagcugauguuauuacauuaccugguacaaauuacacacuugccccugucccuccgguaaaccaucacacacuuaggacaggguuagggggccugaguuacccuugggggagccccugugauuucuccaguccucugaggacugggagucugggcaguggcuggagacuggguggggagugcagcuuggcugacagcagaucuucaaggcaaggucccucaccuuggccgccuggcuggggcugacggucacagcugcaucccacugggccuugagcagcuggcugggcuucagagccuggagagcuucuggggagacucuuccauacuuuccaaaagaguguaguucccaccaggcuuaugagagcuaagaggguuggcagcaugacagguaggcucugaaguugugacacuaugggcagagccuggugucugauaguuuucuuguuuuuggagacaggguuucucuguguagcccuggcuguccuggaacucacuuuguagaccaggcuggccucgaacucagaaaucugccugccucugccuccgccucccgagugcugggaucaaaggcaugcgccaccaccgcccggccugauaguuuucuuaaagggaaaaaaauguaggcuuuggaguagaaaggaccuaaaguggaauguaguuucuauuugguggcuaugugacaguguaguagauguaaucaucuugaaccuacagugaccauuaccagucacaucagacuagaguguacuuuagccaguguugagguggcuuaauacuagcacucuggaagcagggcaggaggaucucugagaguucaaagcuagccugauuuacauaaugaauucuaggcuacccaaggcuauauagugucucaacaaacaaaaacuccaacaaaugucaaaacccacagaaguguuguaaugagagauucuugaauucucuccucuuucauauuuuuauuuauguaugugugaaucucucucucuagguuuauucugugcaagauugcacuuaccugcagaggccagagguguuagauccccuguagcuacaggcgcuggaguuacaggccuuugugagcuguuggaugugggugcugggagucgaccuuuugugcucuuaaccacugaagcagacccucaaauucuuuauucacauccagauugcuggcuuuugcuuauuaucuggcauugcucuuuagugcucguauucauuauuuccuagucacugugacuagaugcuagaccagaaguaacuuaaaggcagaaacauuccuuuugccucaaagcugaggaaugcagcucguuacauggcagugggagcaacuuggacuguagugcugaggaagcagaaaggaauccuagugcauggcugguuuguuucccuuuuuauuuagcccuugagccuaguccaauggaugaugcuccccaaccauagguggguaucuuucucaguuaaauguuucugaaaacacccuggacagacauaccugacaugccuugcaguuguagaggaagcccugagcgagugaguguuguugacaugggcccagucuugccaaggacucugaguagacccaugggaaaucggcaaaccuguucccaugcgguucaggcucagaaaagcaaaguuugacuguuuacugauaagugaucaggguguaugaaagcuagcaacuacaugguuacagcuggagacugcuugccaacagagacccccccccgaccccccaaaacuagccaacuccuccucauaugcuguaaaugaauuccugagguucuggauucuagagguaguagcuaccauuccaucagccuguguacaccacucucuaccugagcccaucuuuucuguacaugggucuggauauauauucuucauucucucacugacccuagucaagguuucuggaccuaagccaugcaggaugacacagugccuuauuagugagcuagguauuuauuaauuuaaucaaguuggcaguugaaauucaccaucauaagucugcguccuugucaacuugcccaaacacaucuuuuuuguuuguuuguuuuuuuguuuuuuuugagacaggguuucucuguauagcccuggcuguccuggaacucacucuguagaccaggcuggccucaaacucaaaaaaucuaccugccucugccucccaagugcugggauuaaaggcaugugucaccccugcccggcucaaacacaucuuuuuaguuuuaauauucuaccuccacccccuauaggcuaauggcugcuucauagugcaaaauauauucauuccaauuucagaaguccucagagucuuaacaguuucaaugcuauucaaaauagcuaagaucucuuuugagacucaaggcaaucucuuaacuacaggucucucaacucauaaaauugacaacaaauaaacaaaaaauccaaguuauuuauuuccauauacaauggcacaguauauaaacauuccuacuccuaaaaguaguaaugacauugcaaugaaagagagggcuaaaguacaacugaaaucaagcaggacaagugccaaauucuguagcuacaugucuaguauccaugguuccugauaacauauggacucuaacaacguuggguaguccuucccuucugguucuauugucuacaauacagcauacuuauccugugcuagucuaugccuucccugcaguuguuuuggcagauauaccaggucccagcaucuccagcuuccugggauuuguuucuguuguaacuuagguuucacccucauaacuucaugcaguggcuucuuagaacuuccuugcaggguaucugaucuuguguugccuggcuucaguagauuccuggaaccuugguacaagccuccaugacccuguaauucuuuaauuuugcaugugugugaaaccagcauuguguguacaacccugccaaguuuuaaugccaagucaaaauguagucuggcacccuauuuuacaaggccucuaugugcauuggcaguugaacuugggaagacacuucccuaggcagguauuuucuaguaggaaaccccuucagcagcauucugaaugcaggcucuuuucaaaggaauuugcauuuuacuagcuaagucuaagucuucaguggguggggucuugcccuaagaaggaauauuucucucucucucuuuuuuuuuuuuuuuugguuuuuuugagacaggguuucucuguguagcucuggcuguccuggaacucacuuuguagaccaggcuggcuucgaccucagaaauccgccugccucugccucccgagugcugggauuaaaggcgugcuccaccacgcccggcuggaauauuucucuuuuaaaaauauuuuaaaauuuaagguuuguguguguguguguuguauacaugcuguggugcaagugugaagauuagagaagggaaugguucuuuacaccauguggguuccagagauugaacucaggauauaagguuguauguaagugccuuucccgaaugacccaucucuuugucucuagagggaccuuuuuuguuguccuaguacaaaaugagugauuucucuuugauugccuuacucucucaacuuccccucuuuuaaagaaaaaugguuuuuagguuaccuaacuauauguauguacauaaauuuugcacauaugugcugauacccaaggaggccagaagaagguguuggauucccuggaucuaggguuagagguaguugugagccuucugauaugugugcugagaauuaaacccagacucugugcaagagcagugcauccucuuagcugcugaacccuguaaucuccuucauaacugaacauucuuugccuaugucuaccaugucuagaacuuuaagcuuacguauguuccuuuucuuguuaaacuguguacuuucccuauuucucuauucucccucauuauaaaucagggcaagagcaguggguaguaaccaugccacagccucaacacucugcuauagugaaauuucucugcuaaacaaauuaguccauuauuuuuuaauuuaucucaaguugucuggacacaagcaagacacagcuauauucuuuucuagaauguaauaugaauguccucuaguccaguuuccagcugaguuuuuauuucugucugaggccuugugagcugugacuucgcuuguuugcauuuuuauuggcuuucuguuccucuguacuucucccagaauggccuguuaaguuccauuuacagcauucuagaacaucacccaaggacuuaacgucuuacuaauuuugacuccuguugccccaauccacccauauauauauauauauauauauauauauauauauauauauauauauauaugacagauagaaacuauuuacaguaaaucagauuuauuuaaaaaguguucuuuggcuuucauauaaccuuaaacacaaaagcagguuugcauacuaaugauauggauguguuuaaaucuguggccacuuuaaaaaaagaaauccuaguuaaauauuugauaaugcaggaaauagaacaucuucauuuuucaguugauuaguauuuuaauuuuauaaucaucaaugcugagaauucuguuucacauaaauuaguauaaaauggcaaaauguauaaaagcauuuuucugucugucugucugucuaucaaucagucaucuaucuauuguauauauguauguguguguguguguguguaucugaauaugcacaugccauaggacucauuuggagcccacaugguugacagaggauggcuugugggaguuaguuuucucuuaccaccaugugguuucugaggaucaaacucaggucauuaggcgugacagcaagugcauucaccugcugagccaucccgcuggcccacaaaaggcacguuuaaagguguuuucugaaauugcuagaaauucugccauaaccucaagccaaaauucauuuaaugauuuuuaaaauaaaacugaaaucagcaacugacauagcaucuuuaagagucaaaccuuuuaauauuauacaaagauaaacuaauacaugcugauuaaaauacuagaagaauuggcuuucauaguugaauuucuauuuuuuaaggacaaacauauacaauaaaacauugcagcuaacagcauacaguguccuugaaacaguuuauugacauugcaugguguaucacaucacaaguguccaugucguguauucagaaucaggguugcagugaagucaugugaugaacuuggaugagcauugcuagagacaccucagaaucauuccuguuagcuguugaguacaucuuugguuauugcauauuugcuguugccauauuuccaugccuccugcauuuaguugugcguuuccaucugugcuccugacccacauuuuaagaagcugaguucuagcagagccgaagucuucuuaucuccuccuguagaccaguuccaaagggcucuaaaaugugugggcaggcugucacagcagugacaggcccuacuucucgguucuaacuuucuguauuaauuacuuuucuuugcuggugccaaauacccaauaggaagcaacugaaggacagaaagguucuuuuugacauuuaguuuagaaugcagguuggggaaggcauggugggagaggcuuggcucaagguccugaccaagaaguaggggaagggacuguccauguucaucuaucucuagccaguggaugguacucuccaucuuuaggguggguuccucaaucuaguuaacuguuuuuggaacucaaacagacaugcucaauggagugccuuauuaaugcccucaguguuuauuguuuuaaucaaguucauaauuuaaaugagucauuauaguaugaguuacagauuuaaauagcaguauuucauuuuuaauuuucuuccuuuuuuuuuuuuuuuuuuacuccuuugauacauuuucugugucuuuaaaccccuaauauguuuaguuuauauuuuaagacaaggucuugcuauguagcucagacuugccuuuaacuauugacuuuccugccucagucucccaggguggcacaauaauagugauauauacaguauuacacccagugccucucuccuucuuaagacuuuuggcccuuuugaggguuugcuguuuugucuuguguuaugucugucgacuauuccaugaccuauuuaacucuugguuauuugucuugcuucucuuuacuuauauauggauuauguagagacugugaacuucuuauuugugaucaacagacuaaaguuggugcuuucuuauuauuuuuauucuuuggauaggaauacugaaugacuacuuuuuuaaacuucauaguugaagaacaaguaauuuguauucauagacuuaacuguauugaggaguaaguuuuuuuaugcaguucucaaguugagaauagaguugguaguggauagucuccaugauuccuucaacacacagagcauagcuuguuuuuccugguuccucuguacagauccuccaauaguuuaucuuagcuauaaugaagguuauuggaguguaagguacgaggugugaagagcucuguagauaggaaagucuagguagugcucuagacuuuucagacgguucugaucugucucagacacacaguuggcccuucacuggcauaagggguacuugcuagggagguagaugaguauuaaggacggccugguuguuuuaaaucaaaguauaguuguagauuaguaaagagggcaucugguuucugaugcuaacuuugugauggcugcuugguuauuguuuguuuuugauuuuuugauagucugaguuuuuuguuuuguuuuuuuucuccacuuuaaaucauuucuuuuucuuucacaaguguaaucugggagacacuguacugugagcugcccacucacaggauaaccuuuuguauauuauuuaaaaccuaauuuucauaugaagcaaaaaugccuauagcucugcauuauuaguuuagcauuuugaaacaacaggauguuuuuuaauuuuuguauuagauauuuuaagauaugaguauugaugccauaauagguggacgguauuuauuauuauuguuauuaaaacauaaguguuuuaaggaaauaaaguuucuuuuggcuuucuuaagggucuauggcuagaaagcugggcagugguggcgcacgccuuuaaucccagcacucgggaggcagaggcaggcggauuucugaggucgaggccagccuggucuacaaagugaguuccaggacagccugggcuauacagagaaacccugucucaaaaaacaacccccccccccaaaaaaaaaacccaaaaccaaaaaccaaaaccaaaacaaaacgguagaauauaauuuaggaggacaguuuauguaacaaucauuucagucaacauuggacucugggucuauacaggaauagaacuuuaguaacacuacaaugggacaaaaaaacaaaaaacuccaucacuugacagaagccuagcugaacaaggaguaagggaaagggggcugcagaaggcuggggcuggggaggacugggaagccacaggaaagccuucagcagaaacuugcagaccugagugaacucuaaacauuucaaagcaccaaaagguuugcuuagcaaagaaaagugaugguuguacauuaucuguuuauaagcagaauauuauuguccauaauaacuguuauaaaucuaugcauuuguacuuuugaaauacuuugaguuuuuaaaauacuuuucucuaauaauauuucuuuugcuguugcucuuuuaacccucaguuuuugguacuacuauuuuacuuauuaacagcucgacuuacuccuuuagcuccucugcuauuauuagacucuaaagauuuuuugaaucuuucucauuuuuauggucuacuuaaagggcuauguaguugcugcuuauuuaucugucuuucccaauacaguccuugaggacagaugacuguauuuuacauuucauuuccaaugcugcauaaaggccugcuguuaaaauaacagugaaaacuauuagaaauaauucauauuugcccaaucuagaacaaacuuaguccuugaaauguaucuaaaacuacucugcauugaauuuccauuuuuuuuuaaagggaaaagaguagaaacgugaugaguguuuuuauccuuucuaguuuucucaucagauuuguaaguggacuuaaguaaucucauuuugacacucuaacauuuaaaucaugucuaaauuuguaaaaguuuccugcagaagcuaugcaucuacugaaaucauugagugauuuaaaaauuuagguacauguuauauucuuuauugauugaagaugacuaaaauauccaaacucagucucuguauuucuugacuaggaaaaugauuuuguuacuuugguuuuucuauuuguguaaauucugcuagaaauauuuugcugaugaauuuuugcugaaacuuuuuguuggaauauuguugaaaugaaauguauaguagagauuguucauucaaauugggcuuuaagauuuaagaagauuaaaccucugaaggagguuuuuaaauaaaucuuuguacuacuauauaguccagaggacggcaucguuuauuuaauaguagcauuuggcucaaaggcaagaaauagaggcucugauuuuaguuuuggccuuuauuauuguuaagauaugcuauuuuuuuuuuuuuuugugccuugauguacuuauuuaugaagugaaggaauugauagaaucagguuuugcucaugaauguuaucuaaaaguaauuuuaugcaauagggaacuggcaagugugggguacuuuauacagcacaugaacugaugagacaauauguucuauuugauagaaauuagugucauuuuuguacauaaaauaaguuauaaaauauuuuaaagaagugacuaaaauuuguuuauaauuugauuauacaguuuaugcaaauuuaauaaacuaaaaugagggcuaaggugauggcucauuggguaggagugaucagggcacaaaugugagguccugaguucagauuccagaaccuauguaaaagcuagggguagccaugagccagggccacagugcuguggggaauggauucaggaggcucacugggccuugcgggucagccuagccaaaggucagaaaaggaggacucuaggacucuugguucagugggagacccuguuuuaagggaguaagauggggagggcuacagcaggacauucuuagguaaagcugagaacaagugagauggccauuuuacaguucuuauuucucauuaguguuaagcaauaauuuauugaauguucucugugugccaucuugaaggaagaguucaaaauauuuacaaaaguguuucuaggugucacauuucggagcugugcugauagucacgcguuuugauuuacuauuuaagccuugaggguggacuuugguaaaaacagucccugagugacugagccaccaggcccuuuaaagguuuucacugccucugagggauagaugggcucugauugaagacuaucauuuucuaaccuuaauauugagagaugucccugaaaauacuugcuuucucuguucagcaaaucuuacaaguuaggcaguauuuuuuuaaaggacuaggguaauuuggagaugauauggguuauugcuuugcuuuuuggcauuuccacauuuauauauuuauaacacccucuauuauuuuuguaucucuuuuaguuuucccuuagugguacugauacuacuauuaaauuauuauacagcaaguguuuugaguuuuuauuauguaccaaguaauaugcuaaguaauggggguuucugugaaauacagaagaucaauuuuugacaguggacacuacugaaauccaaauuuuagauucaaauuguaauaucauuuuuaauguguuuaccuaugugagguucugcucuguuauuuggauagcugcuuuaguuuguguucagguuagucuuugauuuugcauuuauuuuuguuuucucuaauauauuuugugucauuaacuuguguauuuugauguuuggccuggacugucuggaaguaaguggcagauacggcuaaacuuuuuugauuaguaauggacucuggcauaugaaaagagaggccagacacaguccuaaguccauacauaguuaagcauuguaguuuuauaguugaaguguaagacauggagguauuguggcuuuauuugaacacuuguuacaugugcgugcauggcucucaauaguaaggcagaacaagaugaaaaguuuguguuggauauauguuugcugauguguuuauaaaaacugucagguauuuuucuaucguuuugugaugccacaauaaacauuugcuuuucacaacccagauuuucauccucuaguuaaaaauucgguagcagcacaucagggugagguaaccaugagcgccugguucucuugcaaacucccugaaaagugaaaauugauugaggcuucaugacaacauuuagcuacccugacaaaucuacaguguauuuuucuugauuuugcaagucuaggaaauuaucuuuggaaaaacauugcauuguauauauagugcaaauguugaagaaugucccuugaagcugucacaugaaaggguaaaugacccaaauuucugucaguguaguauuaaauaaauuauaauggcuucauauuuaaaaaaaaaacuucuauagaucuuucuaguuacuaucaauaaggucacaguuuucauacuuuuauauuacugcauuuuaauaucucauguugaguacucccauaucagucuugguuuugaaaaguuaugaaaagucaucauacauaauagaugaacagguacaguaaaugucaggguacucagcauugaguguggucaguucuuaacauuucuuauuucagcugaagauuuaucucugaagucagauuuuggacugacacugucauugucagagcuugguuuuauauguucauuacaugccucacacauuuuucaauauuaugauuuguauguauugauguuguggcucuguuucaauuauccacuuagguauucuguuguauaguuagcugugaaguuauguguuccucaguugagagauuucuagaaaagauucauuuacucugcagaaacauuuggacuguauuauuaggugcaucuauuuuucuucaagauaaaaauguguaauuacuggguugcaguguuguuucaguaaccugugacauuuagaguucuggguugacacuuccaccugugucuuuauaaacccugguauuauuugacuaaagaacauuuuaccaacgugaucaccuuuaguuuguguuuucuugauuauuuaugaaguuaggauauuugugaacacaucacuugguuguuuagguuuguauucuuggacacccucucucuccuuuuguguuugagaagguaucucuuuguggccuggcugcuuuggaacuucugggcucagcgaaggcauucuuuagcuucagccuccugucucugggaugacggaugugugcuaauacacuuaacuauguugacuuuucuuaaaaaauuguuuuuugccuuuuucuuucacauuuguagaaauuauacguucucacauagagaguucuuuuguuaaguguguugaauauuucuucuugcuaugggcaccgugcuggugaguuuugugagccugacacaaacuagacuuaccugggaagagaaaaccucaaaugaggaauggccuccauuggaguggccuauggccauuacuaauugauguagcccagcccacuacugguggucaucccugaacagguggccugcacugugucacugugaaagaggauauuagguauaguagucauuuuguagguauucugucauuucagguauacacacacucaugucaucugugaagagucuuaguuuuacuucuguucaguuuugcaugcuuuuuauuugguuuucuugcugaaauuuuaucugagcauacacuguagugcugauagcaucuccauugagugcuguagcuggggcuucauguugaaguuugcaucuuuuucuaguugguugaguacuuuauuauaaagaguguugcauuuugucacaugucuucauugauuuuucuucaacuguuuuugcauuacuggaauaagcuccacuuguuuguuauguauaauccuuuaaauaugauauaggauucaguuugcuagaauuuuguuggggauuucuacaccugcauuucuucuuuuuuuuuuauuuuauuuuauuuauuuauuauauguaaguacauuguagcuaucuucagacacuccagaagagggagucagaucucguuacggaugguugugagccaucaugugguugcugggauuugaacucuggacuucggaagagcagucgggugcucuaacccacugagccaucucaccagcccuacaccugcauuucuaggggauauuugugucauuguauuuucuugugaugucuuuguuuuucuugguuuucaggguaagacuaaccucauagaacgagugaggaaguauuuuccucucugaagaguuuaaggauuaaugucaauucuuuggcugcucaguagaauuuaccuauaaagucaugaauauucuucagguaaagauugcuuuccagguagacgagcaggaggacuucuuaggagaaacuaaugggauaggccuuguuuguugugcauguugguucucagcuuagacauaaccuugcagaacaggguauggagaugggugucuugcugcauuccagaucucuuccuagauuucuaaaagugccuugguugugagugcuuaaugguauauaguaauuguaggcuucguggccaaguucuuauauuccuuguguuccauccagcuaugacuucauccagcuauaucucuucaugauauacucauuccuuuaagucuaauguaguuuuccuuugcuuuauuaauuuuguaugucucccugcaugcacacauguguaugcauguguguauggguaugcagguauguacggguauauauguauguguauguggggguguguguaugcaugugugccugugugugugcaaauguuuggucagagaacaacuuauaguuuggucgucgucuucgaucaugugagucucagggaucaaccugagcucuucaagcguggcuauuagaagccuuuaccuauggagccaucucucuggucucgugcuuuguuuuuugaaugcuuacuaacauuuggucauuguauacuauugaauccuacaagugguuuucucuguucaugagauacaguggucacuaguuuuauuuauuuacugcuuuuuaucugauucuaguguuaaaguaauacuggccucauaaaaugaauuaaguuuuucuccuuuaguuucccaaaagcgucuguggagcugauaguaauuuugcccuaaguccuugguagaagucuucagugaagucauccuaacugauguuauuuguguguguguaugaaagauagcuguuguaccugucauuucuaacauuggaaacuuguuaugauuucagugccuuucacccaguaacuaagagaaauguagggacauaaaaccaacuugacuugacauuuguauauucuuuuuuucuuuuucuuuuucuuuuucuuuuucuuuuucuuuuucuuuuucuuuuucuuuuucuuuuucuuuuucuuuucuuucuuucuuuuuuuuuuuuuuuuuuuuuuuuuugguuuuucgagacaggguuucucuguauagcccuggcuguccuggaccucacuuugaagaccaggcuggccucgaacucagaaauccgccugccucugccucccgagugcugggauuaaaggugugcgccaccacaccuggcgauuuguauauucuugaaccggggaguggcaucauuuggaggugugaccuuguuccaauaggugugacccgguuagaauagaugugucacugugggugugggcuuaagauccucauccuaguugccuggaagucagucuuccacuagcagccuuuggaugaagauguagaacucucagcuccuccugugccaugccugccuggaugcugccaugcucccaccuugaugauaauggacugaaccuugaaccuguaagccagccccaauuaaauguuuuuauaagacuugccuuggucauggugucuguuuacagcaguaaaacccuaacuaagacacuacccaauaauugcaaaauguacauucuguuaaaugcagauguagcuguaucaguauagaucuuuuuuuggcuauaauaaaaggacuugggucauaugaaguaugcucuuagccucagugaaagcaaaacaccuugguaacaugaugguacuggauaaucucccaaugucugggaacggauaccuucugaguccugggucagaggagaugaaaagugcaguuggaugagcaguaagguugcaguggacuccaaagcacuggacugugcacugagcugugaguugugugcacagaaugaaacaaucuuuauccuuauucugagaugcacugugugaugucgauggagcugcugcacauuaggaagaagccauccugccauguauuuauuugcuuuugcgauagggucuuggcagcuuaggcugaucuagagcucacuauguggcccaggcuaaccucaaaugcauacucuacuugccucugcuucccaagugcugagauuauaggcauacaucaucaugccuugcuauugggauauaaaaguguacccauuuaggcuguucacugacagaaugccaggaauuauuuugguucacagaugcagaagugucaguccauugugguguggaggacauggugaagcagagcagucuacaucauggugacacggcaggaaggaacggggcagggacaguaugccuaccagaaccugcuucaguggaguuaggggucaacaccugaaaaugucagaaccucccaaaauaaugccacuagcugaggaccuacgcuuuaauaugugagauuguguaugugguucauuuuauauuaaagcuauaauacucauguagaguuaggugggagcuugaacugucuccuuuaagugaugacuuccaaaucuaccuguccacccuuagguagcugaauucugugcuuuguugaccuuugacuuagcaugacucaagucauacuuaucuuucucacucuuuccuuuuaucaguuucuucuguguguguaugacugugcaugugcacauacaugugucugugcaugcaugggaaggccagaaguagaugucagugucuccucuugcucucuaccuuauuuauugauuuauuuugagacaaucuuuuacugagccuggagccgacacauuugacaagagcagcuggcuccaggguccucuuguuuccaccauaccuggacugcucuuagaggugugcauugagcuuuguuuauuuuguuuguuuguuguuuguuuuuauaaagcagggcauggaagcacaugccuuuuuuuuuuuuuuuuucuuuccuuuucccacugaguacaccugcugucuucugacacaccagaagagggcaucggacuccauuacagaugguugggagccaccaugugauugcugggacuugaacucaggaccucuagaagaacagucagugcucuuaaccucugagccaccucuccagaccuucaaugagauuuugccaagauuacaggcaugcaucauggcaccuaagguuccgugugaugugagauauguuuuuguauguuuguuugcuugcuuuuuguuucuugaggcaugaguugaggagugaacucaaguccucauugcuuguaugccagggucuuuaccaacagagccaucucaccacccccucccuucuuuacucucuguauuaauuaaugcuauuccuuucuuucaagucacuacagaaaaauaccacuuuuaacuuccuucucuuauuuauuuacccaaauuuauuuauucuaccuuuuuaagauaaaaccuuuucuuucccuuuucauauuuauucacccaaauuuauugauuuuucucuuuuuaagauaaaaagauaacugugucuguguguggguaugaacuuacgugugugaggagagcauuguauuccuuggagcuggaguuagagguaguagugagcugacagacaugggugcuuggaucugaacuugggucuucuagaagaacaguaagagcucuuaaccacuuagccaucuuuccagucccuuuguucugaccuucuaaaaucucuaauauuuagagcuuuuacuucaaaucuaauuuagcacaccccccuucaucuguguggugucuuugaucuucuaguuccuuuuccagucucuguuuuuucucuuagucaauccugacagcgucuucuaagacuaaagugcaguuguguuguuucaaauugaaguucuuuaguaucuuccucuuguaaucaggauuuauguaacugcuauucaugcuuuugccaucccuaccccuacccucacccccacccauuuucuuguuaagcucagucugucuguccuacugguguguucucuucuagcccauaugguuugcuuucuugacuuuaauagacaaagaacuuugucuaguauguugugcccuucuuuugugccaucauacacucuacuuucuuguucagccuggcagagucccauucuuuuaauuucuauuugacaaucacaucuuucucugccuauaugcaaaucuguuuucaggucauacucuguauuguuaacauauaguuauauuuuccauguguggcuuacauuuucuguaacaguuguuguguccuguuuccucuguugugauuuacucauuguguacauacuccguuuacacauuugauuugcuccuaucagcaaauccucucucuuucucuccucucuauccccuccccccccucucucuguguguguguguguguguguguguguguguguguguucccagagccuauuaaaauuacucuuuacuuuuggggcaugcuggcugauuaucauugaauuuagugaguuguaaccauucauuugaacuaaaauuauuauuaagaugaaauccuauuaagacucauguuagacugaucaguaagugcucauuauauaagcagaaaagaguuaacagccaaauuggugauguguaccugaggaaagacagugaguuuguguugauggucaugggcugcaucaucauguagcaaccagugcuuuggagccugggaagccuggugauagauuggcuuugaugcuugggccucaguggauuucucagugcuuggcuucaaaucucaagucuuuuucacguggcugaugcauugcuuguauugagacaguuagacuucuccauuaauaugucugaagcagagggcucacucuuaaggaauggggagucccagugguacgguuuguucuccgauucuuaacauaaucaguauacuagaaaguacaugauuuggcuuaccauaauaguguacagaaaguucuuuguuguucauguaagagugcuauucugugcagauagaguacauccauuugcuacugagaaucaucuuagacugaauugugaauaacucccuuauaauaguuggcaccauuauauccuggcgaccucugaguuugagagguccuucugucauggccuugaaggugaggcauuuucuuuuuagaagaucuuaauuuucugcaggcauguugcauuaaauuguauaagauuucaguuguguuguuucacuguuuucuuuaccaguugcuaguuguccucuagucauuuacuaaaccaauucuugcucuguauuguacauuaguagcaauuuacauaacuuagcuauuuuuaaaauuuuuccuacauucuaugaaauuuuccucuaauauuauuaaaacaagaugccugaaaaaggcuguuucauagauaauuuaaaaauuuuaaggcuguuaaucuuagcaagaaaauaauagacauaaccaagcucaccuguggacauaaacaugauauuaccauagaugaggccaugaaguggacguugcaaggcuuggagucuagaaagaugggagcaggggcugugcuggaaagagaguguuuccugagcacgggcuggcggccccuccuuguugcacucuuaguuuuguagguuccuguagacuugugccugcugggacaaaacucuuuuuccuuccuucuauucuuucuuucuuccuuucaucuguuuauuuuuuugcugcugacaguuucccacugcagucagguagaagcugugauagcaucuuguucgcucaucuugaaggaauugcuuuuguaguuuaggaaugauuauauugagugacaagaguuauauuugccuuuggaaaguaucuuuuauuugguuguuuucucuuuuucugcuuugauaugagguauagccaucauaaauggauauugaauuuuauuuuuuuguucacuucuaauggaugauuugguuuuauuucuuugaucuacuaguggacaaauuuuauugguagaauuuucuaaagcucuuaauauuucagaaugaaauccaguuaugauguguuagccuuuuucuaaugcuuuucucuaaaaugcuaaaaucuaaggaguucaaauuuuauuuuuaaaacuaauuauaaaaauuauguaaauugucaguucccacauguugcuuucaaauguacuucacuugugguugagcaauugaaucuagcauuuagcuaauaaaguaaaauguugggagcuauuauuacuauauuacaugacaauauuauuacagcuagauguucuguaccacaugaguuuuaacauggguuugaggaugaauuuggcaaguugcuugcuuuaaagaauuguuauagauagcccuuugacuaucucagcacuuuggcuaggacuuggaacuuuuuugcuuuauuucuuuuugagccuauguuaccugccuguugugguaagcuuuccaugacagauuugaacagaaaccaaaaucucugaacauaauaguuuuuuuuuuugucuuauuagaaaagauauuuaaucacacuucccagccucuagucucucguggguuaggugcaucuucucucccagaggccagaccagacagcccucugcuguggaugugucaggggcugguccaaugacuagcuaguguaugcugccugguugguggcucagugucugagagaucucagggguccguguuaguugagacugcugcuagucuuccuauggggucaccguccucuucaguuucuuccagccuuucccuaauucaaucacagggguccccgacuucaguccagugauugaaucugugucuuucucagcugcuuguugggucucucagaggacaaccaugcuaggcucccaucuguaagcaaacagugggauuguuguauauucuugggccagggaguggcacuauuguguggccuuguuggaauaggugugucacuguaggugugggcuuuaagacccuaguccuaacugccuggaagucagucuucuagcagccuucagaugaagauauagaacucuuaucuccugcaacaugccugccuagaugcugccaugcucguaccuugaugauaauggacugaaccucugaaccuguaagccagccccaauuaaacgucguccuuauaagagucauugcuuugguggaacauuaggaacuaaccaguaccccggagcucuugacucuagcugcauauguaucaaaagauggccuagucggccaucacuggaaagagaggcccauugaacacgcaaacuuuauaugccccaguacaggggaacgccagggccaaaaagggggaguggguggguaggggaguggggguggguggguaugggggacuguugguauagcauuggaaauguaaaugagcuaaauaccuaauaaaaaugggaaaaaaaaaagagucauugccuuggucauggugucucuucacagcuguaaaacccuaauuaagacagucaguaauaguguuaggccuuggagcuuccccuugagauagauccgaaguugggacagucaguagaccuccuuucccucagucucuucuccauuuuuguuccugcaguucuuuuagacaggaacaauuuugggucagaguuuuugacuguggaauggcaaccccaucccuccacuugauguccucccucccucccucccucccucccucccucccucccucccucccucccucccucccuucuuucuucuucuucuucuucuucuucuucuucuucuucuucuucuucuucuucuucuucuucuucuucuucuuuuuuuaaaauaaggaacauuuaauuggggcuggcuuacagguucagugauuuagucuguuaucaucaggaugcucucccuuucuacuggagguggacucuccccacuguugggcauuucaucuaagguccgucccuuugaguccugagaaucucucaugucacaggucucugguacauucuagagugucuaccaacuucucacccccuagguugcacauuuccauucauucugcuggccaucagggcuucucuccugucccuccaccccccacccccaguacuugcucauguucccuuuuccccuccuccuccccucucccacccaggucccuuccucucucuuccuccugugauugcuuucuucucccaugugggauugaaguauccucacuugggcccuuuggcuuguuaaccuucuugaguucuguggauuguaccguagguuuucuguacuuuuuuggcuaauauccacauauuagugaguacauaccaugcaucuccuuuugggucugaguuaccucacucaggaugauauucucuaguuccaucaguuugccugcaaaacucaugauguccucacucuuaauagcugaauagaauuccauuguguaaaugaaccacauuuucuguauccauucuuccauuguggaacaucuggguuguuucuagcuucuggcuaucauagauaaggcugcuaugaacauggugaaacaugugccccuguggcaugguggggcaucuuuuguguauaugcccaagagugguauaguugggucuucagguagaacuaucuccaauuuucugaggaaccuccagauuaauuccagagugguuguaccaguuugcaaucccaucagcaauggaggaguguuccucuuucuccacauccuugccaauacgugcugucaccugaguuauugaucuuagccauucugauugguaaaagguggaaucgcaggugcacauaguuuugauuugcauuucccugaugacuaaggacuuuaaacauuucuuuaagugcuucccagccauuccucuauugugaauucucuguuuaguucuauaccccauuuuuuugauugaguuguuugguuuuuuuggagguuaguuucuugaguucuuuauauauuuggauauuagcccucuaucagaugugggguuagugaagauuuuuucccaaucuguagguugcuaauuugucuuauugacuauguccuuugcuuuauaguuucaugagguucucauuuaucaauucuugaucuuagagccugagccauugguguucuguuuaggaaauucuucuacgugugcuuccccaccccccaacucugugccagugaguuugagacucuuucccacuuucucuucuaugagauucaguguaucugguuuuauguugagguccuugauucacuuggacuugagcuuugugcacggugacaaauauggaucuauuuucauuuuucuacauauugacugccaguuagaccagcaccauuuauugaagaugcuuucuuuuuuccauuguauauuuuuggcuuccuugucaaagaucaaguuagcuagagcaauaagacaacaaaaggagauggaggggauacaaauuggcaaagaagaagucaaggugucacuauuugcagaugauaugacaguauacauaagcgacccuuaaaauucuaccagagaacuucuauagcugauaaacaacuucagcaaaguggauggauauagaauuaacucaacucaguaaccuuccuuuuuacaaaugacaaaugggcugagaaagaaaauagggaaacaacacccuucacaauagucacaaauaauuuaaaauaucuuggggguaacucuaaacaagugaaagaucuauaugacaagaacuucaagucucucaagaaagaaaaugaagaagaccuuagaaauuggagagaggucccaugcucauggauuguuaggauuaacauaguaaaaauggacguccuaccaaaagcaaucuacagauucaacacugucuccaucaaaacuucaacacaauucuucaaagacauggaaagagcaauucucaauuucauauggaaaaacagaaaaccuaggauaucgaaaacaguucuuaauaauaaaagaacuucugggggaaucaccaucccugaccucaagcuguacuacagagcaauagugauaaacacugcaugguauugguaccgagacagacacauuggucaauggaauagaauugaagacccagaaauaacuuauggauacuuuugccuuuaaagauguaggccuugucuuagaauaauuugaugccuuuuaaauuuucacugucuuuuccagaauuuguugcuuucuuccucuuuagagaagcugaaaagguauaagagugcaggucccaaaggacagugacaauguagccuagucauuacuuagcucuguauauggcuauguguggggaauguggaguaaugagaaggguagggcaugaagggaugaaggaaccacuucagaacuuuacugacucucagccaaggggucucucaucucuuccaguaaucaugugugcuuggcagaggccuucugucauacugagaaaaggaggcucagagaggugauauguguuuauugucacccugcuaaugaagaugccacaggccucacugauugcagagucaaagagauguccuugguuaguguguucugucuugcuaaaagggcucugaagacuaaagugauaaggagauugucacgaaguaaguuuuagaaauguguuagacauuucuuucacaaagcucaggcccuguaaaauggucuugauucguugagaagcuuugaaaagacagaugggauauauucuguaucccaugccauccacuucagcgcugacucuagauuacuguauaauuugcacuaaucagccuguuugcagagguuugggggugggggggacgaugcuuuacaguuaugccuguaagccuuugcaaacaccguguuagccccugguuuccuucuucagacucuaguacuugucaggaagacagaaacugcccuugaaagaaccauuaagcccuuugcuuuucugaaccuauguguaugccugugcuugcauagaguaaguuggggagacuuaacugaaaguggcagaacaccuaagugggaggaacuccacagagucugaaaucuggggcagguaguugagggcuccagcaggaucucccuuuuucuucucucuuugguccaugguggcaguuuguucucaugcugauugucucaugguuguagcuguuugaagagaaggaugaauaguugggucaguuuggacuuagcagccaaauggcagguuuuuucuuuuucaguuguccauuucuuaauccacagagaaaaauauuuccugguagacccccuuuuucuuauuuaugaaauuaggauuaugugggcaggugggaaagauuuggguggcguggguggauuaugauguauaacauugggcaggcacaauucucuguuauuuuugguaagguagcauuguucuucuugcgcgcgugcgaugaauugaaaucugaaacacuugugcucucaauuauuuagaauaagaaacacuguauucaccacuaacuaaauuagaacuuuuauuuuuaaaaaaagcugaagagaguuuuaauuagucuuccucaguugggaauuguugcauuauuaaaucuuggccauuuguagaguacuuucagcaguauaugcuguacuaaauaaaugaaaguuuccaccucuaauuucccuuggucucuuucuuuccuugguccuggguucauguugucuccucucugcuguugaccaccacugacugacuugcucugccuucucgcugcccucuuguucuccuugccucauccuugcccucuuuccauggaucccuucaaguuacugguuguaguuccucaggucucuguuguggaauuagaacuucuuuguaggcuuccucucucauuguaaaauauuaacucagcaucuagaauacauuuuucuucuauauauucuguucuuugagcagaugacuuucugcuaccgauaauuuuuaccuuuuaaugugggggacuagaaaacaagccuuagaguuuaguaggagaauuuuaagguguuaaguacuacucugaccuuuuuuuuuuaauuuauuuuuauuucccagggaagaagaagagcgucugagaaauaagauuagagcugaccaugagaaagcccuggaagaagcaaaagaaaaauuaagaaagucaagagaggaaauccgugcagaaauucagacagagaaaaacaaaguagcccaagcaaugaagacaaaagagaccaggguacugccgccugucccugucccacaacguguaggggucagugguggggauccagaagacauggagaucaagaagaaaagagacaaaauuaaagagguaauaagcugagguuggugauccagagacaugcaguuuuguggcugacuggacacugugguguuguguguacauccguucauuccucagugugacuguaaggauuggagggcucucuuuuucuuuauugaucauaauauaaguuuuugaaauuggcucaaguuuguuuagaugguuagauggcuucaccaugcuagagaucuuuugaagccaggguuuuauaaaggaguaagaucuguguauaaguuuauugaauaagcaauuuaaaauauucaguuugaauggauuauaccagaugcugugcagagccuuucauaaaugagauuuuaagcaauucaugcuguuugagccauguuuuaaggaacuguacugcuauuaggaccauguuccuuccaaagauucuucauggauuaaaugauagaaaaugguugaucucaaaggucuuuaaauuuauuuagccccagaagucuuucaaggaauuucuaggaauuacagauuaagaggauaccaacucuagugaauugaguuaaacuguguuaauugggguucuugauaauguugaguagaguuuauaguuacugcuugugaagcagcuucgucagguguaacagcaucaacaagaauacauucaauguauacagucacauaucucuauauagucugggauggauauguuuuuaauguauuuuaaagucugucaguuuuucucacugccaugacauuuuugacagaagcuacaaaaggaagggacggggaaggaaggaggagaaggaaggaaggggagggaggguaggugggcgggcuauuuuuggcucaguuagacauuguugcgccagggaaggugagauggcuaguuauguugcaucugcaguaagggagcaagagagcagugaauccuguacucagcuggcuucuacccuuuccuuuccucccuuucgcccccaguuucaaccgaaugggaaggauggaaccucccacuuucaggguuggucuccccucagugaagccuccuguaaacauccuuauugacauagccagggcuguuucuugagugguuccuuauccugcucaguugauguuccauccugauggccaucacccuuggccuugguguuggaagccuugcccuugaugagugaagauggguggacauguuaauuuuugccugucacuguggucuguuuuacacaauggcugcuuaguauacuugucuugggagcauacuuuuuuuugacagcuuuuuguucagauaccuucauuauccauuuucagaugucauuauaauguuuugagauauuuucuuacauauguaauaauuuggauugauaaucacaugcauuuaagggaguuuaaggcucaggcucgguaguuugccagacuccauagagguuagcuuagcaaugcauuggggcacagcuugucccauuccuuuaccaggcuugcuuugacuuacuguuucuagugacuuuuuguacauaacuucagauuuuccuucuacauaauuauccuuuuugaauagugguacuuuuccuuuuucuuuauuucuguuucuuagccuacugcacaggcuagaccuucugcuaacuauuuuuugaaagaaauggugagaaucagcagacugaguuaggugcuuacucuagagcacaagugcuuaauauucaacugguaggcaugcugggucaguucagguuucuucaggguagccucuuagugugaggauauugcuuuguaauuacaguuuaaagguuuuuuaaaaaauuuuaucaugaauguauauugaauuuugugaaaugcuuugucuauauuuuucuaaaaaaaucagauauuugucugauuuuuuaaaaacuuuuuuguuaauaugguaaauuuuauuuacuuuuuaaaaaaaugauaaacucaccuuauaugucuggguacaugaaaucauguuaacauauuuucuuuauacagcaauauuuguuuuagaagaaaauuugucuguauuugucuggaguuuucuuauaauguuuuugccuaauuuugguauuugauuacauaaagcacguuuugaagugguuuaaugaaugguauguuguuaaaugauacaccacaguuuacuguuacaguaaauguuguuguguagcucacaacuacauagguuguaagacacugaacugaugcuggcugguacagaguauuuauuaguuuaauggcuucaaauaagggcauuaggcauggcugauucuaagucuguaauaaugcauuuguauuugucucuuuucuuucauuacuugguuuuucuuugaugcgagagaguuagccguuaucaggauuaaauuauauaaaccugugagauccuaaauaagauaaucuucugcuuccuacuguuagacuaauaugaauacaaaggacuugauuauccuacuugauccauauacccauccagucacuaugacugagagcaagguuuggcagcucaccacaugugggcuaaagcuuuucauuugccuguuuuugaaaaaccaauuuuaguuggaauacagacauggccauuugguuacauauuaccuaggacugcuuuuguaacgcuuuaaaccuucugaucucuguucuaaagguaagagauuguagaaucaggcuggauuaguuggugguggaagcaagacccccugauugacaacccagucauuaucacagugaagaaagagggacuguuuccccaaguauuagcacuuuaugaaagaaaggaaugccagauaacuaccucucuuucucuaaauagcuuucugauuacaucuaauguuuuguuguguaaguugaaauuaaguauaguugcuuuucuuaggguuuccguuccugcaaugaaacaccaugaucagaaagcaaguuggagaggaaaggguuuauuuggcuuauacuuccaugucgcucuucaucaucgaaggaagucaggacagaaacucaaacauggcaggaaccuggagucaggagcugaugcacaggucauggagggaugcuguuuacuggcuugcuccuaaauggcuugcucagccugcuuucuuacagaacccaggaccaucauuccgggaaugguaccacccaccaugggcuggacucuuucucaucaguuacuaguuaugaaacugccuuacagcuguggaggcauuuucucauuugagguuccuucccuucagauaauucuagcuugugucaaguugacaucagaguagccagcacaguagguauguguguuuuuauacugaaacauguuaauugaguaauaugcuaguguaugaaacauugcagaauggguaaaaauauaauaucccaacucuaaauuauaugaggaauaaagcaguuuguggauagcuucaaaugguguauuacaauuuuucucuucucagaugaugaaacaugccugggauaauuacagaacauacggauggggacauaaugaacuaaggccuauugcaaggaaaggccauuccacuaacauauucgguaagguaacuucuuugaauuacuucccacccccaccuccuaucuuuuaaaacaaaaucuggcuuuuaaaaguacucuccaaggucucugauucugugcaguuauaauaugaacuuuuuguuuuugugugucaagauuuaguucuaguugcacugaaauacauagcuuuguguuagauacucuauuuacacauagguacuucauaucuuuaucuaaguauuuugaaggucuuuuucccccugcauuuucuuuuguuuaaugucaugaaaaguagauaucuguuugcaauuuuuccccuuuaagacgguaaaguacuacuauuaauacucauaaaggaaaaggaagcaguguagagguuccagugugcuaugagauauauuauuucccucccuucuucccccccccccccccggguaaaaacaaaugucuuaaaaaaauaaguuguccuccuggguggugguggugcaugccuuuaaucccagcacuugggaggcagaaaagcagacagguuuccaacuucaaggccagccugguccacagaguaaguuccaggacagccauggcuacaaggagaagcuugucucaaaaaacaaaaacaaacaaaaagaauuguucuaaauuuaggaguuguguugggaacagaaaaacauuuuguagcuaaucagugguuaccauauuuuuucauaauauauuucauuuagcugguaucuuuuaaugaaauagaguauauuuucucugcaaaaauguuacagauaaaaaaguuccuguugcuuuuguagaugucacaaaugauggucuacuuaaagacauagacuuauauuuuauauuauacuuaaauuaucuuucagagacugucccugagcagugauaaccaaugagccuuaguauuaaaggauuugaggauaaacauguauagaaaauaagaggcagauguggauuuucuucauuaaauaagaaagguuguguguguguauguauguguguguguguguguguguguguguguguguguguguguguguguguguagaaacaucucccucacuccuucccaggacggaggucaguucuggucuucuauuauggcguuccagaacucagacgcagguugcuaggcuuguucaggaaguguuuuuaccugcugagccuugccccaagcccucaguuuucccuuuacccaguuucucauuuguuaccccagauuuuauuaugacuuuguagaguuaaaacuguagaccagacagacaaaccagcagacaaagcaacagacaaaacccaagacaguuuucuccaauccaucuccugucacugucaguugagugggcaggcacugaacuuacacucacaguguuacagguugcagggaguuaaccuaaaccaugucuuucccuaagcuuuuauuguaaaugguucucuccugugguaacugaaaucagugcauccugccuugacuaguuaauccuugccaccaaagcacuuugcagaugacagaaaacccaucucaaaaugacuugaaccaguccagucaucucagcggaguccugguguagaguugauucagcucaggcucccccuccccuucuccuauaugcuggcuucuuaggaggagaggcucagcauuugggguuucaugucuuuauacuguguacuguauuuguagaaucagggaaguguuuggauuucuuagaaauaagauugaaagaauuuuagauucuuguuuucucuaacugaugggccguagucaugugucuuacccucucugggcccacugcuacagaggaccaagaguagaagagacugcugcuggcuauagcuuagcacagguccuagcuacccagacaugguuaauagaaugaauccuuugauuuucugagacaaauuuuugcuugcuuauguugcucuauaacuuaauaucuuccuaccucagcuucccaagugcuagacuuacagguuuguaccaccaugauugacugacauggaugcuuuuuuuaucuuuuuuguuuugagacaagcuuuuucuguguguauauuuugcugucuagaacucacucuguagaucagacuggccucaaacucacagagaucugccugccucugucucuggagugcugggaucaaaggcaugcaccaccaccuccuggcugcauggaugcuuuuuauuugauauucuggagauuuuuuuguggaguuauauuaaaggacuuuuugcauuuuaaaaagagggauuuugauuuagcaaaguuugacuuugcaaugcuuuuaaaaagcuacuuuugacuuuguacauauauguauauauguacauauagaaguauuuuuucacuuuugauuuaacuagggcuugauaggcuaauauuuuguuauuuuugcuuucauguuuaugagguauauucuguagauuguuuccuuccucccucccucauuccuucuuaccuucuucccucccucucauccauccauccauuuauccauucauucauucauuuuugagaaagggucuuacuauauaccugggugugagacuucggcuccugagugcugggauuuaaaagguguccacuacaggggcuggagagauggcucagcaguuaagaguacugacugcucuuucagaggucuucaguucaauucccagcaaccacauggugguucacaaccauuuguaaugggaucugauguccuguccuggugugucugaagacaacuacaguguacucauauacauaaaauaaguaaauacuucuuuaaaaaagaaaaaagugugcacccaugacacccagauguauauuuuucuugaacuguguuuuugcuuugguuuggcagcaggcuguugcuacuuucaaaauuaguuauguagcacuuuguacagaguagaacugucagucuuaacauuguagaaugugugguaauuuuauagugaguggcuuuuugaauauuuucucacacauauagucagaucgcugucccacuaaucuaagauuuugaaguuuauugugaaaauaaaguaagacuuuuggaauuuuaucuuguugcuuuuuuauuuccuauuuugauguuuuguuuguuucuuuccuucugaaaaacuagguuaggaauagauguuuuauaugauuguuuuuauagaaccaucuuucaaauuaguucuuucgauacucuucuuuguuucuaauauauuucugccuuuagcuuugguaguuggacucuguuguucaugguugcugguccuuuuccuucucaguaguguugagaguucauuuauuuucguuuguuuucauuaaguaguaaaaauuuaaaguuauuauuuuuucagaaccuuuugacaaucccauaaauuaaaaaauuguuauauaccacucccuccccacccuuuugagacaguauuucucuggguagcccugguuguuguagaacuugucgaucaggcuguccucaaacucagagauuccccugccucuaccuccugagugcugggugagauuaaaacgugcaccaccacgcuuggcuguguuacacaucugcacugucauuuuucuguuaguuuacacauaggugauuccaguuauuuugcguuuuuuccaggugaaaccuuauguuaucuagcaaacaaugguuucauuuucacucagguauuccuuagcucuucauuuauggcacagaccuacucuguguaaguaacucggauggugcgggcagaguauguaugcaaugcgcagcguagacaaggaguugacuaguaacuagcaacauagcugcugcagcacaggauggacagcagugcuggcaggccuuaaaggaaggaguccaguaagucuaaagagcauacuaacaguuaucuuuuagauggauucaaacaaguauaugagagaaaagcuuuuaucauaguaaaaaagcugaggaucaacaaaaguaaaugaaaauguguguguaauaacuccaaaugggcauucggaugauacuggcaugaacugaguuuggagaaaaccaaaucauguuaucaggguguuguauacuuguuuaauuaauagaaagauagauuauugaugaggugaaggaauuauuagggacauuugaacaaaaagguaugugacuuaaggacaaagaucaaaagauauuugugccuauagcuuuaggccauugagggggaaauuaguuuuacccacacccccaagagagagaaaaaggaagaaagagaagaaaauccaguaagcuguccugccuucuucuccugugugcagggcugaucugaguacccauuggguugcuucgcuuaguuaauuccucgugaccugcuuuccgaaacuaaagacuaagauugucuguuagaugugguggcaucuuguauuuugauuuuucucucuauauuuuacuucaucauuucuuuuucuucuaucuguuauuuucuuuuuuaauuaaagaguauuaacauaguuggguaugguggugcaugcuuuuaaucucagcacuugagaggcagaggaagguggaucucugaguuugaggccagccuggucuacaaaaugaguuccaggauagccagggcuacaaagagaaacccugucuugacaaaccaaaccaaaccaagccaaaaaaaguaauaaaauuuauuauaauuauuuagucuuacgaaauuuuuaaaagauuuauuuuauuuauauaagucuuaugaacuucuuauacauauauguccccccuuuuacggguuuaaaccagaaagacauggcuuauguugucuuacucugucauuuugaauaguccccuuuucuugaaucauuacccuccucuuacauuuuucauacuuuaguuaaguauauacucauauucugaccaagacagaaaaacaaggagacuauacuguuaguuuucacuuaauuuuguauuugcucccccaaucuuaucuuuuguaaacucuaucaaacuguuucuaccuaauagaaaaguaagcaaugacauuacuuaaaaguaaucuuugauuuacucuuaauauguacaaauuaaaaauagaacuuagaugaaggggauuuuuucaguuuaaaaaaauuauuuuauuuauuuacauuucaaauguugcccuccuucccagucuccccuuugcagcccccccccauuccguuccccccucccuuuugccucuaugagggugcucucccaccuacccacccacuuguaccucaccccuucuagcaucccuucucuggggcaacaagccuccauaggaccaagugccuccccucccauugaugccagauaaggccauccucugcuacaugugaagggggagccauggacccacccauuacucuuugguuggugguugagucccugggagcucugagggauccauuuaguagauauuguuguucuucuuuugggguugccgucccugaaggggauguuuuuaacaacagcuguuucuuccuccuaaauauaggaagcucacagaugggugccaccauaguggaugcuuuggauacccuuuauaucauggggcuucaugaugaauucauggaugggcaaagauggauugaagaaaaccuugauuucagugugguguguauaccuuggcaauuuaucuaaucccuuaacuauaaaaggacaguuuaaugcucugaucugggauauuuguauccucuuaaauucauauuaaucacucauguguuggaacuggaaagguucuuuggguagugaugaguucaucaggacagagcuauuauggauauaaguaguuccuuauaauguaguucucagagaacuacuuugcuucauacgugcgaggucauguaaguaccauugugaaucaguugaguggcgcuuaccaguuacggaaucugcuggugcuguugauccuggacuuuccagauuccaggaaggugagaagaacauuucuauuaguuaucaacugcauauggugaaugcuguccuguuaaaguagaucucaugggugaagauagcaguuguggugcugugaacauggucucagcaguuuguugaacuguguuaagucuucauucuucuuuuggaauuaucauuuguuuuguuacuuuuaucaucuuuucucacugucuucauauuucuugcaauuauuuaaagccaguuaaggacauaauagcugagggagaagcaaugaacuagucuaacuaauuaacugcuuuacauuauaaugcuuaguuuauaacauuuauaauagugauagaauaauagaguauaccuauuauuauuaucauuaucauuaucauuauuaucaucccuaacuauuggagaguuucuuauuaaugugauguuucugagaaauaguccaggaagcugugcacaugugacuggaaggcaggcagucugacuuucugugguguaggagggacaugccucacuucuacaaaucuccagggcuccuuugaccucauucauaaugucgcagccagugugaccaucuggguagcuggauguccauagcagugcugcauguggagauguggaggccagugcuugauguuagugaagucuuccuugcuggcugauugcuuuccaucucaucugucacucagggucucucaccugaacccaguuuaccuguuggcuagucuagcuagcaagcuuucucuggggaucccucuccccagcucugccuguuugcugggauuauguggaggacucccauucauguuuggcauuuauggaagugcuagagauuggagcuccagcccaggugcuuucaugggagaugcuuuaccuucugagccacugacugguccuagaaaugcccuaaugucuaagccuaaauauaagcaucuaggugcucuauuuagaauguuuucucuauuccccggguaucagauccucugggcauggacuuauagauaguuguaaguugacauaugggugcugggaauugaacccaguuccuuuggaagauuagucaguguucuuaaccacuaacuagcucuccagccucugcuuaguucuuuuuaaaggguguuaucuauugguauucauuauaaaaacuuuuuacuauauuuauguauguaugcaugccucaaugugauaaaauaauagaguggagagugucuuuccuuccaccuugaaauuguacaaaauaguuuguguauuacauauguaaauuuuugugauaaauuugcuucaguuuguuugccuucuaguuuuguuuaugaucuuuucuuguagauaauuuacauuuuagagaaauuucaaauucauaauugauauauuacaaaaauuuuuacuuuauucuuacacauuaugugcuuucuuaaguuugcuuguugucaaauuuucuucuacuucuguauuuauuuuucuuuuaaaauuuuuauauauccauucuucauuuugauauauaugugcugugaaugucaacacugguuucugacauaggaguggguuuucaacaguguuaauuuauuaacaauaauucuacuggucuuuggcaucuccuuuaauaauuauuagguuauuagguacuagcaaaguacuaaaaauucuugagaagagauagaaauagaguuuaugcuauaauaauuaaaauaaaugcaauagaaucauuagaggagguuuuuuuauuuuuauuuuuuggauuugagauucauuauuaaggaaguguggaggccuucacaaggaaccaacaauagucagugguagugaauccuaggauaauuucacaggauuguguaggguacaucaaauggcccauugauuuuggcaguuaggaagcuguggugcuaacaauagaggaacuugcgugagcuaacaaauggaagucaggauuugugacaugagaaauggaagugcagaguauuaaagcaaaacacacuguagaugagaaaccagugagcuucuaaaaaaguaaaaacuuugaaaacugugaaguacuacauguauguguguauuuucacuuugucuccacagaauucagaagugucugucuuugaaguuaacauucgcuuuauuggagggcuccucgcugcauauuaccugucaggagaggaagugaguagagucaaguaauacuuuguugguuuguuugauuagaagagauaugaaugguguaaaagaaaauguuuuuguaauuugacuacaacugaacuaaagauuuuauuuucucuuaauauaaauuuuagaauuuacuuacugguuuuuacaaaauuaaaguuuuaguuggguuuuaugagcuuagagaguuggcagauaaauaguuuuggcucuuuugauuuaugaacauuuuguuuuuauuuuagaauuuuauuuagguuuuugaaaaaaauccucauguguaggagucuuauguccguauguauuucuauacaccauguaccugccuggugccuguggaggcuagaagagggcauuggauccccuggagcugggcaaagagcaggcaguugugaguuuccaugugggugcugggaauugaacccaaguccucucuaagaggagccagugcccuuaaccacugagccauuucuccagcuccuaguuuuuuuucuuuuuuuuuuuaaggguuuuaucuauugguauuucuuauaaaacauuuuuauuauuauacauuaaguuuguuaaauuuaacucuaugaguauggaggucauaggccaugugcagagucuguucuagauuuuucuagcuucacuaauucuggaagcucuaaauagaauagauucuuagggauguucuuugugaagaacaauauuauuaguaaaaagaauugacuuauuuuucucuguagagaagagcauuuuucuuaccuuaaugcauuucuaagauaucuuuuauaaaguuuaauaggauuugucagaguagucaucccugccuggcucuugaucuuagggggaaagcauuuaguuuuauacuauuaacaaaauguuagcuauauuauuauuauuauuauuauuauuauuauuauuauuauagauacccuuuaucaucuugaagauauugucucacacuucuaaguuugcugggcuuuccccauuaggaguggguguuuuauuaucaaauuauuuuggcauguaguaggaugauuguguuuuucaguuuuuaaaccacauuuaugucuuuuauuuuauugauuuguugauugauugauggggugugcauauauauucauguguagagguuagaggacagcuuggaggaggucuguucuucccuucugcccuguggguccuggggauuggagucagguaaucgcccuaguggcaaacauuuucauucucuguguacauguggaagccugaaguuaguguugaguguugucuugcuugcucucacuagagaccagaaguuagagauuugacuaguuuagugagccagcuugccccagggaauccuguauauacauugguauuauagguaggcugucaugccuacucugcuuuuuuaguagauucugagaguccaaauuccagcccucacacuuguacgaguguuuuacccccgagccaucucuccagcccucaucuuuuaauacuuugugucugccaguuuuuguauuuugcauaaguaaugcugguuucuuaaaaucacacucucucuuuuuuuuuacugguaagguuuguguaaacuugauuauuuuccuuaaaagguagaaguuucguaugagguaaccuaagcuuugauuuccccuacugucacauuuuauaacaauauauucaaauuauuugguagcuauaacaugguuacaaaauauaauguguuuuguuuuugcacuuacacagugaugccccaucagucaugcccagguauuggucucauuucaucacugggaaauuggcaguuagugaguagagcagcuuagggagcuggcuuuaaacacugcugcaaggaggaaguuuuggaucaagaagaaaggugaggccucaucuuccuggggaaaaaucuaguucccaaaagcuuucugaagaaggccaccucuugaccugggaaggagaaaaacccagauguccuaguuggauguagguuguaucaggauaggauugaguagcaaaaauuacagacucaauccagaagacugaaaacuucugggaaucuuaggagaacuaagagugugagcuauaaacuccacccuucucuaguucugaguaaaaaccucuuugcaagauuaaaagacuagauccagagcccagcuuugcuccagggcacagagagaaaacacugaauaauaaucccucugccagucaagggggaagcuagaccugcagacccagagaucuguacacccauagugaccaugcucaaacuacuuuugaagcucuguggcaaggucaugguauaaaaugaagcuguaacuaaaauagaguuuuguaagcuuuacuuaauaaaauuuaaaucacuguuucuucuacucuguccuucuccuuuggaacuguucccagucucuuucaagaugaaggacagggcaggaaaaaagaaucaggaaaugcuaagggcagcaaaugaggcuacaguugggauugaucuaacuacccaccuguagguguuuauuuuuuacaacuuacuuuaacaagguuccaaccuucccucuagcccaucacccagcagaggcagugggaacaaaagguuauuaggauacggggaaguaggccuauuuaggccuuguucucagucuagucuacuagcaaacaccaaacaugauucagcaacuguaguucaguccacucagaagacaccacacacacacacacacacacacacacacacacacgaaucagcaagggcaguucaaucuagaagaacucaucugaaucugcagccaguggcaagaagccgcaggaaccucacaagucuuggcaaguuucucucucugaagauaccacaguucaccugcgcuuaguagcgcaguguaaggagaaccaauauaugcgcgucaucagcagagaauagugagguggagcgaggcaaaccaacacuugagcucccacugucuguggggucauauuuauauucuuucuaaacauuaugcauccuuucacguguuugcuauagcaaaacaucuuuucacgugucuguuuuagcaaaaugcccuuucaccugucugccucagcaaaacaucauuauaacuugagucuccaaagaaaccagaaauuucuacuuuacccaugcuuacuuacccuacagaaagaguuccuuccucucccucugcuggacacaugggccuucuagugcaggccaggcagaggaagaaggaagaaagaacacagcauuuucuauucuuccuacucaauccuuugucagcaaagaguaaggaaguugaguagacuguagaagaggacugugggcaugugggcuaguccgagaggaagaggccgagucugguucucugugccagucuuucucugaaggcaugagaaagacagacuagaagcauggcguguguggauauggggaggcacccacagcuccaaggauccaucugaguguugguggggaacuggauggaagaucaugggcuuauguuuguuuuguuuuguuuuguuuuagagaggguuacuagcuaggaaagggaggucuucaccaaagcagugacuaccuuugugauacuuagcugauuguucacaguagucaagauucuguagcuagggccacacuguucuuauacugcuucuggggauuuucuacgugaccauccuuucauuuauacuuuguguacagccaggaggaguguuugcagcagagccugcuuagcuacauuuuucuuuagcauuugacccaguaagaucaagagacaguacagauuagccagaagcaucaacuuguuuucaugggagcuucuagacacaggguaauagacccccauagugccuuguugauuuagacuuaaagugugucucuguguguguccauguuggacucccuggagcuggagucauaggccagcaugaguugcccaauuugagaacugaacaggagucucuugaaagaguaauaugcucuaucucugaagcccuuacugcuguuuuuauacaacugcaaggauauucuguuugucuuacugguuuguaauuucuuuuaaaaauauauuucuaaaauaauuuaaaaaauaugccuacuuuaaaaauauaucuuugugguauuuuauucuuuauaauugacuuacuauuguauuguguauuuaauguauuagagacuauauccauggcacauuguaugagacaauuuaguuaugagcuauacaccagcccucucgcccccuuuaaauugauuuguuuugccugcauguaugcauguauguggaucauguaacugcaugccugguaccaaggaggucagaagaugguuuuagaucuucuggagcuggaguuacuaugcuuguaaaucaucauguggguccucagccaggaacaaguacgcuuaacugcugagcugucucuucagauucauacuccagccccuuuacaaaauuugagacaagucucacagaguugcuaaggucacuaacguuuccaucuuuugcuuucaccuucugaguaacuguacuacagguguguucugucaucuagcagagcuuaagggauucuguugguggccguuuuugaagauggugauucuugguucuuuuauauaaaaaugggaggaagaacauaggaacauuugaagacuuugaaguuagagguuguuauuuaucuggaaguacuguuuuaugugugaguguuugauauacuugauuaauuuucauaucaguaaugagaaccaaaauuaauuugagaagauuuaguagagggaagcuucaaacuuaauucuuccauguuagauucucugcagaaaaguugaagcaaacauugaaauuuugguugcugaugucauggacaaaaccaaauaguuaaggaaauacgcguugcuaccauaguucuaccauuguaugugugagccucgaacuguaaagaaggaacaggggagggagcacguacgggcuggaauccagagcuuugcuuucuuagcuugcaugccuccgccuccccguccccgacagugguaucuaugaagcucuuuaccuguuguacuguaaguuuccucguguauaaaagcuggcuugagagugggccgacuuggugugggcaagcaccuguguggugcugaggacacagaugcugccucuguggagagguagagcucagaagguugauuuuccuuugucaaugcuuuuggagguuuuagagcaucuuagcguggagggcauggcaguguagaaaaggaagccaggaaaggaauaaggacuaagccaggauaaaguagggcacccaacugcacguguccugugacccauuuccuccuucuagggugacuuucuaccguucaccagugugccagcauaugaaguccacuuacuagaccaggccuuucuccugacucuagaagcacuucacagcugugugggucuuaauauaaucaacuugguaacauuaaccagaaguuugugaggguagugaagauuuuuacuuaguugaaaauaaauaacacaaauucuuaagauauguucucucagggguaaagacaugcauuuuuccugacuuucuuauucaguagacuuacauuaauauaugugaucauuuugauuugaaaguccucaccagaccuguuacuguggcuucaacauugaaucugcaucugugauguacuaaaaauaaaugcaucauagaaauaauuuuuauuuggcauuaucugaugcugaacgaguaggaaguaggugccuuucaucugagcugaaguugacuaucauuuauaguguaacagagagcuuuuguuguguuagagguguaacuagaauaagcaaugguuuaccugcaucccauuuucuuguguagggagaugcaugaggguuacaugcuguccuaauagcgcuucucuuuccugcugauuuguuaucaucauaaaugugauguguuauuuuucucagaaaaagaguuuucuauuaacuauucacaaguuaagaacuuuugaugguuuaugaugcuuacucgauacagaucuauggcauuuccuuaacaagguugucucucuucauaucuuaaaauaguaucaaagugcuuuccuagcuaagaacgcauaacuuauaugggaaaugguaccuggaaccugucagauaacauagagaaauuguuagcuggaguuuaauacacacucauagauaauaaaaacaaaagaaauaacagcaauaaacucugucuuuacugaaacauaaauauacugagucaguuuaggguauuuucuuggacaaaugaauagcuuuuaaaccuaaagcacuguuaaauaaagucaugaauaaaggaaaagaaauguuaaguauucauguuuucugguuuaaauaucaaguuguuuuggaaaaagugaucuugccccagaaauagcugcaauuucuauugaaauuuugacuuuuuuuguucucuacaaauguccuaguaauuggguaaaauauuccacuaaacuuugcugacugaaguaguuugccuuccauugcugugauaagcaccaugaccaaaaguugcucuccaaaaaggagaggguuuaccuccccuuacugcugcucauucauuuagagaggaagucagcagaucaaggcaggaaccuggaggcaggaucugaagcagaggcuguggaggagcacuggcuguuccuucuagguugcucagcuagcuuuguggaaaauucaggccuacuugccccagggguugcagggcccugccacgccaaucauuaauuaagaaaauguuccacaguuuugccuacaagacacucugauggagguauuuucuugauugagguuccuuuauccaagaugaccuuggcuuuuguugacaaaacuagguaguauacugacauaaauaucuuuaaauauauucauuauuuuccucuuuaguguguuaggucacauaugcauuuguacacagucuugucaugugugcuugaaaguuucagugguaauacuaauuuauaguugauuguguuuguggucacuuauuugauugaaaagacaauuucuagcauuuguaacagguagaaauuuugggguaaaauuuaugagaagagagugcucuggaggaaaauccccagaugcuguacacagcucuaccugauuggcuagguccuaagaguaagccuauauugaacaagcaucaagccuccugaugucacucgcucuugaucuugagcaugccucuugcagccgcgacugcuguaaggagcaaugauuggguuuugaguuuaguuauaugcuuuagaagauguaaagcaagcacuucucagaggauaugacaauauuuaaagucucagaguacaauuuacagucaccagguuucaguucagaauugcuaauguaugaggaaacaagggaacacauuacuuccacaugaauguugaccugucuugggcuuacccagauuagucaauaaauguuuuauagaaucuuucacagcuagacucaauugcaugggaaauauucuugaaguuauugcauagaugaaaguuuuaguuaaaacguaaaucuaugaaagagaacauuaaaagucuagaaaagaggaauaugguauccaaaaaauuuacuguuuacaacuguuauugaaaguaauaucacuagacuugaaggugcagcaauauauuauuuagcacaaagaaagauaauaaaaucagaaagaaaaaaaaaacaguaaaugcuucagaaguuugggauaauguuaaaaaaguuugauauacgugugcuuuggguagagauauugaaaaacaacagcuauauuuuuucuauauuugguggaagacuugaaauugaaguuuccuuagcauguaucuuaguuaggguuuauaugaaacacaaugaucaaaaacagcuuggggaggaaaagauuucuuucaucuuagaguuguagucuguugugaagggaagucaaggcaggagccuggaggcacaaauugaagcagaggccauggaggaacgcuuguuuacugguuugccucccauggcuugcucagccugcuuucuuguacaccucaggaccacucacaguaggcugugcccucucacauuagucaguaauuaagaaacccacaacagucuuccuuauagguuagucugauggagacauuuucucaauguuuucacuuaccaaacgacucuggcuaugucagguugacagaaaaucuaacuaggacaucaugacuaagcacacuuagucauaucauagucacacagcuagaaaccagggauuaaaacagaaguuugaaagcacucacaggacagaaugauaccauggaaaacuaugcuuuaaaugauugaagaccaugaagauuauuuuuuaucaaguaccuuuaaaaugauguauuuauuuaaagcaaaaaacccaaaaaaccaagaaaacaaaaacagcccagaauauuccauuacaauguuuaauauauauccucuaugaaauaaugaaauagacuucacaauaaaaauuaccaacagagaugaaggcugcuucaugauaaaggaugaauacaucaggaaaacucaacagucccaaaauuaaaucaguagcuuacucuauucugagcacuuaauaauacagcuucaaaugaaugaaacagaaauggauagaauuaaaagauuucuuuugaauucuugaaguaaaaaggcaauuccacaaggacuguuaaacccuuaaacaguuuugcaaauugauaggacagacagacaauagguaaugauguauacaaguccuuagcaccaguaacagcuauguuaagugaauugauguuuauagaacacucauucaacaacuacagaauacacgucuuuuuaaguacauacuacaugcauaugcuggacaucaaagcaaauuucaauaaaauuguaaaaacguuaacauauuuguucuuaugugguggcucacuauaaucccaguucucuaggaggcuggacugaguccaagucuagccugguuugaggcuuugggaaaaaaaugccuucaggugauacacgcaucaaauaaagaauugcaugggaaagugaaaauguuauaaaguugguacuuggaaaguaugaauaaaauugaguauagcuuuuaagcuaaauauauuaaggaaauaauagaagauagccuaccaagaucaggaauaaguguuaucuccaugguuaggcuuuuguuuuguuuuuguuuuuuaagacaggguuucucugucucgaaacucacucuggaaaacacucuguagaccaggcuggccucgaacucagaaaucugccugccucugccucccaggugcugggauuaaaggcgugcgccaccacugccaggcuggugguuaggcuuucguugcagacaccauagacacucuuaggagcacaaagguucuugggcucacagagagcacuagggaaaccaggaaugcuaaacaugcccgguuaucuuuuucaagggaaaagauguaaccuguuuuucaguagccugcugaucugugcuguguguaaggccaagcugcaaagaacuuccacagggagagccagagcugacuaauaguuuagugaccuucauacuaucuguauggccuguugccuccccgagcuccagcaaccaagaccagagguggcucagagcccacaugaccucugugcucuuuguaugagcacgacuacacuagauccucccuagguccuuaguauaacacguacagccaacuccagaacccaucuucauggaagaagugacauguauuuugagaagaguuucuauguaauuaugcauuguugugcaugggggauuguauuacacuagaaaacccuuuuccaguuguacugcacuuaaauaugccuacaguaaacugccagaagugugaaccaacaccagcuaacaaacuguguuaauugggauuuucuucuugccuccugaggauugucacucagcugacccugaugcuugcugagacucccuaccccuccacacacaaaacauuaaaaauggguuagugguaugugugcccgauguuguuuuucaaagauuuuagguaaaauggacaaguccucuaaaaaauauguccaaauugacuccuccucuuccuuuuccuccucuuucucuucuuucuccuccuucuucucuuccuuucucccucuccucuuuucaccuccuucuauuuuuuacuaguaucuauuaguuguacaaaauaagcgcucucaucaugccaugucuguacacaugacguguauaauguacuuugaucuuacuaacacuuacccugcuauguuucugucuccauucccagugguuuccugcccaccuucccaaugguaguccccuuccuuuuccagauaguccuaaucucgugguuuugagcauugauuccacaugugaaugaaaacaggcuagauuugucauucugagugugccuuauuuagcucaacaugaagacgaucuaguuccauuucccuacagaugacauaauuuuggucauauauauguuguauguguauauguaaacuuaauuauguauauauaucacauauccuugacccauucaucuggugacgggcaggcaggcaggcaggcagauuguauaacuuggcucuucucuuucagaaacucaggaacuucuuuugaugguguuagugauugacucaggagcuccuagaagcuaagaagguguucuguccuguacagggaacacugucccacucuucugaggucauaguggcacugauagccaaaagaacauuaccgauuuguaaacauugugaacauauaaguaaaaauacuggaaaaaaauuaguaaagcuaaaccaguaagaauauggaaaaauuaucggaagcauaaguuggguuuauauucagaaagcaaugcugauuuaaugucaaaacaaaacaguuaacauaauuuuuuauuuuaaguaacaaaaugaagaaaaguaaugagcuauuugcaacaaauucagcaaaaccaaugugacuuugauggcauguauuaauagaaauacagugagauguuaaucacaguuaacacuggacuagcauugcaguuuuaaaguagaagucaaaaccacauuauguuacauacauuuuuuuaagauuccuucaaguuuuugagauacccaguaaugucuucaaucuuuuuuaaaaaaaaauuuguuuucuaauauuauguaaccagaaacacacaucuccuggagguggggguggggggcugugccaagucaaaaagaaacauuuacagcaacucaagagcaucuaucaagacuguauuacuagcuuuuuguuguuaaaauuugaaauaugcuugcauguugaugaagauucuguagcccaguuaucuuuuuuucuauucucugucugucugucugucugucugucucugucucucucugucucucucucucuguguaugugugugugugcaugcuauggaacacaguuugcuuguguguucguguauguguggguuggggggggugcacaugugugcgggugcauguggaggccugagguuuauguugggagucaugcugaauuguucuuccagucaaaaccagagcuugcugauguggcuggucuuguuagggaguccacuuacggauccugcuucaacuugaguuucuggacuuaaggugaacugccaugcccaccagaauuuaugugggguuuuggcaguuugauugccagucuugauucuuucauggcagcugcuuuagcugcugauucauuuucccagccuucucuuagauuuuuggggggcagguaaaaauacagaugaugaccagaacuaugcccuuucuuuguaacuguguguccacugaggcugucacaugcugggaaaccuuccucaguauccacucuaguuccuguguacucuguaguaaggaugaugugugacugcuuaccacacgccuucuuauaacguguacauuguggugugcauacggcaagagguaguaaugcgcaguacuuacuauaauugaugauuauuugugcuuucgucucagauauucaagacuaaagcagugcaguuggcugagaaacuccuuccugccuuuaacacaccuacugggauucccugggcaauggugaaccugaaaagguaaacaguauuuuauuugauuauuuauguuccagaauuguuaacugaauuuugacauuuuuguucauggagauuuccaauuagcuauuccacuaugcuuucaagucuuacuauuuuuuuuucuuuguacguuuagaagaacaucaaagccuuuccuuaguuuuaagcucuguccuuuacuuugagacaggucuucugccugaauuucauuccaguugcuaguaacuugucuccaauucuguuuaguguuguaauguauuaaaaguauuuucccucccccuuuucuucuuacauacuacuuacuguucuaaggcaagauagaaagcaacgugccuagaaucaagacagucuguucuggaaugccaugcuaaggauaaaggaacacacaguucugauguaggaugcucauuauagugucuagguucaaggcugagcaggaagccuucaaaauaauuauucuuuguuaucaauuucauucaaaaacacugauuuuuuuuuaaacuuagaaauggaugaaauacuuuauuuguguuacuuuauguaagucaaaaauuugaauaaucccuaauuuuaauuuucauuuaaaucauuuaugcugauugaaauuuuugcuguucauguuucuuccagguaguacuuauuauuuaucuuaaaaucaccugaaaauaugacuguuggucuccuuauacucagauaccauagaacaaguugagaauggucuuugucuauaggugugaaccuguggcagucuagaucguaugcgcuuguuguaacuauagucugcaagccuuuucuccuugcuucauggccagcugccucacucugcugcaguuuccuuugcugugcuuuagcaucagucugacuccugauaguucuucugcucuucucuuccccuacugccuuagacuugauagaguacaguuuggaacuuaaguucauuauacuguuuuuauuuaccucauuaccuuuauaaaguagcaacugugggcauuccacugacacagcuguuacuucaguauuucagugacacugagagagggcagugacaugucuccaaauguuuauuauauccagaaauuuucuuucauauaagcuuuuuguagcuguaugugcauuugcauguaugcaugcaucugcaugaguauuauggaauaauuuuauggucagagaacagcuugugagaauuuauuuucucccaccaugugaguugcagguaucaaacugagauggucagguuugaugaaaggaacuuaaccacuaagccaucuugccagccuucauuucuuuuuaauuuuuaauaaauucuuuuuuuuaaagauuuguuuuaucugaagaauaaaacuucccuuugaagcaguuguuucgcucuuguuuggccuccauuguuuguaagugaugacuugagcuguucuuguguaucccucgauuuguuuccucucacucugcccuuccuauuugcuguuuuaauaugugaaaaagugcucugauaucauuuuuccgacuuuugauuuccuuccaaagcucaaauucauugcacuuaaaagccauccuacagccccauaguucuuuuucguuugauaauccauuuuccaccuaucuuuauauauuauauuuccuuuuaugucauuucugaauuucuuaggaucucuaaaauuguguauaauauuuauuuuucuaauugaaaauacugauaggauagcauuggaaauguaaaugaguuaaauaccuaauaaaaaauggaaaaaaaaaaaaaaagaaaauacugauaggaaacaugguagaucuuuuaauuauuuaauuuaggaacuaaaagacuucaaauauaacacaguacagccuuuauuuaaccaacuuuuucuuuuccuccauuuuuuauuuuuauguauuuuuaauuggaaauagauuuuuuuucacacaagauauuauuaugguaucuuuucuuccuacuccucccaguuccuccccacaucuccuuccaucuugauccaccccaaauccuuagaaaacaagcuggcaucuaaggaauaauaauaaaguacauuaagauaaaacaaaacaaaacaaauuggaauaggacaaaacaacuaagugagaaaaagauccaaagaaaaaccacaggagacgcacaguugagagacaugcaugaaucucauaaaaacguaagacugaaagccauacuauguaugugaaggaccuauaaggugaaacaaaggaugcccugauguaacuuuaugagagagagcaucuccuaagaucccauugaguuuguuuugucccggccaucuaggcugggcauggggccuaccuucaagugguugguuuucccagggagacucccuuggagaaaacucauuuuuuauuugcaaauggcuaucaauuggagauagagucuugguggaagcauguguccacuuucagcucuaggagcccaucuggugcagccccaugcaggcucugugcaugcugccacagucucugugaguucaucugugugcaguccuguugagucuagaaggccuucacuccaucuccucugcucuuaugcuaucucuguccccucuuccaaagaguucugcccugaggagagggaucugaugagagacguuucuuuugggccugaguguuccucaaucuuucacuuucugcauauugucugucucugggucuauguauuuguuuauaucugcugcagaaaaaaaaaagcuacucuaauaaugguugagcaaggcaugggucuaugaguacagcagagugccauuuggagucauguauugcuauguucauuucgcagagcaguagugcuugguuuucuccuaggccccuggccugucucgucucagauucuugguuacccaaacagaauuggguauggcuuuuaucucaugaaguaggccuuaguucaaauuaaauauuggcugguuaucccacaggguuuagaccacuauugcgcuagcauaucuugucgacagguuaucauuauaugucagagguuuguagcuggguuguugguauuuaccuuucuccucuggugguguucagaguaccuccuguacuguaaacuauaucauggaagcuaguucauagggaggaagacucuagaucagcaccagcuugaccucuccauguucaaugacuuguguagcuguuuccuuucaguuuguggaaagccaucauaucaaccauauccauccagacuauuugccuuuccuagggagaucagucccuccuugcuagucccuuauucucuaccuagccucugugguuauaugaguauuuagcauguuuaucuuugacuuaaauguaauagccacauauaagcaauuacauauacauuugucuuucugggucugaggcaccucgcgcaggauuuuuuuuuuuccccugcauuuaccugugaauuucaugauuucacuuaaaaaaaaccaacaaaacaaaacaaaacaaaacaaaacaaaacaaaaaaacaguugaguuauauuccauaguauaagcguaccguacuuucuuuaccuauugaucuacugaagauccauacagguuguuuccaauuucuggcaauuaugcauagaacaauaaugaacuuggcugaggaggugucucuguaguugaauaaagugucuuuugaguauaugcucaagagugguuauuucugggucuugagguaggugaaugaccaucucuucaggaaccaucacacugauuucccuaugggaaguacaaguuugcagucccccagcaguggaugaguguucccuucacauccucgccagcaagagcucuccucauuuuauugaucuuguccauucugagauggaaucucaguguaguucugauuugcauuuccccgaugacuaaggauauugaacauuuauucaagugcuucucagccauuugaaauuucucuuuugagaauucucuguuuagaucuguaccccauuuuuuuuuaauuguuuuuuuuuucuuggcaucuaguauuuuugaguucuuuauauauuuuggauauuagucauuuauuggguguguaguugguaaaaaucuuuucccauuuguaggcugccacuuuguuugaaugauagcguccuuugccauacagaagcguuucgguuucaggagauuacauuuauuaauuguuaauuuuagugccuuuggcauugguguuccguucagaaguucuuuuccugugacaguaaguccaagacuauuccccacuuucucuuccaugagauuuaguguaucuggccucuuauugaagaggucuggucugugauccauuuuaguuuuaugcaggaugaugagugugggucucuuugcauucuucuccgugcacaugugcagccauuuaguuugaccagcacaaguuguugagaaguuauuuuucaccuuguauuucuggcuuauuuaaaaaaaaaaucagguuucuguguuuagacuuauuucugugucauugaucaauauaucuguuaaaccaaccauuuaacaaguuagaaacaccucauuacaaucaagaacaaggcacuguuuagcauuuuucuggaaguaguaacaaaucuaauaagaaugagaaauaaaaaguaauggauuuuaggcaaaauuauauauauuaugacugccuaauuuaaagauaacuuaaaaugcaauuauuuaaaagcuaauggguaacuaguuaaguuaagguaagaaacaaguuuggauuggaagguaaaugcuggaagagucccacaggaagaagagcucaggcugcuacagaggaggcucagcugucugccucacagacagguucucacugaacaaccugugucagcacagaggcauuccuagccaucacaaggacauuaaacaugucuuaaaggaugaaaaugaaacuucauuauuaauaauagagucuuauuacacagaauucaacugaaaauuaguacauaugguaugaaacaggagaauguuacauagucagaagugaaaucugucaggagagaagcaggcagagaacuagucugaccuccaaggccugggagcagguuuuguaaacauggugaagucucuagagggaaguguaacaaugagaagagugaccuauaaaagggcccagauggagcuccuaaagcuaaauccauaggaagcaaauucaccugacagauuuaacgguuuuuacuauagcuugaagaucugugaauuugaaaguaaagcacuagaaaucaccaaauaaaaucacagaaaaugaaaacuaaaacgcacagguaugaggaagaaacgaucuaguaguuucuugggcaguaucagaugguucagcgcacaugugaggagcaagggguggggccggagccagggagugggaucaaaaacagagacacuggcucaaagaaauaaugucucaaaccuuaccauauuugauaaauucacaguucuugguauuucaugaaacuuggcaagagacacaauuugucagaaaaaucaauuuuuaagaagugccuuguuucuccuccauuuccuuccuuuccccacacugcuccaugaaauuaagacaguuauaggcaauuaaaaagcuuagaaaguuuguuucuaguagucuucuguuccuagaaacagaaaagaaaaaaauuaguguaucaauagaaaagacggaucuauacaaaggaaugcacagugaaauguauuugaguaacuauaaaagugguauuuuucuguuccuuuaauugcuauuuuuuacaguuuuuccuaaguuuuauuuuucucaagaaauuaacuauucaaagcaaaaaaccccaguaacuuguagaguguaaaaaccaugaaaaggaaagcaugaccacagcagcacaagcucugugugcagauguggaguacgggugcugcuaaguguauaugaggcggcaucucaccucagugaccaucauaagcugaaaauagccuacucagcagcauagcugaccagcauaauauauacaguguguauuguucacccuuguggcucuguagcugauugaguacuguagcuugcugccacuauacgugacuacauauccuuagugcaggaaaaggucagaacucagaaaugaaguaugguuuguacgaauucagauucuuuuauacuguccaaaagucaaaagucucaugaauugaacuuucagaaaucauggacugucugugcauggcaguguucucacguuacauguaaagugcuacaagguaauauguacuguauaaauuaaugauacauguuaucaucccuagggcaucauaguuagaaugaauuaauagagacaguacuggcauguuaaaaacuacugcauuguaacaaugauaaaaaauuaacuugacagagaaagaaaacaaagcacugaggaguagacuuauguuaguggaacuugauguaauaucuucacuaagaaaaaauugguugucuuuauaaaauuaaaauagaguuauauaccuuaaaguuauccuuugguuuacauucauacaaaguucauuuauaauuuuauaauaaauuugccaaacugauuuacucaaauguugaucaguaagucaaaucauugucaugcuuguacaguaaacacuguuuagcaaaacaaagaauugagcacuaacucagcaguaaucucaaaugcugugagauauuugaucacacugugaauccugagauuguuauauauuuacugaaaaaaccuguuucuaguuuguggcucagcccuuaguacacaccuuuuaucccaaacaaugaagauaagguuaguuuguagaaaaagacacacccauguuugaaagugacgucuaauugaguggaagacaaagugaugaaucagagaaagauuagauagaauuggguauguccaacucucgggaggucagagaaaagagaggcuacuuaaagagaguagugcagagaaaagaggaggcuguuuuacugggagagguuuucagagacagcaaauauucucucccagcccagagucugucucuugcguugauguuuccuuugcuguacagaagcuuuuacugugauacaaucucauuugucaguucucgguguuauuucugaguuccugcaguccucuuuagaaaguccuugacaauaccuuuaucuugaaauguuuucucuccuuagcaucaacuuuuagaauuucuggauguauaguauaaugucuuuuauucauguuuaauuuauuuuuguucaaaaugaaaaguguaugucuauuuugauuuuucuacauguguuuguccauuuucccagcacuguuuguugaagagguuauacuuuuccucaguguauauuacuguauauauuauuugcaucuuuguaaaaaauaugguucacaauuaauuguauggauuuaguucugaggcuucuugucuagucuguuaacugugucugcuuuguaccuguuggauacuguuuuuauuacuguuguuuugaagggcaauucaaaauucaaaauauucucaguauuguucuuuuugcuuauguuugguuuggauguuugcaaucuucugugccuucaugugaauuucuaguucuguaaaaaagguuacuggaauuuugauggugauuguauuaaauaaggucauuuuugguaaaacagcuauuuuugcacugucaauuuuaccaucccaugagcauggaggauuuuuccauuuuguaguauuuucaguuucuacaguguuguaaaauuaucauugaagcauuuauuuacuuucuguuagguuuacccuaguuuuuucuuuucuuucuuuaaaaaaaaaaaagcauuguguugugguguucuccugacuuucucauacauacauacauauauauauauauauauauauauauauauauauauauauacacacacacacacacacacacauauauauguauguauauauauguacauauacacacuuacauauuuauauaauauauuucauauauuucuaauauuaauauauauuaauauuagaaagcuacugauuuuugcauguuaauuuuauagucagcuauuuugcuaauaacuauguuuguccauuuugagagcuguguaguggagucauuagcucucguguguaauagaucaucuugucugcaaacaggauaauuugacuucuuuuguccuguuuuuaucucauauuucucuaaccaagcugucacacauaggaggagagaaaauagauguccuugucuccugacuuaguggaaaugcuugcuugcuuuguuuaauguaaccuuguuuguugguuuguugcgaauauccuuuacuguuggauucggauaaaugccuuuucuucauugacgugaucauuuugcucauauccuuaagacuauuaauagguugguuuuguugauuugcauauacuuaaguauccuuuuauucuuggaaugaaagccauuuugguuagcaugagguacagucuuagcuacuucuguaccacagacuccaugugcaaacccugaagauacuucucauauuuugcuucaauuaugcuguucucuucuuaaucagagcugauucuucagcuccagcugucuagaaccacuaauacaaaauaguacauuaacagcccugauagacucuucucucaacaacuucacaagucaggccuucauccugugcacugcuuucaacauuaucaccucaguucucuuggcuuguuaagcuuugagcacuauagcccaaaauuccaaaaauuucccacaaucucaucaaaguguggucaggucugucagcaauauccacaaaccugguaccacuuacuguuuuaguuagagucucuacuuuugcgacagcauaucaugaccaagcaauuuggagaagaaagagugaauuuaaaaauaguuuauaguuguaucaaccaacuaucaacaggaaaucagggcaggagcucaaggcaaaaacuugggggcaggaacuggugaagaggccauggaggagggcugcauauuggcuuacuccucaugguuuccucagccuauuuucuuuacaacucaggaccuccugcccaggcauggaaccaccaacaggaaguugggcccucccauaucaauuaucaaucaagaaaaaugucccacagauuugccaacaggccaaucuuuuuuuuuuuuaagauuuauuuauuuauuuuauguaugugaguacauugucacugucuucagccacacaagaagaggguaucagaucccauuacagaugguugugagccaucaugugguugcugggaauugaacucaggaccucuggaagagcagacagugcucuuaaccauugagccaucucuccagccccaacaggccagucuuauggagucauuuucucuguuauauucccucuucucagaugucuagguuugugucaacuugacagaaagcaacuagugcaucuauuuuguuagaauuuaguaaaacaguaucugcuuacauucuaguucccuuuccuuagacuguccuuuucuuucuuucaccuuaggacuugcuugugucuuugcuaguaagguguauuucuuggaggcagcagagagaugaguccugcuguuagauacagucugcuagcaugugucuuggagaaguaguaacaguagcccacagagguguuguggaaaggugugugguguugcagucauuuuguuacguuugcccuguuuguugcucugucugcuguucuagugcagcuuuuuuuccaguggucucauugauauguuuacuuacauuuuaauucaaaaauguuuacuuccuuacuuuuaaaauaacuuuaaaaauuuauuuuuauuuuauguguaaaaauguuuuguguuucugcauguguaccugauguguacuuggugcccacaaggccagaagaagauacugaauuacccagaacugaaauuucaggugguugugagcugccacguggguggugagaaccaaaccugacuccugcugagccaucucgccagccccaauuuaaaaauuuuaauuaaugugucgugaaauaguucugccuaaaacuauugccaaaaugauguuauuuuuaagaaaguuaaggaaacauauauuuaauccacauuugaaauuacuaauauucucucuucauucuugucugaguuugaaaaauauuguaugcauaguuguuuugaagcaaauucugcuuaaaugaaguauauuucuacuuuaaauuuuugcauauuauaauauauauuuuuucaaacuuguauuuucauaauguagguacaucagagugaaauuuggagcuccauaaaugcuuauuucuauugaucagguuucugaguuuaaacuuuuacauugugugagugcuuucauuuauuuaauuucuuggguuaugaggauaaauaugaacaucaguuguuggcaaccuuuguucuuaaaauugcaauucacuagaagcuuuguucuuuaaauacagagaguaaagauuuuguuugggcuucgaagaaaauacaaauuguaggugauccauuaucagacaauucaaaauaauuauaggacccuuaaauugauuacuauuuaaccaucaaaaguuugccaaacauuucuaugucuuauugcugauguuuagcuuagcaaagagagacgucauguuguuucuaauuguuuuguuuauuaguauucacugcacauuuuucuuacucauguauauaugaaagcauuuuaauguuucccuuugaucaguugaaaaauauuaacauuuguaggaaaaauuacgaugguguuaguuugaagcagcuaauuuuuaaaacugaguuagucuuuaguagaguucuuuagaguuuuaaguuagaauauauacaaguuaaauuuuauauuuuagaaugaugccuaugaaauaacaaaaacuugaauggaauuuggucuuuugaaaauuauuugcauauacuuugaaugauguuuuccuuuguugcuuuuaguugguaacuuuuuccaugauaaauuguaaacuguuggacuugccuagguuuuguuuauagaagauaacagaaucauuaguuagcugaaaucuagcugaucucuaaauguuagguuuuaugucuaaaauguauacugccauucuuaauuuuuuuguguccuaucauacuaaaauaaaaauucugaaaauguaccguggucuuauagcauccuugcaugguguggguguuagcuagcucucuaauugcauccucuagcauugacuuucuaaacucagucugucaccuucauuucccuccaggccauugcauuugcugcuuccuuuauugggaauuuucuccuugaaggucuaugcaucagagacuccucugugaucaggacucugaaacacuuugucugaucauaauauagaaagggccuuucuucuguugaguuuucuguccauaguaaucaguauucuauuucuuaacuugauuuucuuuaugguaguuuucaccauuucaguggucuuauuuguuacaagagcaggaauauuauaugucauguuuauugaugucuguccugcagcauagcaaguucuuacuauuugugaauguaaaugucugucuuacauaucacuauauccacauuccuuuuuugauccucucuucuagcuauaaaagaaaagauugagagugguauuugccucugauaauuucaaugagaguaugguauuauguaauaaaggagcuguaaaaguuagugcuauguauguccagauguagacuuuaguguguucuuaaccuagauuauuaaaguauagcauaucaaauugacagcauacaaaaucagaguauaugcaaguauauaagagaaucauuuauuauacagaauucuucccagcuaugaaaaucaacgagaaagcugcuauuguaaacugauauggaaagacuaauaaggcacauuacaagaauacagugccugaucagagcacuuaauacaugucacuugugcuuugccuauaagagggagaaaacaaacaaacauauguauugcuguauauuuaugaaaguucuauauguguaagaagcuaguaaaaagugauugauuauagagcuaagugauauaaagggaugagaauagauaaaauuuauuugaugcuuuuuuuuuuuccuuugguuuuucaagacaggguuucucuguguagcccuggcuguccuggaacucacucuguagaccaggcuggccucgaauucagaaauccgccugccucugccucccaagugcugggauuaaaggcgugugucaccacugcccgauuugaugcuuaauuuuuauguugucuuaauuuuuaaaaccugauuguauuacugauuuaaauuuuaauaaacaaaauuaaaauaaacuauuauauuagauauaauuucuaagaucuauuuaagaugcauguguuucccuuucaauaauccugucucuuucuaucccuuauuacucaguggaguaggucgaaacuggggcugggcgucugcaggcagcagcauccuggcugaguucggcacccugcacauggaguuugugcaccucagcuacuugaccggugacuugacuuacuauaauaagguucgucucuguccucuuucuguuugguauaaaggacuuacaaguuugccaaaagacgucacagguuuucagggcuuugguuuuuauugcuuauuuuccuuuuucgguuauuuugcuuuuuacauuucuuucugcuuagacauauuuaaaguauuuauugagaauuuguaacuacuauuuuuauuuaauucuauuccaguuucuaaucauauuucuaaacucuguagccagcgugcuaagacaagaaaacaaaauuuagaaagguuaauaauugcaaaggaagagaggagguacuguuuguuuacagagcaugugauuauucugcuggauaguuuaagacagucuuaaagguuuuuguggguuuuauuuuuaaaggaagguuggcuuuuucauuuucuuuuuggugaaguggaucuuaguccagggucuugcaaaugcugacuguuggcucuacuacuagacuauacucgaguguuagaacuugacuauuuaaauacaaauaacuacugugaaugcaaaacacagcucuuagcucaaaagaaguaagaaaugcuuauuuuagagcagaauccgagcagucuaugugcccuccccaccccagaacagagucacguuauuauuauuucaacaccauaaucgucucauggaauuuuuauaauaagagaacaaaauaaaauuauaaguaauaacccauguuaaaauauauugguggaaacaucagguguaugaauuacagcaaaguauauuucuuuguaggucuccgaugcuaauucuuaauauucuuagccuuuggauagauagaaaccaggggucuguuaggacaucucaggaagaccuaauagucacaaggcacuggguaacauauagagguagguaaggaguggcaauuaagagggggaaauauacuuuaagauaguuuaguucugaacccaaaauauuccaacagucucuaauuaugguauuuuaacuaauuaauggugguuguaguagcuuuaacauggacaugacuguuuuuuucuucuuaaguucccacuagaaacaaacauuuuaauugcagggguauaaaauauacauguagacuuaaaaucuuuagcaguuugucuauaucaacuguaaaaaguaagaauuauuuuauaagaagauacuucugugguaggaacagaucuuuguguuuaccacacacuuaaaaucuguggaggcaaguucacagugaggccaggguggcagcugguggucaguauuuuuuggacuagaaggaagaaguaugccaagaagcuaggaaaguaugcuugcaacaguccugcaggaaguugcguuugccugccagcuucaguaagggaaggagugacagaugucucugucgcaggcagcucuagguuucuccagucucgguugaccagggagaagcagaggcugggaaccacacuuauauuuguguccaaccucagucuuuuaugucaaaacuuccuugugagcacuggagucaggauaacagauuagagucaguguggucguguagaccuguagugucaacauuccuaagacuaaggcagacaaaucuguuaacggcaggauagacuccauaauaaguuuaagagucuucuccgaccugaaaagggagaaaguggugaugaaaaauucauccaaaaaggguaacuacagaauuuguagagauuuaucagaacaaaaggagggaaagggcccccauggaacaccaggaggaaaaaagaaaaaaaaagaaaauccuguucaaauaacaccauaagaaaaacauugauccuccauagcccaguuuuuguagaaucaaaauauaaacugguccugcaguaagaugugcugaguaccagaguggaagaaaacauuaccaccaaaaagacggccaaaguggaagcaacacagggaaaagcagagcuugcaguaggaaugacuuaagaagacagaacugcaaaaugcuguucuaagagcacacugaggaaggaaauaaugugcugaggaacacagacaguauuauacacaauuucagaugucagaaagccaaguuucucaucuuuccuaaugucauuuagaagcgucuauacguggcguguggaaucauuccauugcagugguacaugaugguggucuuacauaugcgagauucaagcuucuucccaaagcaccaugccaaacccagccauagaaaagaugaugagaauuacugugcuuaaaauuauuagugugcucagcuccagaaggcugaaguacacauguaugcccaugaggaagagcguguucuaagucacuuagagguuccauaggucgucagucaucugugaggacagcauggauacguuaccuacucaagcugagugaucggauuuuaguaagaauaacuucucagaaauagagcaccuuuccuguggcacugacugcucucccaucugaaagccgcuaacagagcugaccaaucugcagacagacagaagucagggcucuggggaagucaucagccucuuaauguaauucaugauuuuuccccuuccauuaaccucagggaggucuuuaagaacuuagagaaugcuuuauuuugagagcauuuaagcccaacaguucgauguuuacgucauuuacuuuaucacuuacuaaaucgaaaugaauccuuucccagaaaguucugauuucauuucucuggaguuacuuuuauucuuauauuuuaauauauacagggauacaucuggauuauaugggugauguuugugaugaucucuuuuauuuugcuauuuuauuacuguuugaguuuuaaauaauaacauauccauuaauaaaacuaauggaucauuuaaggaacagaagcccuuccuaaccaccacacacagcaagguagaagguggguguagguuccaagugaggggaaaaccgcagaccgcaggcuaauggaaagcuuggugacaccugcuuuuuauuaauuacauucuuaacuucauuuugauuaggucaugcacauucggaaacuacugcagaaaauggaacgcccaaauggucuuuauccaaauuauuuaaacccaagaacagggcgcuggggucaguguaaguauuucuaguacaacugcugacuuguuaaaaugauuauuaaaaagucuuugcuugauacagugaaaggugagccauauggaauuaaaaccccaaaccuaggccugacccugcuaguuaucugguaaugcugcugccacccaugacucugaucuccuuuagcuacuuaaguugaguuucugcuuguuaaaaggaagcauugcuaaagugucucacaaggauauuuucauuuuguaucuggauguacuuugcuaaaagaugaguuaacaguuugagggauaaugcauaauaauuauucauaucuuccuguaaauaagagcacugcuugagauuaguauuuuuguaugaggaguucagaauaaacauaacuauguaaacuuugguaaaggggacaguugcuauuggacggacuaugucuagucauucaucuaagacaaagguaccaugcaccugaucuucacuagcuguuggaugagacuaaagauagggaaggaguuagcguuugaucugauuuacggaguucccaggcuagcaggauagguagaaacacuuagaagugguuggcguauaaugugauaaauguaauagagaaguguacuaguuaaugugaaacugcagaaguaauuauucagccuggugggaaaauguuaauaguaucagcuuagaauucaucuuuaaagguauuggguuucaaacaguaauuguucauguggaaaguugaacuuacaauuuuaguagcuuuuuauaaaugcuauucucuuuuuaaaaguaaagaaacuaagauagauacagaauguugucagccuggauaccuacugggagcuggagagguuugccagggauuguccugcaggcuccuuuucaggaaguugcucuuagagcugucuugauuuuucucauggauuuaccccuccauuagcucauggaguucacuuuucucuuuacuuugaagaaaacauuaaagcuaaugcucauacugaauggagauaaaaagcaaaaggaugauagcuguauuuguaaaacaaaaauguaauuuucuuauguuauagacgacugacuggauuggaugccuaccuuaguaauuuugaugaaucagauuguaaacuuuacccccuuaaguauucauuaauauuuggaauuucaaaugugggaaaauuaugcucaguuucugcaguaucucauggcaguauauauguuauaauuauuuaaaugucuaagaugaaaagcaucaaaagcuaaguagugguugcauguguaaucagaaacuugucuuacaauguacaauauaaagccagaagcauaagaugucagacuaaucuguaaagauuaaucuauauucuauaauaauuaaaaagcaaauuuuauaauaagauacauuugaacauauuuggaaaaugguuuucauauucuuucuauauuaugucuuauaagaucauaagaaauagaugcucacugaaagacugcugauauaagaaaacaaaaguuaauucagaaagcaaaacauagaugaucagugcuguguagcucugaagguauugugccuaguauuuguaaacggucucuguagaccucuaccuagaggauccuucugucuaacccuuucacuguguccaugcucagaauguacuuugaacagaggcacgguucuuugaccauuaguuugguaaagcaaaucaaaaccccugaauacccaguguuugaaagaauguuaaucuuuuuaugccuucugagucuagcaauuaccugguuuauuuuuggaaaauuuuaagaguuauaaaguucauuuacugagccuaggaauuauuuacaguugcaauaauuuugaaacauucuaagaaguuuuuaugcaacagaacuuucucuaauuauggaacaugagcauagucauuagacaaaugauagguagucagucgguaagcguuugaaacauuacuuuuauacuuacugaacugugcuuuaaacuuuauuuauuguuuuaauaggguuuucucuuagaacuuuaugcaugagcacugcaccuucccacccucauucauguucuuuccuucaguaauuaguuacauguacauacauaugugugcguauauauguaugaguguguauguauauguauguguauauauauaaauauauauaugcacguguauguguguauguauauauguaugugagaggggucucaccucuagaggugggacuacauguaauuucuucuguuuguauuguguauuggcaggucuacuggugguauuauuguccugaucuugaaaguuuaugggcauguuuuccuuguugugucaagaggauauugucuaacagcagaugucccaggcugcuguugcuuacagucuuuucacccccuuucccaugguuuucccugagccuuagguggagggguuuuguuguagauguaucaguugggcuugggcaccucauagucacuuauugucugcauuuugacaaguuguagaucucuguaauagucucuuaucuauugcaaaaugaauuguuuuauguagagugaaagguauacuuuucuguggauguaaggaugaguauuaaaaaaaaacaagaaaaacaaaaggaaacaaaacagaaaugacauugacuuaggaaccuagcaguauaugguucuuucaggucuauaaccuacccauagauaguuggcuaggcuuacauuacugggcacaaauucucuccuguugagcaagcuuuaaaguucaauuagauagcugucugguuauucccaagguaaaaguacugcuguuguaccauuguggauaucuugugggaccaugcauuguugugguucauuggcaauacagcuggacaggacuaccaguuguuccuaucccugcauagguugaauaacacuauuggauacugugagagccucucuucagggaggagacuuucuggucagcuccagcuugauuccuccacauccuuugucugaaaaguguggugucuucaguaacauagagccuuaucuucaaauucugauagaaaacaaaaauuagauugguuuagaaaccugacaguaaaaaguaaaaggcucuccuuucagagagcagcuguggguaucacuguacucccaacaccaccuuuucuuuuuacugagugauuaaaaaaaacuucguaaguguuugaaaaaaacuggauuaacgcuuacuuguaucaucuaugaaaaugauuucaaaguggguuuuaaaaauacaaccaaauuuaagugacugaacugcaaagccuuuagaugaauauccacaccaguagauuucucaauaugaugccaaaacuagcuaaucguagggaaguaaguuagauauaacuacaaguuaaaaguuuugugcaucaaaggacacuauccugaguuaaagauaaccuacuaaacaaauuacauacaugcugaggguauauuugcacaauauguaaaacccuguaacucaacaagaaggcaacagaaauggaaaaauagaccaaaugauuugaauagauauuuuucccaagaagauaugcaaaaggaaauaaguaaaugaaaagcauuuagugcccucauugaaaugcaaaagaaaaccacagugagauagucaccuccuacuuuacagcugccauaguggcugcaaucaauagaacagaagcaaaccugggcaaauuguggggaauuagagcauuugccauuucugguggucaccaaaaaccuugcagcuagaagcaagaaaaaaaaaaauccugccaguuuccaaaagauaaacagaauuaccaaaugaauagcagacucagauacuuauaucccagaauucacagaagccaggagcuggaaaugagcugcuuuggaugugauuugucaucuagaaguacaguugcuggagacucuggcccugggggugacaguagggagagaguggaacauuuaggaugugcaagaguuucaggaauggguaucggucaagauuaccuaucucugggaacauuacuaucacagcuagaacacuucccaguguuacucagguaugagguaauugggccauuagagcccuguccaggaagggguuugugcuggucauagcuuuuaugaggauggguuauugcagaauaacuuauauggcuuucuacccguucccuuucugauucuuuugcuguguugugauguaagcagauugccuucacugaaguuaaguagaugcugacaccauaaucuugaaucuucaaaauugugagcuaaauaaaccucuuuucuuuauuaauccuagcuuuagacauuuuauuucagcagcagaaaauggacauaguccaaaugucuuaacagggaaugaauaaacaaaauauguaguauaaguguuacaauguaauauuacucaaugauuaaaaaaggaauuaauuacaugugcuacaaaauaagugagcccuuugagaacaauaugcuaaaugaacagagacaaccauacaacacacaccaacauacauauuacaucuaucuaucuaucuaucuaucuaucuaucuaucuaucuaucuaucuaucuauccauccauccauccauaugauugcacuuaugucaauacuuagauucauagagacagaaaguaggguagagguuagcagcagcuuuagugaaagagaaauggagcuagauuauaucuguaaucccagcagucuagggacaaagacagggagguugugaguuugaaguuagccuguaugaguuuaugugaaaguaugucucaaaacaaaaccaaauugauagguugaggagaaagaaaggcaugaggaaaaacaacuugcugacauucuggcccuuauuuuauauuuuuacagggagaagagggaguggcagaggggucucugagaaucagucuucucucugcuuacaaacugggguaguuauagugagacaaggacugaaaagucuguuuccuuccuccuuccuucccucccccucccucccucucucucucucucucucucucucucucucucucucuuucucucucccucuucucuucucuucucuucucuucucuucucuucucuucucuucucuucucuucucuucucuucucuucucuuuucuuuucuuuucuuuucuuuucuuucauguucaguuggcuguggcuggugguaaccagggaguagucaguaguuaaagaagguuaggugaucaauaaguauuucuccugacuggccacuacuuggucuacagggagggcagucaagaaccuagagagacaaguuacuuaacuucuaagagcuauauuacugugguuauuguauugucacaguucaaccaaaauggaguuuuauaaaauggcucagcucugacuaacacaaaugaacaaaacagaacaguagaauaaagaagagaaugaagaguuguuugcacaagguuucaguuuauggugaugagaaaguuuuaggaacaaauagugauuguggucaccuguugaaccuaccaguaucagucacuagcacacuucacaguggugcccaggacaccauuuguguucaccauaagaagaggcccgaucaaaaaaagaauucuugucacuguuuuucuccacaaaguaaauuuaaaugacuuugcaauauauucaucaucagcaguuauuaauuuugagaaugcuacagaaagugcuauucauugggaguuuuggcaggcagauuuucaaaccuuagcaaguugcccuuauaucccauuugcagcugcaauccuacuaaauugucugauuuguucuuucuuguguuuuuguauguuuuauaucagcucuggaacguguaucaaauuccaucauuaucuuggagcaguauacaucugucauaucuauaaauaggcugcaaaacaaacauuuaauugaacugaaaguuaaccauucagcuuuggcuaacuguauuauaauuagagugaugauaaugucugacaugcacauagcaaucagagaguaauugcuaguaauuucucuuaggauaaggacuuggcaacagauauaaaagaguaucucaaggaaccuaaauuuaaaggcaaaccauugguucuguuucuuuuuuauuuuaguucucucaauuuuaaguacacugauuagccuaugccauuuaaugauuuaaaauuaaggcaauauaagaaaccagucaguaguaguucauuaaguuuuauaaaacuaaauuuaaaguuguugagagauuagaauggguauaauguuuguaguuagagugcaaaccuugguuuuucugcuuaacaguuuaaauaaaagguugaacuucugugucucuguaguuucuccuagugagugcuuuaguaugacgcucaugugggucauguuguauucuagauucuauuuggagcugcuucuagagugagcuucuguuagaaaugucccccagaugccugacugcugagauggaugugugaguggcugggaguuaggcgugcuuuaaaaugcaugcacaguuucugaguaucacaagagccucgcagcaugguucaucagaucugacacauaagcagucccaggccaguggucaguagaaaagcagacacaugauggcuuuagguuucuagcuuccacacaguucucucccaggccagcugcccaggaacuugaauggaucugaaagaagacugagaugaauucucacgaauuaaguagcuuguuaaaucaguaaacccuaacaguaguucagacagaaaacuacauuuuucuucugacccauagagcuggacuugcaucuucuccuucaguuucauuuccuuuaauucuguuugugaguuguuuugcuuuguuuuguuuuaaccuaugcacuuguuaauccuuucuuauauuuauaacaaauccagaaauuggcacauaacaccaaagugcaaaacgcuuaaaaaaaaaaacuauuccuuuaaaauacauuuacuggggcuggaaugauggguuagugauuaauagcacuggcuguucauucagagaacuggguucaauucccuuccacuuguaacucaagucccaggagaucaucagaccucagcaagcacugcaccaugugguucacagacacacgugcagucagaacacccauacacauuauauaaaauaaaauauaaaacaaaguaagaacugacaguaacucucccacugauaggauacugaagcgcagcguauuugccugcccuguacuacuacuuacaaugaauaaaucucuccugaugacggacauugguuuuaaggacgaucauuuguaaccuugugcuacuauacauuacuauucuauaguguuauuuuucuccagaauucucuucucuugcauuuuauccucagcacauuucuuugacuaccugaauuuacuccccagaguucacggugaaggaagagaacuagccccugaagcuguccucucucccgugugcauagcacacccacacacucacacgcuuaacaguaaucauaaauacaauggaaacucugcuuccuguucaacuguugaguacagucucuagauacaugauaucauagaaaaaauagaguuucaucacugugucauaauuaccaggggucucuauguucuuuaaguacagcagccacuuuguagaccucagcugucaguccaucagaaucuguuucuuugcuugaagcacugacuuucuaggacauucuuuagcauuuguucgagucgcacuuagaugugaauuugcucuuuauuauaucucgucuugugagccuucuucccagugcuauagugugaaauaccuguuauauacuaacuguuguaugacacuguuuuugaggagaugaaaauaaacaucuuacagaacaccuuagagaaccaagggcagacuaaaauaaggguaccacuaaauccaauuuggugaauuaauggauuuuauuguuguuacuuagagaaguaugaauaagggaucugaaaugacucagagacaguugcaucaccgaagcccaccccaguauggauaaccuuacaugcauuucacagcuugcaggcagcucaacagcuuggagacuucuucagagacaacacagguggucuuagccucuucuaggcaccucagcugaucucugcuucuuccaggcagcucugauugucugcugcuucuaggcagcuugccuuagaaaugagucuucccugcuuaccccuucuaaaauuuagacugcccaucuaacuaccaaauccauacguuguguuguuccuggauaguuacugacaacgcagaaucugagcagaauucuagcuggauuugacucaugucugcuacauucccauuuugugaccugauuauuuaacuacuuugccucugcauuuccuccucugugcagguggguaauagcauaauaugcuuuuugagcuuuauaaggauuaugcauaaaauacuugaaauaguaucugauacauagugguccuuguuguuugauauuuaucuauuuuucaucucucaacagaauaaaagauuccugaaggcaaaguguuuucuuaguuuuauucccuucuuaucccuagugccuagaauggggacuggcacagugaggccauuuaagaaauguagaaagaguuaaaaaaaaaaaaaguuuuagguauuaucucaguugauauauuuguaaauuuaaaagucaugaucauuccucauuuuucuuuucuuuuuucuuuuuauuauuccauucauuuacaucucaaaugauaucccacuuugcccuuaccccuccacaaagccccccaucccacauccaucuucuccccccuccccuuugccuacaugagggugcuccccuacccacccacccucucccaccccacugcuccagcaucccucuaugcuagggcaccaaaucuccacaggaccaagggccuccucuuccauugcugucaggcaaggccauccucugcuacauauguaucuggagucauggaucccucccuacacacuccuugguuggugaucuagucucugggagcacugggugguccagucagcuaacguuguucuuccuaugggguuuuaauccccucagcuccuccagcccuucagccagcucccucauggggucccugagcucagucugaugguaggcuccaagcauccacaucaacuuuggucaguugguggcccagcuggagacccacaugccuuccaguuuguaccagugccuggagcagagccucugcucuggauccagacccacacagcccacaguugcagugucugcuuugaucuucuacccaguccccauucuuuaaauguucaucuuaucucuaaaauagcaauguaucuaucuauuaauauguauacuuggguaaacugguuuucacaaauuaauagcuuuguuauccaacuuagcuuuucccugaauuuccugcuauccaauugcuuuuuguuguuguuguuguuguuguuguuagauccauucagacauguaaccaaauucaacagaccaguuguaauaccucuuccuucaggccauucuccuccaguauucccagcuucagugaggagcacauuugucauccuccugccauuggaaaacuggcaucuuccaggauuuccccuuccaauaggcgcacccgguagauagcauacaggagaguaacgucaagaaagaugauuguuauuuuaagaaauuaauaauaaucaucaaaugcuaagaagcagauacaguugaaagguaaaguuacaaauaaaaagggagaggacucaugagaaagaaacugaaguggucaggguucagagcuauagguacuguuguagcgaacaggugcuguccuuaguaaucaaaggauaaagaaagcacaauaaauugaaggaauuuucugcauuaucuugccuccagcuuucuguauuuucucccuguuuguugugugagauaaggucgaacaguggggaacuuagauuucagaaaucugcuuuagguuacaggagagaaauaaaucaagucauuuaagucaagucauuaugaaauugagaagauauuuuggaguuuccuuugaugguggauauuuugaauuuggugcucauaguggaggagacggcugggucaauccaggguuggaguguugauugaggacaacaggagagugguggagcagcuugcgaaugcuugcacagcaggcaguuucuguuacuucuuuccuguucaaccuuugcuguauaggagcuaggcuaauaagaaaaggaguauugguggccauuuguccuucuguuuuaucugcccaucuguuuccauuuaugcucagucagccaagugcuguugcaggccaccagucauucaggugaguuacuguaaauauaugauuuccacuccuccugugucacuccuagucaguucuguuacuuugauaguuuacuuuccuaaucucuguucucuuuagauuuucugcaugaucguccuacacagcucucucuuuuggcuauuuucaacuuuguugacaauuuuaauuuagauacagcuaucuuuagugucaaaguauguagaguuuugaaauuuuuaauaugaaagucuugauguucuaaaaaucuaaaguaaaaaaaaaacccuuaaguuuguuggguuucuucuaacucuaaauauccuuuuuguuucuuuacuuaaaaacugcuuuauuaagauuuaauuaguagcaagcuguuagaaaauguuaauggcaaguucugaaacauaacacuaugaaagccaucacaacaguuaaauagguaacauacuuauugcuucugaaaaaucuucucauguucuuuugggcucccuuugucacggccuucucuccugcuccucaggaagccacuagucugcuuugcacgugcuuacauuuucuacagccacauguaagguguguucuucauauggccucgguuacucuuuauaaaauguugaaauucauccauguuguauauauuacuaguuuugaauaauauuucauuaugugauauuucuguaauuuguauguuuagugccuucuugguggacauuugaauuguuuuuucuuagggguggcuaaaaauagcuugugauaacauuccuauaaagccaccacaugcucucacuucuuguggguaccuaucuaagauguguaguauuguuuaguagaugucaaauauuuuaagaaaccgcuagcuaguuuauuuucagaggggcuauacugucuuacacucccaucagcauuccucugagcacucccaacacucaggaaccaggcuuuuaaaaauguuuuauucauuccugugaguuucacuugaugcaguccaguccugcucaucucccugucccuucauggcccuuugcccauguaaccuccaccccaaaauuaaaaacacaaacacauaaaaaacaaaaaagcauagaaaacaucucaucauggaaacuguagugugucacagugugucccacaguauaucccucuggccacacaucuucacuugcaaauguucguugaaugagucugguuugaggucucuggcuccuuugacacagucauauuugagacacugggacuccucccagucauucuuuuguuguccugugucaagggcuggcccuuucacacaucugaaccauucacagaugauguagauuuuggagugggccaacucagagcccuggaucuggcccugggugguagcugaacuggucaucgagcuuggcucucccuuauccaccccacuagggcaagcucucuagcacugcuuguaccagccacccauugccagcaucggcagaaggcagggucagcuguccugcucucaugcccucagggcucauccacacccaagccuuuaaagccagcuccacugaguugcccagucaaggugagggaccacucuccccaaaguugcagacugugaggagcugagccagcuuucccuccuguucucauacucuugccuaugccuucaccaucagggccagcuccacuguguuguccaggaaaggugcagggccagcucucccaucucccucagguguuggguguggaaggagggagccaucagcacuuauaagucacuuauaagccaaugaugagagauggggcccacucuccaguacacuucagccagugaggguuagggcuggacauccauauguucccugguggcugccccaacagggauguccccaugcuuucuagugguaauaugagccauggacacugaccccugccacugcauagccauaaccuagacacagcccucagcccucagugcggcucagggcuaccucacugugguccuaugugacagggccagucacucaaagcaggagucaguggggggaugggggagugagucaggcgauaggguuugaagggagucucacagcucugacuggcuagugaucaggugcuaccuuauuccaagaacuacagauaauguguuugauuuuucacuacauuucuagggcuacaaguucagucacaauuagaaaauauaaacaaaacagauuuuauuagcagcucuauaacuccaauuuaaggaaucuaaaaaaugucuccuccaaagcaaacacauuuauuaugcaauagccugcuuguaggcuggcagcauuuacaguuugaaagcacugaagacaaacagaaaauaucugagcggucuuuuuaugaauagcaaauacuaauaccuaacuucuuuuacuauaugucuuaucaucuaugcuauaaaguaggacauuauuuucgucaaucuaucuuauuuacugaauucuguuccuccagggguguacccuguaucacccccuaucuuuaaaccacauuuucaaagagcucuaagccuauaauaaaaaaacccaugaaucuguaaccuauucuccuggccagucagaguuugucaguugugucugucuaccuugcaccaauuauacuguuugaguuugcgcuggggcagauaccccaagaagaucccuguagugauggccucaucugguuaugugcuugucuguucuuaaugcucucuaaggcuuacagaaaacuuucaaauaguggcccaauaaagcugauuuuaggacuauccuaaaaacacucagucacaaaugucucaggaaaaaacauaaaacgaaucauaaugcagaaaauccccaagaaggcaacacgcgagagaccaaacccgagaaguuagaaggacagcaguugcagcaaucuguucagcuucgccagagcugcauuaagcagccaugcuggcuucaugacucuguuuccaguggacauggcugugccaugcuuuauuuuaguuuaauuuaguuuuaauuagugacucucaaaugacugcuguuaaacaucuuuuuauaugacauuuaguauguauugaagaucuuugguacauuaucagaugacacuucuuguguacuuauuuuuuuuuagauugcauuauuuaauuuuuucccuugaaacuuuuuuuuuuuuaauguagcccuggcuguccugaaacucacucuguagaccaggcuguucucaaacucagagauaugccugccucugacuccugaguucugggaucaaagguguuccuugccgccacccaguuuaauuuuuaauuguugaauuauauauauaacaaagccuaugugagaaauagucuuaacaaggccuuuucccaguauguggcuugugcuuucauucucaguagugcuaaagaguauaaaauguucuaaagguuuuuuuuuuuaaaucgguauguuuuuauagcagaucaaaguucauuuuguacuauagcuauccagcuaagguagcaccuuuuguugaaaggcuuuuuuuauuuggugccuucaucccuuugccaaagccagugggcuggagaguuaggcauuggguuuggauucuguucugcugggugccugugacuccaccuugcuguuuugaguauuauagguuuauuauauguuuugaaauuaagcugugcugaugaucugacuuuuuucuuguuuuugaaaauguuuuugcuuuucuagcuuuuauuuuaacccacugacuuugcagugcuggagauugcaccuaggacuucucauauacuaagugaacauucauugagcccauucucugcucuccuuugagaaucaucuugccuaggucuguugaguuucuaaaucuguuugagaagaacugauucuuaacacuagucagaauucuaacccauuaagaaaguacuuuuagcucuacuuuuauuuaguuuauaauuuuacacagauacuuuguaauuuucaggacauaggucuuucucauguuuuauagcaaguaugucauauauuauacuauuauaaauggcauuuugccaggcaguggaguugcaugccuuuaaucccaguacucaggagacagaagcaggaggaucuaugagcucuaggacuaccagggcuacacagagaaacccugucuccaucaccccucacccccccaagaccccccaaaaccaaaaagaggcauuuuuaacagauuuuaaaaaaugugggagggguagugugugugugugugugugugugugugugugugugugugugugugugugugcauguguguauuuauguguauauuagugcagugccucaggaggccagacaagaucauuggaucccuuggagcuggaguuacaagugguuauugucaagucccaaagaaagucaggacaaauggcuaacuguggugucuuagcauaccaaagugucugcuuggacucuaggcucacuuguaccaguggcuucucucagcacccuucacccuacccccuaccucccuuaagucuauccagccaggggcuucucuccuuuucccagguucgcuuccuauagagcccugccgguucagcuacccacucuccugguuugcuugauucucgucaguucccucuucuggcccuuuucuccuucuguucucuuccguucuuuccuucacauucccacagcccaguucaguuugaauucuuccagacacuuguggcuguucucucccucauaucugcaggacaguccuuuuucucagcucuaccuuggaguggccaugucuucauuuucauuacacugugaagcauccagcauaagggcugggaagggaacuuaagucccuugcaaggccagcacauucuuuaaacugucagacaacuggaccagugcucuggcccuuauaaaugacauuuuuauuuaauaucuaacguuaguuagcuauagaaauaaauuguuguuaauguauugaucauagaucacuuauuuauuuccaaauugguugugguuuauuuguuugcaauuaguuuuuuaaaucuauuacacuuauaggauucuuuuaauuaauuacauggaaaacuaagaauguggauauucuugucuuacuccugauuuuaggaagaaaucggguuuucauuguuguguauagugcuagcugcauguucuguuugcuuuuuaguuauuugucuaucaggugccuauugcuagguuaauuaaggaguuuauggugguagggcuugcuguaaauuuguaucaggaacguagauuuuuaccaagugcuuuucaugccuacccaucuccuuuuuuuguuagcauacugacuuguaucgauuauauuauuuugauuaauaaaucugccauucuuacuuguguuuacuaaugauauaccauuccuuuaaaaauguuguaggauugacuuuauuaggaaauugcucugugaaucucucuuuccuuucuuauucugguaccuuuguaaugaugaccucauggauugaguugugaagcauuuuuucccaaggguuuugauaagaguuuguguagaauuguauugguccucuuuuaagaauguaauaaaacuuaauagcauaaucaaccacacagucuaggcuuuucuuuugaaaaaauuaacuacaguuucaaguucuuggacagagaaagcuuuggucagguucuugauuuuggauauuuuucugacucucagaauuuguuuaugucauuccuuuuaauuuuuuaaaaaauauuuccuuuccauuuuugcuuuggcuaacuuuguuguugcuauuuaguuucugacugagguucuuacuguaggaaccaucuuuucuagucaguugcaggcuaguucucccagaaucccacucuagcagcaucccauaaaguaugacacacugugcuuucacuuucucucgacuuuacaacugcuaucaaacgaaaaaguuugggccauuauuucuugagguauuauuuauuaugcugcuuugccuuuugagauuccauuugguugauuuuuguguuuuuaucuuauuuuuauugcauugcguuuugcaaaaaaauauuuugcuguuggggauuagacccaaggccauaugccugguagacccucuauagaguacugagcuaaacugcuaagccuuugggggguuuuguuuuucuuuguuuuacuuuauugagaaaggcucucacaagcagcuugaacgggccuugaagcaaacauccuuuuguuuuggccuucuucagcuagugucauaggcauuuaccauagugugugugugugugugugugugugugugugugugucugucugucugucugucugucuguguauuuaaauaacuauuucuauaaaucuuccaggucagcuacccucccugugcaguaccuagucaucuguuaguuucaucuagcaguuuuuuaaaaucucugauauugugguuuucauguuaagaaguucaguguggauccuuuauguugucuuugucuucacuuuuuagacauaugugacagugguagucauuaaccucauagcccuuucugugucauuaauaccauccauguccauuccuauccuccucacuugguuguuguccugacugagugucuguuaauauuugacugcacagcacauauuaugaauuuuacaguguugcagguuagauauuuuuuguguuucugggcaucuugaggucuguucagggauguaguuaaguuggcuggaaacaauugaacuucuuuccugccccgcuuuugugauuuguuaauugacucuggugcauuguucagaccugggcucauuauuucuucuacgaaggcaagauaauucuugaguauuuacuguauacccugugaauuguauuucugcccuaacugguaauaauaggaacuuucuuaauagucuucauuuucaccagacaguauuuccuccaguucuuuucaugguuuuucgugaccauauuccugguuuccauuuucuuaccucagaauagaaagcauaggaaaacagaaaauagcucuuuuugguagucacaaaaauagagccuuuucagcuuauuuaaucuuaccaguucauuuuggucuucucagagaggcucaguuggcauuuuguccaaugcaugauagaaaucaucaaagcuggaaagaugccucagauguucuuuaaaggaccugacuuuaguucccaauguauacagcaggcaagcuuaccacaucuuguaacucaagcuccaggggauccaccccuuuucuuuccuucauaaauuccuacauacaaaugaaaauaaauccuuuuuaaagaaggcagucgugauugggaaaccacacaugccagugaggcuuggcuuagacuuguacucaagcacagaaggguucccaguuccaggaauaaggcuuuaacccaaaaaguggucuugcacagacacuuagucuacugccgcauagcaguauaguuaaugcuugcuauccugaauacucaaggagaaauccuuguagaucucuagugcucuucucuucugcagauuuccccucaguacagaaugggugaaguucugaauaaauguguguuguuggcacgggcaugggcaugucaagcaagcaucccaaugccucagccccauagaguggcaaagccuuccacguguagguguugacaguguguaccagaaauguccucagcaucuuucucuuugcuccccccagauguuuccagccucaagacuguaccuagccucucuuccauauucagcuguauauaagaacgguguauauauacaaacauguucagcuguauauaacaaacaugcugagcuucuggaggugcugagguucguccauucuagugcuuagguuaccugaccucagcuuuucuguucauguaugugugaaugucuuuucuguagaguuggggaccugagccauucaaggagacugcacuccucuuucauguacucacuugucacuucacucccagcuucauuucuucaguucaagggaccuacaggacauggucuaguuuacugguccagggucucugccugcagacuuccuugagggaacagcuuguggcaagcagggcucacuuuauuuccaucuuuaaggaauuaacaucccccccuugucugaugcugacugcuuggaacaaacauugcuuuauuuugucccauaguuuuguuguuuuagauugcagagugaacccaaauuggaguugcucuguuuuggucaccccacccccaccccagcaguuccuaauagcuuccugucuuccuauuuauuguguauucuuaaaauaccacuccauguuguccuuuuauuuuccuucacugauugaaauccacacauguauauaaguaccauucaaugguugaccuuagauuuuaacuacugucuucauccuuuguauuuuucuaacaucuaggauuguuauaguccucuucagaacguucucuucagaaugccauaaaaacaauguggcauacuuuucacugcuuguguccuagccucacuguggacuuguuuaaaauucuuaauuucuuuguguacuauugcuguuuauauaugucauucuauucuuguagauugaucuauauucucauucucucccucccuccucccucccuccucccucacuuccuaucauguucuaagagcauguccuauaguacuuuuacaguuuuacagugggugcucacuguaaugcuuuugugucacagugacuaaaguaucugaaaauagguuaaaggagagaauucuuuauuguggcucacagcuuuggaaguuugaguuaauuauaauggggaaaucguggagggacagagcuguucuuaucuuggcagacaggaagccaagaaaggggaauacaggcaugguacaccuacaaacagaacacaacgcaaugccucugguuaccuucuuccuucaguuagcacuccacuuucuaucacguucuaguaacucuguuguagucaccauaucuuucccuuucuucugcuacaccccaaugaccaaugcucaaaaugaauuugaaaguacagaugaaacugggaguguggcuccgugauagaaaacacuugccuaguagaaaguuugaacccugauugcaucccaaguauauuuagaaaaaucuccuucacugauucauuugguuuuaccucuuuuucuaauugaggaaaggacaccguccauuauauugauccuuugaccuguguuccagauaacauguucuuccaguucuugaauuuuauuuuccauuuccucuaauuuaauaugaaacuuugaacuuucuaguuacauuuuuauagcaguaaaguccuggcuuuuuguacuuuuucagugaccuauaccaccaugacaccaaaaguaauuucuuaugugacuuuuagcucccaaagacaacauauuaguugucuacugcuaaguagcaaauaacucuaaaacucuuuggcuuaaaauuuaccauuucccuagaaccugacuaaugugaaccuuauuagucaagagaguacugcaaagaguaaugauaaucaccaagaauaaaagaaaaugcugaucacagaauggaaacauaacaaucuguaguuugaauggugccuagcacaaugaauauggaguggugguagugcuuucuguagcuaauguuaaaaugaagagucuaagacucagcaagggacgcugaaugugaggaagugggaauauauugaaccgcaaaauagcaucaggucucuuaccaguaagagaggauuuggauaguguugggacaguacuuuuuagaagcucugagggaagauuauuucugccuuugaacuuaauacccacauauuauaaaaugaagccucaauauaguaaaaacauucuaaaaaacaagaucuuuuauuugacauacucuuucuuaggaauuuaagaauguuacucaguaaauucuguguagacuaagauguaggauugaagauacaguagguguaacuauggagagcaagaaggaagaugucacagcaacagcuguggaguaagccuagaggugaucgauuagauuggauggaaagccugcggggauaagaggagaugggugcuggugcaugucauuuucgggaagcuagacagcaacgcaacagcuaugcaagaaacuagugaaguaggaacgcaggaaccaacccucaugguccuuaaguccuugguggaggguaagaaaagaugaggcagagggaaggggaaacaguucuuugugaaucacauuuucacauagccgcaaaguugagauuauaaaauugauagcaacauugugccaucguuuugauuucucuguuguaaaauaguuccucuuccgauguaacagugcuguuccuguuacuaagcagucccacgcacacauugggacucuucuacuccuucacuucuguauuguuucaguguuuuauaaggaacgauacaauguuaaugugaggguuuuuuuuuuuuuaagcaaaaaguauaauuuacccuauaagcccuucaucauuuggccaucuuuuuuuuuuuuuuuuuuuuuaguggccaucuauucucaaauguaaacauucucuagaaauccuacuagaaauguagcuguagauacauucucucugaaacugagugagcugucauucauaucagagccccaucuucuccuccagccaucuucugugaugcucaguuuaacuucaagagacucgagcagaggaaccuuccuuuacauaguagguagaaaacaggagaaugguucuucgcagcauuaaguuaacagaugucaguuaaaggugaugggcauuguauguucaagcacguagaaaacguggugagaacggucacagaaguggucaucuuucgucacugaguuugacugaaggucaugugaaguucuuuaggaugcuggcaauguucuguauuuaaagcuguaugacuguaugaauguaucauguuaaaauucaucuacauauuuguuuaugauuucagaaaaaauagugaaauaaaaugguguuuaagguauaugcuaauuauaugaacauucaaugcauugcucaagcccuuugacccauuuguugcuuucuacaauagagcuugauuuuggguuacaugaaauuacauguucucagguaguauauuuagauaugaaguuaaaacguaaggccuuuucucccagagauaaucacuguggcaauucuguucaaagaccuuguacccuaacguucuucaauauauaauucuaagcaaugucaaacucuacauauuguucugagccugcucccuuuccacacuuaacuagguagaaauagauacccuucaguguaagauuacagacauauuugauuccuuuucauuggcauguauugcacuguacuauauuuauacucuauuuauuuauugacuucccuagauauuucaggcuguguuuaacuuuuuacaaaugaaaacaguuuuauaguggauuuuuuucuuacaccaguauuuugguuuuucagguauuguuacaggugcauuccagaacuaggugcauauauuaaauuuugcuaucuacuaccauucucaacaaauaugaacuauauuaucagcacuggauaguaauaauaguaagcuuuuaaaaauacuugaggagggacgaggacauagcccaguaguagaguacuuacccagcauguacaaggcccuagguucaauccccagcaccauggauggauggauggauggauggcuggaauaacauuuucucuuuauuucucugugugucacucacuuguuggacuguccaaaggacucagcagcuaaggguacuugcuucugaauuugauucuuaggacccacuugcugcagagagggaauagccccauauacacaugcuguggugcauaugcccauuuauaugcacagauaaauaaguguauaaaacucuaaacauauucuugggaaccuguuaguagucgaaucuugcauuucucgguagaauuggcuuuucucagguuacugaacuugaguauguuuucuuagguaaugacugaguuuuguuucuuuuguuguuuauuuuuuguguccuuucauuggccucacuauuuuggucagaggucuuugcuuaggacauuauccucuuuuccuguuauguauccugcaauuaccuucuccuauucaaucucuuuuuucauuuuuuuucucuuaaauuuaguuugugucauaggaagcugaaacuuuuccuuuaugacuccuuaguuuuggauuuaagaguaucugccuaagaaaaccagauguauucucuauauucucuucugcuauacuuagaauuucauacugcuaauaauucacagauauauucugugaaauaaaaagauaaaaacaugccauuuccugagcccaagugcagguuuuccucauaaaccgcuaaauaccauccucaccugcuugugcuaguguacugucugacugguuggagggucuacacauggugaggggcuuuucuuuuccuacauagacaaugggaauuugauaauaaaauccugcaguguacagcaagacuuguggaaagugagggauggcagagugucuuuuaccuuaaaaguguaagugacauuuaauaguauuccugugaaaaaacaauguguacuaauguauugaauaugaauaguaauuaaggacaggauuuaacagcuaauuauauuagaaaauauauuacaaaguggucuuuggaugaugaucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggacggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaauaaaaaaaaaaaaaaaaaaaaaaaaaaaaccaaaguggucuuugaauuuggaacaggacuuuaccauuagacauuguuguauagagauguuuaggagugggugggguuuuuuguuuguuuguuuauuaucaaauauaacugucauuuaauaauggcuuguauuuaaagccauuauuauauaaaagauuuuuuuggggugugugugugugugugugugugugugugugugugguuuuuuuuuuuuuuuuuuuuuuuuuuuuggacaggguuucucuauguagcucuggcuguccuggaacuugcucuguaaaccaggcuggucucaaauucaagagguucuaccugccucugccugcuuugagugcuggcaaugaaggcaugcaccaccacugcccagcaaaagauaauuauuuuacaucugcaaaagucuguauggauaacaguacaaacuaugaaauuuaagaaaaaagacucauaaaucuaaaaucccacauauagaggaaaaaagguuuucuagaagguuagacacguauuuuguuguacuccuacuugacuaaguuuggaauauguuaaaaguaggcaugccacuaugauuaacugaucuguuaaguggccuuauuauaugguuauaaauauauguauuauuuauguauaauauuuauauauuauauaaaauauuauuguaauugucuuuaucuucuuuuucccucacuccuauccucuuuucucuuuugcuacagaucacacaucaguugguggucugggagauaguuuuuaugaauacuuacugaaagcauggcugaugucagauaaaacagaccacgaggcaagaaggauguaugacgaugcuguugagguaacuauuguuuugagucuuuucuuauagugaauauauguacuugguacuagauagugacuacacaaauguaaccguuuuauuauaggcaucuaggaaguacauguacuauauauuguguucauucacuguugaauuugaugguauuuuaacagaaaauccuuacauuaagucuuauuuguaaauggguguauuuagaaauguauaacacuucauuuuaauuacauuugauuaauuucucuagagucaguaaagcuucugacuucauccuuaucuguaaacacuucuuucaagugauggcuugagccuacacauugagucuuugaauaaagaaauguaaugggcagugguggcgcacuccuuuaguuccagcacuugggaggcagaggcaggcggauuucugaguucgaggccagccuggucuacagggugccuuccaggacagccaaggcuacacagagaaacccugucuggaaaaaaaaaaaaaacaaaaaaaaacaaaaaaaaacaaaaaacaaaaaaaaacccaaaacugaauuguaacaguagccacuuguauagugcuuuccugugccaggcaucacaugagccuauuuacaugaaugaugucacugggucaccguuaugacuguacacauggagaccugaagaugcagugucaauggucagguagcuuggugaaggugagagucggaaacugagcuguuggccuacagagccugucuuuaucauggcauuacauuguuuaguaaauauguaugacagcuuaaaauguagaguuaauucuaugaaaauuucuaggaaaaaauuacaaaauagaaaaaucuuauuuuuuuaauaaauuacugauagcuggacagugauaccauacaccuuuaaccccaguauuccacagaagcagguggaccucuguaaguuugaggccagccuggucuacagagucaguucuaggauagccagggcuacacagacaaauccugucucaaaacaagaauaaaaauuacugacuuucugaccaauuguaaaugaguauguccuuaauaauuuuaauauaacagaauucuuuuaauauagacaucuguuuucagcauuguaguuuugugauuuaaaaaaaucaaaccuaagaucuuauuacccauuuuauauccucugucagugucugguuuaccaccauuguuuuaaaaaaaugcucugauauggaaguuaguguaugaugcagacuuugcucacuguaguugcucaauaaacauuuggugaggggauauguuaacuaauaaaucgaauuaaagucuaauaaagaaucuaaauuuauacaugauuuauaagacuuuuaaugaagccuuaaauuugaaaagcugaaaauuuuuauuuuaucuugcuaaaauuuaagccuagaaaaugauccuggaaaggcauggucuaagauauuuuaacugugauaggugucauuguuuugaaaguuaaucuuaaauuuuuaaauuauugcucauuagauauaucaucuauuauauguacaugacuuuauauauuugucuuaucaauccuguuuuuauuaguuuuugaauuuagaauggguuccuacuguuuuuauaaaaauaauaauuggucaaauuucauugugaucucaagcauacaauuuuugcacuguuaucuucagcaaauacucguguuaggagggaguauuuuugaauaguaaaauaacauugagugcauucuguuuaaaacgcuuucaucuccauccugcuuccucuacagaucccauugucaugguuucuucaucuuaguauuuguuauagguuuuagaucgaacuuaaagucaguuuguuuauuuuuuaaaguauauucaaagcauacauuuuaauggccauuugucaguuaacgggcuaugguaauacuagugaagauguucaagaguuauguaauuauuccugacugccauucaacagcuggcauuuuauguaagacauuguuagacucuucagagagaagaaugcaguacaguaaauuucaagagucccaaggguagcuaaggaaguaaagcccugucuucuccaccuuuccuuagucccaguaaguuaaugagcagguuuagcugucuuagagcauaguaagauuugugccacaaaugacaaaacaauguaaguauuauguagaaagucacaacucuccagauauggugguauacaccuuuaacuccaguacucaggaagaggcauggcaagcagacuucugugaguucaaggcuagccugaaaacuucaugguaagacacucuuucaaaaacaaacaaaaccaaaaauauagccaagucucuaggcaaguuauuguguauauucaagccacguugcuaucauucagccuguaaagauggaaaacuuagcccucgauuccaaagacuaaucuuuuaaauauauauguauguacguauguaccuauguauuuauguaugcauguauguaugcugguuaaaaaaauaacaaagacuuaaaauccaguggucaccccuaucauuugauuaucagcuacuucuuauugcccuuaucugucugauuuaauuaucaagagcgucaucauuuguaaaauuacuaucaacugcaugguacauuauaggaggucuucuguagcaugagauaaugagggcauguauacucccuacaguucugaaaagcacacauugucauuacaaagaauauaaaggagauggcuucuagagcugauguuauugaacuugucagagaacaaccauuaaucaaaaugugaauuaacccucgaaaaauacaucucuuauuucagaaagaaaaguauggcccaucucagcagacucuuaaggacacaguccagaggagcaaagcucauaaaaauaugucauuauuagaaugaaaugugauuguuauacuauauuuuuucuuauauuuaaguuuaguauaaaauauuuccuuugcuauccccauuacuccaggacaguagccugcucugauauugucucccuuuauucaugaccaaacauuccaaacaaauuacuguacuuugagaagccaauuuccuaaggaguuaagggauguguguaucaagcuucaacuaguuuugaaagccugaccguggguaagguuaugcuuuugaagauaauuuuccaaaguuguauaguuacaugaaaaauuaagaauaauuuuugccacuuacuaaaauauccuuuuaucauaacuuauuaaaucuuuuguucaguuuuuguuaucuggaauagaaaauaaauugguaaaaccuuuuggguucuaacuucuuaaggugaucucaguugguuaaucauuaugaaucucauucagcucgagaagacaagcuauauggguaauaccaugcagaaaagcacucgaaggccaugucuccucuuuugucuuauaauagugauuagcguguuugugccagguugcauauacuauuaaguucccaguuugugaaaguuacuacuuuauaaaaugccauaaugccaagguuuuucugauggccagagauccagaaauaaaugaccagacacucacaguuuguguucuaguuucguuucuguugcugugacacuacccuaacaaaacuagcacugggaggagauuuauuugccuuauaaucuuguauuagaaccccuuacugugucaggucaggaacuuaaagcaucacuguacagccaagagccgaggaagcccuuccugccugaugcucagccggcuugugaaauggugcugacauauuucacaccucaguuagcaauccagagagaggagccauggccucagacaacugaucuggauaauuccuuacuaagacucuucauaggugauuuuacguuguuucagguuaacaguugaaacuaaaaagguuugugucuaaaucguuucuuuuucuuguaggcuauagaaaaacaucuuauuaagaagucccgaggaggucugguuuuuauuggagaauggaagaauggacacuuggaaaggaagauggggcacuuggccugcuuugcugggggaauguuugcccuuggagcagaugguuccagaaaggauaaagcuggccacuacuuagaacuaggggcagaaauugcacgaacaugucaugagucauaugacagaacugguaagaauauuuugauaaugcuagugacuuagucuaacauaaccuguaaguuaaacauguuuccagaaauuaggaggaaagaauauuuguacuguucacuucaaaaucuugaacccuaaaauagcaaauaauuuuucuuagcuuuuauuuuaauuccaggauauguuuccaguaucauuuuuuaaaauucugaacucuugggaggagguuguuuguuuuauucuuuaauuuagaaaauaauuguuguaaagacaaaagguagaggaguuguauggaguaauaucauuuauuuuuuaauagaagucccaaacuauuaguuuauauugccaugccuauacucucaagaaaauaaaaggaaucaaaagaggguagacauuuccuugaaaguacaguuguuaucuggcuaucagacaguuugucuuuggcucaauucacuaguaauuuuuauguuugcuuaagaaaaucuuaugacaucgcuuugggaaaauagauaauauuuuugauccucuguguuuuagagguugaaaugguuuuuuauuguugacaaaaauugauugaaaaugcaaauacugcaugcaucuacagauagauacucagcauauugucccuuacagggacaguaaugaagggggcugcagaucggcagguuagaccugcaauuuacuuuggcuuuacaaacaagucuuucuaagugaaguaauagugaagaccuacaaacuuauaauuucuauagcaucagaaguugaauuguugcuuuucuauaguaacucacuuucuguuucagaguuaguuugucauuaaguacggugacacaaacauaauuggcuuuaaacuugccuuuguucauaaacuuugaguuauuuuuauauaguaaggaauagaauuuaauguaaaauugaguguucaauucucucauagccuuaaaucuaguggcuucacuuuuuaaaaaauguagcucaaaaaaauauuggcaauuguuauuucaguguguuuuaaugucggaauuaagacaaaauuaguggucugauuuacgaauagaauuaucagauuaucagagugugugauaauauguaguaucaguuauacacuuaaaaugaaguuaacaguucaaauucccauuaugcacauaaaaucccauuguguaucuuugcaaaauuuuugucucucauugagcugugaguaagacagcacugaacauggauguauaaauacucuauaguaugaugcagaguccuuugaguauaccaggagggguauagccggcuaguacagcaguucugccuuauuuauuuauuacugugaggcaccaccugugaaugcuuaguuuuauuuacccauuugacacacucuggaaucaccuggagacuucacugagaggaagucucacugaagaguggucuauaagguuggccuguagacuugucuuuggaagauugucuugacaugccaagaccuauuguaacagugggcaauggccuucccugggucugaguccuggauuguacagaagaggaggacguaaacugcacacaagcaugcaugccuuaauuuguuguacucgggucuugaccauggauauaagugacugcuucagguuccuucugccuugacuucccacugugguggacuauaacauggaauuaugagcucuaaaauaacccuuccuaaauuguauuuguuagggguuggauuacagcaacaggaaaugaaacuaagacaccuccauacugauuuccacaguauuuugcugguuuagacucccaccagcaguauuaaggguucuucuucuccacauccucauuauuauuuuuucucuucuuuuccuuccuuccuucccucucccucccccuucuccuccuccuccuccuucuguuuguuuuuuuugauauugccauuuauuuacacuuugcccuuucccuucuucccuccagaccgucucaaauaccccucccaauucuccuucaaaaccauggccuuuuuaaaaaaaaaaaaaucaauuguuaaucguauacacauguauuuauguguguguguguguguauguaugaaugauauauauccuuaaauauagcuguucagugugacuuauauguguguuuucaggucugacuauuuggcacuggauaagaaguuggugugcucuucucuggggaggaccaccucuugugcuccccacuuuauucaguugccuuuaguucuugguauaggguugaggccucucaggugguaccgcucuuguugaguggaucuuaaguccaguuggagagcauuuaguuaugaccaggguguucaggccacuucugcacccauaguguuacugugccaugcuaguuuauguuuucuuaauauucaggcaagggugagauaaaacuccaaagugguuucaauuugcuuuuccuuaauggcuaaagauauugaacauucuuuaaaauaacauuuggccauuuguguuuuuucuuuggagaugugucuguucauuuuaugagcccauuuaucaauuaauaguuuuauggcuuugguauuuaaguuuuguaguucuuuauauaugguaguuaucauagcaccuuuaaucccaguauucaggagacaaaagcauguagaucucuaagaucaaggucagucagagaguaaguucuacucaaccaagcuuaggcaguaaagggaaccacugaaaacagaaagcuacugaagauggaauagaacaagagacccacaagcagcagaacucagcaucuuaagucaucuuuagagucaagaguagaagggguuacuggaacaauugauccugguuagcuggagcuaagaaauuuguggugauuuaaaagaccagcaucacugagaugacaucuucugggaaguauuuucugagagcacaaagaagcuguauugcagagguagacauugugcuggcagcuggacuugguaauauguuaagaauuaucccaguggcacugguuucgaaggcaugaaggggucaugaagagccgcugaggcuggccacuggugaaggugcagcauaagucguaguugauggcccaggacugaacgagucauguaaagaaguugaggcuuggcaccaugaacagagucugauugucaguuuuacauaguaaguugaaccugcaauucucuuugucaugguguccccagaagcguacuguuuuauuugugccuuguacuuuuaagucuuuuacugauuuuucuuguuucuguucucaacuuauauccuuggacuaguaaguauaguccugguuuucuuaucuucccagucuauacucugcuguguuuuucuuauggcucuuuuauauauuguugccaccauguuaaaaauucuaucuccuucuuaauaauuauuucugcuaauucauaaaguaauuauugccuugaaaguuuguuucacuuuuauuguuugaauuaggauuaaaauuaauuaaaaaaugaaucaucuuaaugcauuucaccauguggugaauauagcaaauuuuaauguuuaguugaguucauggcaagcauugcugaaccuguucgugagaugggcacuaccucaguaguaguugaagcaugaguuaugcuccggacaccugacugauaguugguugggacauuguuucaauuuauuuuaaauaugauuuggguaaaauacauacauaguuuuaggcuugcccuuuuuuauucauaagucuguuuaggaaaaaucaguuauuuuuuuucuguauguuugugugaaguuauuaaugaccacuaagcaaaauaauuuucagugagacgcucacguuguuaauuucuuauagccaauuucuauuccaguucugguguauugucauuauaauuaugguaguagcuagcuaauguaaucuuaagguuaaccuuuaaaaucuucaucugaucaccacuuuguacugaaaauuuuuacauuagccuacaaagugacacguuucauuguguguguuuucacacuuuguuucaguagauccuccccacacauguucaugcccuuaugccucuaauagucuccuucccucuuugguugcucauaguagucacccuuccauaagacccacgaaaacacacugucugucugucugucuuuguagagaaacagauacaaauucaaagcugguaucugcacaucagagcgaauauuugugguaauugucuuucugagucuaauauucuucacugauacuguaauuuccagaugcauccaucuuccugaauauuuccuuuuucuuuaggggaaggaaaaacacaaggaaucaagaccacaauaaccugccuuuggauuacuuucauuucaaugcuuaugaugugggaccuuuuaaaaaauguucuugcuuguuuauucuugucagagucucauuauguacuaaggauggccuugaauucaaauucuuuuccaaguagcaccagaaguuacuagcaaguauagucagacaagaaagaagaaaugaaggacuuuaagaucagaaaggaagaagcaaaaccauccugauuuccauaugacaugauuauguauaauaaaaacugcacacacacacacaugcaugcacacaaacaaaacccuguuagaauggaugaaugaauucaguacaguggugggauucaaaucagugugcaaaaagcaauugcauuucuuuacgcuaauagcaggcuauuggaaggagacaucaagagaagaaccuuauuugugauaacaucaaaauaaucagggcuugaaagaaagcucuguaguaauacuugcugugcacauuugaggaucagaguuccuagcacccacauaaaagccacauaaaaacacacccacuaggucugguguuucuauaaccccagcacugacagguggagacaggaaaauggcugggucuugcuugcugcaagccuagcugaaaauuuccauguucuagauucagucagagacucagcuucaaaggaaugaggcaaagaguuauagcauaggauacuuaauaucuuccuucccuugacuucacacuuacaauaagcacacuccccuaccacgcacacucaagaauaauacauaaugaacugaccuaaccaaagagagaaagauugugaggugaaaauuacaaauauugaugaaaauaauuggaaguacaaauaaagggacagauuguaucuguuuguguuuauggauuguaugcuguggucaccuuugcauuugguuccaaauuacuacuuagcucuuggcagagucagagucuucuaagggguacuucaugccagagcaauagaaauauuuguaauucuguuagaagaaaaccaaauguaguuauuuugaaacaauucauuuuguaguacaguaacaauacaauaaccaaaguuacuucagggcuggaauguagcucauccuaguaugugagagguucuggcuuuggucuuuaacaccaaaacaaauaaauaaaaauuaaaacaggaagcaagaaaagucacaaaagauaaagauuacuucauaccccuuccuuuuagaaagaacaguaaguauuccuuaaaucacacacauuguuuauguggcuuuuuuuuuuuucuuuuuuuaauguuacagcauugaaacuagguccggagucauucaaguuugauggugcaguggaagccguggcugugcggcaggcugaaaaguauuacauccuucguccagaaguaauugaaaccuauugguaucuauggcgauuuacccacgacccaagauacaggcaguggggcugggaagcagcacugguaaauacgccaaauucuccucuugucugugcucacuggguagagcuguucccuguaccguuuguccuccuccccaugacuugauuuugagaacugugcacuuugauuucucuggugcagaaacuguucucauuuguuucuugaacaguaggagcuagacuuacacuccuguuuacuuucuauuagcacuuugauaaaaguaugcacuugguauucuacuacauaacuauaaggagcuauuuaagaggcaaucucaggauuauuauaaaauaagcaguauuuuuauaaugucuuuuuaauguuuaaccacuggggggaaaagccaagauucauagccugggcagaugauucucuguucauuuuaccuuguguucuaauaaguccuguauagaucaggaaauuguuuuuuaaaaauuggauuaaaaaacaaaauauaauauacacacauacaacagguguguacguguguguguguguguguguguguuuggaagcaggaauuuguuaugauuaguaagcaaaggaaacaguccauuuacucuuaaauaauagacauucacacugagugugauggugcauacuuaugauccuaacccucaggagacuaagguaggagcugucauaaguuaagaccagacuggauggccaagugagccugaagccugcaugggcuucaacucuucugauauggugacgagcuagucuuuaaaauaaacaaaaacauguauuuauuauuuguguguacccaugagugugaggaccuguggaggccaaaagagguugucagguccucugagcuggaauuacguguguuugugagcccccuguuguggguacuaggaaccaaaaguagguccugugcaagaacagcaaaugcucugaccugcugagcaaucucuguagucugauaaugcuuaucuauucuucacaugaucauuaggaagaauaagacauuuaaauugcuuaggaaaaagcacuaugccuaaguaaggagacuuuaaaacccaucggcaacaaauaaagcuguaaaacgaacuugguuaaguccuuucuacuguuaacuagcuuucuguuagaagagaaggccaggugaacaggaacaguggacagggacaagcagcagcagcagacagagaugagugagcgcugaggucauugcacaggagcucagggugacaguggggaaagaaagaguccacgugcuccuagcuuuuucuaaagugugauacauuugcaccagcaagguggucggugacugcgacuuaaaaguagaguugcugauacacuguuuuuuauuuaauggguugacuaauguucaaggacacaaaugaagauagaauguaagaauuuuaaauuccagucaggcauuagaacguaguaguuagcacagaacaaauugcucagcucaauuucucagucugaaaaguagagcuguuauccuccuaggguuaugaaauuuaaaugccagugcauaugggauguuggcucuuaaguagucgccauugucaucuagacauguaggugugcacuuccugcuacuacucacgaccuaugagccuaacuaauaagguuguggaaauacagugucucagaacagaguaugguuauaauaaauaccucauuacuacugcuguagaaagcuccuaaauaauacaucuuuaaggauguuaugaauuaguauuuguacuuggaaaugaucacacugaaagucagagagagaguguguggggguguuuguguguguacacauacaaguguauguggaguuaagaauauaaccauguguuccucauguacuuuccaccuuuuaaaauagggucucucauugacuaaggacuuaaccaaguaggccaagcuggccagccaggauagcaaguuccaguguccaucagccucuacuaaucauugcuggaauuacagacaugcaccacuguccucagcuuuuuacaugugaacugaucugagauccucaguuuccaagacaagggcuuuaugagccauuucucauacuccuaaauacaagcuuacuucugucuugauuugugacagacagcuccuuaauuuagaaagaauaggucaaaauugacauuuaagucaggaaaauauaaaauauuuuagagagauuauaguguuaagagagggaaagacacccaguacaaguuuguuuuucucguaugagaauauuucucuuugauaacugucgcagacccucugggccccuuugucugcguggaacgggucucuagucgaggguggacaaagcguaggaugagugacaaacagaugcacacaggagaggucauguggaauccgaauguaauuuaucaaaucgaaccggacuuuuuaugcagaagacaauaaggaaguugggugacgcaccagcaagguacaaagagguuacuggauucuuacauaaaacagaggaaugcaaacacagaaggucuaacaccacuugggauagaauucauuguuaacaacugggauuaaaaggggcuccaccuaagauucacuuaaucuuagaagccagggucaagggcuucaugcucuugccauaguuccuauuuuggucuauuguauaguccaccuuccccuuaggccauuguaaauacguguguauggguguaacucagcuauagucuuagaagccaggugugaggucuuuacucuccuagggcaagggcuuucacacccaagucaugguucuaacuagggaguuccuuucuagcuaaccaucucaugaauaaugcaauacucuaaaaccacagccugaucuacuuccuaaaccauuguaaauuccuguauaugggagugacuuggcuuuuauugauaguguaauaccagaggcuauuuugaaugucacugucuagcucaaguacguucuaggacuguugaaacacugaggcuuuagcuaugucagaauucaaucuuaaaaggcacuuauaauaggaugauacugaaagagagcacguggauccauacacuagacuaacucgggaauggagaauuaagaaaaugcgacuccaagaggagagcuuccuugaaacucuuuuccucaugagugacuuuuaagccucucggcuuucacugacucaaccagaguguguggcagauaacacuaugcuuaggcuaaguacauugucaguuacacaaaugucaaauuuuccuacagauuuauaugaguuuuuguuuuuagaagagacuagcccuggcuguccuagaacucacuauguagaccaggcuggcuuugaauucagacagaucuaucuauguaccucaugagggcuggaugaggcccauccuuucuaugaauguuucuuuugaauacagguuuugacuugucuuucagaauugaaauugcacagaaugaauugucuucucugcucucccucacaggcuauugagaagucgugccgggucagcgguggguuuucuggugucaaggauguauacgccccgaccccugugcaugacgacgugcagcagagcuuuuuucuugcugaaacauuaaaguaagcacauacucaaaaggguuuuaaguaagcugcuuuuaggugcuguaugaaaauaaaagcugaccccaauacugagacaauguaugugguugccauacagauauauauacauauaugaguaauguuuaaaucaaauuaauuauaucugucacugcacauaauuaguucuuuauggugacgacuuuuaaaaucccaucuuuuugaaguagaguguuaucucugcucacccuuuucugcaggaacacaccagaacuacuuuuccccaugugauguuagcauaggauuuguugguccacugccauuccugucgcucacuaggcucuggcugcuguucuuuuccuccuaagcagcagcuuuuacauucuacauaggaaugauaucauauaguuauuugcuuuguuguguguggagucuuucacuggacacaguaauuuuuagauucacccagucugauagaaaugacccauuuuaccauuuuuaauggaugaauaauaguacugaauuauagauaagugccacauuuucuuuaucuacucauuaauauuuuuguagaauaguguuacuauaugguuucuagauaacuaaauuugacuauauauuauacuguauuauguuuuauuguaaacguuuuauguagguggauugguaaauagcaguaugagaggaaugacuguaaguagauguucuguugugguggcacaggccucuaauccuaauacucuggagacaagacccuagcacugccaucuccaggccagccuaggaagacugucucaaaaauaauaagucauuguguuucugcuuuuugauuuacuuuauaagcaucuaggaaauuucuuaaaguauaaauauaauggccauaacuacaaagucuuaguaggacugagguaggaucaggccaauauauuugucuuugaaccccgcugaguguagauuucaucucuuaggaaugaucauauguuuugauguacuaaaugccaauguagccaucguccaccauucucuccagaaggucuuguacuaagguacaugcaaagggaaaaugggaaaggaaaaagacaguguggggcuuagacucaaagcccggguggagcucuggaaauaugucuuggagaagauggagacauuaauuacaugugugcuuucuuaaaggcauacacacaaaucucacuucauaucaccaguaacucaguuucauguuuucugugucuuacacacaggugacuuauaaauacaucauuugcucaacaaauguuuacugcccaguaccacucagaucacuugggaaugcauuagcaacccaaagggcaaguguccugcugugcucugcuguaacagaguucauccacgucugcccaucuggguuucucucucuaauauaagugugguucguuucuuuaugucugguguguuauagcugaaaagcacaugagcagccauauagucuuucuuucacgaauauuaguuuuaguguucuuccguuucuuuuagccuuuaaguuagugcucuucuguguuuccucuugcucugucagugcagaguguguuucuguuuuguugcuucauucccuccuucccaugucugccauggaccugguccagacccugacaguuguggagaugguuuagggcgucugccuuaguccugaguuucccacuccugggcccuccuuguucuuguguauccuguugguuaggcuuguaucucuaucaaauagcuguaagagcacugggccauagcaggcuggcagcuuuaguuguucugugcuuuaucuguaaagcuguggaauuugacuuagguugugguagaauuucucucucucuuucucuuuagcucuuacaugguguguguguguguacacgagugugcaugugugugcaugggcuucgcuagugcagguuuggcaaagcacugaccacugaucuguaucuucagccucuugcugcuugucuucuugcuacuucucaccucucaucucccugucucagugucucucugccucucuccauacacacauacucacauauuuuccucauuuaaaaacaacauuguuuucuggauaguaugacaguucccagcauuugguguuuuaccauggauuucuagagggaaguggaucugguugggagggagguggugaggaacugggaggggaaaauguuaucaggauauauugaaugagagaagaguguuuucaacaaaaggucaauuguuuuuuaaaauaagaagaaagggguauuauuguacaugcuuacaauucaguuuucauacucagaaacuuuagcauucauacaguuugguggugugacauauucuauuuaaauuuuuuuccauuauuucaaaauguauuucaguuuuucuuuuuuguuuuuuuaaauccuaguucaagauacaguauuggagccuuuauuguauuugguuguccuaucacuuuaguugccuuuaauuuaggaaaaauacucuucagauacauuuuagucuuuugcaaaauuaacguuuuuaaguguuuggauuaguuucuaagaagaauaucucucaauuauauuccauauuacuuuguaauuguuggguuucucuaaagcauuuguguguguguuccucauccugcucugugaagaagcacaugauaguaaugcaguuauuggugauguaggcuuaguucauaggucagauugauauuauugcauacuuaaugguguguaauaauacucugucugaggagagauucuuuuucagaagucuuucugugguuaucagcauccuuugcuugaaucaaauguaacuguagaugugggguugguaacuuggacaggaaccagggguccaggagacaugaucgaacaccuuccgucccaugcagguggaaaucaccacccaucggguccccaggcuucuagaccuuugcucgaaugaagaccaggcugucuguaugcagcccacagacauguagagacaguagaagaucuagaaguccuagaguccuugacuuucaccaucagguaguuccuuuaugcuucugagaacuacaguggucugucuuucuuagcuucaucucacccuuuuacuugcccauuccauccuuaaauaggcuuacucuacauacagucagacauugucacacaugaagcauguaaauuugccuuucguugucuuucuguaguucuccgcuuggcaggaaugccucugcccugucugucaguuagcacuccucuccuuucuaacuuaauaagcucccaucuuaccuguugaugacuggcuuauaaccauaucuccaauaccucagccaguacagaccaggagcauuuggugugugauuuagggugaggaauagaugacauucugccucuuccccugcaguacauauauggaccauccccaggacauccgcaguagucuagguauccagucauuacacucacuuucaguaagccauacuaguggaucaauaaaauuaauaaaaaggaucaaacaugaguaaacagaaauaacuauauuaacacuagcugggaaaauuaucaacacugaaccacugaacucagcuuugagcauccuggaagcugaacaagaagcaauccuucaguaaaagacuguccuccacuccgggaggugggagcgcacauucuuuugacaaaugagauaauauguuuguucugcuaauuauaaggugacuuauacugcauagcucaugaccauauauugaacuagugaguaagcuguaugaaguugcuuuuuucaaaagcuaaagacaguugaauauucucaguuucacauuguccgacuguguauguaucuguguaaguauguauuugcauauauaacugugugguaucuucaggcagugaugcugccuagaagcuacugagguucucucucuuuagcugcaucucuuauccuuuuaaaaagcacaaacgucaaagauacagccuuuauaaaaacugaugacauaaugugaagguaagaugagauaaaaguucuaugaagaucaaaauuaacagucuuaauacuucgaagagaauuacaggguagcauugucccuuaacuucuucugaaauguuaguuaacucuaagauaggcuuuuguuagaagcugagagguguugaagauugcuuugucagguggcuauauuugguguagaucauuaaagacuagcaguugggugugcuggacuacuggacguggugacuuuuugacauggcagcggcauaguuacaucaaaguaguguucuaagccugaauauuuugccauggaaacuaucccgugaauuagcuguugcuaaggcuuuuucucucuaaaauccaaaggguuguaugauggcuuuuuuguuuuguuuccuuugguaguuccuauauuauuuguuuauuaugugugcugaugguuuaacaaaauacuauauaaugaagaauaauaugaaauaaaaugugcgauauaucaauaaaucacauauacuagguucauaagagaaccauuaaugaaaugcuagucguuugcgaaaaaauaguuaguugcuuaacuugcaaaacaugaagaagauguaauggcaguggugguauuugaacauucagaguugaugcugaaagaggaugaauugaugucuggaagaacagccacaaaaacgacaguaaaguaucaugcuggggcugcagacuccuguauugagugguucagugcagggagauucaguaagaagguaaaagaacagauagugguaauguuuccaggguggauaauuauggagauugugauaggaguuuaagaagaaauugguuuuucagaaaaaggaauugauuuuaauaaauauuuugaagagaaaguucaaaggauaaauauucaaagccugaguaugaagaguaaaaaaaauaucuguauagucccuuggaauugccucaccuaacggaaacguucccguucaauuuggcagacuagacacaguauauuuacuuaugcuuucuugaaagccauuaaagugacuacagaacacuaacuagucgaguaacagaggacgagggcacuucugucagcacauauguaacugacauaaccggacagagaaagccaaaaguaccuggguugauuugaacaagcuggcaaucugcuacaaugcucugcaccuuugaaagguggaguuugaggaugggggaagggcguuuccauggaaugguggacucuugcuucuauccugccucaucuguguucuaagugaaaagagaucuuaugaaaggagcuucagcaacaaggcuguggacucuggcugagggagcagccacugcugaaagugagagaugacugagagacuuccuucugaggaaauucaguagcucacaagaaaugaaaagccucaccaagauaaaauaaccauguccuuacucaguagcaaagcccaaguaaauaccacccuccccucugcuucaggcuagccuuucagcaccuuauguuuaagcauuggccugugcauuagcuugggaguguuugauacuaugagaucuguguauaugugugugcugugagauuaagaggauaguucacccagcuugauuacuuaggccugagagaaguucuuuaagguuaaagucuggagugcucauacguaagcagguaguaaugucacccugcuggguuccucaaauugcaagacagagcuuuacauuccuagcucuaggaauugucugucuguguguuuuaguaaaaugguagcugauaaaaagucucacaagcugaacaaaucuaggagccuacacugccgggagcagcucuccagcaccagcccacacauuguucacgaauuuaucuucuuugaauucuacaauuucaggccuuuguauuaccuccuagcaucaacuaauucuucuuaaaaaccauggaaguguuuucuaccugccuuuagcccuacaacucucccugcacagcucucacagacugagcucauuugccauguguuggaaucugauagaaagagcaggcauguggagguuaccucacagccagauuuucucaguucauaugcaccaggcaucuaggagcuaagggaaaucaggaguuagugggaaacggucuucuuauuaaauuuauuauuaaaggaagcaagacagcaaaaaaaucugagugaauuugcugcauugugucugcuacuccugauaauaaagucucuggggcagcaauugugucuguaagucuccaugucugaaagucagucuuacauuauuugaaucucaaguauuuuaaaauaaacucauugcuucuacuuccuugcucuugaauuagcuuugcucucuagguuugucuuuagaucuaaaucaucaaaguagaagaaagauacacuguucauacacucuauccagcaagcgcuugcuguuaagugcuugaccuguguuggcuguuugcauaugucaguauguaucaguaaguaccuuggggaauaauccuguaagaguuuacauccaaaaguucucugcauucucccuaacuuaauaguugcuguuuccaugccauggguaucaucuguauuccccaucauuugcuuucuaccccugcuuugucuucuuugcaacaucacuuccuaaugcagaaguguguuauaugugaaguaggaguucaauguuugcaucuaggaucacuuaaauaaguuuuaguuauaugauuuuauuauuuccaauuacacuuuuaagacauuuuugacuguuugaugucaaguuuuaaguuguuccauaaccguucuuuuucucuucugucuuuuaacagcauuuuuauuugguuggguuugguuuuugaagacagaguuucuccauauaacagcuuuggcuguccuggaacucccuuuguagccuaggcaguccaggucgccucaaagucacgacgaucugccuaccucugucuccugagugugucaccacuacccagcauaacauaauuuucuuaaacauuaccaaaguagaauauaaacucccuggaauagauucaggggugugugcguguguguguguguguguguguguguauuguuuauuguuuuaucuuuauaaacugagguuuauauauacaaguuuuaauauuuaauauaugccagaugaagaguugaaucccuugacucccauggggacaggugacaacagcagcagucuuuuuuuuuuuuaaauuuuuuuagauauuuucuucauuuacauuucaaaugcuaucccgaaaguccccuauacccucccccugcccugcuccccuacccacccacucccacuucuuggcccuggcguuucccuguacugggcauaugaaguuugcaagaccaaggggccucucuucccaaugauggccgacuaggccaucuucugcuacauuugcagcuagagacacgagcucuggggguacugguuaguucauauuguuguuccaccuacaggguugcagaccccuucagcuccuuggguacuuucucuagcuccuccauugggggcccuguguuccauccaauagaugacugugagcauccacuucuguauuugccaggcacuggcauagccucaaaagagacagcuauaucaggguccuuucagcaaaaucuugcuggcauaugcaauagugucuguguuugguggcugauuaugggauggaucccugggugggguagucucuggaugguccauacuuuugucucagcuccaaacuuugucucuguaacuccuuccauggguauuuuguuccccauucuaaggagggacgaaguauccacacuuuggucuuccuucuucuuuaguuucaugugguuugcaaauuauaucuuggguaaucuaacuuucugggcuaauauccacuuaucagugagugcauaucaugugaguucuuuuguaauugaguuaccucacucaggaugagacccuccagguccauccauuugccuaauaaucucauaaauucauuauuuuuaauagcugaguaguacuccauuguguaaauguaccacauuuucuguauccauuccgauaaaaacugcauggugcugguacagcgacagacagguagaucaaugaaauagaauugaagacccagaaaugaauccacauaguuauggucacuugaucuuugacaaaggagcuaaaaccauccagugggaaaaaaacagaauuuuuaacaaauggugcuggcuuaacuggcgguuaucauguagaagaaugugaauugauccauucuuaucuccuuguacaaagcucaagucuaagugaaucaaggaacuccacauaaaacuagagacucugaaacuuauagaggagaaagugggggaaagccuugaagauauggguacaggggaaaaauuccugaacagaacugcaauggcuugugcuguaagaucuagaauugacaaaugggaccucauaaaauugcaaagcuucuguaagggaaaagacacagucaauaagacaaaaaggccaccaacagauugggaaaggauuuuuaccaauccuaaauccaauaggggacuaauauccaauauauacaaagaacucaagaagcuggacuccagaaaagcaaauauccccauuuaaaaauggggcacagagcuaaacaaagaauucucaacugaggaauaccgaauggcugagaagcaccugaaaaaaauguucaacauccuuaaucaccaggaaaaugcaaaccaaaacaacccugagauuccaccucacaacagucagaauggcuaagaucaaaaauucaggugacagccgaugcuggcgaggauguggagaaagaggaacacuccuccauuguuggugggauugcaagcuuguacaagcacucuggaaaucagucuggcgguuccucagaaaauuggacauaguaauaccggaggauccagcaauaacucuccugggcauauauccaaaagauguucuaacugguaauaagaacacaugcuccacuauguucauagcauccuuauuucuaauagccaaaagcuggaaagaacagcagucauuuuuauaaggucuuuaaaaguagaagugagguuaagaagacuguagcccacaucuuucccuggcuguggcuuggggcuagauucaaagucauuuagugcuaacugugacuauucguugggagaggaacugauaaaacuagagccagggucagcugugaaaacuugagggaucagagcugugggcuguuuucaguggaguugaggguucaaaugagcugaagaaggaccauugaaacaauagaacucugcuuagaaguuacacacgcaggacacuuacagcagugggucucaagcuggagcaugcaucagcacugucucaaaggauucaacagggcuucuuacuaauggguucuagaguacacagugguagcaaguucacaggcgcaucuugucacugccugucuuagagaacugaugccccugcuauggaaaacauuuuguggaagcgauuaagacucaagaaacugugacagccgcugucacaccaugaugucagguagcaaccacugccuaccugcucuauccaugucacuuagucuccuugagccucuaucagaguacuggaaccaugaguuuccgucuucagcccuucuagcaccugucacagugcaauccaaggguuaguuacuggcacacacugaauuuuaauuuuaagcaauuauaaucauuuguucacuuuuaaaaccauguacuuuaaaaugccuugccauucucuugugcuucaguagagggagcuaugacacaaauuguacuaagcagcaacaacaaauuuuuugacuuccuauuuuugucagucucuauugcaguauauuaggugagugcuucguugcuguuuugucagauuuguuagacuggauaauuacuacccugguuaaugucgucgucgucgugguguucugggcagugauguuuuggccagugguggaccacauauuccucaggggucccacauauucugccaccugcugaccaucuuaguucauauuagcacucuguaaugcucacaugcugagggaagcucugacuguguacuccuccaaacccagcccauugguacgcgacaccgagugcagaggauacaguuccaccuucguuugcagucacuuauauccauacccaaacugcucugcuugcugucgcauugccugcuuuaaaaacugauucgaaaaaaaaaaaaaaaaauaaagauucacaugcaaaaaaaaaaaaaaaaaaaaaaaaaacugauucguuugaaucauaugguuugguauuuuagcagagugguccguauacaguugucagcaguuccuuccuuucugguggugcuauuucguauucuauuggggaugcacaguuuguuuaucccucuccuucugauggucuacuagauaauuuugaaaugaguaaaggaaaaaugauugcucaccccuugacuauggcaaucuguuuacauuuaacuucucucuaauuuaaaauuuuacucauaaacuaauuuuauauaauauucuauuaucaaucaguuaucaaaaacuaugaaugauaguauguguacuuuuuuuaaacaaugucuguaaauuacgaagugaugugucuucugcuguucuuacagccuucacuguuucauaggcuuugcacagguaugugaauuuuuuuaagaaauuuauucaucaggucuagcucugcaucuucaucggaacugcucagaaucaauuacugguuuucucugcaguccccagugagcccacuugguuuccugcggcauugacucguguuuuguccuuuucuuuucagauacuuguaccugcuguucucuggcgaugaccuucuaccuuuagaccacuggguguuuaacacagaggcgcacccucugccgguguugcgcuuagccaacagcacucuuucagguaauccugcuguccgaugagcacagccccagaaggaccauucuuaccuguguuuuguuuacauggaccacuacagagacugucugcagaggagaggcggcugugggaaacugggacucuuaugucaguaugccggaugaaacucuucccugcaagacuuuucacuuguacauauaucaacuuugaaauuauuccauuuuauaccugaccaaaacaaguucugguacauguaggacagagaccugauguguuuugauucuuacugagauggccacaugagaaacaaugucuuauucuauacugucagugcaagucaagaccauagagcaccuuacaggagcuagagauggcuuuuugaaccaguuauacauuuguuuucucccacaguggagcagcucucaaaucaaauauaacacauuguguagccccuuuccuccauuuuaacaauggaacaaaccgaaugagcaggaaccgaggaacauguaacuacauuguagcaagaagacuugggaaagaaacaaacagauacuggcccugucugaauuuuccagcuccucauuggauuuuuaccagacuggcaaccauuucauucccaaccuaggcauugaaaucuguuuagauugaguuuuucucugaggggcaugaucucaugaagaauauuuuucaagucguugucuccauauaauaugcugaaccugguauuuaucauaacugcugcuuaugagccggagugugggagugugcauguagcucacgcuagcauugggagcaugauggaaggagggaaggugccagauuguugccuugaaaucuguuuuagagaaauccuuaauuauucuucugaaucagcaacuauaucaagcaaacauuuucugcuuuaaucucauaacacacuuaauagagucauucaccuuacaacuccaugugguucggcaaaauugacucuacuguuaugcagcucuguauuugcuagaacaaaccuaaucgcuuuuacaacuuacuaaagcaaaggcaaaacauagcaaugucccuugaguagggucagguccuucacucauuaccucacacgugugaucuguucacaaagagucuauguuuuuaaguuucuccaagauauuauccauccaaagaauuacuagaauagcuucggaauaauuuucaguggcaaaugugugacguaaagaaucauacucacuaaaauuggcaugaaccuaagggacuuacagaccugcacugguuauuuuuguuguugauacugcucuauauuuuggcagaaaaaaggguaaauuuuuaucaagaacuauaguucuuauuauaauauaagauaaauaguaaugcuauaaauuuucugucccuugaauuucugugauaauucaagacacuuucucucuuuuauuucauacauacaucaucuauugaugacaauaaauuugagaacgcuauaauauuuuaugaaacacuuugcuuaugaauucuacuguggauuucugaaaacuuauuuccuugguugguagcuuuucuuuuuagccccguacuagcuuauuacuagcagauuuaaacuguggaaaaaauauaauuggacauguuauaaguugacugagcaucuuccagugaaaaccauuaucugauccucagauugagccaguacuccaaaaacuugccaccucaaacuuguucaguauugauaaaagacaacauggagagagugagcucuagcacaugucaaaacuguaucuuuuccuacuugaaauuuuuaaacuguaaaugagaaugguagauggcuauuacuuuagaaaaaaagaugagguuuugguucucagagaaaaagaaagugagccuuccucauacagcacaagcccacucccaagucaaaggaaagugaggagcugaaggugccaaagaccagugcagcaagcaggggaaccucuguuacacucaugcaguaaaggcgccaucuugguucccugggaaugcuccaaggagacaagaguccccccaccuacccagugcucugcauuguccacgugauccuagagcaguagagagaaggcccaggugugagcaggacauguucacacaaagaucuuaagacugucacuugacuguccucacccuccugauaagaacuagagcuuguaacaaugcuuuuuccucuuugaauaccaaaggcgauuaaagucagguacaaacgacugccagugucauguuugauuuuguuaauagaauuuuuaaaauaauuuuuuccaaaaucuaccauuaucccauauuuugcuuacuuuuuguguguuuuccuccaucguucauauacuugguguuuguaaaccuuaguacuuuagacuccauaucauuguguuuauaaacccugaagauaacccagaaaugcucauuaacugaugucucuccaaaaagcugguaccucaccuucagcuuugggcagagucgugcagauuaaauaauacauaaaaguagggacuauugaacaccuucuaauuccagauuuauugcucauuuuagaaucacaccuuuugguucaaaccugaguuuuagaaacuaaugaaccaauaugaagcucguaaaacuaagaaugagcccuucaccaagaagucucacugcagaacagcaaguuccgaggugaaggucuuucuucaggugggcugcacauuuugugcgccucuaacaccagccugucggugucguccagcugggguaugugcgcaggaaagccuggguguuagaggaacgcauucuuuuugcagaauauugacuaccugauucccuaugaugucaucucgggcgccacggcuucccuuggcagguuuuaaacaagcagucugaggucacgauccucagcuucuccuccuuuuugcucuucauuaccaaaguguuugucagcacucugaauuugucgguaaagacugacaaugagucucccuucaggcuggaguucucugagcgagugcauucgugagagaaugagggaacaaacagguacagagcaugucauacgcgucacgcuccgccuggcaccaccccggccuuacagcaugucacaugauuccaguggcaucuucuguaugagaguguuccauagcauuuuaaauauuccccaaaaugaaucauguuucaaaauucuuaauuuuauauuucauuuaaauuaaaaagggagauaaaagguuuauaauauauuuuaaacacuguuacuauauaauacuaacaacaaaaauuguaguuaauaacuaaagacucuugaaaaaugucaaagaaauauuugauuucuguugcaucuuugacuaaaauauuuacuucagaaauaaaaucauuuguauuuuguuauuacuuuaauuacaugauuaagaucaauacuuuguagaagucuguguuacuuuauaucuaaaagaaaaauugucccuuaauucauggguacacugugcaguuguaaauuguuuuuucucgaguauacuuccuaauaacgguggcaucuguauuucucgcauauagagaaaacauacuaaaauuucucuaacccaguuacuagagcauaauagauguaacuuuagguuccuucuuuucucugggcucuuuauccugggauuggcuggcuccugccucgucuguuuuugcuuagcuguguauauguacaguuauacacagaucuggaguauggucugcucacugauagguagaugauagaguugcuguaguccgcacagccugucugcagagcauuuaagucaucagcaucugaccaggagcuguuucaagucacucguaguucagggacacuggaaagcaugccucuguucuuuagcuccauaccccaauacaaguauucuguuugcucuauaaauagccagcaagcuuuucuguaaacagccagagaguguuuuaaggucugccagucauguagcucucuuauuacucauuucugcuguuacagcuauaaauaauaugcaaauacaugaguggaacugugaugcaaugcacauuaaaaaaaaaaaaaacagauggaggccuggauuugccucuuacaucauagcugcugaccccaauccagaauuuaauuuguuuaagauccucuaaccuauaaccugcaccuuuucucuuuuuuauuugcauaauucacuuuaaagcagaaauauguauguauguacacuuguauguaugugucaccuaaagcuguauauuuugcucucuugaaaguagauauauuuuucggggucucuucagguuuuaggauaugauugucaugaaagaggcagaaugggaggauaggcuuucggcaccuaucuccgucuuguuguuuaaugucauaauuccagauuacucaugaacaaauaaucuguauggcaucaaaauacucguuucuaacuucaccugcugaccgacacuuggaccaagaccuugcgauguaggaaaguaugcacucucuucucacagagcuuucagaugagagcauaguagaauucuggaucuuggugcuacagaaaacagucuuuuugcaaacugugggcaacacaaaauggguuaugugcccaauucacccuuugguacagccacugcuaguauguaggguguugacugcugucacuccuagagcagcguaagucugagugaagguauguucccugaggcgugcccccuucucgcuucauuucaugaugcuccacaaugcuuucacaaguacgucaguaugcuucacuuugcaaucaaagcauccuucaaccucagcuuuauacuugcacuguuuaacagucaaucagcaacugcaggacucacgaaagguacaagucugugguaucaucuugcuagcaucuauguuguggugugccaagccugaugggcaguaagcuuccugugauguuuguccagcacuucacuauuuuuggaaaugaaaccuguauucagaaugauagggcagagcgagcucgucucagccuuugucauggcauacauagaugaaccgccuuuccaggcccugccuacucaggucacuuccgcucugugugcacgugagcuucaguacuccagaaacacucagagcauacaugcagagcaggcagacaccuugcaguaaccuguaugcuacagaauccugcauaucgaugaagugcacacuagaaaaccaugagaagcagagcucuugauugacagaacuuagauguucauuuuuacuggguuaacuaaauacaguaucccugauuauaauuguugguuuagaaguugaaauaccauucuuuauucucacuggccucaaauucgcugauaauuuuucccuaaacuaauaaguggguaaguauaaccuuuguuguuauccacuggcugcuccuaaacugguuuccagucauguccuccauaaugugauuuuuuuauaaaucaaagguaauauuguauauugaagaucaaauaaagauguucuuuaagugaaaag

SEQ ID NO: 1609 - RNA, 30806 nt, Mus musculus
ggcuuccuggcugcgguauggaccugguuaaguguccggagcacgguaaggccucagucucgggauuucccucccggggacugugggacuggcuuggaguggccgaugcugaccuucuuguuuccucaggggacgccugcuucuuaaagaccggcguccgcgauggcccgaauaagggaaagagcuucuacgugugccggacgaacacaugcggcuucgugcaggccaccgagugagucuccagcccggcccgguuacacggagugacccagccuggucacuucagcugccuugggacgcggacucacccacacuccgauccuucuagagucugcuucaaguuucuaggcaccugucuggccuuacuuagccacuccccuuugccccggcauccuuucugcucccucuaaaaaguguaaacaaacaguggacaugggaauuaauuugcuagucuuguaccaauuuuaggucgccauuuaaauuuuacguuuaagguuaaaacauguuaauuagacacaagcuuuucuccuucaucuaguggcaugacguuaacaacccagagagagccagagucuuuagggcaguguuucucaaccugcgggucacgaccuucaggaucuaaggacgcuuucacagggguugcauuucaguuauccugcaaaucagauauuuuuacauugcgauucaaaacggcaaaaauuacaguuauaaaguagcaaugggaaugauuuuaugauuggggucaccauaacuguuguaacggguauuaggaagguugagaaccgcugcuguagggaguuagugcugaaagaaacaucagagguugauguggaucgcagguucugcagaugugaaagcugagaccuagaaaccucaagcaucuugucuaaagugaggaaagucaagugugacaaucuuuuuuuuuuuuuuuuuuuuucccagacaggguuucucuguauagcccuggcuguccuggaacucacucuguagaccaggcuggccucgaacucagaaauccgccugccucugccucccaagugcugggauuaaagucgugcgccaccaccgcccggcaagugugacaaucuuaacauaccggguguugacauucucgaagugaaauuacacuguggugucauuuaacauuucucccugcucucuauucagcuggacuuuguagagcaugguuauuuuuuuuucaguaucauagcuauacuaauauacuaaugaauauuaguaauauacuaaugaauaguaguacuggaauaacuuguaugauuugugucuccacuuuguaccagaauuuacuauuuauuucuagaaauauuauauagauaauguuucuaaauauacugagauuugguacccugcucaaauguuuuaagacacaugugugcucauguuuauaggaauugugcaucaauguuggucuuagguuuguuucaacauuaaaagaaauguucuuguggacuggagagaugggccaaccuuuaagagcacuggcuguucuuccagaggcccuagcuucaauuuccagcacccacuuaggggcugucaaaugucuauaacuucaguuccaggggaucgggugcccacuucuggccucugaaggcccagcauguacuugguguauagacacacaugcaggcaaaauaucccuaaacauaaaauagaaauaaaucaaucuugaaaaagagagugaagauucuuaaacagugugucacuuacauggcuacacugcaauacagacuaguacaguacuuucacucgaggcuugcagugugucugaggagcagacugcagacaguuuuacaagucacgggagaaugcuuuagaccuucacucaaaccuguucacauauuuuucuucuauaaguaauaaggagggacauuuaagauuuuaugccaggcaagcagcacaugaguaaguuauuguaagagggagacacgugaguaacagcacguggcaccuaauaggguauuaauggauaaaggguaaugggagaaccugaggagaagucacagcaggccugcccuauagccugccuuagacuauaagccaucccugggaggguugcaaugugggcaucauaggacagucaggaagaaaaaaauacagagugaguuccaggacagccagggcuacacagagaaacccugucucaaacaaccaaaauaauaacaauaauaauaauuauggccaugcuuugguuuagaaagugagaagagggaaagacuauggauccuuuccucaggaagccacacagguaaccaaccaucugugggacuuacaaacccaggacaccuugguguaacaucuguggcugggcugggugugguggcacacaccugugauccuaggacucaagaggcagaagaaggauugcugcaagucugaggccacacuggucuagguagugacucccaggccagccagggcuacucagugagacucugucuccaaauauguaaauaaaaauaaaaauucaagcuuggauuugacuucagacuguugaccucucucuauuucuugucuucuaauaaaguuauuuuauuguauucuucucuucuaguauuccuguuucucacuguuuauugcaugaggaguuuguggucgagcuucaggguuuguuucuaccacaggacaagaaagaauggaggugaguguccagaggaacccccccccacacacacacacauauccacacauacacacacacacccccaaucuugaaagaguuacagucauaguuuuuuuuguuuguuuguuuuuaauuuuuuaaaaauaagggauuuuguucuuuaaaggucauuacugaaacccuuuguuguacaugcugaucaucaucuagcuaccuuguuggcaauuccaaaccugugggucucgggucuugacccuuucacaggggucacauaucagauauuuacauuaugauucauaacaguagcacaauuacaguuaugaaguaucaacaaaaauaauuuuaugauugagguuaucucaacaugaggaacuguauuaaagggucacgguguuaagguugacaaccagugccccaaauacugacugagcuacccugagcagccaguucccccccugcuguucaguugcuaauaacaucaaccuugucaacuuucuauucugguaauagaaaaagggaaaaggucuaacaugcuaaguaagacucaguaaagugcaguuuuccuugggaagagcagggaaguccauauagaugggagaaguuauucgucaugaauauuaaaggguaaauagaaaguuaccagucauuagauagucuuuuaaaggaacacauugcauugggauaccaaggcgugacauaacaugaccacuucaagaauuggcuuggugguuuggccaagaaggcagggguuauacacacaugaugguuuuuauguaauagucuauguuuuagaauuuauguguucuaagucucuguccccaaucaaaggcuaucgaaauacuuggcauccuuguuaaaaaaaaaaaaaaaaaaaacugacccuaaguuuguguccgugccugaggugguuaguuuuuguccguugcuucauuuacauguucugugugguuguuauaugaaauagucugucuuccagcuucuucaagauugugcuggaaaugugggaucguuguguuugcauaucaaauauagauucaaccucuuaaauuucuacagaaaacucuguugagguugcauaacuuacacaggcagcuuugagagaacagacaucaauauuggcuuuuccaggcugugagcacggugcauaguacaacuuuaaauuuuucucucaguguuucugaauaauuuccauuaugcagcucuuacacuccuuuuccaaaguguauuccucugguuauguuucugcugcuguuguaaauggaauguuugucguucuguauguaggaagggggugugugccucuguauauuuguauauguuuggaugugugcgggugcugugugaggccagagguugguguugagugagucucuuggucacccuccacuucacuuacugaccuuggaacucaccuguuugcaagccucgauaggugacagcuugucuuagggacacuuugccugugccuccugagugcuaggaugacaggucggcuaccaaacccaccuguauuuuaaguggguucuuugguuuucacacuugcaaggaagcacuuuauucauuaagacagcucccuagccuauaaaugugauuaaaauagauagaugggggggggggagagaaauugauugauugauugauugauugggagagugauuguuuucuguuaguagagucaggcuggcaaaucuuuauuagguucaguccuguuccccugacacuuaagaucacuugucucuugauacagaaacaccaaccucuauaggugguagauagcaaccaguggcuuucuaauuugcauuaaaagaaccauggagguucaaaaguggagacugaggaaaagugcuuugagauaauagcugccaaagaacugagccgcauggcaccuuguuauccugugccuuccaugcccgacugcaguaguuggucucaguagcugguuuacagguggguguaagucugcucuucgagagguugggaagggaaucugaguuccagugguugcugggauucaaacccagcuccagccacugaacacagcugcuuucucugagugacagcuugaauugagguggugaggcugagugcaguuaggcugagagagcugggacggcaugccaucgccuggcgguacguccaggguguaccuugcuccaucucucaucugcgacagcgaugguggggcuccagaaagacccuagguugugaacaguuagcugugugauaccauuuggaguuugcuaguauuucuuguauguuuagcuacuuccuuuuucagacaguauuguggccccucuucuggcgcacacaauaucugguuauccuuuuucuguuuggcagccauugcuggucucucuccuuuguccuucauacagggaaaaaaaaagaguaaaccagggcauccuuucggguaucauaucauuuugauucuugacuuccagcccuaaaaauguccucugcaggggcuggagugauggcuuagauacgcugcuagcugugcaagcaugaagaccugaauucagaucuucagcaccacguaaaaaccaggggugaccagcuagggcuguggugaggccugcccccuccuucucucucucucucucucucucucuuucucucauuacgaguuuagauugaugcuuagugguuaagagcacuuggugcucuugaauaagccuugggauucuguucccauuacccauaauaucaugcagugcacaacaaaauugcaggccugaaucgaauuccagggaauccagugccaucuucuggccccuucaggcacuacauguauaaaugcaggcaagaugcucaugcguacacaaaaucaauaaaaacccguaaaagaugaagcucuuuaacauuuguaccuuaauuaccuguuucauacuccauuaggcuguucuuccgaugugcuagaaccaaggcggaggggaagcagugguguggaaacgucccauggcggcagguaggcauugcccaugugucuuccgcccacagaaagcaccccagucuguaagauugcugcuguccgucacacugccgcuaagcgcccugaaggguuuuguggcugcucauucaaagagccacugcuguggucaaaguuugauuacuuaccuucuguuuuacacaaaugucuuccagugucauaaaagcagccaguauccuccuacuuagggaagaaagacuaacagccucaucuuuuuuuagaucaguauugacuugauuuugauauaagcuaaauguaaugccucgguuccuagacuauaaaagacuauauauauauauauauauauauauauauauagacuauaaaagaggcccuauucuuguguaguacauggggacuugaucuggggaacaggcaacacucguaaauagagaaauccacauuguggcuguggauuccuugugaauuuggcauuuuuccuuuuuaaaugcagaagccauacuaggcacggacuguacuuacuguguuucccuuuccuccaaaaggacauuuuagauacaaggcagcccuauuuuauauuauaaugucuauuuucauuaucuauaggauccuaacccuaaagaacucucuguaaccaguaagccucagcagccaucugagucacagcuucacucucccagccagccgagaaacccauuuagggugcuuaacaagaaucaaaaaacacucgaacgaaaacaguuugucgaagaaggugagagaaagacagcugauaagaagcugagagaaaacaaugagcagcucuuggaucaaaggaaagaacagaagcccaaaucuaacagcaggauggagaaggaccccucaucugaccugguggcaacuagacagucuggaggugacagggaagaacaagagaaaucaaaguuccagcccaaaacuaagaaagcugaaggaauggcuuccaagcaaggccauggagaggugcuucaaggaauacccaaggguccucacaugucagagagugagagucgaggggucccgaacaagccagagacucugagagaaaaggaaacccagcuuuuggugccaaguguuccuggucagaacccagaaagcaagguccagaaagagggacacgucagcagggagccccucaagaacggggaggccccuagugcacaggucacccagagggggcucgcucaggggccucuccagggaccauccaagacuuggaggccuguuccugaagcaccagcagcaccugagcuuugcucgggaauggcccaccaugccaccuccagcagugaggacagcgaagaugaugguguuuccaguaggccgggguccccacuucucuuugacucgacuguggacucacagaagaaggggagccuucagcauucugaccagagugugcagagacagaugccugcugcuucagguguuuccaagaagggagauuccucugacccagcagcccagcgugcaaaccuaacaacacagcugaaacaaaagaaggugagucugcaguguauacugcccuggcagaagaccccaguucggguccaacacccaugccagcuggcuucaaacccccuguaaccucagcuccaggguucugacagccucucuucgccucggcaccuucacucacauuuacauacuuauccacaguuucugugcauacagauacacauaaugaaaacaaaccaaaacagcaggccagucuugacuugugcuuugucucuaaggcagugguuuucagccugugaguuggaaccuuguugggagucaauugacccuuucacagggauugccuaugacugucagaaaacagacauuuguauuaugauucauagcaguaguaaaauuauaguuauaaaguagcagugaaauaauguuaugguugggagucaccacauuaugaagaacugugcuaaaggguugaagcauuaggaaggaugagaaccacugcccuagggucaggguguuccugugggcagcugggagcugcucgcagaguugaguacauuccugagagggcuuucuaggggacugcuuaauaccugccuuuccuguguagacguaggcuuagugugcuagcucggaucuuauuuugcuuuuuaauccugguuuuuacauucauaauuagaagaucauuuugaguuuugucauaguaagccaaauuuaaaaguuugaagcuguccuuuaauaacuugagaggccaguuguguuugacaggaucuguuuuuuaggguacccuggcugcagugaacauccaggcucucccugauaagggugagaaguugcuuaagcaaauccaggcuuuggaggacgcacucagugcucuggcucucuccccagaacaagguaugaugggguuugcccuagaacucaguguuugugaacgugucagacacauuccgagaaagguugaguucauuuuuucugccuuauuguuggcuuccaggcguucuccuagugauaugugcugguguuugucacagcgcuccugcacgcugugcucugagaacagcugaagcucaggcuucucugggagccuccacgggcugcauuugcuuagggucuucacuugcuugucucccuucagucuguuuucccuuguguguugaacaggaacuaaagagaagugcagcgcucaggaaccagagcagagcaacaucaccaaagcugcugcugccccucuccacuugguaccuccccagccccuucccaggccccucauccagccugcaagcucucuaggacuaaaggcaggccgccaggaaacuccugagggagccagccagugcucaggagguaagguucaaaggacuuagcccugcuguggcaagcugauaaguuaugugcugcccagcagauauuugcagccacucgaaggggaagccguuuauucuuggauugaaaguugcacguguguuagauaucugauucucuguagagcuuugaauaguuguuuucagacuaugaagcuaggggcugguuacugccuuaugccaccauaagcccacccaccaacccagaagucgauacauaggauacacagacaguauugcguaugaaaaccaacuuauuacuaugaggcagguagcuagcagguaacauuuuuauuucccuguaugaaagauggggggaugggucaggcaugccuagaggcagagaagaaugaccuaaguggugacccgugccuucagacacauaaaaaguaguaacucccuaguuagcuagauuucuguugcuaacuuccagacaacuuugcaggucccuaggagagucuugguuguuuuguuuuguuuuguuuuguuuuguuuuaagguuuucuugguuuuauuuguuuuuugaaagagggucucaccuguuucagaaggcuggccgggaacuugcuguauggaccagguuggccuccaagcauuagguaaaggagugaccccccacgcccagcgccgagauagagccucgggggugcugucugaugacuggguuugcaggcaggagauuggaggugaaagggggcuggcagcaacaaggaaagcaguggcaguuuucucccagugauaacugcuacagguguaaaaaauugaaaggcagccuugacagggagugucuaauagauggggugggugguauuugaauuuaggccucucuaaaagucauugagaaaacauuuggucauauagguagccaucuuggcugcucaggaagcuuuuugggaccaaagcuuauguuacaacauuauuucauuacuuaauagugaugaagucaccuagggagacauuaaacuacagcagcuuauugaugugaaagaacaugugacaggccgggcgucguggcacacuccuuuaaucccagcacucgagagguagaggcagguggauuucugaguucaaggccagccuggucuacaaagugaguucuaggaugaccagggcuacacagagaaacccugucucaaaaaaaaccaaccaaaaaagaacaugugacaggucuuggaaagaguucuccuaagacaguguuaaggguuucagaacuucaaguugcccauugccuagaaaccuuguccuagaaaugcuuucucccuagacuugggaaccgcuugugugucuugccugugugggaugagagggccagcaguacaguaugacauaguccacugugaccugcaucucagggaucagcuuccugcccucacagaugaccucgugccuggcucuucucuuuuggauucggaggccuuugcuuccaggaucacugcccgggaugaccuuuguggccacugcuuuucagaacugaaaaauaagugaucaacccaccgagggccuggcuggagguggacucgguggcggugcuugcccgacguauucaaggccucacauauggucuccagcucuagaaaaauauuauagguuguuuuguucuaaauaacaguuguuugugugguuaaggaaucagaaugggaguagaaaagcuugugagaccaggagagccuugagguaggaguuuucacucaguacagauucaucauuuagcagauaauuacguuuuugaggcucuauccagaauacaguacuugucuugcuguuuuuauuugagagacagggccuccuguauucuaauuuguauggcauuggggaucagacccauuuaugugagucagguacuacagugacagcacugcauccccagcccucaggacacagcacuugugacaucuuuggggaacacuuaucuguccucaggccauaugaaccaacaucaucuuuauaauguguggaaaaucacgagugaagccauagaugagcugcaucggucacugaagucuuguccgggugaaacagcaguagcagaagacccagcuggcuugaaggugagccaggagcuacaaugagaauccagcaccccggagagcacugugacaccuccugcagagagaugccucaguggcuucugagugguuccuucuuuuuuguugaacaguaaaaauaguaaugaaccuuucuuuuucaagucauaggcuauacaguucuauaacagccaaggaucuguguuuucaguugcuauaugcuauaggauccaaaccaguucuuauguguaaugagcuacugcgguggaaauaaguaaaacaaaugucaucauaagacaaagauaaaaagcacggucuugccaagcagugguggcacacaucuuuaaucuuagcacucaacagccaguaggugaaucuaugcguuugaggccagccuggucucagagugaguuucaggacagcgagggcugcacagagaaacccugucucaaaaacaaacaaaaaaaaccaaaaaacuaacaaacaaaaaaauaagagggcuuugcaggccauguauauaaaguacaaacucaaaauaauggccaguaaguaguuuuauaccuuaaaaaaugcaaauauuuagagggcagagaagauaauaacaacacaggacaaugagaagcaggagugaggggucagguugguaguaaugagugauggaugggugagugucaccacucccucacugggaggaguagguagugcuacugagaauagggagagucccuugcaguggacccugacauuggcaaaugaacuuagauuugaaugguucaauauuuccugugcacuagugauaacucuauaaagguuuaugaauguugugaagguuuguucucucccagagcacagcauaaacuagggcacaaaagaacugggaggaagucaguaguugaagagcuguugcagcuugugacuaucaguccagacugggcuguugaguaggaaggagagucaaauauaaggaucaugaaaaggaacaggacggcuaguaaaagucaagugaccuucucaagcuugguugcaggcaguaaaaugugaagacaaaagugaccuuuuaguggagacauggacaggagcauccuaauagagaugcugaguguuagccauagggaagucuucaccagaguggacaggugaaaccagcagcucauggccacagcuagaacauaaagggcucaccuguacaaaagaggagaaugaagcugggguccagcauagccucucguuaggauucauucuggcauuugacuuauuuugucagguccccuugcuacugcaccagaagcaggcauuagccugguuacuguggagggaaagucagaagccacaaggagggauccuggguaaguuugguaaugcuuagccacuauguuaacugugcuguagugugggacuugauguugucccagugcuaagaggaagauauaugcauuuuucagauggaaaacuaaaguguagaaauguuaagagcuugguuaaaaacacauaguguaccaaaggagguguuggcaaccaacauuaguagcugccucugacuaaggaaagaguuuguuccaugcugguccccacggucuccccacagcuucuagcuguggaauaugaaccuggggaccagccuuuccagaagcacaggccauggccacaauugcaaacugaucaugacuuugcucugagcguucgaggaagcuaaggcuuccgucugcccagaguucagagacuuguaauaggacccacaauauuuaguccaucccacagccaugauguacacagaucaaaaucagcagaaggcucacaggacagaauccugggagcagucuucuggagccuucuccuaaugaagucucaugggucacacuuaaaccauccuagcaguaaguuggaggauguuuccagccacagaagcauuuuggaaacuuagugcccagggaguuuucuaggagcauguaacauaggcaguuucauccugguagacagcaagauuccauccuccagaagggaaggcuguguuggcacagaacuacgucauuuauacaaaugguguaggcaguuuggaaaugugagagcucgccuuacauguuaguuccauggguagccauggccugauguugggcagggcgcucagacguugacucacacacaggcuguccauguugaugcacacacugugucagaggcagagugaaccgcucuacugccgggucacagugaggaugcugaaagacuauagaggcuggugagauaauccaagugucgcauuugguaugaagaguacguuaggucaucucaguggcuggcacagggacaguguaaugcaagaagugucugccacagcuagugacauggcucaguaagcaaacacuuguaaaagccuggugacccaaguuugaucuuuggaauucauguaaaaaguagaaggagagaacugacuccacacaugugccuuagcaugugauacuuuugugcaugugcacacauaugcacgcacacacaaaugugugugugcguaauauauauauauauguauauguauauauaaaaugaaguguucaguuauggccuuugauagguaaaggaagugcaugauagacugcugaacuguggcagaguagaguaggugauaggauauguuagcuagacauuuuuguuuuggggaauaacaaaaaaagcaggcaccgucaugaaacugaaagucaauccacuguuagauaaauccacuguagcagggaaacugagguaagaguaagaucuagcuauuuauuguaugguaucugaccucgaucuccauacaaauggcaggaggccacuuuuuacacagagacccauaggauagggaguaggccaauuucugccaggagucuucucuuaaagucauguugagccuuuguuucuucuuauuuuuagcggaugauaugggcuuaggaaagacucugacaaugauugcacucauccuaaccaagaagaaucagcagaaaagcaaggaaaaggagagaagcgagccugugacguggcuuuccaagaaugguagguauaagcccuucugccauucccaaccuuauuugagccagcagagggagguuuucaagcuaacaaaugauagcuuuggucacaucuaauuaaucuguuauaaaaccaguauugguuacuuuccuguguuuguucuuucuuucuuccuuccuuucuuucuuucuuucuuucuuucuuucuuuuuuuuuuuuuuuuuuuuuuuuuuuugacucuggaguuuuauucagugggucucuggauuuagaaguuguugggccucuugguagugcagcaaggcuuuugcugucauggaagcacuugguggggcuaugguaacuugaagccaugaaacugcuugaugcccagcuggcuacacccucuuuuaccuucaugaucuggaaggagugcucgugggcacggaacaugguuucacauaugugugaacauggugugaccccgccagugauuguuagguucccuugcucccagugcauguugugugugccagaguggggguccuagcacggccagaugccaaaggucuucacgugcagugcuacuucucagacacugccugcaguacacugucucccuggaagacugacuucuucacccgugacacgagguacuggaaaugaggccuggccaccgcgugguuggaugcaaagaugcucauucaguacaguggcucugugcggcacuucagggugggcaagcagcgcccugccugguaccccgaagugugccugacaccuucauggcggucuguccucauucgccaccaucccuccuguguuauuucugaugcugggugugcaguuauaaaugacuucuccguuuuauuuaaauuuagcuugaucugggauucaaaaaaguuuuuuggagauaggugagguccuagaacagauaguccaagcauaguaauuaguguuuucuguuggugcuggggauaaacucccagguauauccaacuuaagguaccuuuuuaaaggugcauauucuauuuguuucuuaacuuguuuuaaaaauauagcuuuaugcauauuuuauguugauacauguuaucaguaaauaccguguaaauuaccaugaacaugaacacaguccugcuuuguuuauauggccagaagcauguagcgcucucucucagggccugugguacacacuguugcagcugggccccucacccugcauggaguaacacacacacacacacacaagaugagaaacauugguaaauacugugugccaauagaugguuacaaaucacauuugcagggcuggagagacagcucagagguuaagagcauggacugcucauccagagguccugaguucaauucccaagaacuacaagauggcucacagccaucuguaaugagaucuggugcccucuucugguguacaggcauacaugcaggcagaacauuguauacauaauuaaaaaaaaucuuuuaaaauaaucacauuugcuucucuuaggagaaguucuuucuacucauuuaaugcauagcaauuuguauuuauauuuuaauguaauuuguuacauuuuuauauagaaaaacacaaaacaauaauuccugguagcgaaucaucucaggaguccuuaggaaagggccugcuuccaccucuagccacgugaaagagcauuccuuuuuagacugggucacacacugcccacuucccucccugucauucuaaaauaaauaauuguuugguuuaaaagacugucucuuccguuuucuauucuguuugcuuuguguagaacuaaaccaguaguuaaaaguacugauugaagggguaaagucaucauguucaaggcuguucagcgacuguaacuagguauugauuucuuccucuagacuccucugucuuuacuuccaguggaacacugaucgucugccccgcuucccugauccaucacuggaagaacgaaguagagaaacguguaaccagcaacagacucagaaucuaucucuaccaugggccaaaccggagucggcacgcaaaaguguaaguaagugggaagugccuggacgugucugcaacucacacagggagcccguuugucuuucugcuugcccgauucuuuggggcuagucauauggguggagacugaggacaguuuucagucuuaagugucaggcagguugcgcucaaacacaccucagaguuuagugguuucacuuugccauugccagucacucuuccuagcgaaagcugcaguaggaggggcuugcagugccugggcugccuaagguggcagccacauucccugguaagcccuggggaacgaggaaaugucagggucucucuugggcacugaagaccugaggcuagaacucaucuuccauuucccugaguguaaaaggaagcacuuagucuuaugcgauaucuugguagcgcucugucaauuacccgcugugggcuguguggauguaaguaugcuuaugacuguuuuuucacauauagacuguucaguaagguuaaacgcaagaguuuuagaugcagaauuguuagacuuaguaaacauucuuggaaggggaugcuugggagggagacgagaucaccccagauggcaaucuuuagguuuuggauuuugggguguuuuuuguuuuuauuucuagugcuaggacucaaauaccuuaagcauucuggguaaacaccuuaacacugaguuacagccuguuaacuugaaggaccuuccagaggacccagguucaauucucagcacccacauggcagcucacaacugacuguaacuccaguuccaggagaucugacauccuuacacagacacaugcaaauaaaacacuaaugcauguaaaauaaaugaauaaauaauuuuuaaaaaaucauuccuuaauaagaaccuuuguguguaaacaauguagaaaagaugaacugaaagcguacuacauuuuucugcccaaaacuaaguuaauggguuuuuauaaaucuauuguaaagugauagcaagaagguaccauuggcaugggguugacagugcuuugaagaguucuuuuuucuuggacaccugagcaucaccuacuucaaaucauuaaauaucaguuuccagcccugaccuacuuucuauucugaucaggucauagcaaacuuauuaugacuacagcuagacauuuuccuuucuggcucacuggaugguugcuggaaugaacagucuauauaggaagaaugaucacauuaguaagagauaaggaagucugauagaaaaguccaccucauauuucacacauacacacagagagagagagagagacggagcucauguguguaccaaguacauaauuaguugaugucaauucugcuaucuuuuuuuuuuuuuuuugucucuaaguuuuguuuuguuuuguuuuugcaguccugggaaauaaacugagagccuugagcauccuggcaaacacccuaccccugagcuauuuuuucuccccagcucccuaggcccuuuuauaaagaagcugccucugccacugccccuggcaggucccaggaggaauuguuuacuguucgcuuuuuguauccacgcagacucucuacguaugacaucgugauuacuacuuacagccuucuggccaaggagauuccuacaacgaagcaagagggagaggucccaggagcaaaccucaguguggaggugagacuuaggggugccagggagguagaggaagggccacacauagucuuccugcccggagaagagugcuccaggcagcccaccugugggacugagucccucugcuccuuucuauucuggacaagcacccagugguaaauucguacuuggcacagagcucagcuacuuuuacaaguaaagaaacauacauuauaacugugguaauaauaaucacacuugagugccgaagagccucacaugcuauuuucaucuuagacuauauggaguauacacuaauaugcuguucuuuauguuagacuauauggaguauaugcuaaugcucuguucuuuaugucuuuauguaucaaccuguuacugccugccuuucuucuaccucccagaaaagagcuuugcaaauaauagggcuacaaaugggucagaagcuaaaccaugaccuucuucauuuguaggcagagucaggaaucuugucagcuguuucacaggcuuucuuguacaauuuugaagggauuucuguauucugggugauuuauagaguaucauuccagcucaaaccaagcuaagugcuuuucuauggcucuaagagaaaaacccaaauuccuauguaaugucucaggugccguguggugcuggccucucucuccucucuccccaucugcgcccucccugaggcacugcaucuugugugccgucauaccugccacccucugggcuucucugaguagugugcuuagcuaccucccuuuucucaggaguguuuccuaaccaguuucaggaagccuuucugaacugcuuucuccuaggcguuuggaugcgugccuccuggcaccuugugcucacaugguuguagcucuguucagucagcugguguggaggcucugcuggguugggggaagccuccacuguccuguauugagugacuucugcauagaccuuaugcucucaugacauucuucucucuugccagaguuugggcuucuggagggucugagauggccuuucuguuuuugacuuagcaucuuacaccuaaaaauuggcauauaggaaguuuuaauaaauugaauaaauacuuuacugacuaagcgaauuuucaaccuuauaccuaguuuauuccugacuaaauauuauuaauggugcugcugaauguggguggagagaauaaauggaaacucggguauauucuguuuggagugaccauuuauuugaacuuuuugagaaguucugugcuugguuucuaaccacaguucaguggaagagucuaaguaaauuagagggucugagugggcccucagguuauguucccuccucuugaggacacgugcauguucccacacugacugguauuaaaugauccuuuguuccuuccaggguaccucagcaccuuugcuucagguagucugggcucggaucauuuuggaugaagcucauaacgugaaaaacccucgaguacagacauccauugcuguguguaagcuccaagcccaggcccggugggcugucacuggaacccccauucagaacaaccuguuggauauguauucacugaugaagugagugaccucuuuggggucacauuaaugugaccuugucccuguuuguaacccuucaucauuauuucaugccuugggauggagcucugauguguccagauuaucuuguguggcagguggccagcuuuagaggcaaagaaugaauauucaugauaaaguauuaaugguuugauacaguauuuuaugcagacauauggagcagcuugaauuaaaggaaaccaaggucacuguucuucagcccuguggcuguuuuaggcugcuugcuuuaaaauacaugggccagagcaggacugcaauguauuugaggcaaacagaaaagaaugcuaacuuuuaaaugcuaacuuuuuaaaagugagcccauaaaagucuuuggaauuucuucgcuaacaucgaugcuuuaguaauaaauucuagcuguucauuauacauccuguuggggcuguuuccauuguuccuguaaaaugcacaacuuuacagugugauuuuccuuacugacuugggcuuuuggccugucaagcagacauuggcguggcuuucacuuucagaugggaugggagcauggggcagcagaucugauuuguuuucaucuggugucuuccuuuggacccuaauaccauccucuccaaucuccucuccugcuuugucuuuccuggcccuccaaaagguuucuccguugcuccccauuugaugaguucagucuuuggaagagccagguugacaaugguucaaugaaaggaggggaacgguuaagcauuuuaaccaagagccuuuugcugaggagaacaaaagaccagcuggauuccacugguaaaccucugguaaccagauuucugccuauccccagggaggccugggagggaaugugaucuggaccucagguagaccacucagugucaggagccuucauuuccuucuggggagacuccugagagcagucccuggugcugugcuagcucagucauuugcagggaagaggggaccgcagugcagagacuggugcagcgagccagcguguuagcucugaaguacucagugcuuuacagagcuucacagcaucuccuuucccauuccccagguagcacugccugcacguagaugccagcugcaccgguuaaagcuuucugaggacgagcgggccguuuaugacaucuuucuugcaaggucaaggugaguaccaggaggaagcaccuucucuaugcuuuguuuuuucuuucuuggcuggggaagaauccaggcuuauauuuccuuaaguuucacauagaauacuaauguguuacaucuucauuuucccgaaaacccccaaauuuuauaguucuuuuuaauuucuuuuucccuuccucuuguccuaucucugucucuccuacacacugaaggcagaauuuugaccccacuuuuaauugucuucuuuaccuagcaaucagagaguauaggaucugucugccccuuuggggauuggauaauauauuggaugaugacucucuuuggccuuugaccuaccacgcagcgucucacuggaguuuaaaucccagcuuugggaucacacuguuugcugucagcaccuugucuagaacucuugucauucuucucuuacuccuucccaugggccgauaucuguuuccaggaggauugugccuuuugucuuuuuauacuuuagacguacuaugcguuuuuuagggguuuuguuuugugaauaauaauaauaauuauuauuauuuugcuuauggcccauguuggcugugagcugagcagcauuuagccaguacauucucuauccugcccaggccccgcuccaagguaagagccuggcguuaguggcuguaaugugugcauucugacaggucagcucuccaguccuaucuaaagagacaagaagguagaggcagccaccauggaagaagcccugauaauccauucaguagagguaagccaggggauauucaacuaugaauagcugagaaaggaaagugggauuucuagcccuuaaaauaacaaacagauuaugggcccuggguaucagagagaccacauuuuaucaaagcuuguuaagccagagaaauacacacugaucugaaaaauguaaagacuuuuuuuuguuuucuaaaucuacauuauuuaaaacacaggcaugccuacagagaaacccaguauuucuuucuuucuucucccucuccucuccucuccucuccucuccucuccucuccucuccucuccucuccucuccucuccucuccucuccuuccuuccuuccuuccuuccuuucuuuuuuuuuuuuuuuugagacaggguuucucuguauagcucuagcuguccuggaacuuaguacucuguagaccaggcuggccucgaacucagaaauccgccugccucugccucccaagugcugggauuaaaggcgugugccaccacauuucauuugacuucauaaaaguauguuuuagggcuaucaggaaggcucagcugauaagggggcuuggugccaagccugaugccccggguucaauccccaggccccagaguguaggacaacuuuuuacagguugucuucuaaccuucacaugcacgccuuggcacacaucacaccacaaagguugguuggcuuguuuguuucaagguuauugagugucaggucaaacuguuuaaguagcuggacucagguccgcuucuuccccagagcuccuguuuuaaaucuuguacugucuccucucuugucuucucuccuccaguggcucaggaguuuggauccagugugucccagggcugcccugcggcagacucccaaagacccagcaccguccauguccugucccagcuucugcggcuucgccagugcugcugccaucuuucucugcugaagucggugagagacgccccgucuguagucaucuccacagucggcuguagccgggauccugcgucagggaaaaggcuggucugcagcucucuuuuaugggauggagaggaaacgcauuucuucugcuuuacuuuauauuaauguuuauuaaugcucaugaguuccaugacaagauacacuuuuuuuuuguuuguuuauuuuagaucacaacugacauuuuguuaagggaaacauuugugaguguuuuguuaucucagaaugucauaaagcuuugggaguuacugguguucaguacucugggguguaugaaaacccaagcacacacugggaggugcuuuuguacugggugcaggugugucuaggauucuaauuaacugugugcucacuucagaagcuuagacucugaaaacagaaugaccauguaggccgucagcagguuuuuaacuugcgucaagcuuuacacagggucuuuucuguagugccugagauaagucauuuuacucucgacuguuggaaaucagcagguacgaaggcuugccaccuccauuguccuguguucccaucuccucucuuucuuccaaggcucuggaccccacagaacuggagagcgaaggccuuguccugucccuggaagaacagcucagugcucugaccuuguccaaggucgaugucucagagccaucacccacgguuagccuuaauggcacauguuucaaggcggagcuuuuugaugacacacgaaggagcaccaagguacuuuugucaccugugcuugaugacagauauuaccuuucucccuguguugaacauuaugcacgugggaagagcuuaugagaggagaguuagaaggucagaucuuagaucccccuuagucuuaaagccucacuuggucaggagaagcccaaagccuucauucucuuuucgcgccaugugggguccagggauugaacuccagucagcaggcauucagcaagcacaguuuccugcugaggcaccuugcuggcucuugguuaaaauuuuagaacuuaagccuggguauuuaccauaaauaacuggaaaaucagagcccuguaugcgagcagauuauauauacucuagcaucguuagaguuagcugcuguggccuugccuaauacucugguaauguucuuaacacaaggccacgaguagacucaaaccguguuaggcuucguguacacagggaacagcuuaaagccagcaaagcucuuuugcuuucuucugugacugucaggcuagaaccuugccucuuccagcaguggucuggcagccagaagcacaggagggauccagacaugcauguguucagcuccucagaggaucuggugucccgaaagcaaaggaaggcuacuaagcaaugguuguggcgugugaucagaaccauggcacugguguagcccacacgaaguuggggaggcuuucaaaaguaacacccaucauaccccagcaacauggcuaaaugagaccggaacaaugacaguaccacagagacaugcuaagguggaagagagucuccugggguccuagcccuagcaaagaaguacuggcugcccaagacugcuucugagagacagagcagccucucccacuuccaagugcuuagcucuagaaucauauauauacaagccauacuaaaaguauauaaguaggccacacuuauauauuuauauaaguauaacaauaauagaggccauuaguguaagaaagagucgagggugcaugggagaggcuaaagguaagaauggcaaaggagaaguauuaaaaagaaaauaaaaaucuacagcaaaauuaaaaaaaaaaaaaaacaaaacaaaaccaugacauuaagcuggcauggaaaaugauacuaaaguagagggaccagauguggccuaucgggucaagauuucagcgugauugacauguccuuugaggagcgcauagugaggaaugaccagcgcagaggccagagcagcauggacacagcagguaagauuggacgcguaggcuuuauccucauuaggaugucauaagaggaggagggcggccugcuuacauuuaaaaaacagcuuuccagcugcaggagagggaguagucaagccaggccagagcauagaggcuguccuggaaagugcuucugucacucagggagagaagagaaaaagcaaaugaccuaaacugcaauguuauguggccuuucccaggugucuucucugcuggcagaacuggaggcgauccaaaaaggcccagggucccaaaagaggugagcagcaucucaccacuucugcaagggucauaccccacagaacacacacagcuuauagcauaaauucccuaacuucuaauuaaaauacugugauguguauugagugagaucccuggcuuacccuggcccugaggaucuaaauaagguguuaucugaauagcggaagaacagaagggugagaggggagcagggcagggcaggucugcugcugagcugcuugccuggggcuuagagucaggcuugaguuguccuuugcugugugucacauguauaguguuaacacaugcacaccgauaugacuguauuacacagacacguuuauagacaugaaauaguuccuuauaaaauuguugaaguucugguuaagacacacgucggguggucacaagaugaguagcuacugccccuuucugcaggaccacagguuucuggaugaacacuaggaccccaagcaaaagacagcagacaucauuacuuagccuagccagucuuuuuuuucuaaguagcaccaaaugagagugacgcuuagaaacaaauggacuauaaacuuacaccaggaccuuaaaucaugugccuguauuagcuucaugccaauacugggaaaggaggcucuuaaaaaggcaacagacuuuuagcccauggcuccagaugcuucaguuaugacucgaugcucccauuggcuuaggcugagggguauccgcauucgcagggguacauauccgaacaaggcaggcagagggaagaagaggugagugcugcagccuccugagagcucugccuccuccaggcucuccucauaccauucacccccaccccccacacacacacauacacacacacugccaccccaugacacccuuuacacacaggucccagggggacacucuccaaagcacagcauggccuugcuggucaggugacaaagucuucuuaauguacauuuguaacuaaucuugaggcuaguggguuacagcccacgggggagacugcugaguccuuuuaguuguguucucuccucucuagugucauugucucucaguggaccagcaugcugcagguaguagcacugcaccucaagaagaaccgacugacuuacgccaccaucgauggcucugucaaccccaaacagagaauggaccugguggaggcauuuaaccacucccagggaccucagguaugggcgcagcaagugugcaaccaaggaacgaacucuucuuaguuacaaagcagcaagguguagcagcuuaacuuaaaaaguauucggccuugaucccuccaguguuuguaaguuuuuagacacuuauugcagaucugugccaaagugcaccaaugaucuaaagagaauaacuuaacuguuacuaaguaaauaagcugaugaguccgcagggcaggcuggugugggagaaucuuugcagagcaggaagccuugcagugucuguggcuuugaugggagauguaggagaacagggcccuagcauaguagggauuucagaaguacuagcugaauggaaggaaggauaauguagcuguggggacauggucucaagacuaguuauaauuuaaugcaaggucaccccccccccccccaaggaucuuaauuacaguguucacauacuuuggcagcugacucucaugugagacgggagaauuuuuucaaaggugagguaugaaaaauggcagguuagugguucaaaacauuauaccauggggaaauuugaaaggaauguguuccuuguguguuuugaccauuuugaacuagagcuggaaagaugcugguuagcucucuuucuguuucuacaaauacccccuccccccaaacaccccccauaaagagacagggcugcuuugggcuuguuuuggagguuucaguagucucccauuuaggcuucuguucugggcggguaucauggccagaguguguggagggaaacagccacacgucucaguaaggagguaaagacagagucaaggccaaaggaagugaagaucaaugauacugaccccauaaaggcuccaccaccuuugaucuagugccaggauggggccaagucuuugcugcuuggcuuuugggggaacugaagacccagacuguaguagcugcacuauaagggcaguggguggaaguuuaaugacguguuuccauuccaaggucaugcugaucucccucuuggcuggcgguguuggacuuaaccugacuggaggaaaccaccuuuuccuucuggacaugcacugguaacuugaggaugcuccugucccaacgucagggagggcaguggucagagggcagcagucugacuuuuagaaagucauggugacauucuguauggccccaucugagugucaugugaagcuggcugacguccaguacugcugagggaccguuucauggcuacuucaugauuuuauuguucacuaacuuaaaaaaaaauuaacauuauuucuccuuaaaaacaagcagccagauggcgguggugauuaucucuaaucccagcacucaggaggcagaggcaggcagauuucugaguucgaggccagccugguguacagagugaguuccaggacagccaggguuacacagagaaacccugucucaaaaagcaaaacaaaacaaaacaagcaaacaaaauaccaaggaguaguuuuguuugauuuuuuuucucaugacuaagcuacauuacuaaguuugaugucucuggaguaccauuuuccagacauaguuuuugaggacucagggaagucacagccuuagauuagaaaccuuccuccagaaggaagaagaggauuuuucuaguugugauagaaaugcuuguuauaucuagccuuuggcuucacgaugugugugcuaccugccagucagugccuugguaugugcaccuccugguacuggacaggugaagucacauauggcuagguggaggcucacagugccaggcucuaauguucugccuaugcaaacugggguugcuguugcagacagccuuuguuuugcuugcucugcaguucuggggcugagcccagggcauugcacaccuagcuuuccuccuuacuguuuaccuugagauaggguuucacuaguugugcaggcaagccuggucuuuccauccuccugccgcagcgcuauagauaacugggaugucaggccugcaccacgauacuuugucccaggcccucuuucuagggugaugugccuaaugcuccacgcagccucaaauggugcaaagaggccaacuugcuaccuuuguggagaacguguggguuuacuuaggauccuuauauacacagaagugagaaaagcaugcuaguaaucacaccagucuugagauggagaaauauuacuccaauucuaaagagguaagaugagcuuaauuuagaguugauaaugagacuuuauaaggaagagaacaaauuauaccucuuuaacugacuucacugaacacuaaaguugaaagaaauauuugagacucuuaaccagcucuuacgcuuccaaguagguuccgaagccugguguuauaaguacuguguagcugcugguugcggcucggcacccuccacagucagugccuccuagauggagcugacacuucaggaaggucucaggcucugcagggcaccuagguuucuguugcguauccuuugucuuacgucauuuucuuucuuucuuucuuucuuucuuuuucuuuucuuuucuuuucuuuuuuuuuuuuuuuuuuuuuuuuuuuuugagacaggguuucucuguauagcccuggcuguccuggagcucacuuuguagaccaggcuggccucgaacucagaaauccaccugccucugccucccgagugcugggauuaaaggcgugagccaccacgcccagccuuacauuguuuucuuaagccccuugagaauguaaugacgacuuuuagcuaaagaagcauacaaaaaaggacugucauuuggaccuggcaguaggcuguugguguuucugaguuauauaucuccucaaacaggaaucccucacuugaagaccaagcuugugaccggauuuaccgaguaggacagaagaaggauguugucauacacaggugagcaaaggcaccaggccccuucucagcaucucccuuugugaaagacuuuccuggagaguauuuccaucgacugugaagggcuuggugaucagcacuaaugauaugcaggcauaccuaaggaacucuagucaggaaucaaacugucugauguaaccucgcuggccauggccagagaucaauugugugcggggaugagccacagcucaccaaggaggcagcuguggaaggcguccuuccugcccacccuuuccuuguguaaucucagucauaaagaaaaguuacaaagaaauuaccagaaaguuccugugugggggugggugggugugaauguugggcauguuggagguaaucaaguucggugauaacugguuuucccgucuuuagcucucuuuucugcucagaggucccaaaucucuauuuuuaguuccacugucuccuaagugucaaccuggguauccagaucucugcuaaacaucuaagccuaacugugcaggucaucauccaucuucauuaguuugugcgcucagauaccuaagugaacguuuacugagcaccugaauaugccaaguguaauuacacccuccaggauaaaaaagccaagcugaagucuuugcuuccucugccucaguaugugcauguacacuaucuggggaaauagcauccgcuuaucuagcauacagacaggaacuggacuccuucuucucccucugcccaggccaaagccuuagcugugcuuucuaaacuuguaacuauccuuuccuuccaucccugcugccagcucccuuuccagcucugcugauuccuguccucugcauugcaaguagaaggcucuccugagucaucugucugcugggacaugucacaccuucagcagcucacuccuguagacuuacucucagugucuucagcagcucacuccuguagacuuacucucaggguuuuggcaugucaggacaaccacuaaggaucuggcucacagcuccggaacuuugccaccagcagacuugacuggacagcaggcucuuuaauuaaacauaccacguucugaagcucggccaguuuguucguguucucauuccuggggggugugccuguuguauccugucuagcaagcccuggucauccuacaugccucacauuaaggauuaacucugauggagccuuccuugacugcucuacacagacugccuuuuggacccuggacacacucuugcucagucacuucccauagggcauaguguauguauauguauaguauaugcauauauauauaguauauaguauauauauauauauauauagagagagagagagacagagagacagagagagagagacagagagagagauacagacuuagucgguacuugagugacagcagggugacuucuucaauuugaaaagccuggcugugcuauggauuagcuaagaaguuaaaugcuccacuuaaaauacacacagacacugucagaaggccuucugaccuugucaggauaagugucuggguaaagguugggccucuguauuuguuuuagauagaaauaccuucugcaguuuaaauggacauauucagugaaaguuguguggauucccuacucuccacuaucucagggaaacagacagucuucugugaaagcgaaguggaguggaguuggaaggcucgcuuucgugagccgugcgggcucugauguucguuauuauuugcucuuagguuugucugugaggggacaguggaagagaagaucuuacagcuccaagaaaaaaagaaagauuuggcaaaacagguccuuucuggauccgaaggaccugucaccaagcucacacuggcugaccucaagauccucuuuggcaucuagcuucgucugcuggagugaugcucuuuccaugauccuggagucuuagauuucauccuacucgaagugaggcuuguuccuaugcuaggaauugaggauggguuaccagguuaacaaaccaguuagucagucagcuuguguaaugugggccauagaaacccauugguuauuucagaauuaagccuggcauguuagugcaugccuguaauccagcaagaagauggagagguccacuuuggccuguuguagacucuuucucaaaacaaaccacaaagugcucuggaaggcagccauguaguccauacuucccagcaccugaaaggcugaguggggauugugaguuagaggccaguuuaugccacagaguacauuucaggccagccugggcuacagaaugagaccgugucuuagaaaaacaaaguaaaaccagugaagcuuuggcguuggauggccuggaagcugagucuggaagaacuguguaagugcugggugugaugcucagggagccauuacaagcauagugacacaugcuuagaaugcuggcacuuuguaggcaaaggcaagaggaucucgagucuaagguuagccuggguaacagugaguucuuuagcagccuuaauuacaugggaagacccugucugucaaacagccucaaagcccugugcugccauguuugggacugauggcggaccuggucuuauuaccuugccuauguaggcucuguccuguuucccugcuggcaggcugcgucuuguaagccucuuuguaaccaaccaucccuaugaggcuggcugaaucuaggcagguuuagggucaagauauuucauauaucuugaguugaguauuaaucaugguaucaucuagcaucucucauuuagccugugcaucaugguuucauuuagggauauaucaacaucagugugacugugucacucaguuucaucacuguaucauuugauaucacaguauuucauauaguauuugucuuauuuaauguuuauguccauuucaguugccaguggcauuuaaucuguugugucacuuaguuucugccauuguaccacauuguguuaucauugguauggucuuaauaaacgccuucggccgugcac

SEQ ID NO: 1610 - RNA, 2532 nt, Mus musculus
ccauguuuggguaagaaguuuauuacaaggguuauuaaugccaaggacagacagcagcauggcaggagcccuaaugaguguucaagcccacgggcagaguuaggagggcaccucuuagaggucucaggaaggggauggggucacauggugagcgugcagccaggcucucucuguuucagcggcugcagaguggagagcagaagggaauuccaggaaagagaugugcagcucugaggaucuggggaagugaggaagaagggccuggcuaguugacgucuauccaguauaugguggaggcaugugucaacgcuggugcccuuuugauauuccaggggguccagcccugagguuuguaaauuugcuuggggaagugaaaaacuguggcugucugucauucucugggagucuggacaccugaggaaacuguugacacucuccuagaugggcuuucuguagggggcccgucauuuccugacagugaccacugcuauaaaaagaagcuucuuuggguagccaugguugaguggccuggccuauucuaacacaacaucgcagccugcuucauuugaccaugcuugccagcgucauaucacaugcgacccaggggacuaauuaucauucgccuggaucauuugaaagaagaaugcagaaagagguuagaaaaaaauuaaaaauuaaaccaggcauggugacacacucccauaaucccagccuuugggaaguugaggcaggaagaucuuguguuugagguuaguucaggcuacauagugagacucagccucagaucaaaacaaacaauaggaaaaaaaaauucaaaaucucucucucucucucugccauugauuacauuuucaagaaggaaaaucagaugcaagaugaaaacuacaauugagaacagaaaaaaaauaucuaggccaccaacucugcagcucugugccaaacccauucagaacugacagccuaaugccagggaccgacacugcaugauggcggccaccuuggcucuugcauggggaauacacucgguagcugguuccuucuccaggauccuggaggacuuucgggggaggugcguuacaagguacagagacauguaagacacaggcccaagccuccaggagcucacaguaccuaucacgagcaaaugucugggcucucucuugauuuccagugaagaggcagucuuugacguguaaagugcuucagagaggccccaaggggucuuuucuuuugcacuuggagguuggucagaacgaccuaucaaaacuguuuuaucacugggaauccauagucucggaaauuguauagcuuaaccuuugaagaagagaggucuccugucguuaguuucccaagcaaagcacagcugcuguuagcaucggauuguucagaauagcccugauuucaaauaguucagaaauguaguuggaagagugcagugagugguugguaccacuuuacacauguggcuuucugcugaaugccuguaacccaggccuuuagccauuagcccaggguaccauuuccgaggaccugugguggccgcaguccucucugcuuugccucucugggaaaugaccaggagccccaaugccccacaugucagucuguugauggugccucccaucggccugcagcugcggaggaucggaggaucgcaugcuuuggcgugccucucuguaugguggcuuugacucuguggcggcauucaguuugguuuaagaucaccaaaggcaggaacccaggacacuuagccauucucaguccagggaagaaaggagccgaaacaaagggcugugugacaaggaggggugagcacgggaccaugcaagaagucugggagaagugagauccaaccagacagggacugugcccaguggcuuagauacaggaagugagaauugagcauaguggggcaaggagucaggacccgggauaaccuauaugucaugggucaggggcaaaagugcccuccuucauaggcacagcuguuacugaggacagcuuagugcacugugaguuucagaaacagcagugggaauaucucaguuaaaaauucagagccagccacacaguugagaacgagaacugaauuauacauaucuuuucugagggaagaagauuaaaggaaagguuuucuuucucucucuucuuuuuuuuuuuguuuugcuuuucuuuuuuggcuggugguuguaaguaggucauuggcagcuguacagcugcaauggccgggcagggggaagagguguguguugggaauguccugggccuguucuuccagugcacuugcagggcgagaggccugugccauuccaccuugucaucuacacggacuugccgauaaugauguguagggagacguacucgccugcucggccccgaucguugggacacugauugauugucuucuguguuucucugguugcagagcccacggucuccucccugaucugcuccucggggcccuugcuccacuuccucaucgucugccccuucgucaugcugcuccuucuggccacguccuuccucugcuug

SEQ ID NO: 1611 - RNA, 2317 nt, Mus musculus
gaaacuuggaucuccguauuuaauuuuugcccuugcaagaggaugcagcgugaggaacguggggaggguaagcaggaggagucgugaccuuggaaagcugugucacaccagaaggcaggggcuuggugggccagucagagccaggagcccaagggcaccgaccuuguuucagaucuuccugcacacugucccucucugcuuugucagcuggugggacucugcgcgccuucccacuccuggucacuccuuggaaacugacagccgugguaggaucuguuugccucucuuucuacagggaaaaaggaggugcuccuuaggauaggauggaaauaaaauggagugccccucccaagucgugccccaguaaaaagacucaauggcuuucuugggccaaccccacuaaucaugggagaaauguuuaauuucagccagauuacaaggcggcugcuuuuauuuguuuuuuuccuggauuugugccaaggacucaacuuuuccuguucauuuuauuaaaaaguuuauaaacagcguuaauaaauagauauaaagcugccguauaaaugacagcgagcccaaaugaaauucacaagggucaguguugaauaaguaacagagccauguccuugcgcgaucaaauucccauauaugcaaauuagacgcagagcuuuaccacgcuguuuuaauuaauauuuauaaaucacaaagugccuuggaaagggccaguaaccuacuuauacugccaucaugucacacaaauaacaaauccucuggggacugcugucuguuuugcauucagucagaaaaguaagcacguugcugugucugucuccccuuagguguggugucagcgcagcgacaggucaccguccaggaagggcccuuguaccgcacagagagcucccacaucaccaucuggugcaacgugaguggcuaccagggucccucugagcagaacuuccagugguccauuuaccugcccucugcuccugagcgugaaguacagaucguuagcacgguggacucuuccuucccguacgccaucuacacccagcgaguccgcggugggaagaucuacguggagaggauccagggcaacucagccuuacuucacaucacagaccugcaagcccgggaugccggcgaguaugaaugucacacccccaacaccgaugagcgcuacuuugggaguuacagugccaagaugaaccuaguggguaagugacucugccuccacauggccagugucaggccccagucccucccucaugugcuuuuguugccuaucgauaugauuccccagacaccuuagaaaaccgcaugagggagcaugagugaccaugaauccuaaguacacuugugaacccuggauggcuaaggcugacacauggaaaguucuugugcaagcaucaaucaccacagugguuaagcagaccuuugcuggugaaaggcaaaaugaauuuaucaaggccagauccaggugugguggcuucaugccuauaaucccagcauccagaaggcugaggcaggggacuacccugugacaaggacauuugugggugauaauuugaagaugugacuuggaagggaaagugggugagaccagcaggaagagcggcaacaccccagauuuaagcaagggcaaaacucccagcgugaggcgacaguagacacacagggacaggaggaucauuacaggagugcaguaaugugugugaggggaaucucaggggaguggcugcucagauaacacacagagaguuccagaugcucagaggggagagacaacaagcagggggugggaccauuuugaggugucacaggugauuuuagugaaccacccaggcgguuugucagacagcgguaaugguucuuuuugggaacagagacagacaauagcuugugacugaagcugcccauguacaguguguucuuuaauuuccuugucgguagauaggaguuuaaugagugaaagcuuuuucagcaggccuguucuguuuuuuggguagacaggcacuggaauauuucuucuuacagcauccaccaccaugcaaagacuuacuuuaaugugacguaaucagcaaacaagcgucccuguuuugggauguaauucccuggacuccacuccucaggagccauuccugggucagaagugagguugagcuaucucaaagugauacccaacaaggaaucuuacuagaugucagcaguuguucuuacacaguauucucggagagcucuucucauacauuuucuaagaaaauccaccuuugcucugagcgucauuaagaucccaagcaagugucagugccaaaaaauacug

SEQ ID NO: 1612 - RNA, 2317 nt, Mus musculus
caguauuuuuuggcacugacacuugcuugggaucuuaaugacgcucagagcaaagguggauuuucuuagaaaauguaugagaagagcucuccgagaauacuguguaagaacaacugcugacaucuaguaagauuccuuguuggguaucacuuugagauagcucaaccucacuucugacccaggaauggcuccugaggaguggaguccagggaauuacaucccaaaacagggacgcuuguuugcugauuacgucacauuaaaguaagucuuugcauggugguggaugcuguaagaagaaauauuccagugccugucuacccaaaaaacagaacaggccugcugaaaaagcuuucacucauuaaacuccuaucuaccgacaaggaaauuaaagaacacacuguacaugggcagcuucagucacaagcuauugucugucucuguucccaaaaagaaccauuaccgcugucugacaaaccgccugggugguucacuaaaaucaccugugacaccucaaaauggucccacccccugcuuguugucucuccccucugagcaucuggaacucucuguguguuaucugagcagccacuccccugagauuccccucacacacauuacugcacuccuguaaugauccuccugucccugugugucuacugucgccucacgcugggaguuuugcccuugcuuaaaucugggguguugccgcucuuccugcuggucucacccacuuucccuuccaagucacaucuucaaauuaucacccacaaauguccuugucacaggguaguccccugccucagccuucuggaugcugggauuauaggcaugaagccaccacaccuggaucuggccuugauaaauucauuuugccuuucaccagcaaaggucugcuuaaccacuguggugauugaugcuugcacaagaacuuuccaugugucagccuuagccauccaggguucacaaguguacuuaggauucauggucacucaugcucccucaugcgguuuucuaaggugucuggggaaucauaucgauaggcaacaaaagcacaugagggagggacuggggccugacacuggccauguggaggcagagucacuuacccacuagguucaucuuggcacuguaacucccaaaguagcgcucaucgguguugggggugugacauucauacucgccggcaucccgggcuugcaggucugugaugugaaguaaggcugaguugcccuggauccucuccacguagaucuucccaccgcggacucgcuggguguagauggcguacgggaaggaagaguccaccgugcuaacgaucuguacuucacgcucaggagcagagggcagguaaauggaccacuggaaguucugcucagagggacccugguagccacucacguugcaccagauggugaugugggagcucucugugcgguacaagggcccuuccuggacggugaccugucgcugcgcugacaccacaccuaaggggagacagacacagcaacgugcuuacuuuucugacugaaugcaaaacagacagcaguccccagaggauuuguuauuugugugacaugauggcaguauaaguagguuacuggcccuuuccaaggcacuuugugauuuauaaauauuaauuaaaacagcgugguaaagcucugcgucuaauuugcauauaugggaauuugaucgcgcaaggacauggcucuguuacuuauucaacacugacccuugugaauuucauuugggcucgcugucauuuauacggcagcuuuauaucuauuuauuaacgcuguuuauaaacuuuuuaauaaaaugaacaggaaaaguugaguccuuggcacaaauccaggaaaaaaacaaauaaaagcagccgccuuguaaucuggcugaaauuaaacauuucucccaugauuagugggguuggcccaagaaagccauugagucuuuuuacuggggcacgacuugggaggggcacuccauuuuauuuccauccuauccuaaggagcaccuccuuuuucccuguagaaagagaggcaaacagauccuaccacggcugucaguuuccaaggagugaccaggagugggaaggcgcgcagagucccaccagcugacaaagcagagagggacagugugcaggaagaucugaaacaaggucggugcccuugggcuccuggcucugacuggcccaccaagccccugccuucuggugugacacagcuuuccaaggucacgacuccuccugcuuacccuccccacguuccucacgcugcauccucuugcaagggcaaaaauuaaauacggagauccaaguuuc

SEQ ID NO: 1613 - RNA, 93657 nt, Mus musculus
caugaaaaaacauuauuucagugaccccugggcccugagucuaguggcagagccaucaugggaaacagaggagcucugggcacuuccaggaggauacaagagggaguuugcacuucccaucacacaucaagugauuaaagaaggugagguggaguccuaaggagaaaaagagaacucauucauacugcaggcaggucugcaaaugaauacagccauuauggaaacuuccacacaggaacuccuccaaaauacaggaaaagcaacuguguugccuauuaccauguuacuguguagcuaccauggagaggagagugagugugaaagagacaccugcacuuaccccagccuuguucacuguagacaagauuucggggcaacuaaguguccauuagcagauuaaccaauagcaaaaauucgguauaugcaagcuacagaauaccacugagcuguaaaaccccaaaccuggauuugugauaacacagaagacauuauuuuaagugaaauaagacagaugcaacaaaauaaaccuguccugaacucacuuauauaugcaacauaaagaguugauucauggguggaguggaauggugauggccagagaguugaaugguuagagggaggacagggggcagggaggaagaguacaggucaaaggguagagggaaggacugggaguggggguaggguguaggucaaagguuagaggaaaggacugggagugaggguaggauauaggucaaagguuagaaggaaggaccgcggguuagggugcaggucaaaggcacauacaauuagaaagaacaaguucagggggacuucuggauggucugcaauaucuuacacucuggagagaugagcgguguggcuguuggauguucucauaaagaugauaccuguaugaagcacugcauguuugauuagcuaacuccacaauguguaaauguauuuaaacauucuguuguuaucuaucacacacacacacacacacacacacacacacacaaacaaauagcaugacuuugaugaacaaccacgacaggguuccuuuucaacacagagcaguuuagagaaagauuuacucuucccacaguuuaaagcccacccuaaugggcaaugaauaaaguaguuucuuguugaaugcagagcaaugagugcaagauucaagucccccaguacggcaccgucuuugcuuccucgaccucaacccuaucaguuaguucucuagcuccuguuucauauauguguguggagggauguauaucaggugaacagugugugugugugugugugugugugugagugugugugugaguguauauaugugcucaugauguguguguuuaugugcucauguguguguaugugcuuauguguguguauguguguaugugcucaugugaguguauguguguguaugugcucauguguaugugugugugcucaugugugugugcaugcauaugagagccagaggcugacuuccuccauugcucuccauguuauuuuuugaaauggagucucucacugcaguuggcuggccugggagugcuggggacccaccugucucugucagcuaugccuaucuagcagacagaucugcagagaugguggggaucugaacucagguccaacgcccagcacucuauggacugagcacccccaccccucugccuccuguuucuuacucugugguauuagagauggggugggaugcgcaucagaaucaauaccgcccagcucgguauuggacuauacggaaggauaaaauagagggagacgacugugagaaagcagcugcauaaagccaagccucugaguuaggugacugcaaggggagaaagggaugcucagcaacacagggucccaagaccuguguguguguuaaucuuggagcuucccugugguguguggcccuggcugccucuccaacaggcuucagugcagaacaagaaagaggaaagauggcuuugucucugcggccacccacgcucugacugcauuaagggucccacugagcccacaaugacuucugauaaaguggacacgacucccugcagggccaacagucccacaaucagagggagggaagcgggcagagcagcagaaaacacaccuggcucucgagccugcucuugucauugugugcuucuuaaagcaugccuucugcgggcuguuuccauucuaagccuuccauggcucccaggcagcagcaagauguggggagcagagaccagcaacagccuccaccaagggaccggugucugugggaacaccuguagaucuauacuguucccagcgggagcagaacaaagucccuuuuaucucuugcuuuccaaaagccuuugugugccuuagaagcuggguuuuauugcauuauuaaagccccggugagccuggcaaggcgaggauccacagagcugucccaggcagcuucagcugguucagacuucucccuauguaccccaccugacucuugguugguaggagcagcugccaagaagggaaacaacaaccagguagggagaggcuggcccuugcugaaggugcccccagcuucucacuagacuggaucaaccaguucccaggaguuguucuaagcauaacucuuguugccaauauuguguuucuuaaagaaccagcaacagaguaagggagacggugaguuuguaauaucugaaaccaguuuucuuucagcuucagcaaggaggccguugggaagauugagggugccgcgugaucagguuccuguguauucugggguuuggagaccaggacagugcauagcaauuaccucuugucacuuugucaucuuccagcuuucauagagagaaaggccacagaaaggaggugaccaguccaaugucucacaauaacuuauguuuaguucagauaaccacagccuggacucuugcugagcacuggguguccguucacugguuaccaggcacagauauccuuucacugguagugucuaucugguguuagugcccaggaagagaaacuuccagaaagggcgucuaacacgcaguuagcaagacucaggcacucucugaugcuuuggaacagagucacaugucgcacucuccagccagaucagacauagguuuccuugugcaaguguagcugaagagguuguggcaccgcagugccaaaaccuacccugccagccacuaaccaggcaaccaucucgcaaacugucuuguuuccugauacaguucgacgcuuaccuuuuguuuguuuuugagacagggugucaggcaaccauagacaaccuugaacucacacuguagcagagacuaguccugaaugagaaccuccauccuccaucucccaaaugcagggcuucagguuugcaccaccaggguucaccuuuaagggaaaaguuuccagccccuucuuucuaauuuuucuccuacuucagccucauucuacccgcugagacuuuuuauuuuauuaaaaaaaaaaaaaaagauuuauuggugaugguauuaugggccuuuaaucccagcacuuuggaagcagaggcaggcagaucucugugaguucaaggccagcuugaucuagagugaguuacaggacagccaaggcuauacagagaaacccugccuccaaaaaacaaaaaaaaaaaacaaaaaaaaaacaaaauaagauuuauuauuuuuauuuuuaaauuauaugugggguauguggguaugugcauaggagugcaggugcccccagaggccagaggcauuguauccccuggagcuggagucacaggugguugcgagcuaccuggggacugggaacagaacuuagguccucugaagaguacugcaugcucuugaccccuaaaccaucucuccaacccugacuuuuuacuuuuuaagucuaugcuucccagguuucuaaggcauugcugagcccugcuuggguugcucggcguuccugagcccauguucagaucucuuagucucccauccaggcuggcugucccugggcacauccacugacucuguucccacaucgccucuccccuuucuuuucucucccacguaaguugcuccuaagcgauuuguuuaugaacuuuccuuucuugaggaucuauccugugccccacaguagcugcaggccauggucagcaaugagcauuugauguaucuaaucugaaaacagaaacguuaugagucaaagauacauccuagaugcuaugaauaccuagugugcagaaaguguaagauagccagaucauuuuuacugaaaagauaauauuucagcuauauuggguaaaauuaaagacagaauuaaaaauuacuuucugguuuuuuaaugugacuacuagaaaaaaaauaaaauauauauuuaaugguuggcauuaucuuuaucuacaugguuuagacuacaagcuuuuuagguccagacacuauguuauucauuuugcacccccagaguauaacacagacacauaacuggaugcugaaaagccuuuguagcaaggcaggugugaugguuagaauaugcuugccuccccccucaaugaaaauaaauaaauaaaguaugcauggcccauggaaaguggcccuauuaggagauguggccuuguuaaaguaggugugacuucauuggaggaaguccaucacuguagggguggacuuugagguccuaugccuaagcucucuccaaugccaaagagaccauucuccuggcuaccugcagaagauggucuccuccuagcugccuuuggauagagauguagaacacuugauuccuccagcaccgugucugcuugcaugaugccaugcuuuccaccaugaugauaauggucugaaccucugaaacuguaagccagccccaguuaaaugcuguccuuuauaaguauugccuugcucauggcauuucuucacagcaaugaaagccuaacuaagauggcuagcaucacugugugucauuauccccaugacccacaugccuccucucccagaauccuuugccugaacuauguacagggacagggcaucucccaucaagcacucuauaagugacagguccagaauaaaauuuaaagacguuuuaacuaaauaugaaacuagaaaauguuuuuaaaacauuagucuuaagauggcauaauuucucaguaguuaaagguagccagugccaacccugagaaccugaguccaaacccugaguccacguggugggaggagagaacuaacucccaaaauuuauccuccaacuuccacacacaugcugccuuagguccuaacaccggggagggaacaccucagcaucagccgcaggacaauggcgaggacaagcagaaccguccuucuauuuucuuauaugugggcauggcccaaauuuagggugggucuuuccaccucaaaugauccaaucaagagaaucccucacaggcaugccuagcuacuuggauuuuaguugaucccagauauagucaaguuacuaaccaagauuauaagcaccaucacacaugccagggcacaccugcacacaaaaacacacauacaugauaaauacauguggguuuuuuuuaagucuuauuuaauucuacuugagaaccauagaugcgauauugacaccuucaggugagaggggaauucuguggcugcaaauuucuuauuccucaguguguguguguguguguguguguguguguguguguguguguguaagcaguguuggauggaucccuuugucuuuucuaucccuuucucauuaagccaaccuggagcucacugauucaguuagacuagcuggucauggguccucagaccucucccugcuaguacugcuauuacaaacacaugcugaaaugggugggguuuguguguggaugcuggugaucaugauucagguccuuguguuugcaugguaaacacuuugccaacugagccauuucucuggauccucuaaauugcuuaaaacaaacgaacaaaggaaaagcaauucugagcuuuacaaacaaauacaagauaaaguacguagacuacggagacgaaugcuaaccaugaugauuuauuuauuacauuaccauccccugugguaugagguaccuuuuagaacucaccagagacucacagagaagcaggagaaacuuggcuccuguccucccuugcugccagcuagugccugcuugucuaggcgugcuccguucaucuagggguuugcuaggcaauuuagcccacauaccagaaaagaagggacucuugagcccuaggagacacaguagauaaggcuuugugcucugaaucaauaggauggggaaucuggguaaggcacaaugguggauaccagcaagauuauaccccccugaagaacuuggccagugaagaauucaggaggcagagaagugcaauuaaaauauuaaaauaccgauuagaaccaaaucagcaugucagccauuuugccuuuuuucuaggccgacacccaacuuugcaagguuguaaaauaaacugcuucaauuucucccccgagucuccaacacucuuauuaugaaguggggaucagugcuccucacaaggaugacaguggcaaugaugggcuuagucugagaacuuuucuaagaagaaaagaaaagcucagcucaugugacucucguccccuagcuccgugauuccauagcugugugucuuuuauuuaaucugagcauuuucugaagucuugguuugggaccaggcugugugaaauccaggaacauuaucccacuuagguuccaggacggacuucaacugcagauauccucagguggggcauuggcuaggcuauucacaccauuaccuauugagacacuuggcagauucuucaguuauacaaauaacuaugguuuaaaguccaaaacaauaguaugccuuucagaauuuuccugagaaauaaaaacucuuuagugaagaguuccauugggauuccucgucaccaugaauuguaucacacaccauccuggccuggcuuauacuaaugguguggaucucuaaguucaugccugcugacuagcaacaugucagcaacacacuguaucuuaguuucuuucugcugcuauaacacauaaaugagacuagucaauuuauaaagaauaaaaguugagacuggaagaugacucaacgaauaaguacucaccccauaaacagggggauuggaauucagaucccccaaagcucuguauaagcagagcaggcauggcagccagauguaaucuuaacacgcucuggaggcagggacagauuuccuggggcaagcuaguuagggagauuauccggaacugucaagcuucaguuucagggagagaccuuuaccucuguaaguaaaguagagaguagcagaggaaagacauccaacaucaacacccagccuucacacacauacacacaaaugcgugaguuuuuauagcuuuucaaagccaggugcccacacauauucaaacaugugcaugcacgcucgcgcacauacagaugcaaacacagacacaagcacacacaaauauaugcacacaugguucuagaggcugacgcugguuucugauucacuucuggugagggcuucaucaggugauacguagcaaacauacuagauugggggcuguucucaucuuauucagccaucagugccaucauggggaccucacacaaaugaccucaucucacucuaaccccuuccuucuuacagguuccacaucuagauacugcuacuugcuucuuggucaugauguuuugcgcaggaauagaaacccugacuaugacacuggcuuauuccccaugacuuguucaaccugccucuuuauccaacccaggaccaccaguucaaugggcuguguucuuccucaucaaucacuaagaaaacgcccgauaguuggaccuucuggaggcauuuucuuuaauuaagcuuccuuccucucagaugacuuuggcuugugucagguugacaucaaacuugcacaccacuccugaguaaaacugaggcucaaacuuccaacccguagacauauguguggacacacuuaaaccauagcagagucuguccugcucugagucauugcugucuugauuaaagguagaaaagcugagagugaagcgugugcucacgugauggcagccauugcaguuugugguaaagagggggaaaccccaagaaugcuaauaauaaaugugaguauuucaauugcagcacuuuugauaccuguugcugugguuccuagcaggcucagcuauucagcauccugugcugggaaguccauguaugucaccucacugaccagguaagcaugccuuucccauuccauagaaaggaaagcuaagauccaugaaguucagugaccagguuuaggaaaauaguaagcagaugagcuauuacucaaacccugaucaauguguccccugugugagcauagcucugaccagucugcgucugcugcaccagcggcuucccaucucccacauagcuuucuucacuugacccugccaugguuaccaugguaacagauucaaaucucccucucccucucccucucgccuugguuugauucucaagcuacaucaaucagcauucuucccgcugcagugagcagaaagucagugaagccagcuuuagcaugucagggacaaaauguacucguguucagcagaagccaaauaguguuucaggccuggccacacucggggcucuuagagcauuaaucugggcccuaucuauugcuuccaucucacuacccagacuccuucuagcuucugagcuuugcuuuauuuucaaaggacucucuaauuuggacagaaauuccacaguauuccuuucucccaaugucucuacugaucaccagcauacccaguccaacccaguggcacauuccucugaucccaguugaugucaaguauuuaugcugugcauacaucagcuuguauucagcauccugaguuuagaccuaaagcuguuuugauccugacagaauagcugcuuccuggugauaucauuccaagggaaucaugccuugcuuucuugaauuucucagcacuuaaacgcuggguuguaaagagcaaagggcacaguuacucccaauuagcaucagugacagcaagcgagagcaaugcagcaguauccugcugcugugcccaggacuguagcuaccucugcuuaaaccugcuaaugaaacgauugacccucaauugaccacacuuguagaugccucagugcguuuguucagacaacaucgguagccuucccuguggccauaagccacguggcugcuucuguagugccaagagcugcaacucuuucucuucuggggaauagagacacacacccccuuucaccaugaggucuuggaagguuggcuucagggccccucacuugugugauauuccuaaggggccaagagcauccauccauacaugccaucuguaaauacucucucaggcucaccaacucuauuugaauuugaaaguaaauuauuuuaacugcacuugguugagcaucccccgcaccccaccuccgccuucccugauucccacuccagucacacaucuuucucuaggagaggugacaauacagaguccugcugggggaugagaacuacauuugcguuugcauuuauggagguguguucaugugggucacagccauuucugcauacauggcauuauuauaagucauccagaagaggaauagcuuucuagaacacuccuuuggcaaaacuccuuucgccaacucagccacccacgggugcacccugggccugaggucauguggaagugaaauguaccccguggugcccaucacuagacacacuggagacucaaggaaaaaucaagucagaaauguaugagccagagaacguguggaaaguucucucaagacaggcaggaugguaauccugaucucuccaugccucaucaggccagaagucccuucuuaucaagaagaaaccugaccgugcaguuaugaaaccauagaggauaaauuaccuuuguuguuguuuuacuguguuagugaucaaacccaaggcaagcgcuugaccacugagccccagcccuagcccuccagcuccuaaugaugaguguuaggagcaacagaauuuauggaaauucccauuuccauggugugaauuccacacaaaacaagagguguggcaaaucaugauagaaaugcuauaaagauuaucaaauuugaauacaaucauaaagauaaauauggcuugaccaaugaaaagaugagucacuaaagcacaauaaaaucaucaauaaaaaaaaaucuggagcuagagagcugacuugguggcuaagagcaacaucuuauucuugcagagguccugagucuggccggcccccagcaucuauauagaugguuacuccauauaguaacuggaauucaaguucuaggagaccugaugccucuucuacccuuuguggcaucuguauuuacaccuguccaugugcacacaggugcacacacauacacgcacgcaaaaaaauacuuuaaaaagaaauucugaucuaccaugugcaaacauuaaauugccuucucuuucaaguagggcuguaaucagcugaaauaggcaaucaagggccagggagaccgcucagcaggaaaacaugccugccaccaaggcugaugacuugaauuggauccccaaaaccuacaugguaaaagagaaccaaaccagguaagccguccucuggccugcaugugcacuccguggucugugcacacccguccccagcacacauaagaagaaucugcgccgguaguaguggcgcacgccgguaggauuugcugaaggaggcagaggcaagaggaucacgaguucgaggccagucugggcuacacauuuugccgggugugguggcacacaccuuuaaucccagcacucgggaggcagaggcagguggauuucugagaucgaagccagccuggucuacagagugaguuccaggacagccagggcuacacagagaaacccugucucaaaaaaccaaaaaagaagaagaagaagaagaagaagaagaagaagaagaaggaggaggaggaggaggaggaggaggaggaggaggagaagaagaagaagaagaagaagaagaagaagaagaagaagaagaagaagaagaagaagaagaagaagaaagaaagaaagaaagaaagaaaagaagaagaagaaucugcagcaaaaugcucucaagagaaaacgugcauugcuaugccagguagcucaucacucguagugcuugugcuaucugccaccuuuagaacauugaguuucugaugacucuucucccagucuuuaugaauacugauauguguacgugaugguuuauccacacuuuguaguacuaacgcaacagcaucccuccccccaaccuucucacuggccugggaaggacggaggaagaggagcaauauuaaagcccacauuggcuuuccucgucgcugacaggucugcaucucugugcgagaucacgcauggagaaaagggagagcgguuuaggaggaaaugggaacaacacauuuuaaaacgacugguuauuuucaauuacuguuuaugugucuguguaugagugugugcacuugagucaaggcaucaguggaggccagcagagggugucagacccccuggaacugaaguuagaagugauugugagcaacaugauaacauggaccagagaacuaaaccuguguccucuucaagagcaguaaguacucuuaagugcugagucaucacuccagccccaggaacauuaauauuuuuuuaaaaaagcaaaacaacaacaaaaccccuuuuauuuacauuucuuuuauuuugaauuuguuuucauaucauauauuuuuguuucaagauaccaugaccucagcaacuuuuauauuuuuuaaaaaaaaaaaggcauuuaauugggacugucuuauaguuucagagguuuaguccauuaucagcauggugggaaucauggcagcgugcaggcagacauggugcuggagagguagcugagaguuguacaguuggauuugaaggcagcaggaagaagagagaauggaccugauuugagcauuugaaaccuugaagcccacccauagugacacauuuucuccagcaaggccaccuccuaaucucugacaaguagugccacucccuaaugaccaaaccuucaaauacaggagccuauggggccauuccuauucaaaccugaguguucucuccaugugacaugggaucucaucuaaccaugaucucaguuaagaaugaugguguaucuuggacaccuuggugagcuggauauauggaaagcccgagaauccgcaccuagaugcuuaaauucaguaugacucucuuuuuaaacacaagcaguaagagcucagcccgcugucugagcacaccuagcaacuccucaguuauaccaccagaaagccacgcaaguccccucuguuauuuucacuuugagucaggcuuucaccacguagaccaggcuagccucagacucagagauccaccuaucucugccuccauccugcugggauuaaaggcacaugccacaccacacggcggccccaccccacacugucuuugcagugacauuuuuucagauguagcuuguaggcuaugcaaacucuuaaugacuugagcaguuucacggacauucuuaaagaacacaguuugaaccucuuggcuucuauggguuugcaggaguuuuccacauccagagccaugaaugauuuucauuggucaccccagguugcuuccgaggagagagagaguaagaggaagcuuuacuucuucuccaagcugacccacaaugcagccugaacugacagcagacacuauauuucaguccuaguuuugguugucugauagaaugagaauccagacaucuuccugacauggagucagucccaccaugucuaugccuaaauuuuguuuguuuguuuguuuguuuguuucaaggugcuagggauuaaagccagggccuugugcauggcaggcgaguacuguaccacagagucagacuugaaacccaggcugaaaagguggguacggcucacaggaaguccauucaguuuuugauucugauuugcacagcugaguguagcuaaaccaagguauuccaggacuugcuggagagaacacaggagugacucaugaauuuuuaauuugcaaaugaccacucuuaagugugugaagccggaucauucucauaaguagguuaaacauaucccucaucuauuauuucaugguguucaauuauuuaauaaaucccuuucuguaacagagcagaggugaacuucugaaugcccccucugggugcccaugaauucugcacaagaggaguccaaagcaacugagcuuugcuguugcacgaaucuacuacccgauauucuguaucccuucucgguuucuugacuaauucacuuaugcucucuuauuuuaucuuuaccaaaucuuaggggguaaauggagcaaggauaauaauuuccggauaacaaguguagaagcagaagggaaggcuccauuggucuucuguuaguuuuacuugaccuagagggggaaauaugguuaggaugcacuagucaccacacaggucguuacuuagaaacgaaugucugccgugggaaggugggcagucugguuaguaucgguuacucacacauguuagccgaaagcccuaaugguccaugaugacaagaacucacacaaaguaagcucacucacaaaacguaagagagagcuuuggaauucacucuaaauacuaaaagaagaacaauugggguuagccaguccuugaaaauaaaaugaacaguguccuggccccuccagccagucccuguacacagcuaaacacuccaucugagcacaagugcugucacccagcuccaaguccauggaacacagggaagacauuuggguuuaggucaguuggcuaccaguaccucauuugcacaaaccuauucucugacggauguuugcaauugagccccaggaaggagaugcagguacgcccagcaccugugcuccuccaugugcguguaccugcucaggagccucuguuuaaauauugaucaacaguagcccugucaccauagccacccagucagggccucucugcuucgccucccagugaaaugggagccccucugaaauucaggcucauacguguuuacaguacccugcuccuuggguaugaagucuagaaguuagcuauugucagguauucccuuacacagagagagagagacagacagacagacagacagacagacagacagacagagucagagagaaaccucacuacaacaaacauacccugggcacauuuuagauguguaggugacagcagcucagauugggcccacuuauacaucacucacaggaggcuguugucagaacucauuuucuuuugucaagacacagucacucuaugucacccaccgugcagugccucagccuccugugugaugggaucacagacaugugucauccaugaccacucacacccagcagucagaacaucuucuccuugcauuuaguaccuccaacaaaauaaauacuuccaguguucccucugugccuaugcugugccaugcuauucuucgguaucagagaagaaugaaacaagaaaagaggacucgugcuuggugaaugggauguggacugaguagucagucuucaaacaucugucuucucuauuaugaccucugccuuaggauuagcaccccauauuacagaggcccccaaaauuuaagcaguccacagaacaaagcauucagaguucacacuggucggcucagugcugaagcgucgucuccaacgcucaaagcuggaagagcugcuuaugaaagacaagucaagaaagacuucagcaaguagaauugguuugcauucacaagucaccucgauacucaaagccugacauuucaccacugcaaggcaaacucauaaaauauuuuaugugguaggacugcugacaaagguuaaucuguuaaggacccagagaacagacuguuccuuacuuaccugauuguuccuugaugcuaauguccccaggaaguggaaugaagaaucagccugcaaauuucaccuacagccuuggcuuuucucuguggcuagaaugugaucuugaucugccauucaauuuuacugugucuugcuugccuucucuguaaaauggacucaauaaaauacuggaggcacagugaagcuauauauauauauauauauauauauauauauauauauacaguaaagcucaaagaaauaguaccuaaggaaucuugacuuggggauuugagaaagaccugaggguuugagaaauacaaacaugauauaaaauaucgugaauaaauaacaguuccuggaccgcacugggcacccuaggucuugugcugagugcugcaggcaccaugcugaguacuacaagccuugugcugaguauuauaagcccugugcugagcaaugcaagcgucacgauaaaugcuguaagcacuguaaugaauacuacaggcccaugcuaagugcuguaggcccugaacuaaguacugcggguucuauauuggguacuagagguucuauaucgaauacugcagacacuauacuggcugcuacaaguguugugcuaaguacugcaugccccacccuggaugccuguagcuaccguuccauuuaauucuuucaauccugagagauagguaucuguucuccuaguuuacagauaggaacaaagugcagagaaaugucccugucacccagcugggaaaggcagcgcuuaaugacauucuaacccuauggucgcuuuccaaagguuguaugguuaagucuuccuguuucccauauguaaaccuaaacaggagaaggaaggagggagggagggagggagggagggagggagggagggagggagggagggaaggaaggaaggaaagaggaaggaaggagggaagaaaggaaggaaggaaggaaggaaggaaggaaggaaggaaggaaggaagagcucauuacuugacagcuagguuaauuaucagggacacacaguugccccauacacuuucccagaagguucauccaaaccuauccuugacugcagugcacucugggagaaagccucccguacucccccagcaacaugcaguguucauacuggaccccugagaggauucuuccagacccucugucuuucagccacggcucccucccauccccucagauccacacgcccuacauuccucuccugcucccagcgauuucuucccuuccccaggcuuccccggcccaugcugucagagcgaauccaucccaccacugauucccaucugcuugcugguuuaugcuaacuaagcacaaugcccaaauauaggcucugccuacauucuucuccuguuacauuguguccgccuaaaucagaaccuuagucucuuccuuccauuauccccacugccugacucacuggacagggcaacugccccauaaauauuuauugagcucucuucaggugcuuggauagaaaccaagaugacuggcaugaaauaaauauuaaaaacacagauaaugauuuugaaaucuucccuaucagagguaaugggauaaagaacuuagagguuuauuucaaauggcuaaggcaguuuggauucagcugaaggacuaagccagaguuuaaauuaaaaccagcauagccccuuguucccacucgccugauggccugagcucugguuggcuacaguucugagaacugacagaaugaccaucaauuuacugcuagccuugggccaaaauagaccaaguuggcagguggcaugaauaaaauggguauuagcaccagggcagcuggguaugaacucucuccagcccugccaaccucaugggucugaauucuaccuagccuggcuguucucagggcuguuuguuuguuuguuuguuuguuuaacgucaugaaucucuguagcaacuggcagagccuauggacaauaucuuaaucuaaaguuuuuaaugcauaaauaauauagauaagauuacagaaggaacaaauuuuaucaaaauacaguugagacaaugucaaaauuucucugaacauuuacagcugaugcuacccauaauccuucugcuucgugagagcauaagcaauguaguccaggggcaggcuucaucagaaccaagauacugacauagugaugagcaugacagguauuuccagauaguaacagcugcaaugcgacauuaagugaucagcagguuuuacuacacccagagaugcuauugcuaccuugacuuggggcuuaaauuuggggagaaggaaacaccaaauuucuguuugaaucuuagugcuagagguuaauguguuacagggggcggggucccuccuggcacaguccaaauucuacaaaaacaguuguuagaaccccuagaguagaagucaggacaaagaacagucuauauuucaguguccuugucugaaacagggugcuuggcagccauuggugauguuuuccauagcaguucaaggugggguucggagggaggacuccucagacauucuguagccuccuccugucagucacuccucucagcugagcaguaggaagccaucaccgaccagacccaccauggauggcacuauagggguagaacucagggcucccuuaugcuagggaagcacucugucaucaagcauugccaccagccuagugaaggagacgcuuucuaaaaugcauacacucauucauucauucauucauucguguguguguguguguguguguguguguguguacacagaagggauauacuugucaccgugcaaagcaugugggguucagagaacaacuuguagcaggucaguccacucuuucuccccucuaagucucaaggaucaaacucaggucaccaggcuuggcagccaaguccccauccuccugagccaccucccuggcucggaaauugucuucugaugacuaccuccacaguguuccuuacucaccuggaauguugccuugagagaagcacagaugucuuuggaacuaaaagccucaguuucaaggaacuaguaaggaaggcuaagugcuggcuaagcuggagagcccaaacccuaagcucuagugacagcucucuaguccuaaguuagagaguuaagacacuugcuggcuaggaagaaaauaugagugaucacaaaaacaaaauacacacuuggaauuauaccccacagcucacuccucucagccccaugacccguuaaggcagugugguucucaaccuuccuaaggcugccacuuuacuauaguuccuuguguuguggugacaccccccccccuccccgcaaccccaucuauaaaauuaccugguugcuacuucauaacuguuacuucugcuaccguuaugagucauaguauaaauaucugcuauacaggauaucugaugugugaccuacaaaggggucaugacccacagguugagacccauugcucuaaggagucuacauuguuugccaaacaagauccuauuagguguguggcuaugggcuuccagauuucccuaaagcuuagcaaagcacgcgccugugucggcagagccuuacauagccaacccuccagcugcuguccaccuuacgacaguuuuuaccauuccugggagacagugagaugguuuccaaguacuugagaggaagggcuuucucuugacugaggccccagcccugcccuuugucaccaccugugcagucuguaguagaggguuccuuagacuuccuguaucccagaaucacuuguggaaaccaucaaaccacagacugcuggaugcacccacagggguucugguucaguaggccagaggaauggcaucaccauuuuaacaagcugcuauguuuaccgggcuuuucaggauguuugagcagauuagaaaacaaagaagauaagagucaaaguguuaagccccuaacaaaaauuuaauagcugccaagccucaggguggauugcuauggacaggaagggacagcaucagaacagucuugacucaauagacaagugaggggggagggggaggaggugggcaugacacacuaguuuauuauuguuguuuuaaauguuauuuuguuuguacagauguuuccaccugccugugugucugugugcccugugcaugccuggugcccacagaggucagaagaagacaucagauucucuggaacugaagcuaaagaucguuuugagcugcuguguggacacugggaauugagcucgggucugcuggaguguguuaaggcugaguguacaaaaacauaugacugauucagaaagccacuagaaacugaagcagauguggaugguagguacauaggcagggucuggauaauaagagcccuuuacgugacacccagugguuucagugcuguuuugaaagagacaggaaaccacuggagaucuugaagcaagugaguaagagguggaaaagacauggggagaaaaagggcucaaggcugaugccuaaguugauauggaugugccaauaugcaacccacagaaguaucucagaaacaugaccuguugggaaaguauauguauauguauauguauauguauauguauauguauauguauauguauauguauauguauauguauauaugugugugcauauauaugugugugugcauauauauguguguguguguauauauauauauauauaugcuauacuugaggucucuaugacacauccacaaagggacaucaaaggguaguuaaauauaugaaucuuaugaaucuaauggacuagagaaaucugaaaauauaauguagcagccccuaacauauauguauauuauguauauauguguguauauauauauauauauauauauauauauauauauauauauauaacacaaguuauacucacaggacuaaaugagcuagcucagagaagccuugaggauagaauucuucagaagaauguucaagagcaaucuccaguugcugagcaacccacaagcugaagugggcauggucuuugcugccucuucucauaacaucuacauacaagccuguuguagaguaagugauugucagggucagccuagccaacagcagcaacagagaccuauccagcauagcacucggcugcuuuaagccaugggagcaaauagugccaacaggccacaggguguugcaagcacauguccuggcugauaaugauacagggugaaugcuaccacagcacuguccuacccaucccucaacugucacugucucuggagauggaaguggagggacaacuacuuacacucaaggaagaguucucugagcaguucuuuucaugaguaaguuuauugaauuugcccuagcucagagaucauccuuagggaggaaggugcugaaccacgagucaucaucaaaaugaaugcaguccacaguucucuuacuucagauuuaaaaaacaccaacguacugccagaccuaucaucuggggcucugccaaaucuccacagacaagcaggaaccugcaccaggcagcucugaacucucaccuuucuuucuacaggccucugaauagucugacccacuggggaacagcucaaagcuccaaggcauggauggcccagaggagacugggauauaaagaauuacagaaaaaauggaauccugcaccauuuguaugugaaacaggacaacaaaagagcaguuagucuacagggauggaggaaaaucacaccggagaccauccaagggucuccccauuggaaaaaggucuaggaauucagcauuugcaaagauccaaacuggagguuaauuagaagguaauuucuauauucuuccucucacccaugaaaagauuuuuuuucccucugagacaggauuucucuguguagcccuggcuguccuggaacuggcuccauaggccaagcuggccucaaacucacagagauccacuugccucugaguacugggaugaaaggcaggagccaccacucaccgccacccaaccuaaaagaugaauuuuuagcacgaguucauacugagacuauuucuucucgucuccauccacaagccaaguuuuguaaaagacaagguaccuugcucaucuucagaggguuuucucgggaagaaaaacuugggagaaauagcuccauccugauuucagagcucggggcuagagguucagaaaggugacuacagacuggggcgcugacagacucacgggcuuggcaagcccaggaaauguucaaucagauggaauggaaacauaguguacggauggaaaucucaucucauggcagaucuuuauuaccacuggagggggcggccaagaagcagggaacaaauguaaggcagccggacugcugacacagagcaguaacagugcgaaaguccuccgguuggaaauggcuugagcagccagcgguaaacaccugggcaugccuggagccagggaauucaggguccuaaguaccugaggcuggaacauacuauucucgcuggcugaguccaugaacuuucuagaugaauuuguuccuauuuuaauuaucaauugacauguuaaggcuuuaacuuuaaaccuaaagaaacgacuucucgaggcaguguuccaugaaaaagagagaagugggacaaaggccaccucuggccccagugcucugaagaggggggaggcauuaugggagcaaacugacucuuggcuccucccccuuugugguuuaggcuccuaaaguaaucuggguaggcguggucauccaucugucagucaacagccuaauuuagaaacccaaggcaaagagaaaggcaaaaccucucuuuucuucucucucucucucucucucucucucucucucucucucucucucucucguccucucucucucucucccucccucccuccccuuucuuucuuucuuucuuucuuucuuucuuccuucuucccuuccuuccuuccuuccuuucuuccuuccuuccuuucuucugucuuuuuucuuucucccuuccuucuuucuuucuuuuuucuuuuuaguuuuugguuucuuuuuuuuuucuuuuuuuuuuuuuuugaggcaaggucucaugauguauaacccuggccuagaauuugauauguagaccaggcuggccuugaguucacagagaugccccugccucugcccacugaaugcugagauugaagauguauaccaccacaugagccagaggucccuuucccacaguucucuaccacccgcucuagaagugggaaagaacacaucucaagaacagagaggugcugccuguuaaguuuuucaguuugaaugaggcaagaagcaacaucacugggauuggagacuucuuuaauugauuuguagcuauaugacauuuucucacagaaaacguacauggggacuugagguagaaaaauccagccucccagguaacaacaugaccaguggguaggccucaugcacuucugagcucagcaccucccauuucccaggucuccucuaggacagcccccaggccccuucacuccuccaagcucaguugaacaaacugauuugaucagcaucacuaggagucugcccugcccccaggucccuugucggaggagaccaggauggcugguaacuuggccaguauuuauccugauugccuugggagaccccugucccccugucccccugucccccgucccucccauccguccccccccccgcccccccaggcugaagugauccuuuagguaaaccaggaacucugauccagaaauaggcugcuggcuggccucuccaaccuucguuauacaaaccucgaaccaacaagagcuugguugagcugugcucaugggugcucucucucauucacugucagccaccaugaauaaugccagugauguccaauuauacagccagucuaaauuaaucuucugcagaaugaaugcacccuuaguacucacaccaaaaacaaauuaaugugcucugcugugggaaagggagagggcuguccugcuucuaagcacauuguaucaacaacccacuuacaguuccauccucaacgcuccagaacuacucaaagucaaggucacacaugucacugaggaaccuauaauuaacaugcaagcacagcauuagacucucuagauugccucgcucggcuuaaaaugggggagaggagagggagguuuuuuuuuaauuggaagagauuuaggaaacauaaacuuuacugguuucuugacuuuuuuuuucuguuauaaagagaugaauuuauauauuuaaaauaaacccugagcuggucaguggugguacacaccuuuagucccaaaacuuaacagacagaggcaggcagaucucccaucugaggccagccuggucuacagagcaaguuccaagauaacuaacuaggacuacauggagaaacccuguuucaaaacacaaaauuaaauuaaaaauaaaauaagguaaaaaauaaaaccugauuaaauaguauagccaucuucaaagugguuuggagacaguagcaaugucacagcccagaguagcuaaugaagugcacuucccauucaagugcauacccaccuaccaccccccucucuuuuucucccgugcacucgugcacgcaaacaaggaaaagguagaucagaugagaacagagauuuucuucccauccuaaagcagucaaucugcagugagucccaacuucauagcucuaaggccuugacuacaaccucagagaccaacuacaaagcaacuacuuaacaucucccaggccugcugauugcuuaugcugcguuuuaaacgguaucaucagaauccuguagaugcagccaacauugaaagccugccuggccuguguccugcaugcauuugccgaacacaaguccucccacucucucaagggucucucucauuuguuggucaucugugacaaucagggaggguuagcuuauuucugcaaagccaaagacagcaagcagaagaccagaguguagggcuuguccuggguggggaaaaaaaacaguauggggaacuugcuggauuucagcucuguaagaaauuacucagagacucagaaguccaaugccaccuguacuuggagugguucucaugaguauggggugggcugggguugccagcaggggcauuuucuagggaaauuuucuagaauuuuucacuugcaaagaggguuaaaaacuaccagaagacaaguaguuuccaucucagguagaacuuuuaaaaagucccuaacccugacuaaaagcccaucuuuacucccugauuuuccuguaagaaacuaggcagcaaggaucuuucauacaccagacuguucauuuaggcuuuggucagaacuaugcagaaaaguaguagccuacuucugacaguccugaucccucaacuuccucauauaaaauccuaaacaauuugacaaaucacaaauguguguguaugugugcgugugcaugugcgugugcguguguguguguguguguguguguguguacaccuauauaugaguugaaaauaauucauaugcauuuauucuaguuuaccaucuguugcugagauaaacaccaugaccaaaaguaacuuggagaggaaaggguugguuucaacuuacuguuuauaguccauggugcagggaagccaagcaggagcucagggccagauuuugaagcagaaacuucagaagaaugcugcucacaggcuuccucccucaggcucucucagcuagcuuucuugcacagcucaagcccacuugccuagggauggugccgcccacagagagcugggccuucccauauugauuagcaaucaagaaaaugccccccccccacaagcuugcccaaaggccaaucugauggaggcaauuucucaaucaaaguucccucuucccaaguugggucaggcugauaaauaagcuuggccauuguaaugcugaaagcaguucuaauagauagauagaugacagauagaaggaaagaauugugauucuguaagcacaucuauuccaguggaauauuauaaccaucuaaauguauugucauauaguauauacccugcacauucuccuuuuuggucaggauguugaucucagcuguacacuauuguaugacaugauuucuugagagacgugaauaaauugucuacucacuccagguagggaauugacaacagaguaaaguaaggagacuaccaaaguccagcuuggugaaccaaugaguuuuguaggaguuacuuacagaaguuuggcagaagcaggaaugauuaaaagacaguugcaucaccagagccuaccccagcaugggugacaacucacaaaccugggacucuggagugcacugcacaggcugcaggcagcucagcaggcuggggaguguccucuccagauaacuccacugaucuguuauaucuuucaggcagcuugguuggaagucuucuagccaacagagccguugucucucagcagucuauacaacuuauauguguuuggggugggagggcccaguguaucuggucaguuucaggacucccuaacguuauuaagugauuuauguccugaacuuaaggaacuucccugcaggaugagauguuucacuuccccuuagaacaugcugucuuuaacaaacuuuccuugaagguagaaauugccacuuaacuacauccauauuucuauggugaaucagggacuuggccucccucacucucugggaugugguucuugcccucguguggaauguuucacuugguuggugcuguauaguucuggaaaccucuaucuguaugggucucuguccugugcaugagcuauuaguagaagguuuuaggcucaggagguugccuaggugcagaagcaucgccagaacuaugucugccugcaggagaugacucuacacagccagacauacaaaaugccccagguggucccaugcaguucaguacagcccuucccagggacaucuaauaccauucucaaucaacacaaaccauaugggaaaaaucuggugugaccuggagcaggagaaaguauuacaguaaucgucaauguccuugguucuccagaccauuccaugagcagcacaauuguaccuggugucuucauuuccuguacuuccuucagcuuguaugucagcuuguucaucucagagcucuccaugccugggcaucuaauccucugucucccaucauaauuuggcaucaaccuuaguccaguggaagcacagugcauccucccaggccucugccccauuggugcaccuguggucuuuaauuccuaugcuugcuuuuguugaacacuccagacccagcuucugggucagcacugccacaggcucuucuccaggcccugugucauuuuggaauccacauuucauaaccccagagcauugggcuuaccauugcuguaggugcaaagcucuaccucauacaggaauguuugcucccugagagucacauucagcuugggccaggggaagugugaaguacugaggaguggugaguuacguggcagccccacagucccaugaugucauugcucagggaacuucagaccacuaucuaagagacccuggaugccucuuccuggugauuuuguugaguaacacugccauugcauggauuuuugcaugcuaggcaagugcucuaccaugaagcaacaaccccagcccaggcgucuagaauauuuaaaugggaaacauggccucagauccaagccuugggaauuccuggccccuuucuccucauuuuccaguaucuccaggccauuccccagcagucauuagguaugugaaccagucugguguguaguuguuuuuacuaaagugugacaaucuuucagagugaaacccacauuuagcaguguuuaaagcucccauuacacagccagugggauacaugucuagaucacuaaacaguucguccuaggcccuuccugccuuuucuccucuauaaguuagcuuuuccauuccuuguguuucuccuuuuaacacaguauccacaaaugagugucaaagccuuuguccacugaaagaaagaaaaccucugucuucccagauuccaguucucuccuggagcauggaugggauuuuuuucuuggcacuggaaugucugcugcagcaggaaucuucaaugggauauuagcuggaaccucuucuaugccgaaacucuacccuuucaacccuucaucaugugauuagaaucucaagucaacaauaacugacaaccaggcugagacagugagaagggacaaugaggccuccuccuucugagcaaggaaggugaagaggaggccuccaggcugauacacauacuggaaaguagccagagauggauuuauaugggggcgucaccauagcacacaaacagaugguccuccaggggccagccauguugccugcagagucuccauugucgccuuggacaggaaguguguuggcuccaggaaucacauguucaaggucccauaaccuuccugggcagccugugaccaacaacuccuggaguugguugauaaaggccuggccuucuucgccuagacucuaggcaacucuagaauaauguuucugcuucagacagagacugcacuguggccaagcucccuccucuccaguauccacuggugcacaucucacugccucacaagcucuucccagcacaugccugcuugauaaucuucaucuugggcauugguuucccagguaacaucaggcuaucccgcaaguagcugagaaaugcaggucugccccauuucagugucugcagcugauucauaaggacugugaaguuccaggccccaaccaagugacaagugggugaggaaggcuucugugggcaugcucaguaccccuaggggacccugacccucaccuuuuccugccugcuggggauaaauugcacuuggcugacuugcuaagaggaguuuugaagagauuaucuugccacagaaucagcacaagcaaagagacugaaaccaaagagagcaagggacugguggugggaguccaguggggaugggaaugaaggacggggacggggguugagggaggauggugaacuccugcagugagcaguagggaagaggcuaugaaguacauccaggaagagacaaagagucucccuggguauaugcucagugggcuuugagcucaagcagugauuuggauccucucugggaggcaauaggagcaauaggagccuaaucuaagaaaccuucccuaaagcuggauauucauauuuguugagcaagaugacuucaugccugagaaaacuccauuagccuaaagguuccugagaaaggagagcauuucaaccuaagagagcaugaugagagcuuauggagggguacacgccugcaugugaaggguuaacaaaugcugccaggauucuccaucacagggagaacaaguucacuagagcccuucguuguccaugaacacugcggugaacagccucucuacaugucuuuauguagggauagcuuggcaagucuuggccucauguggcucuuccaauaaaggucccacagucggcaaggcuggcuaagugacucucaugaagaguauugcuccaccgugauuuauuuaugcaggucugugggcuuauccugcucaagacaucaaggagcaagguuggucuuccugccuccaccuccagagugcaugugguacugcagauggagcccagggcuuugugcacaguaggcaguacucuaccaccuaaauuauaucuccaacccauaacagguuuucuucuuccuuccuuucuuucuuuucuucuccacuccuuuguguggcaacccugaggcacccccuagcaaugacaccaauagcagagauauuggagcccaccaggaacauuccugcucagauagagagaugcuguggacccaagagaaugagaaaaugcccauaacccccucuuuucucccacugcuguggccacgcucacaagcauguggucacagaaggauaaacacacuugcuuuccacgggguaggcaagaagaggagcugagcaccacacaggcugggaagagcacagaaaggcgaguguccuccuccucuucaccccgagccaggccuacgcugagaugccaucgaaacacacuaaugccuguaaggaacaagcuuaggagaaauagcaccccacccagcucccagacugcauaccagcaagcuggaagagcugcagagauaagggaacgagucugauggugaaacucuggugcauggaaguugaaggcuggaagacuuuuccaggccaaaucuaugcagauuggugaccugugacagcaaaaauaccagcacagaagcuccagcccgaagccagugucuuaucacaauagucaaauauugaggaaacacugcauccagauugauucagauuguggagugaaugaucauaagcuuugaccuuaaaagaacagguucuguucaggggauuuuugucuucagaacgggggcuugcuaugucacugguccuccaugccugacucaagcaguccucccaccgcagccucuggaguaguaggacuguaggccgaugccaccauuccuggcuauaacuaacuuuguuuuaaggauuuguacaucaaacaucuaaaaacagcuuugccaggcaaaggccauguccugguggagcuggcucgugccagaggcucuugggagaaucugccuccuugucuucuagggauaccccacauuccucaucuuauaaacccucuuccuccauguucaaaaccagcuauauaauaucccuuugacccucacgguguccggugucacaucccuuucuacccacagccaaugguauuuuaauuaaaaaaaaaauguuugaggugugguaguaugguggcucuguggguaaaaguacuugccacagagccagacaaccugaguucaguguauggauccacagaguggagggagagaaaugacuucgacaaauuguccucugaacuccccacaugugcuggggcccacaugggugccuacguguauacauacauacacacacacaaacacacacacacacacacacacacacacacacacauggggugggggcaggcagauacugaguaaauaaacaaaauuuaacuuaaaaaccagcacauaaacaaaccuaauuccuucuacaaugcuaauucaagaugguucaauagguaaagggcuagcuuugaaggccuggugaccugaguuaaaucccuagcaccucuauaaggaaggaaggaaggaaggaaggaaggaaggaaggaaggaaggaaggaaggaagggagggaaggagggagggagggagggagggagggagggagggagggagggagggagggaggaaggaaggaaggaagagagagaggaaggcaagccuccucugaccuuuacauguguguauguaccaucacauugcaauggaaauaaaguauuuuuaaagacgugggcaugugugaaggaugcuuuguuuuagcuucaucucuggguaugugcaugaccaugauguuucagcuugcuugagcugacaugggaaugcaaagacgaugcagauucuguaauguaugauaaagacuuuaaagccuguauacacugguccaagaaggaagaguggaaagauggacagucucgacagagagagaaauuauaaaaaugauacaaaugugaauuuuagagccaaaauuagaacggaaaucauacaacuccccaaauagaccacuaaaaaaaauguccaguguaaauaagaggaaaagguagagaaaagagacccuuccaagucagagugacagugccagcaucucuagugucugucacuggaguuccagcaaaggaaggaaaugaauaagaagaaaaaaaugacugagaaauaaugaccaaaagugucucagauaugacaagaaaugugaagucacaaauucuagaaacauaaugacuccaaacaguauaaacccaaaaaacucucuccagaugcaccacagcuaacgcaaaacuauucuuacaaaaacauuagaacauccaaaaagauggcgucuuacuuauggaauaacaguccaaaugaagaggacuucuuaucuaucaugaauaugcaaaugaagacaaguuagauucuuauucccaucaaauguugaugaugaugaugcccagaauagcacugaugugauguugggugugagaagguuggugaaaaaagaaguaagucaauguugguaaagggcaauuccgcaucaacuaucaacccuuuuaauagacacgccucuuuauccucaguuucacaucuagaaaucuaucccacagaaguguuuauagggguccccuaggguguuuauuaugguaucaugugcaaugacaaaaacacccuaacuagcuaacuaguuauugagauaucuagcaauaccucauuaucuaguuuaucuugucagaacuagguaaacauacuaacuaguaaaaaugcuauagacugaugcagaugaagucauccuuaaauggaucacagagccccacacugggauacaauguaccuuuuagagcaauuacccuggagccaggucuguuggcaugggaaggaagcuaugguauauugcgaaauagcaaaauaaaauuugccaaacaguacaugcauaaaucaggacuuguaauugugccuguguagcuauaauugcugaggcuaagaacugaaauaaaacccaaugugacaucagccaucgcugcuggguggggaacaggagaauaaaaagggaacauuuauucuuuauuauaucccuguauagauuuuaugaagaacauuauccugcaaggcuuuagucuuagaaauucaucagucuuccacuguuuucuggaaacagcucuuacccacuucucuuauagaaauccaaucauuuagccaucaucuccagguaaggaagcuauuuaguacugcauaacaaaguaagucaaaauuuaccagcucaaaacauccaccauugucuuaugaaucuuuuaaggacugggaacccuugagugaccuuggcuaggugcuauggucacagggucucuguugagguuuugauaaagauaucaucuggaacuauagccaccugaaagcuugcccaggcugagagggucuguguccagaaccccaauauaauuugucaaaguuucucauuggucuuaauuucucaccacauggaccuuucuacagacugcuucuaggccagcucccugguccugguaugacuguucagagucaaccaagacagaaccacaaugauauuuguauguucuucaaaaugaaacacuaauacuuucuggagugcauguggaguuggggcuuuauccauguguacguauguggguaggugcaagugugugugugugugugugugucagaguuaauauuaguuccucaauugcacuccacuuuaaccuuugagauugaaucuggagcucaccaauccagcuagacgagccagccacuggcucuagguucuacugugucugucucgacaacagacacaucacuugugccuggcuucuuacauggauccuggggaucugaacucagguccacaugcuuaguaguaaacacuuuacccacugacccaucuccccacccccuagugugacuucugcucccaucuacuggucaugcauacuggcugagguguuugaagagaauauggggagacagggaacauuguccuccuuuugaagacaucaaggagaaaauguuccucacucucuuccuauugaaguucacagaccugggaaccuaugaaguacagaucuguucacaugucaucacagauuaagggguuugggggcuuccaaucucccauaagaggaaaaccuuggaagcuaaacuagcaacaccaauucauagagacccaaaucuuuucuuucaacaaggaaacuucaguuucucccagaguguaaugagucagaaaagcuggggaaacuucgacuguaaacaacugauggagaagaagaaccaggcaccucagcaaccgucccuucaaaccagagccugucauuggcuucugccaugcaggacagacaucuagaaguggaaguacuugccaauuacagaccaaugggagagucaguuuagauuuuuaguuacucagaaaauauuagagggugaugaauaaaauccgaggauuuuccugacauauguaaagaccugauuacaaaagauuugcauuccguauccuggaguauggcugaauggcuuuguacuggcuuguuucuguucaggcaagcauuucacuaagucuuucguaaugcucuuggagaaguaauggugagggccgcuucaucgcaaguuaagcaauucuuauuugaaagaugcugauuacauuauugucgucaacuugaaagaaguugcacaccuuagggcuuuuugaaauugaaccugccucccgcaacauuuuuaaugaacuaauuggagaaagacaaagaaaacauguccauuauaaaugcaaggauugucuaguuagaugggagaguuaaaaaguggagucaauguuucuacagguuucugacaagcugaaacaaaagagugguaagugacauaaaguccugcuggagucuaaaacaagagaugccuggcaaugcugaugaggucauuaagaaucucuuacaggagccacaaauacaccaagucagcccuuugccaagucugcccaccagguaacgaaaaaauaauucugucucaugaagaauacacagagacugagccugaugaacaaauauguggauuccugcugugauugagagauugcuccagcucguuuguacauuuagcuccaagaucaugcuguguucugcuaauaacaauacccuucaugaccagucugguaauuauauccagaaagaaaggaaaagagugaucuuguguucuuuuuacaaauguauucaagcauugcuuaauagaaagauauauuuaccaggaauucugcuggauucuggaaacacagauguuugggucacagaaccucaggguuagaauuaggaucuagagaagacagggagaugauaauucauauccuuccccagauucauaugcugaaaccaaauccuuacugugacauuauuaggauguggggccuuugagaggcaacugggugaucggcucugccugaccugugaggcagaaagggaggccuaccacacugaaugcugccaucuuuaucucagaauccucuagaccuaugagcaaugccaauuagcugcuuacccguuacucuagcaagguauuuucuuacuguggcuuaaauagauuagcaaagggauguggcacggggucuguaggauaucucccugccaagauucuucaacccccuucuacuuauugcagaacgaauguugguuguucucuagaagauuuugccugugucauuaagguuccugauaaacggacuuuaagaaagauugccugauagauuaagggucauccuaagcacauggacucuugacagagaguuuccccugcuggugucaguagaaguaggaggaccauuucccauugcuugcuugaagacagagagaccaugaggugaacgauauggcuagcucuuggagcuaguaccaggaacuccaagcuagcugauuagccuguaaggaaacagagaccucagccccauagccacaaggaaacagauccugcuaguaacacguauggguuggaggggaccccaagucccacucggaaacugcagcuucagcaugauaaaaucuuaagcaaggccugaagccaugcuguuggcacuaauuaaucacccuugguauacaccucucguaaaacgguuucuuagagccaaagggguuuaaguaucuugugcaaagucacacuguuuaccgaagaauccagaugcuucuaaacucucuguucacaccccauagcaccacaaagucucuguucacaccccacaaaacaccacaaagucucaguuucuuccacuacuuuugcuaccaagcugaaaaguccuuagaggaaggaguucauggaugugagcucuucuagaacccuccccguucugaagacacacuaugaguagugcugcaaauagcuguugacaucuacagaguacugacugugcguguugcauuagauugcauuuaaucuucaaaauagccccaacagguaaaccauuaauagcccccauuuccuagaugaaaauaccaccaagacugaaagucuaaaggcugugucuauggucccgcagcaaaguggcagagcugagaugaggacacaggcaaucuggagcccgagcccacgcuccucccacucugccucugagccucuucuguauuccugguaccagacgggguccguugcauacauuuucucagauauucacaccauuccuauaaaagauuuauguccucgauuuuacauccaagaaacuggagugucagagggacuaaauaaacuugcccacgauccugauuugaauguaaagguugaguuuccaccgaaucuaugauguccugaaguuguuugucuuucugugcccuaaccaguuucucuauuuuccaccuaggauugggcugagaacuggagacuagaccuucguucuggacaaaaggaaaagggauaaggacagaggaaggugaugucugccagcugcugcuccaaauaaaaugcaccuacauuuacaaaggcccuggagcugguugccuagcaacaucuuucuaccuccccagucuguuccauccauccugacccaccaccauacauccacugagcuugauaugcaaggcccuugggaacccccucacuuugaagcugcauuuaugcaucuuugcccaauucauugggaagaugcuuacagcuuacaacuuguagguaguccugguagcauagcaucauguaccauucaugacccugggacaaggcaaaagagagcuguccucccugcauguccuucagcaauacaggauagcuagugcuuugagaaagaaaggucucauuuugggcuuuuugucaugucccugcagguuuaaaaaaggaguuuuguguuucucaugcaccagguacuuuaaauaguccuuugaaauaaaggcuugauuuggauagauaaaaucucuuuuuuuuauuuuaucguccauguuugaagucagagccucuuaaauuuaaaccuaucuucaguucaaccagccugaacagccucgggguucuucucgucucagagucaaaugagagaggacaagacagacaaugcaaaguuuccugaacucuuuaagcaugggccaagaggccguucagagucucccgcuucaccaagugugcaaagcuccagugagucccagcugugcuagcacuuucauggacccuagucccugcugcuucccuugucucuucuuccauaaaaacaaagacaacaauauaaaaagcuguagcuugugacugcacugcuaacgaccggaagauaugcauccacuguaguaaacaagguucauuuugcccuuaauucuaaaagggaguagaauguucucacaggcuucugagaggguggcagguuugugccacugaaccacuaugccuaugauaagugacccugcucagagugggucagcacacagcaagugcuccugagacacgggugcccagcuuuaugcauggagcaaggacaagaaagaugcaaguuguggcagcggccuucguaggaccaaaauccagcuagagggaaaaauaagcuugcuggcuacaaucacuaaaguguggaaagucaagugugguagccucuaaggcagacaccagaacccuuuucuuacucuguuguauucuuauuuaaauagccgaugcguuucccccuagguauggucuuuauuuuucuaaugcucuccuuaaaagucaucuaaaucuucccauucacaaaauuucaaagacaaaccaaagacaucuuuaacaaaagcaaccacagagucaggccaccaaauggguguccaucgaagaacuggacagaaucuuuugaaaucaucgauuauggggaaacaucuggagaggugagaggugaugcugguccguaggaagacaguuuagaugcagaauuauagcaaagucuagacugggcuuuggcgaccaucaggaaggaagaugcagagacaauguauccacuauugugcuaaaaggcuggagauacuuuuggagaggaaaggcuucuccgaagucagagccugacgugcuguuuguacuaaguaaaagcacuuguggaaucaaguggaugccguuggauaaaccuagugacaaacugucuuuauaguucaggugcccagagccgaggccugaacuaaagcuaacgccauauuguacuagucaguaaggacuugccuugugcugggaccuguggcggcugugcugaggucagugacaaagaggucaucagcugcaucccagggcugugcugauggcaauggaggcuaaaaguaaaguccagagacauccagagaccugucaaccgccacacagcacagcagaggcaggaaaagacucccagaggccugcccuccaccaggggcagaguggaccacaaagggccucucuccaugcaggaggggaagaugcccacugccaugccauuguagacaccuagaagccugcuuacuccaugccaugcagcacgggcagagaggucaucuagaggccucccagccacauggcccaccuucagggcgagcuacugcaaugugcaagcgugugguggguagaugggagagaggaguggaacaguuugagcacugugaagggaaauagaacuggagacaggagggaguagagaaauagccuguugugaauagccaguccugcuacccgaggucaugguaaaauccuguuccaugucuccacagagggucauguuuggguccuugggcaugcagcagcaggggaauguggugauguccaugacucauauuaccacuagagaccacgggggcauacaugaucuuggcagccacuuggaaccacauggauguccaagggcugugcagaacuggcccugcccuucacagcucuggaaagcuggccucacuuuccuccagagaggagggagaggcaggccagacaccucuccugagcagcagaguggagcuagcccugguggaaguggcaugagugagcuagccuugagggcaagagugagggagggcuagccccaugcugugaauuggcaugggcccagggaugaugcucuuacaccccucacaucucacugccuacaguaguuggcagagcuggccccugggucaugagagaaggugaacuuccacgccugucaauguuuguaguaggagggagagcagguccugcaccuugggugacacaguggggcuggucuugaugguaaggcacaagugagauugcccagagggcgugagagugggagagcuggcccaguccuuugccagcuacagcacuugggacaguuggucugguacuucaacuaggcagcacaguggagcuagcucuggcggcguacauaggugcagguaaaucagccccaaaggcaugagagccagagagcugacucugccuucugucuaccguggcacuggguagccuggucacagcagugcgggagagcuugcuuuguugaugcggauaagagagcgcucacgggcugaccagcucaccuaucacccaugcccagauccaggguuuugaguuggcccacuucaaaaccuguaccaucugugaauucuuggagcauguguaagggucaguccugcugacccaaagcugcaggaucuccaugacaccaggcaacaacaagguaacuggaaggaguuugggugaggaucccguguugauggugucacagaagccagagaccucgaaccagacuaaugauucauugcaaggaacacuugcaagugaaaaauguguggacagaggggcauaauguaggacacacuugaggcuuucacaaagauguuuucuaugcuuugguuuugguuuugguuuuuugggaguguguguguguguguguguguguguguguguguuuuauuugcguggcagggggagauugcaagggcagaggguggauaugaaggggcagagagaugaagggacuaggaugcgugaugaaaaauucacaaagaaucaacaaaaaguuuuuuaaaaaguaauuuaaggaaggguggguuuaauuggauuucuaguuugaagguagaguuucccacagugaggcaggcaggcagcaggagcuggaggcagcagucauggcacaacagggcacaauccuuccacagagagcuacccaucuuacuuaucuuagcaugaguggaucuuagguauuucaucagaguaauaaaagaagugagaacagaccacugguacucugcuuugaaagcgaggcaagcacaggugcaugaaaucuauaggccaauguccucauuaagaacaaugcuucauuucccacuagaaaacuaguaaguuguacuuaccagugugcacaccaaccaacugagauuguucaugggaugcaaggaugucucaaccuauaaaaaccaauguacacaccacauuaauaggugagggggaaaggaaauauauggugauuucaaaggcagaaaaacguaaacaaaaaugaacccaaucuaaugauaaaaacauucaacaaaccaggaauuggagacgacuguuaacauaaaagaaaccuuacauagaaaggacucagaguaagcccacgcacguucaggaaucaaaggcuggacuuuguccuucaggaaugagaucaaaauguucauuauuugccguuucuuuugaauaugguuuaugaaauucaagaaacgaaauaaaaggcauccaaaauuagauggaaugaauagaauuaucuccuuucacagaguauauaagcuaugaagaaaacaauaaagacucaaccauuauuaucccuaaccaaugaauucaacaaaauagcaggacacaaauucaacauacaagcaaaacaaaaaacaguuguacgucuauuuacuaauagugaauaaucuauaaaguaaauuacauggccuggcaagacagccacaguggguaaaagugcuugcugcaaacccgaugaccugaguccgaucccuggaacccacauauuagaaggagacaaccaguuuuccuaagcuguggucaaccuccacaugugugacauugaacauaccugaaacccaccggggccagaagagaguguuggauccccuggagcuuaaguuacaaacggcugugagccaccaugugggugcugagaacugaacuugggucuuuggaaagaacaguaaaugcuguuaaccaaugagccaucucaguagccugguccaaugauuccugacaaggguaccugugguaguuaaacugagaauaguccccauaggauaauauauuugaacgcucaguuccuaguuaguagaacuguuugggaaggauuaggagguguggccuuauuggggggaugugcauagcugggggguggguuuugagguuucaaaagacuccuaucguucucaguuagcuggaucucugccucaugcuuguggguaagauguaaacuuucaacuacugcuccagcaucaugucagccugccugacccaaugucccucaccuugauggucauagagucacccucuggaaccaugaguccccaguguaauucuuucuuucauaacgugccuugaccaucgugucuuaucacagcaauaagaaagugccuaagacugaaccaagccauucaauguguaaaggaccuuuuuuuuuuuuuuucaacaacugguaucaggaaaacuggauuuccacaggugaaagaauaaaagugaacccuugccugacacuacauaaaaaaauaaaaaauaaaaauaaaugcucuaaauggaucaaacaccuaacuguagaacuuaaaaccacacaagggaacagcaagauagcuccaugaauaacgaaccugcugccaaaccugaugaucugagugugguccugaagauucacacaguggaaggaguccacucucacgaguuguccccuacgcagugauguacacaugugugcacgugcacauacauacacacuagauagauagauaauagauagaagauagaugauagaaagauagauagacgaaagaaagacagacaggcaggcaggcaggcaggcagacagauguagaaaaaaauuuaaaccauaauauaucuacaagucugaggcuggagagauggcucagagguuaagagcacuggcugcucuuccagaggauccagguucuaaucccagcaaccacaugguggcucacaacgcucuguaacuccaguuccagagaauucaacauucucacacagacauauggacauacaugguaggcaaaacaccaaugcacaugaaaugaaaauaaauaaaaaacuuaaaaaagaaaagaaaagaaaaagaaagaaugagucaaaagcuucacagcauugaguggagcagggauuuucuaaaugugaucuaguagaaaaaugaaacuucauaggcuggagacaugacucagcuguugagagcaauggcugcucuuguacaaaaucugggcuccauucccaguacccacauggugaugcauacucuccucuaacuaccacccucagggaucuggugccauuuucuggcucccuuggucacugcacacagacggugcacacacaagcaugcaggcaaaauauucauacacauaaaauaaauaaauaaauauuguuaaugagacuucucgaauguuuuugguuuuuagacauggucucacuauguagccacggguagcuuggaacucacuguguagaccagucuggccuugaacucucagaugucucugacucccaaaugcuagaauuaaaggccuguacccccacacccagcaaaccucauauaauuuuuuaaauugcauaucaaaagacaguauuaauaaagagaaugaacaauccacaaaaaugaagaagauauaugcaaaucacauuucugauaaagaaucaacauuuaaaggacuucuaaaaguccaacaauacuaaaugaauagauaaaccacuaggcaugguuguacaugccucuaaucccaggauucuggaggcugaagcaggaggcucccaaguucaucgccaagguggccuacauguggcaaaguguuccagacuagcuuuggguuacaugggggaagcuuugucucuacacaaaaaaaaaaaaaaaaaaaaaaugggggaaaggugcacauggacaaugcccagugggcuuugcuguuguuuguuugccaacuuuacacaagccagggacaacuaggaagagggaauaucaauuaaaaggucuccaucugauuggccacugggcaauucuggaagggcagguuuuugacuaacaguuguugagugggcccacugugauuggugccaucccugggcuagcgggucagaguuguauuaaaaaaaaaaaaaaagggcugagaaagacauugggaacaagccaguaaauagugcuccuccauggccucugcaucagcccuccuuccaaguuccugacuugaguuccuccccugacuuuucuucacaauagacgguaaacugugaggugaaauuagcccucuucuccccaagccgcuuucagucauagugccuaucauggcaccagaaggcaaaugaggacuuuucuccaaagacgugcugauggauggccagcaaaugcauuaaaggaugcucaauagcacuaaucauuaggaaaauagaaaucaauaugccaaugagaugcuaucugauacccaucgcgauagcuacugagagaaaacagagcagccgggaaacugcugggagaacacaaaggcuacggaaaucucacgcacuguuuguggguaugcaagaugaccugaugagguggcaagcuguguggcaguucccuaaaaucaaaaaauaaccaguugucacacuguccggaaaaccaccucuucugaccucccugacucuguacucaguccugcucacucccccaccacacacaugauaaauaaauguaaaaugguaguggugaugaaaccguagauccggacacugaaagcagauuaacagcguacguuucuggcuauguguguuuaugugcacugaggaagaccaaggggaaagagucucuuuuucccuccaguaccgucuuugagucucuccugucugaugcuagcugcauacuuuacuuuccuauugcuucagaagacaaguugcaccagcugaauggcuuaaauagcaacuuuguuauuacacacaguggaagucagaagcccagaaguccaggggugcucugggaggcucugggaaggaucaauuuucuuccccuuuccauaugcuaaaggcuggugccuucauuagcuucuggccucuuucuccaucuugguucaccacacagcgucuuuccucucuccuuuguucccaggugacugucuccccacccuuucccuuccagccugccuccuuugcuuuuguucccaugucuucuucucuguguccaucucuccugcccuccuuugaggucuuuuaauaauaauuaaauuugaucaaccuugauaaucuaggauuauccuguauuugagggauccuuuggcuaaucacaucauuuuaaucauuuuagcaaauaaaguaacguauccauagguucuggggcucugggaccuuggggagcuguuauccaaccuaccaaagcacuucagcucuaucacugaauccuuguggcuuuauuuuuuguuaaaacauaguaaggauacacacacacaugcacacgcacgcgcacgcacaugcacacacacaccuuucccaguaacuauaaccauuguuuaagugucaagguuuaggauuugucauuuaucuuggucuucccacuggguaugccuguggugguuugaauagguauggccaccauagacuuauguguuugaaugcuuggaaguggcacuauuagguguguucuuuuggaguagguguggccuuauuggcagaagugugucacuguggaggugggcuuugaggacuccuauaaaaucaagccacacccacugaggucucauacaugaucaaggcacacccaguaggacaguccucuucuugcugccugcagaucaagauguagaacuccucugcugguccgucuucagcaccgugucugccuguauacaugugccaugcuucccaucaugaugauaauggacugaaccucugaaacuguaagccagcuccaaugaaauguuuuccuuuauaaguguugccauaguccugaugucucuucacagcaauaaaacuaagacaacgccuaaagaugucucagggguggggaggggcucacuauacauuaguaaucuacuaaucuacuuggugaaugcuugcugugccgcaagaacucugcuagguucagcaaacccuugagauacaugcuguuuguguaaaggagaacacagacgugcuggguguuuacagaaucagccagguucuauccugggggcuacagaccugaguaguaggguccaggagccuguccuauaauguuccuuccacucguuucaagcucauucuaccuuaucauggggaaacuaagcacgugacuacacagcgaaacauuguuucucugccuuccccuguagccuugccagucaaucuaaggagauacuuggaauggcauuuccccugugggaaccacaguuuauuucugagugaugggacuugggacauuuuuguuugcuuauguuuucugcaucuccccccccccuucgggcuuuuucugaugaacaucaugacgugagguagguggccauacugcaucuguaguccggaagcagaaagaggagacuguuaccccacagcuccugccucucaagccuucuccaccgugauggacugcauccuggaacugugaguccaaguaaacccuccccuucuuagauugccacugucagguacuuccuucuucacaacaaugauacaaaccuuacaccauaaaauucacugaauccauugcucuuagcguauuguugcgacugugaacauaucaguacuaucuaauuuggaguguaacugcuuagucauuuaguaagccugugcuggacuuuuaaagcaacugccaaacugccucuccauuuuacauggguacccacaguguuucaagagcuccacauucuuagcaggacuugcuaguguguguguguguguguguguguguguguguguguguguaggucagaggucaacuucaggugccauuccuuagcaggauuccaccuuggguuuuuuaaaaacagagucucucuuuuggucuggagcugguuaaucaggcuagucggcuggccagcaagcccuagggauccuccuguuuccacucuucagcauugcgauuacauguccacacuguccuagggauucuggacaucaaauccaaaagcucaugcuuguguggcaagcacuuuuaccaaaugagcuaucaccacccggugauagcuuuaucccggugcuucuaguuuguauggagugguauuuaauuaugcauugguuugcagcucccaguggcugaugacacagagcaucuuguguuaauuggcaaaaugcaucacuuuuauaaccauccaaagcaggcuagagauguaauucagaugguagagcccccauguagcauacacaaagcccguacauaaaaacaguugugauucugcauccgugccuauaauccucauacuuaggaaguagagaaaggaggguuagaaauucaagguuauccuugacuaaguaggaaguuuaaggucacacaugaaacgcuggcucgaaaacuaaaaacaaaaacaaccaaccccaacacuaagaaauaaaaagauuuugauaucuauuuuuguguguaaucauccagacgaccuuugaccaacuggcugcaguaagcgagguugccugugcaugcauucugcaucucacuaaugcugucaaagcuuuggggcuaacuccugcagcagcugcauugcaccacugacuaaaaugaaaccaucaccuaacucacuccccugaaguccuguucucguugaccacuguggagcuggcaucagaucucucagagcuggaggaacaaacagaugguugugagcagcccuggauggguucugggaaccuaacucggguccucugagcucuuaaccaaugagucauuucuagccccuaagucguagauuuuucaccauuauauuuuuugucuuuucugagucaaaaugaagcuauuuuuucauaaguuacacaagcacucaauuaugauacaugaaaaucuguuucuuuuuaaguguuucaaaaaauuaaaacaaacgaugggggcccauacaacuuuguagccucguuuuuuuuuuuuuucagcacagggguacaguuuuaauacauugaaaacuguuucaggugaucacuaccaucaaguuggccuuagaguaagagccacuuuuaauauaauauucuguuaaugaggagagcaagcauguguauaaugcagucaaguguaagacaugcccuucuaucauucaaaacuagcuugucuuuugucuuugucaguuucagucacauccacaaugcauccugaucucauugacccccaaacccuucaucacauuuugaucccgauuucacucucagugaggaauucuuuuggcaagugugguaacuuguuuucaccuuuaugcaugaaugguuuuuuguuuuuuuuuuuuaauuagauuuauuuaugugucugggcauuuugccuguauguaugugcaucaugugugugcagaaccuaugauggccagaagagggcaucaguuucccccugggcaauggagucacagaugguuauacaccaucauaugggugcugggaaccaaauccagaugcccugcaagaacaagugcucuuaaccacugagcucuccagccucacgugcgugaauuucuuuacccauaguucagucauaagcuaucucuuccuugacgucucuggggccuuccuaaacuuggagucauucuauucugugacaucccucagcauaugcuucuuaguugguguagacuucuguuucauuucuagccuuuuuguuccagcugucuuggcuugcuuuucuguugcugcaacaaacaccauuaccagaagcaacguggugaggaaggaguuuguuuggguuauggguuagaguucaccaucaagagaacuggaggacaggagcuagauacaggaacuugaagguagaaacugaagcaggggccauggaggaccacugcuucuguaucacuugauccugggcucacauucagcuuacagauaccaagcccagcuccguagagauaguaccaccucugcaucaauuagcccucccacaucaauuagaaauuuuaaaaugcccccaaagacaugcccacagccauuccgaauggagacuacuccucaacugagguucucuauucccaagagugucaagggaacaacugaacccaaucauggcacccgccauccuuacucccuaggaugcucucugcuacagcuccaaaucuaguguauuucagucucccggcccagcuugccuguguuuguuuaggcaaaugugcauucauaagggaauguguguaugucuauguuuuaaaauauguaaaucaaauggggcuauaaguccuguuugauuucuuacucaaacauuguuuaugaaaacuauccaugugcuacauguaaaucuaauuuauauuucugcaugcugaauucuauuccaucacacaccagaagcuguuaucuauauacuucagaaugcaugcuugccuugcuuaaaauaucacuuccugaacaucucuguaaauauacuguaucuacaccgcucuagaugucagagacauuucccacaaagaggaaugggcaauuucugcuagcgaccagcuccucugggguauguccacaagaaggugauugcugaauuauaggcucauggacauguaguuucuguaaaaucugcugugccgcuccccauauagaagagcaguauucaguauuacucagaggccuuguuucaucuucuacacuacaacacuuacuccuggcuagcugcacagauuuugcccgggucaugaggugaaguggccucucuguagagcccuguggcauuccccugugauugcugguccuggugaacaucauuucuuuauaggauaugcaaauugucuaugcuugcccacuguccuuguguguguguguaugugugugugugugcauguggaagccagaagucaaccccaggugucauucuuuaggugcuguccaccuugguuuguauugaaacaaggccuuacaguggcuagaacuugccaguucagcucggcuauccgacccccuguaucuguuuucccuguacugggguugcaaucccucaccaccaggcccaguguuuucacacgugcucugaagaucaaaaucagguccuugugcuaacacagagagcacuucaccacauucccucccuagcucuuacuguccuuuuaauuuuuuuucauucuucuaucuuauugcugauugucauuaauucucugugcaugcugcuacagauacuuuaaaggucucaugccuugcagcaguuuuucagagugucaccagccauuugucacuguccauguugccuaggauggccuucaauggacucaagucuuuugcuuuugauuguaguugaaauuuaaccaucuguuucuugauagcuugugauuagagcuuuuacuuaagaaauucucugccaugcaagggcagacagauaucccagucuuuucuccuauuaacuuuagaguguuccuuuuguauuuugacauuaauccaucuuaagguuguuugugaauagaucaagauaggacuucaacugugucuuuuccuccacauaagacuuucuccaaagcauauuccaacuagccucuuaguuacuuacuacucuauggcuuugaagaaacaccaugaccaaggcaacuuauaaagggaggcguuuacuugggggcuugcuuauaguuucaaaggguuggcccaugaucaucauggcagaggacuugcagcaagcaggcagguaggcaggcauggcacuggagcaguauuugagcacuuacauccugaucccuaggcaggagguagaaaaggcaagacuggguccugcuaugggcuuuugaaacuucaaagccuaccccuagugucaccccuccucuaccaaggccauauuucauuccauaauccuuccuaaacaguucaccaacugggaaccaaacauucacaugugugagccugugagagccacucucauucaaaccaccacgcuguccaucugccaugcuugucaaucugucucucauuguuuugucaaugcuuucccuggggaaauggaccagugacaaacccaagcuccauucuaccaaaguccaacuuggagaguuaacuucauuuuuacuuacagcaugggugagggauuauuuaucgguauauuaauggcgcccaaaguagccacacaaccacucugaaugucaaugauggugacuuccccacugcugcagauauggauucacuuccuuccacuagccugccauagacuguauacucccaagaccaugagaccaugugccgguggaacagaggugcauacaacuggcugggaaguccaggaaggaaaaacuggagucucaagugaaggugcaaagagcuuccccauacggccuccuucucaaaugacucauucacuaguuaacuccucccauuccuaauguucucuuucagaguugauuacucaaaagucuuuauugcuuucauagaaaacuuaaaaugaguuuaucacaaucccacaaauuccugccaugauuuugaucugaauuguaauaugaaaucuauaaagcaaucuagggacaaaugccaccagaguaauacuguacuucccccaaucacuuguguagaucaucuuuucuuuccuuuaauaaauaauggagcuacaguccuguguuuuauuaguauaaugcuaaaaauuugacacuuguugccauuauaaauaaugucuuuuauauacaauaaaacuaccauguaugauugcacauauguaacuuuaugaaugccauaugcucuauuugagcuccuguguccucuucagaguuggauuagagguaagaaaacugaagcugugagcgauacacccccuugucuguaaucauauuuaacguaugccacgaacauauccacuguaagcuucaucuaugaccagugcucccaaugaaacaaagcuuuacaaagaugaauaccugcacguuacauuccaccucaguuuccucaagaugugagucaaagccauguguaaaaagaaaggcagagagcuccagccugcaaggccgucuacuagagucagaagacuugcauggguuucucccucuuccuuugacuuugagcuugccccuaauccaccugaaccucacugucuuuaucccuaacauagaguaauaagccaucacaaaauccuaaggagauaugucugacauaggucuuggcaaggagaaccagucauggcuauuuggaucugaagguaacggauacccaaauuagcuacaguaaaaagaugaauugaaaacuuccaaacuaucucuaaugauuagaaauugugacuacgcuuacucuagccauggaucgcaaagacaauugauaauggugucuacagauaacaccugcauucaugaaucacgacuaaagagcaaaguucucaucucugucucugaacuugguagaacagucuaaggaacuuuauuuucggggacucuguucugggugaaggaggaagcugauguggguggugagauacucuuccucugcaaagagauaauuucagcagaaucccaaauaguaaaaugaaguuagcuguacugaaauguaaaccuuaugcauauuaaaagauacaugccccucuuauccaagagaauccuuucuaaggacccccacuccaaguggaugcuugaaacccagacagcaucaaauccuauauacacucuuuccuccuacaaacaaguauuaaugaagaacaguaauuuauaaagcacacauaguaaaagauuaccaacaacugauaacaaaauagaaccauaaagcaauauauuaugauaaaguuauuuaaauuaauaaauugcucauuucuagaauuuuccguuggguauuucccccugaugauugaccacacauaacugaaaucuuagaaaaugaagaggagauuacuguggcucaggaaaguaggaaucacucucagugccaacuuuauccuacugucuguaaugaaggugccagaaugaaggaccguuagagaguguggguuuauaaguagucagagagcauauggcuugcugugggagucucugagaagccuuccuggggucucacagcugaaauggcagaggaacggcacuaagaucaagucaggagagaaaugggccaagaagauucaaagcacaggccucagggacaauguugaauaccuccucaaaagcugcccucccugaccacggugcaggcguccucuccuuggcccugggauucucugcuuuauagcccucaccgagcugccaucauguauuaucuugcucacucauguuugaguguugucgaucaucucuucggggcuggaaacuauguaagugcaggaaccaacucugucuuguuccuauaccuuccuuguucuggcauccucauuauagaccaguaguagggcagagcggacguucaguccauaucauguuaaguagcaaagggagcccagaucuagcagaaaugggguaacaacuuguguuugucacuuuccucuuugcugugacaaaaugccgggagaacgugacucaaaaaaaaaaaaagaaguguuucuucgggcagguuaaagggugcaguccauuacagagaggaaggcagccaaccacugggcaucugcagucagaagcagagagaaacaaaggccgguguucagcuugguuucuccuuuugaaucggcuccagcucacugagcccucagcgaagccucucuggaaacuuccuuacagacacgcccagagguuugugauucuaaaaccuacuuggacugacagcuaagaauuaagcaccacacagcaguuucuuguuucuucuuauuaaauagugaccucugugauggaauuaaaguuacauuuggagucugcuaucaaacgcuuugguggaagaaacaacuucuagguuaaggucuaucucaccccauuuucccggaacuuuauucauaaggugucccccacccugauuuaacacucugugaauccacaaguuccugauuuguguuuagauaacuacccuaaguauggagagauguaaggccagucggugguggugaccuuggaugcaugacucacgccacagguugcgaagcucucucuguaaagucuguuuauugcauauggagggaaggcugggggaaggaugacgaaauaggcaaguguuuuauucucauugcggcuaccucuugguuaucauuaucauauaauaauuauuauugacaggcucuucaaguuaucgcauagcccagggugaccuugaacucaauauccuccugcuucacccucuggggugcuaggauuauagauuugugccauuaaauuagguucuaagggguuuuuuuuugguuuuuguuuguuugcuuguuuguuuuuuuuuuucagggagaacuaagaagccaagaaguacaaagguggcagacaacuaagaaaauuuuuuugaaaagaauuuuaagaaagaaagaaaaaaaacaaacaaaaaccaauaacccuaaaaucaucaggcaaaccaguaggggguguuaaaguuaaaacucuccacuaagaagucaaugggaauguaguuacagcaauuacugcauguucucuguuucacuggaagggaacaaacugaccuuuaaaaagaaacugccucagucuuuuucuuuuuuaauuucauuuucuguguuucugacuuuguuuccaacuguuguuugcauaaaaacaaaacaaaacaacaacaaccugcagcuaaauuugguggcucacccaacaaucccaggauucagcaagcugagguagauuucccacaaguccugaggccagugugggcuauaaagagaucuuuucucaaccccuucccaaagagacaaaaacuccaaugauauuaucauaaauaaaaguaaguuuuagcugggcaugguggcacacgccuuuaaucccaacacucaggaggcagaggcaggaggauuucugaguuugaggccauccuggucuacaaagugaguuccaggacagccagggcuacacagagaaacccuggcucaaaaaaccaaaaaaauaaaaaaauaaaguaaaauaaaauaaaaaguaaguuuuuuuuuuuaaaaaguauauuauuuccucacccgcauuuuuaaaaauucauaucauaucucuuguuacaaauauauaaacuaugauguugucaaaaaauugaauagucugggcccacaagucuguauuuaugucuuaagccaaauuuuauuaugacauucagaaauguucacuauuaaggucuucuauuuuuaaaagccuggaaacuaaagauagggaaugguuuucauuguauuucauuauauuuaaaaugauuaugggcuucuggguauaauuacgggugaauauuucuucuucucuuuuguaacagcuccuccaccauuucugaauucuggucacuaaacaucacccuuaaaguucaaaaauguuaauaaaaaugcugagaugguuuuguggggggaaaauguguuuaacauaucuuuugagguagaugggggaucgguuuuuuccuucuguuuaaagagggaaauacugaggcguugggggcauuguaagaacgcucugccugugggcagaguucauuucaagagcuggaaucugaaagggaaacugugcccgugcacuggcaggaaaggccuggguggacacucaaccucuagaaggacuuccucucugcccugacuguaccuccagggaggcagagacuggacuugcuugugacaccuucuaagcuuuagccaggggaagggaagagcccugagaugguugccagcuuucaacgguuugucuggcugggacaauuucagauccaauugcuauuguggcacaaguagaauucccacgcuuccagauuacuagauguguaagcuccuuucuucuugagacuccuugagaacagggucugugccuauucuuuuccaaagacuccuagacaaacccuagacuuaucuacccgggacuucucauggacacacaaugacuuugggaauagguacccuaacgaguuuagccuagauccauggauacagaaagcaauaauucacuguucaucaaaugggguggggucugacuuucuccuuagagaaucaaaauugucccuuucuuuauuuucucaucuaaaugguuuuuauuuguugcaguuuuuaaacaguaaauaugaugacaucaguucccuccucucuugucacuuuuuccauguagcucuucuaauacuuuaagugccagugacaucuugacaucuuucccuuuauuuguucuugguccuugauaaauaaagaugcaauccuuaaagagacaaaggaaaaaaaaugguuaccuggccccacccauggaaaucuagcuucagcugguuccagauggaaccuaggcaucagcauuuuuuacucaaucuccuuugacaauuuugaugcucaguugaguuugagaacuaccgauuuaaacugugaaucuuugccucugugacauauuuaguaucagugauuuaucugaugccaagucuuuggucaagaaugcagcauccaauuauaacacagaucccacagggaagaucaguuuuaggauuuuccauguggcuuccagaaauguauugcggugagaagcaaguauuguuggguauuuuauauuuccccaaugucucaaugacccccaaaagaaguuccugagagaaauuuguuuucuugauguucacagaggcucugggauagcccucugacacagucauagugugagucucauacaauaacccaauuuuuuauuauuggugggaugcugugagaaaaacagccuuuaaauagcaaauaagaacaccaaagcugauacugauguugaaauagaacaguuacguugcuaagaaagcaguucuucuguuugggauccugggaucaacaggucccuccagcauccuugaaccgcauccuguaauuggaucuaaacucaguaucucccccagaacuccuauauuccaaaguaaaggauuugauuuccugggcaccaugcauggaucccagugugggaaagaagaaauucuagcugguuccagaccagagacgaggucauucugcauaaacagagagagaggcaaggauaauggaagcugcagcgcaggaacaaggagauuugagacuguccacuuggcaagagaaaggagcauacagagacagcaaucucucccaggcuuaaaaugugagugacuagaucagcaguucucaacucgugggccgugaccccucuggggaucccauaacagacauacugcauaucagauauuuacacuacaauucauaagaguagcaaaaauuacaguuaugaaguagcaaugaaauauucuacgguuggggguccccaccacaugagaaacuguuaggaagguugagaaccaccgcuuuugacgcaugcaaaaaaaccugguuggacaaaacucauucugcaaaguaaauuugaggacuucaacgcuugagggcaagauacuauggaugaaagaauauuaagacagcuuucuaaauuuaagcaaguucuccccgccugcccccccacacacacacacacuuuguuagauuaagaagggagauccaacacuuccagggcaucagagaguggccagcugggagucaguacugaccagacaaggcuccucagcuaacucuaacuucucuguuccaagcuccaguauguaugugucaagcauaucccccaucccucucaccccagccacuguccaccacacccuccucagaggcuccuguuggcgccuucuucaagagaaaagaagccucugaaacagaagggagcaaaggcacccagcaguguggggcagcgcccugaaggugugagguagggcccaggguucugugcuugcagugaggagcaucuuccaaggaaggaagcagggaggacucuuccugaggauguagaccaggcuagccucaagcucccagagauucccucugccucugccucugccucugccucugccucugccucugccucugccucugccucugccucugccucgaguucuagaauuaaagucauacaccaaccacccugaugcuaaugauuuuggucccugaaccuagaaacccugcaaaguuuuugguuuuugcuuuuaacuuuguuuuacuuugacaucaaguugaaaugagaaaaaugcuuuuuugaaugcuauacaguugaaaacuauagugugcauuuauguaugcauuuagauauaacuccauauguguguaacagggagagaaagggaggaaggaaguaaagaaggaaggaaggaacgagagaggaagagagagagaacaaaaggaaggaaggaaggaaggaaggaaggaaggaaggaaggaaggaaggagagaggaagagagagagaaaggaaggaaggaaggaaggaagauuucucaauuuuuuuucuucuagacacagucucucuauguagccuuggccauccuggaacucucuauguagaccaggcuggcuucgaacucagagaucugccugccuccucugcugggauuaaagguguaggccaccacaccugguucaccuuuuuguuuuguguccucuuuguuuucuauuucugucugggcuauuuagcccaugcuggccuugaacuaacccugcaaaccaccaccacuccaguagauacaucucucuagagaaaugaggcuuucaagaugcacuguaugaauaccaggucaucauggaaaauuccauuuuaaagaucuggguuuuguuuuuguuuuguuuuuuuuuuuuuaauugcauguuuuagauaaccuucuggaguuguuuuguuuuguuuuguuuugcaaaacauuucuguccccaaagcugauucuuuucuaguugcccuacugaggaggaagccacaugguggcuggaaagagaacggguugggaaucuuugcaucagcucugugaagacagcagggaaacccuuguagccccucagccuuaucccauccgguaggaggaggcagggcugguuguuccugcuguaagacucuuacuccauaaacuccuuuguaaaacuucucacucccugugggaagagcuucguccagugcagaggcucucccaacuaaaaaccacagguugugugcacaagccaccgggcuguccccugcucugcuacaaacacugcaggaacagaagaaacaggcugaaacacaaggucuugcucguggccauccgaguucccagcagcucugcuccuugcucuucuuguccuugcuaacccuuccucuugacaucagcaaggucacuccacguaaauacaagacauucuuggccuggacagcccuggcugggaagccacacaguuagcgcucugauuccuguguucucugagucugugguucugaggugggagggagagucuggccugcaacucccucaugcugugcaggcuacagaagcauaacaggguugggcagcuccguaggaggcagcaggguaggggaggcugacccuccuccagggcuacccacucuuccuccacuagucucaacuccuugacucuucaaggagagcaaggugauuuaagccacuugugugucuuugacauggauguccaaacaggaagccaaagggaacuggcgguucaguuuuggguuuauaaagggagcgugugaccaggaaccaacaaguccaacuauuugugcuauaauucucaucugucugcauccagggaacucucccgugcaucgagguaacaugauauaaggcggcugucacugcuuagaaauuaaggucucuccacugcccguggaaugugagcgagccuguguuuagaagucaagcagaguuugugcugaucccuccauaccugccaagagaagcugaugugaaccagguggccugcuucaagcagaauucaauuacccagauggcaacugcuucuuaauucaaaacuuucacugcgccuuuuuuuuuccauuaugaaaaaugagagggcgaagagaauauauugaguuugagcacuucugguuuaugagauuagagccauaggagggaagugugucccuggccugugcuggcucccugaagcuccagccccaagcaagaugccugccuggcaugauguggcugcugguuccuggaacugaagugaccugccuguaacacagcucccucuugggucuguucuuaggaggauagaauagcuuuccccagcuaauuagcaauuuuauuagcagauggcaucugauuuggggggggggggagcugggagagaaagaaaaggagaaaggaaaauaaauugcauuuggagacaauucgacaauauuuuucucccuaaggcuguucggcaucagccccuacagugaggacccuggguuuccaggcuucuuacucugaaggugucuugucuggauggcagcugugacauuuugguggccuuauucccccccccccccccgguucuuaacagguucuguaauaaccaauuauucagacaggcagggccuggggugacccaugccaccugacuuggugggaccggcagguugugugucagcagccaaguugcugguuggaugagagcaggagagagggagggagagagaguagaaguggauucugcucguacucccuccucuuuuacaucaauaucuguggaucuucauccuucuugggcacuuacaucucccaggcugaguagguguuuggaaucgagauaauuccuuacacuucugaaacaguuacuguuucaaucaccacuaccacugugagcaucaccaccaucagccacaucuggaccaccaucauccgcaucucugccaccuccaccagcaccuccaucacuuucaccagucaucaccaccaucauuaucucaccaccaucacugucuccaccaccucuaccucuacugcuaugucugcaagcaaauaucaaaugucaaguuggcaggaaccuuucaagaaggcagaacacuaagauucauugccacaaggaacaaauacaacuggagcucuuugggcaauugaagcuaaauuauucauuaauuuggacucuucuuccuuuuucuauccccuauaaugccaaucuuuauugugagauugguugccagguggcuuaaauuuucuuuagucacugcaauugcauuaagcacugguuucugacaaugccaacaacaacagaagccucuggucuacccgggaguuucauuuaacaacacggaucaggaaaccagaagaaagacaaugcccugucuucccagaaaauugagccaucuuuggguuaggggguuguauguuaacugauugugaagcguaagcuucaaccccaguccguuucucucccauccucaacaauuuggaagacgcaguugggaggaagugguggagaaugaggaucaugcuggaaauuaagaaaucuuguaugugcuuuuuaaauaaaaugaguaggccaucgggaagcuauagggagggacagaugucuucagauucugaauuugacagggcuagagggccguugauaagcagacuggcuguggaaacuuagcacuguuucuuuucugccaaagaaaucuuugcaacaccacaccccuucucaaaacccugccacaucucacugugaccuccggaaugaaguucaagcccuggaggacuucuaaauccucuccaaguuguuugauacuaccuccccaagucaccacugacuccuccccuuccucacccaggcuccaaccauuaugaauugugauagcccaucauccacagaacaggcuuauauucugaagauuuuacccacgugcuguguuugauuugaguuuccuugaucuuccugaaucugucucugaagguccagucagggauguuuccuguccccuggcagagcuggcugcuucuuccuccgugcucugaugucgugagaucuagcuccucucaccauguuucuaacugucuccuccagcaucuuuuuuucaugcuucaugcucaguucuuccaggauggagagaauuccuuuuggucuuuacacauuaacaccaggcauuguguuaggcucugaaauaagccuggagauccuguaauaguuauucuggggacauuugguuguuucgcuuuuuguguugaggagcuguuguuuuguguaaaaugguucuugucgccauuaacuaauacaggagcaccagaguuauggguugcggaaggcucuuugugagagaggaaguaaaagacagagcacauccuagggacuuccuuguaagaguucacacaugggggcgggcauccaucacuaaaauggcagucucuuggcuaaacauaagcuguuaggaauugagcugguuacuauuuucauaccugaccuacuuuucuguugcuucuaugaccauuacaaaagcuuccagacuuuuauaaaugaaucaaccuacaccaagaucgccuuguauccccuccucuuaagguagcucuuuccuaagaagaaaauguguauguucucugacacccagcucugguaucuuggcaucucuagaagaguguugcucucaguaggaccaaccucaguaggaccaacguccguacaacacuuuugauugauuuuguauagaaaauuuucaggccaagaauagugaacccaucugggccagauauggcacuugcuuccucaagguuuacccuccugaagucagccauccaugcugcccauucuagacucaggacuugcucacgcucagccugccugaagcugcacaucuggauggccgaagaagaaacucuagaaacggaauauuuccaagucccagaccccuuccuguuugucauuugauuuuucuuugcuguguugaucuauguaaacaaugaguuuuucacugcaaggaugcuauacuguuucucaguguuugggguggagaugaagagaguacaagucuuggguggugagugcuagaauguagcugucuuuuugcuacuuuauggguucuuuuucuuuuccacccuuccccacccuuuuuucauccuuccagugcccuaacacuagguagaagagagaaaaggauacaaagaaaaggaggagacauuaucauuagacuacucccugcugauuaggggcaucuaguuccuugugguuggggaggguagaguuugaucuuuacugcuaucaagauaccuaguaucuucuucuuucuucuucuccuucuucuucuuugcacaagacuuaauaaaccuggaccaauaaccaaccaacaacccaucaccucuggagcccuagcauuuauauacccucugaaaaguacccacaauuccaagcaacgcacaaucacagaaacuauaugccaguggcaaaaucacaucccugcacaaggcaaaucauagucagcuguuguagacagucugaagcagccccauaccucacaccugggauuaaaauggaaaauauucuucuaauguuucuguguuuuuaaagaaaccaaaauucucacuacacuagaaaacagaauucugauuuguaaauucaggaaccagaguagagcacagaagaaacaguuaaaauaccuuuauuaccacuuuauuuuuaaaugcugcucuuaaugagaguaaauuauuuaagugacaguuucauuaaaaggauggcuaguaaaggaccuaaaacuuagacucuguugugguuggcaauaaucuaugacagucaccaauuuuaugcugaaccuucaacauucccagauguacaacuugaagucuucuauagccauugguacuugaagauauaacaaagaacuuucaaaagauacaccaaggagcuuucaaaaggaauuaggagcuuaguaggaaauggaauuugggaggagagcuuacaggaacuggaguuauuucucucuaaauggaauggcuagcuagcuaugugcauggacugcacuuuuaaaguagccaguaguggggugguaaaauagcucaguggguacaggggcuugcugccaaacuugacaaccuaaguucaaaccuuggaaagagaaccaacuucugcaaguugucguuguguauguuguggcaugcccugcaccuaaaaaaaaaaaaaaaaaagugugauuuuuaaaaugaaaaaucaagcaggcaacaauuuaucugcugucaaacaggagaaaaauaaauggauuuuccuuggagggguagaaaugagcuaggaagaacuuuacaggugauuaacacaguugguuucaaggaaggagaggggcuuucuuggggagccugggcauggguaaaauauaaaggauacuuaaugcauguuuacaugcuaacucuagggcaagcagggccaaggaaaaucucaucaucccaaauucuuagcucauugauggcccaaauauuugcuuccuauagaaaaugcuaauuagcugugggcuccaagccaucuccuaaaguccuuaauugcaacguuguguuuauucaacucugcaagugcucacucuaagugcuaauguucuuggcucagaacccugccuugcaucauauuuuucagacaucugcugacucuguucacagugauugggucaauccuucuuagcugggaucagagccuccuccuggagacagccacaccuggcagcccugagcucugcaaaugccuagucugagcccauccauuuaacuaugcuccaagcuagcaguuugaaagcguugcuagauuaaggagggagguguaguguucauuacucccugaaucucgguuucaucaucaucaaaagaggagcauguguaucuuugacuucuaagauuucauucagaaaucucuucugagaauagcgggggaaaucccuuucaagaagagaccuucagucaccuuccucggaagguguaccucguauaccuaagaccuccacacuucuaucuuaaccgugccuugauuuuacuugguucugguguuucguuuguuuuguuuuguuuuucuuuuguuuuuguugaugguuuuuaagacaggauuucacuauguaucccuggcuguccuggaacuugcucuauagaccaggcuggccucgaacucagagaucugccugcuucuaccuucugagugcugggauuaaaggcaugcaccaccaucaccuuuacuugguucucuacccauauccacaacucuccacuucaacaaggcagagucuuuccaucucuuuuuccauggggaguugguucuauguucagacaccaaaguaugaaguucaaagauaguuuaaguuuccaaauucaaagcaacccacacaacacacacacacaaaaugggggacaguuuugcugcuccauuuggagccauguaagaacuccaggacagguuaaaaacuauuguaugaagucaagagcaaaauacaggguuuaauuagacguccauacuuauuuugcccuuucuccauccuugaacacaacuagaaacccagggucuccugagaggcugucagcaccccaagcugcaaggaagcagcuguggagauaaagcagcgucuugaccuaucagacuuaucuugaugagugaguggaugaguaaggaggaccacagcccaagcaugugcuuucuguauuuuaguuguuguguuuucccauuuagaucagagccuauaggcaauucaucuuaaaguaaggucuucagcaagcaaagccugcugcacaguggcagugaucugccaugcacaggaaugcacuuucuuaagucuagcuaacacucugugaccuccaguugaacuaacagggcugguacugguacucuggauuugaagggucuuuccccagaaucgugauuuuaaauuuugcuuauaguuuccucuucucucuaagccccaaacugauuuaaucaaguucuguagaucacuggaagagauaaaggcugccuucugcuauaagcaacaguuguauaagcaaccguuguuucuaagaaguacugagaauugcucuauggaggaacugauaacacagugccuagauguuuggguguuucuccuucccuuacccucugcccacccccaccuauuuuuugcaagcucuacauccuacaaagcauugacacuugaaguugauaggucuauaucuaagaaguuaguguuuuccuuacuucuagguauuuucagagauggaaaucgaguuucucuucugaauccuaagcuuucccagacugcuugcuuuccugagauugguaagaacaacaacaaauacuuuguuguuucugauguuaaguuucagccaucacagcgccugcuuagccacugaaacuagaagccccgcccugcaacucugccaggccaagagugggaugcgacuggcuggaagugagucugaugagacccucaagguaaccacggaugcuguggaugcuguucuucaaaaugcuugagccaccucuuuuacuaaagauggguguucuuuuggguuuuagguuucucugccauaaaaaggagaaacucuccaacaaacaguuuaauccccccuccucuuuugcaagauuucauucauacagugcugugaaugaauuucuuacugacuuuuuuuuuuuauauagucauuugggggucauaagggaagggaaauguaagugaugcgcgcacgcgcgcguguguauauguccugaagcauuucucuagugguggagugagaggaccccaggacgaaggaaucaaagggaaagcaccauccgccgccgccgaaggaugccggccuggauucugcagagaggaaucccucggagucgugcagcugcuguccaaccccggccccucgagaccccagaaaagcuacgcugagcaaguagacuagccccgacugcgccgcacccacuguggaccuuccgcacccuacuccgcaggcugcucacucaaguccccaguguucugcaggcgggagcgcuccguagcccuugagagacccagacacccgcguccugggcaccggcgcccuccugccgggagcccagggcaggcagucgcuagcgcggucugggcccggcugggagggguuagaggcggaggcggagcuagcuggagccggugucagguugcuccgguaacggugacgugcacgcgugggcggagccaucacgcagguugcauauuuuaggaagugaggaggaggcacgggcucgagcugcggcugggucuggggcgcggagccucggcgggaggaggcggacacguggcagcggcggcagcagcggcggcagcagcggcggccucgguccggggcgccggccguccucccucuuuccucccgcggcagcccuaguucccgccucucggcucccccggcuccgcucucccggccgggagcugcucucuucucuuucuagucuccagcaacaggacccggcgcggggcccgcagcgccgccaccauggggaagggggugagugucuggcgagcccgggccccgggcgggggcgcgggaggaagcggcuuagagaccgggcucucggcaauggaggggcgggugcugagcgcgggcagcggcccgggaggaggagcacccggggcggcaucucugagccgggcgccugcccugccugagcccucuggucgccuucaccgcgcgccuugcgcuuccuuucucccuccucccaccgugcccaggggaaggagcgcuccuccccuucccccggggagcuccgacagggcccccucgcgguggcgguccucgccgcggcccggcgccggcgagggcagccuccgggucgagacucccuucuccuggaggcgcuggggcucggccagcuccccgcagaggcgaccgcccucccccaaaggaaaaaaacuggcuuccccuuaggccgaaccagcccagcgaagcuggugccagaaagggugugacuucacagcccaaagauagccuuuaagguauacuuuugagagcuuuaaaaugggccacuguccauaacaggaugugccuuugguaacugguguuaucgucuuaacgacggggagggguguguuguuuuaugucggagcacaauucuuaaauggggccaggcugacccuucagggccgcaggguacugucaaucuaacaaaggacuggagacugggcaguugaugguguuagaaaagccaugcggguuuccugcacugcugucucacccgagagcgguucccgaagagaaugagggaaucgggcacgaacaacacugaguucccaccucgguuacugcuguccaccucggaagaguuaguucuugaccucaaaguagcagauuaaaaacuuaaaaaaauaacccugaaaauaucaguuccuagcuugaaaaagcaccagucaugagaauacaggugggagaguccauuccacccuuuucagggcugaccaagcagacaagcuguagacacugcagguccuaaggcacccggguauauacuggauggagccagagggaagcacauucuuuggagacuugaaagagaugauuauaagacgugggccaggaagagagaauagagaccccgauagugcccagugugggcuggucggcguaugcagcauccuagcaaagaacugauucccuccuggccuccacuuuccacgauggaaaccggaucuaugugucacaccauccuacaugccauccaagccguuccuauaaaccauuuauuccuuaaagccccaucuuuuaucuccuaucccuucgaaaaguaucuuugucauuuggagaccuugagcggcuuuuaggaaguucaaagccuaggaaggugaagugacuuguucaaggucaaacgguuguuuaguggcaacaggugcugaacaaccuguugcucucagcuuacacauaacaucugccucugaagcaucauuuugugugcagaacucugaaguuauccuccagaagaaauugggguguuuauaauaauaaauaauccaggaggacguuuaagucagaguuaugccuuuaggccuaggacagaggcacucaagugcuacaauaacaguucaacugagaauuuaguuaaguucaaccgaaguguuuaauguacccuaacaggugucuagugaacuuaguauuuggaguacucuauucuauacauuggauauuagguugccugugugcauucauguaugagugcaugucuuucucuguggcuuacaauggcaaacuggucagaggaauauuucauacugaaauguugggauuuuuccacaugaggauuaaaauguggguggagcgaugacuaaaacccucuugauaauugguuaaccaagaagcuuaaaggcagcuaauuuuuaaggucauugugaucuuucccccaccccccaccccuuuucucaagugucaucuagggucuagaugugggugauaucuccaaaugauucuuccuagcuaucaaaacuggggucuugaacauuugguaagaaaaaugaaaguccagcuugcugaaucauuccuggauaaaauaggauuuuguuccuuuuuucuuauucaguguuuucugccagugacucggcuuauagccucauaaggccuaccacccacaacuguuuagcucacccaaggugcacaucauaauuguuagaaauguaggagccuuggcuuguuuguuaaacguuuauaaaaggugggagaagggagcgucucucuagccuuucauuucaguccuggguuugguuuacuauuaacuuagaugcugagaaaagaaauccuaucuuauggguagugauuuaaagaccaggcagggaaagaggugacacaagguacacaugucagcaggaaucuugguuguaggguaacauuaucagcugcccuuuuggagcuaaacucgaaagugugacuaaauacccacuggcugcuauaaagcuaguacuuuagacucaaaacccugugaggcagagucuucccaauggaaaguggcccagccuggacaggaacaaguaaggggcgcugacacuggggcugguccuggaaguccaggaaaacagaaaauaggcugugagguuguuuccaccuuguaagauugaaacaguucccugccuggaagguuaucagcacucacacacccccacccccuauuauaaggcuggccgcuggcuguuuguuaauuuguagcguucucugcuggcaaguuuguaacaauggugacucaccuugggguggaagaauaagaaaccgggaggcugcucuuuuuaaacccaagaugauagaaaacaccccccaccccaccccaccccccaaaaaagcuuuauaaaggucuaguaggguguuuauccaguugaggacuaaaacuuagaaucacauuuaagaauaaagagcaggcccaguguuagagaagagacuuggcacucgcacugauccaucccugaacucuucaaaaccaacgccugaggauuacuuagcaacaagugcacggagaagugacuucucuucuccacagacuguucuuuuaggaguaccucaauaaugagagggaaccauuaacuaaacagcccugaaggacucuguaugaaaagcuaaguuaaaguauugcuucauuugaagacaagcagguuucuugaaaaagcacagccugggagcucugguuucuggucuggccagauguacaguccucgcccugagagcaaguagagucaucugugugcuguguggagugagugccauaccagugugccggggcuuccuaagucaucagggcugggggacacagaucugcguaagcgcugcucuccaggcccuuucaaagcuguguaacaguuuuccuuccccugagaaauauuaacgauagggaaauauugagaaguccuguuaacugcuccucaaaaggaaguauucauuggcaugacugagcacuguaucacuguccaacaagcaaauccaaucagcagcaucuuagacuuuccgucaacauucacguuucaagugaagacuuucaccgugaucaguggucauuuuuaacuucuuaaaagugucauagggaaaaccggcaguuucucagcuaagaacacuggugccuggggggggggggggugcggaggggggcugccagccaacagaccugaagaagaaauccgagugucagaucagaugggcucccaguaaucagaguggcuggguuugcauaacaaagcacugggcagacuuucaccagcccugucuaauucuagauuacucugagacuagggcuaggggguacuaaugugaaguaaagggaauguuauaaugcaacaggcuuuaaacacuccuuccuuuauauguguauuugggguggggacuaacaagcagagucgggucugaacauucucacuuugccuugaauugagaguaugagaggaaguguguucuuuggcuggagucagagagaguguucucugcauaugacucaccucauuagccgugcugaaaucuggugucgggaauccauaagacauucuuaacauguauuuguuggguguaugggauagcagauucugugaauuagaaaagaggaaaccacacacacacacacacacacacacacacacuuucacccugauuugguuucauuuggguccugagccaaagggauuuuuuuuuuuuaauccaauagaccucauucuuuaguugcuuugugauuuuacagugaaaugcaucugggcacugucucuuagcagguuuuacucaaaccccacuuaguaacagcaaucucauagucucugcuggugauuugaaaggcugauugaugguggccaggcuuuaucuuuggagccuucguuauuuggggaacuagucuaguaaucacuguaaugguuugucauccuugggcccugguguuuaucuuuccagucuguuguccugguguuauucagagccuuggggcaguuggggugcacaaccugucuguuugcaugcucucugucucacuuccauggcaccaagcuguguuucuguaggcuuucagcaccuuugcccucuucaacucagcaguccguuugcuuccuaggcuccaaaccaccuaucaaagagugaucaggacuuccuggaaacuggcagccccucuguagugcuguuccaguuuuuaagcuuuucucucucaaaccagaauaaugagggaaaaagggggguuauaggggagggcagguggaggauguuaaggcaugagcagacguuuugauucauucaggucucuuggagagaucaaaugucccauggcgcuggugcuuuuuaguaaguagaagaaaaaaaaauacauuuuaagaggaagaaaauuuaaaauauaggaauucuucacauuacucuuaccauuuuuauuuuuuucaaauggucacgguacauuccauggccacaaggguggacuagcaggguuguuuaagaauucaccagggaggcagguuagaugauguucccaugggaugagggaacccaguggcugaucacggcccugugacugauggaugcagcccaaguuuagggacugaacuggguucacaaaggacccagugcucuggcuucguaggaguacauuuccagcaugcaugucuucaggagugagaggagggaccuguggcaccguacgugguuggggugccccuugguuaccuccucugcagagaauugcuauuccaaaaguaucacugugggcuggagaacagcuaaaggccucucacuguuuacccauugucuuccauuugccaauucccaccuagcacaggcuugguacaucccuuagguccccagcuagaaagaugaaccuacaggaagccauuuaggccgagcaucaguuggaaauguagcaaaguaggccagagugauacuuucuuuaacauguuucugaaaguuaccucuauaggaaucaaggaauggcaguaauguguguagugacuggguuaucacagugaccuuuguauagugcugugugugaccuuuucagacagagcugaguuugagguuuugauaugagaaccaggaaaauuggggaauacucccccacucuuuacuaacaguuggccaaaacuaggcagagccuucuguagcugaaucaggcugugucugacuucccugccaaauuggaguuugccaaauugaguuugaaggugccgucuccacagcccucuuggccagcugugaaucagcaacauuuggagcaguuacuuugccauauugguagccucucuugcuagucaaaagcuuuuguucucaguucuggaaacaauguggggguuguuuuguuuuguuagguguucuguuuucagauuguacuaaccaaacuaucagacuguguuagguaaguuaauaguugugacaaagcuggugucuaaggcugacuguucaaggucauguagcuggcaaguggcggugcuaggguaaugacaugggccagaauugaaagcaccauccacugaccucgcuaaugggagugggcaucuuagacuuccaaguacccuuugggcaaaucagaggggauuucagaagucuguaagggccuccugaguucucuggcuguagaaccagagguguugcuggugaguggaagccuuagaaggcaccccuagaugcuagugcacaaagcagaggcggugcugguggcuguguaggcaucaaguugcagucuacuggggaggaagguccuuauuuaaaucucacugcagagugugugugugugugugugugugugugugugugugugugugacugugaaagggugugugacuauguaugaguguauuuguguaaaagugugagagacuguguguguggaugugacaguguguuugugaguguguguaugagaguguauaugugugagaaaggugugagaguaugugaguugugugugugaacuauguggguguaugauccucauguuauuguaauuauugguaaauuugcagcugucuucuaccuuccccaagcacauuuccuccuguaagugaugaauuaacugaagaagaggaaggaagauuuuccacucuaaaaggucacggggauuucuuguuccuuuauugugagggccaacauaaagucuuguuacauaucuauuuuguccuuuguucuccccguccaggguuuucuccuuccaucuuccucauguccaaaggcacaguagcuuuaggaaucucugggaagguggaaacuggaggacacauagguugaaauagugacacacccagccuugaagugucacauggaguaaauaaugccuugcuauaacuuccuaguucuuaaauuagaauggaaaagauuaauaaccuaacuuacuccccugcaaccaacugcccuuuugaggauggcacagccuguucaaugccccuuccagauaagcuagagacacucaaagggcgucaauggaguuagucguucuugcucuguggugcugagugaagaagcaaucucguuuuucuaauugagaaaggagaaguuccaugccuggugcccaaacgagccggaaggucagcggagcccgggagggaggggagggaacaccgcaccacucccugcugugaccuuuguuuuuaaaagaaauaaggaaaauguugucuuaccccacaccacaaacgcauacuuuuucagcuuugaaauuacaguucuuagugcccauaggaaccuaaggaucucuugacccacaccaggaagaauuaacauuaaauuauuguuuuacuugugggcaagaacugaucggauaagcugccuaguucuuuuagacaaaaauuaccuacuggaaaaauuaagauuuugaagaagugaucuuacauguuaauacuuuccaugucccuuuuacagcuguccccauuuaaaagugccuuaaauagcaugaauuuauaaaggaguuuggcuauuaggaaauguagauuccucaacuuuacucucaauagcugugaagauacaggcaacacacugccuuugugauggcugauaaacguuggaagguauccagaaugggcuggcugugccaauaucucucuucucccucuugccguggaaaaugugagaagucuaagaauaaccgaagcacgcagacagugaggcugggggauucuaacacugcuccucauggaagcguauuuccgugaaaugagacuugcuuaaaaauguauuggguguauuuuaaaagucuguuuaaguugggcaugguggugcacgccuuuaaucucagcacucgggaggcaggggccagacuggucuacaaaagggaguccaggacaaucugggccuguuacacagagaaauccugucuugaaaaaaaaaaucaguuuaaucuggucacauacauaaaggagccaagucggcagcuauggaauggcuuuaccgucagauaagcagagaaacacgcuccauccuaacuccagcacacagcuccacuccgagaggcccuuggagcugugcugacuccauagcagagagagaauguuaggaaugcugacuguccuccacucugcccaacuccacucugcagauaaggugaagauucaagugcccugcucucaaggaagaagucauuugucaagucacaugguguugaauagcgucacagauacuacucacuucuccaacacccacuaaucugagcaggcuuucucuuuggagccuuccaaagucaagugaaugcguauuuuauuugcuacguacuaacuauaagggccugaaauacacgcuuugggguuuuaccaagcauucauuguaaggcaagggagguggccugcaggggugagcccucuccacugccugacuuuggaguaccaaguucugguuucauacagaucugccgagcacucuaacagggugagggaguggaacagucuaaauuuaaacuauagaaucaacuccuuccagucuggagaggcguagguggauccugugaauuacacgguaacgcacgcgcucucccugcauccugcuugugucaaaacauuuccagggccuuucauuuggggagaucuuauuuuagguuacagaaugggguggagacucccuuucuuucauuuucuucuuuuuugucuuuguagcauuauuuaaaaauuuuuguggaccuuuagauguuuuguuucucucugaaaaaaaaaaugaaauguggucaauaucuuuaugugaacauuaaugguguuuaaacuguguauaauggcuuugcaucgaaaagaauuuaaucaucaaaucagagugacuggcacuuagauguaucauuaaauccucaggaaugcugacuguccuugucguguuguggaaagggaaauugguccuuagggaguugguaacuucccucaaacuucuuuaacugguggcuaguagggcccaggacuucagugucugucugauugacagugcaaacuuaggcaccggacuggccucaagaucacuaauggaaacauuguuucauuccuucaguaggcaaggcagaagacugcaaaguagggauuuuaacauuauagccacuguucauuccaaaugggaguugcccuagcaaggcuguuugaagccuguuacaacuuccccauuguucuguauaacccaggguggacacaagaugucuuuaguggcuguaauccaccguccauggccuuguuuaggugccucccuguauaagccccuaggcuagguuguguugugcugaauauuaacccagugacuguuccaaaccacugugucccuguagcuuccaucccuacacacacacacacacccugcacaaccuuguguucccucccaggcgcugcacagagcucacccucucucccuucccccuccuccugucuguagguuggacgagacaaguaugagccugccgcuguaucggagcauggugacaaaaagggcaaaaaggccaagaaggaaagggauauggaugagcucaagaaggaagugucuauggugagugcugggaggaaaacuggcucuguggguuucccuaaaaauccauugcaccugagcccuguggguguaugcuucugcaccggccuagggcagagaacugacggguuggugcugaagagucuccauucuagaagcuacuaaaggguugagcaaggucucugucuccccuccauaagcaguggaagcauucuugauaccgcagucuacgcuugucucugaaggaugcugcuacugcagccucuuuaagcuaaggaggcuuccgugacuuaacccaucucuagccaaccuggacagaugagggccccgucuagacaagugguuccccaccuguggguugccauccaucuuggggucgaacgguucuuucacggggguuacauaucagguauuuauuuacaguaugauucauaauagcaaaauuacaguugugaaguaguagugaaaaaaacaucacugcuggggaacgccacaacaugaggaacugaauuaaagggucacagcauuaggaagguugagagccacaguccuagacacccaagaggcauuggguuucucugacucaauucagcaaaugucacccagcguuggagaggaagcugucucaggagacagucgugagggugaugcuuagccuaggcaguugagggaaggaaguuucaauagggaugaggagugagggugcuuuuuuuccuuuugauuuuaggauguauaauucuuuuucuccccccuuaggacgaccauaaacucagccuggaugaacuccaucguaaauacggaacagauuugagccgaguagguacccguuugaugccugccauagcaaaucauaguuuucccugugguauuguguuccaccuuaggucagaccuuacuaggaggauuggacugacagcugccauuggcugugugacaugcacagaacuuggacuucucuguugccguuucuucccugaaaccuuguuggaguggacauuaguuucucuguguugcagagcacccgguuuuguaggugguuccaaagccaggcuccuucacucaaagugucuauauuuguaaaacuugagagacauacagcagcugcuagcuggguuuuuagcaguuaguguccuuguacuuuucucagccuggcucaugguggugugucagaacuucugucacccugagguacgacuuauguacaaaucucaaaacacaccuucccuccaaaauguguuuuguaucuuuaaguucucucccacugcuaugagaacucgucugcgagugcugucacagucacaaucaguacagugacugagauggaugacacuauuuuagugacagucugagucuuuggaacaacugccccugugcucagagagcgccuaggcucugcucagacucucugcucccacugggccaggcugccuucucuaagcauuucaccuauuuauuguuuuuauuaguuucuuaugucugugggcccuuuacuuuguaaacuggguuuaguagccuguaagagauggucauuaaauuaagcaggcuccaacccagugcuuagggguguagacggggcucagacguuaggugguuguuuuauugagcuagcagcaggcacgugacgcagauguggaugcuaaauaauucacuggucuucucucaugcuguuucuucuuuccucgcacuuacuagguagcaccaaaguuaaaaauaacagacagcacguccauagaggcacacuuuagacagaaauguguucugucucuuucuaagcugauauuuuaguaguacaagaguaauccuguuuucuccucuuaaugugagucuugucugccacugagauggguuuuaaggcccauuagaccaugcagacggcuaugcaguggccuuuccagugagcacuguuaagcugacagguuucccaggaguuagcugaaguaugcgugugggugagcccuucacugccuggccaguguuuucauuaccauugugagaaugaaguucuguacuuacaacuuggcuguuaacucagggaggcuuggauuccugcagaaaaauuuuccugcucuccuguuuuuaggcuucccccucccccuuauagaaucaauguacagaaaacucucaaagcuccugacaugcaaaaccgaaccaguuuguuaaaaccgagaucuuuucgguauaaaaagcaaccugauucagauuuuccacaguuccuuuuaaaagaaguuuuaaaugaggucuuagggcauuacgggcuccuaggggaaugagguuuguuugucuuuugagauucccugcuuauuuugggggaguuaaccaggcuucaccuggcucugcggccaagagccuguuucuuccauggauuucuuguuggaagagcgugauggcuuuugaaugcuggugugcucugucugaugcacgccucucuacuccucagggauuaacaccugcaagggccgcugagauccuggcccgggauggccccaacgcccucacacccccucccacuacucccgaaugggugaaauucugccggcagcucuuuggaggcuuuuccauguuacuguggaucggggccauucuuuguuuccuggcuuauggcauccgaagugcuacagaagaggaaccgccaaacgaugaugugaguuguguaguuacgguagcgcuguugccucccagaccgucuuggucaucccugcucacauuugucccuucuucucccacucugggucauucugcuggccugagggugccugcagcucugcugagcucugccuggcucugccucccacugcuugauggcacagcucagcucugcacuuaggugugcuggacuugccuagaaaaguuuguccuuuagaaguucuuggaaagauaucauuguuuucaugaagcaggagaaaucgacucaccuaggagauuugaaaaggcucauuaagucaauggccaggaaucuguaacuuucucugugucugagccuccugcccacaggcucuagagggauaaaugugaagacacaagcucccuauuccugaagcuguggccccuccagauguguuuucuauucugucugagcuaccugacuauucccucuggggccuaacuugucuguuuuuacuucuagcuguaccucgggguggugcucucugcuguagucaucauaacuggcuguuucuccuauuaucaagaagcaaaaagcuccaagaucauggaauccuucaagaacauggucccucagguacccacugcuucauccuucccuuuugagagauugacaguucucacaauauaaguuagugugacauuaagauaguccaaguaucaagugacauuguccccgagagcaagggcagcgucuugugagaacagcccuaggguaacuguugagcugcaguguuuuuauauaaacaugagugauaucuuugcuguggacccagguaauuugggauacacgcauuuuuguaacuugguuuuuuaauuuuugagcuuuacccuugcuuuguugggcucccucuaacggugucaaccaucuucccuucugaagcaagcccuugugauucgaaauggagagaaaaugagcaucaaugcggaggaugucgucgucggggaucugguggaggugaaagggggagaccggaucccugcugaucuuagaaucauaucugcaaacggcugcaagguagcugaaccaggagaccucucuuggcuagcucggcucggcagaccuggguccguggugagacuggggaaucaccugaugcuauuuucccucacauacagguggauaacuccucacucacuggugaaucagaaccccagacucgguccccggauuucacaaacgagaaccccuuggagacaaggaacauugccuucuucucaaccaacuguguggaagguggggcuauuuaaggcacuccuuggcaugucugaguauuaguguggguauuaacagaaagagggagagggggcagggcacaguuccucauuucauuggcucuguucugacagcuuuccuuagcagagagcagagagggaggcuuccccugcugccaggaaagcccaggaaguuuuucuuugauccacacaguggucugugcugauagcaacaggccagugugacuucucuccuggcgguguauaccagugcugucaccagacucugcuuuaaaacagacagcaagcuacccagaaagcugguucuguuuaaauaaaggacaggaaucugcauguguguguucucugaaaccaagcacauuuucuggccucuggcugacacgauccccucacaccuucucuuaaggaaccgcacguggcaucgucguguacacuggggaccgcaccgugaugggcaggauugccacgcuugccucugggcuagaagguggccagacccccauugcugaagagauugagcauuucauccaccucaucaccgggguggccguguuccugggggugucuuucuucauccuuucucugauccuugaguacaccuggcucgaggcugucaucuuccucauugguaucaucguagccaacgugccagaaggucugcuggccacugucacgguaagaugcccggggacagcagcaguggccaucgcucugaucagcuuguguggguacagggcucagccaugaaccucuugcagggagcugccaacgucuauauuuauuucugugcagucuuugauuccacaucacaugguaaacuuugacagagaaaaccuuagcacagguuuaucagaaaccccaaagcauaucauguuuuuaaguuaucauguaacccagcugagggcaauggaggaaaauaguaauuuggagguaguauggaggguagauagacuugauaaauucuguuuguuuuguuuuuguuuuuuuacauuguuuauuggagaugggaggaagucccuaccaucuucaugacaucaugacuuggggagaaggcuggagagauugaauucuaaacagauuucuucuguauuaagaugugguggaauuuguccagccuggaugagugauguccguuucuugccugcccugucugcaggucugucugacacucacugccaagcgcauggcgaggaagaacugccuggugaagaacuuggaagcuguggagaccuugggguccacaucuaccaucugcucagacaagacgggaacucugacucagaaccggaugacaguggcccacaugugguuugacaaucagauccaugaagcugacaccacggagaaucagagugguaaggcuggagcccaccuuacgccgaagcgccugcucaccuuggccuauuuauucuguguauaugugggcacaggcaugccauugcacacacguggaggucagagggcagcuugcaggagucuguucuccccugcuguguaggucccagaucaucaugcuggccuucacucucugagccuuccugcuuguuuuuaagcccaugacacuguuuugguuuuugguuuaauacuuauuguuggauggagagagagggagaaaggagaccaaugaagcuaccccaugcacaugauuaagaaccacuagaagcuaaugucuuugauuaggaagugggauguaucaguucagauuuuuaugagacuuuaauagaacugguaauaugccacagucugcauagugagcgagucuugagcuggagagaugguucagcaguuaagagugcuuguugaucuuauggaggaccuagguuugguuccuggaaccugugucaggccgcucauaagugccuauaacuccagucacuggggaauugaugccuucuugccucucugagaaccugcaugcaugugacacacauaaauucaugcguguauucaugcacacacagagaacgcacacauauacaucauguauccuugcuuccuuccaucaggugucuccuuugacaagacgucagccaccugguucgcucuguccagaauugcuggucucuguaacagggcaguguuucaggcuaaccaagaaaaccugccuauucuuaagguaugccucugagaagugcucuggccugugguuguuuggggugggguuggggguggggguaagggugugguuagcacauaagaacaccaccuugcuuuccaaacagcaccuugccuuuguguguagaaaaagagcuucauugcagcaugcuugagaucuuuuaugggaaccuucgcuccuuauagcaaagauuguguugccuuagagguccaagugcucucaguggucacaguccauacugauggggaggaagagaacagaaagugaaaaucggaccugagaaagucuuucuuggugaagaaaaccugucucaguagagcagguuagcccugccccucagacagcaccuaaccaaggggacagugaggcugcccugcugauucuaauuguguuugcaugcucagauacacuagauuccaguaaaucccuuaagccauuuauguucuuaaaauagcuuagcuauuucccuuaucuugcucgcucuuaacuugcuuacuaaugaugcaaaaauuagauccaggcacaaccucagccucuccgggauacucacacacagucuggcauggcugggauuuuacuguugcucgugugccacuggagucccacaaggcccacgaguuagagauguccaggugcugcgugagguuccgggaccccaucuguccacugugccgcagcuugccugugggaguucucuguauaaccucagucgccaaagcgaguauggcucagacguaacugaggcggcuugugaggcugggcuuaguuauucuuugaaggcaguuugcuuggcguugguuuaagaaugaugaugcuuagccgggcgugguggcgcacaccuuuaaucccagcacucgggaggcagagacgggcagauuucugaguuugaggccagccuggucuacagagugaguuccaggacagccagggcuacacagacaaacccugucucgaaaaaccaaaaaaaauaaagaaggaugaugcuuaucuugggagucacacugaagauggcugcuuuguguuuugccuuaccucagaauggggcauuuucuaucugucuugaccaaagguggggggguguagauuauggagauguuugaaguauuuggguagcuaagcugugaaaauaauagcuuuacuaccucuuccuggcaagguuucugcaagucauuuuauucugcucgauacuuggauuuucuuuuuuccuuccuuccuuccuuccuuccuuccuuccuuccuuccuuccuuccuuccuuccuuccuuccuucuucccucuucccaaaugcucaucaccaccaccacccuucuuacacagagcugcuguccuugugagaauucacuugcucaccuguaugcgcccaggcuugugugucagagcucucacauauucaccuguaucaaaguugcuuacaggagaaaugcuuaguaggucaaaacagcuauguggccaugugaguaaguagaucauagaaaaacauauguguguguccccaaacaaagacagugacuaaaauaucagcugauuaugcugcuuccagagcugguaacagcuuccagcucacaaacuucaggugacuuugcacaccugaguuagguuuacagcauggaggccuuugcuuugcccuugacaguuugugcccggcucugaacccuaagccauuucacuuuaaaggcugggccagugagugauacuagaaauccuugcucuuuuugguuuuguuuuuuuccccagacuuauaagcagaaguguucaguugugaauaguguugaauguggggcuuuuuagcagcccgggggaagguuaugcuagacugcaguagguagggagguguguugguggugccuccaggaacccuuuccccugaagcugccguguaugcugaaggaggugaggcuggagccuggggcacugugagcagccugguccgggucacuucucaccuguuuucucugccacugacaagauuggaguacauccagaguuuucuauuucccagugaugccuugugaaucagccuuuccaggucacuaacagacgaugucucuguucccagcgggcaguagcgggagaugccucugagucggcgcucuuaaagugcauugaagucugcugcggcuccgugauggagaugagggagaaauacagcaagauaguggagauucccuucaacuccaccaacaaguaccagguacgccgaucagggacgcucauacagcgcaagggggugcuggggacaugagcgagaggaagagacauuccaaacucagguuccacccgguguaacuuuaaauuugggaguguccuuuuuauuugaauaucaguaggagaaaucaaaccucucucagaauguuguuggggaccuuggaauuggggggcgcuggaaggggagggagauuuuguguacgcaagcauugaccagccuuuugcuuguccaagaguucaugguggucucugugagcaagcacauguaagauguguguucacacaugaacuuaggcaugcgguaagugcuuuuuccuucuguagcauucaacauguauguaucgugagguauuuagagguccugagaggagaucuuacuugcuuuguaguaaauacuaacuaguuaggaaaaccuacucuuacccccugaauugccgcgugcagccaccuaauguuuccuucugaauaaauaaucuucacaguuguccauucacaagaacccaaaugcaucugagcccaaacaccugcuagugaugaagggcgccccagaaaggauccuggaccgcugcagcuccauccuucuccacggcaaggagcagccacuggaugaagagcugaaggacgcuuuucagaacgccuaccuagagcuggggggccuuggagaacgugugcuagguaugcaggugacugccacgacuccugagcacagcucugucagacagccacagcaacuucuaugucuucuggauguuccucuuaauuuugaggggagcuacccugcuuauuugauaugccuuacauuguuuaaagcaauaguugguggggcaauaaugaucauuuuagcccagucuugaugacuuacugaccuguggcuugaugcuacucaguucuguauagcaagaggugggggugggggggcaguuuauuaucuaaccucauuguuagggccauggucuguaagcuuaguuaaaaccugcuaguguuuggugugccuaaguuauaccuaggaugacuguucuuguccaugggaugggaagugaccacucuacuuauaaaaccagcacaguaaaccagaaagccaggcugcugacuaucauaaccuagcaacugcugagaaguuggcucagaaguuuauuuuucccucuguccaguuuauuugugcaaauggcacuaaaaauauuuuguauauugauagacacaaaugcauuauuugauuauuccuggugagaucauugagaaccaaucacuucgucuaguucucugagucagacaccuuuuccugcaaaacuaacccacaggcaguguuucucccacgugucuguccaaccgaaggacuagagucuucucuaaggucauuuugcuuuuucgcuuugcccaaccccaaauaagaaggcucuacuacucuucuugagccugcacggugucuucugucccacuggacagacuguugugacugucacacgguacugaaggccaagucuggggugucuuaugucuuagaaugauagaacccuaugacacaguuacagcaggauaucuguucuguguucauugucaaagaagcuccuaagaauguccgcccuggugcucaguaacagugacuagauaggaagagacggcuucaguuucccagauaagguacuuagauauucaucacacugcagcccagugguguggugcuaagagcuaauguugucagcucagugucccccacauugaguacucugucccuugguaacucuuucuggagaagucugucuuccagccacucuuguucuuucccugacucugucuuacucguacacuuucacauuuaacaugcaacccaagauguugaagggcugcagugacccccacugucuaaggcacggggaaccuaacaggugugugcucuccuucguagguuucugccaccuccuccugccugacgaacaguuucccgaaggcuuccaguuugacacugacgaugucaauuuccccguggauaaccucugcuucgugggucuuaucuccaugauugacccuccccgagcugcuguccccgaugcugugggcaaaugccgcagcgcugggauuaagguagggccucugugucuccugacuccaucacagagccguggguccuguucucaacagugccccaggucuaggcagcuucucucucucucucucucagauacucuuaaaagguuggguaaagagcagaugugcaguuggaggcaaggaagcaccuuacuuagucuuugauaaaagaaacacaaaugacaagaaaaagacaaaaagauugagguuuaaauuuggaaaugcagugaauggcgcauuccccguguugugagcugacuucucguugauucggucucugucuuuuucugaggggcucaauacugugcugcugcauuuacgcccucuuccgcuguccucacgcuuacgagaaugccucucugagaagcugauaguaggacguuguauuucuaaacaugggcuggggacacggcuuagugguuaagugaccugaauucgcaccaccucaugcagcucacaaccauccaugacucgggcuccugggagucugauaccuccaaggacuccugcacuuggugcacugucccccuaccccuugacacaaacucauacacacauaaucaaaauaaaaucuauaguuguuguccuucagaaccgggcaagugugaaagugcuaaccagcaauauacaugucaugauauauaguccaaccaauauuaggcuuucuuucuucuuuuaaugguuuuaguagaauuugauuuuuauguuucuguaaguaugauauaugcaguauggauguggucaugugucauaaaaucuugguguugggauguguuuccguaaaaccguguuuauauuuuucauaaguugauacaugucauucaacuuccuguuucaggucaucaugguuacaggagaccauccaaucacagcgaaagccauugccaaggggguaggcauuaucucagaaggcaaugagacuguggaagacauugcugcccgccucaacauuccagugaaccaggugaaccccagguacgacagacagaaagcuuaaguaugggcccuccuuggcucugggccgauugugucucggcuugcaccaagggaguagugagugcaccugcacuacuagggaggagucacacauccauggugcucgauguaaugguguaagaggcugggagggaaucccacuugcugagcuuggaaguagaggcuuaagggauguucagagugcuuggaacuggagaagucagaugauaaauagucuggacuagccacuggaccguucaugccucgucaguuuccaggcugaaaaaauaaaugagaaaggacaauuguucagauggcuccggcaacaaagaagggagaggccaucgaaguagagagagcaugggugaggugcucaggcagugaggugcuugccucaugagccucauggccugagugaucccuggagcacaucuggaaguaggagagaaaugacucuuaaguuguucucuuggcuuccauauguguggcuuggcauguguuccugcauacacacaucauccacauguaugcacgcguggaugcauccacacauacacacacauuaguuaaaaagcauauaguggagacaguuuuguuuucauucuguuguggucuagagcuuccucgcccugauuuggguuuagaaaaggguuuucucggcuccgucauuucuaaaagcaugucuguuauuccaguccgucugauagaguuggggacagggagguugcaagcuggccucccacggguggcugugagccuugaaugaggugauccguguaaccgucuauaaauacugaacaggaccagcucuuacguggcggggaagucauuugggucuugguucuguuucggaagugcuggcgaaugggcaggugaccuuugugacuuuccuggucccaauucuagagaugccaaggccugugugguccacggcagugaccugaaggacaugaccuccgaggagcuggaugacaucuugcgguaccacacagagaucgucuuugccaggaccucuccucagcagaagcucaucauuguggagggcugccagcggcagguccgugagcuacgggggccacagggccacagggccucaggcuccgggguccggugacagcagagccagaguagagaacaggcucucugugugcuggggaguucaggcauaggaagagggauucugccaugcuguagccuagaguuaagcacugaugaagucucauggaacagcugaguggguccuccugucuucagaggaaguggagguugccagaagacccuccccugauuuuuaaccauugcugugcugcagggacagggcuuaccacaaugcuguucaccaaaaucauuucuggguuaaaugggaggagaauaugcuugaugucauuuuucccuauugucauugugggugggguccaugucuacuuagccaagaugauuccaggacucggucccugcagccucagugggagagaagggcaucuauaaccugcugagugugucucccuucauuucaucccugcaaagauuugggcuuuauuaacccccuccccaccuccuccuucucuggacagggcgccaucguggccgucacaggggauggugucaaugacucuccagcuuugaaaaaggcagauauugggguugccauggggauuguuggcucugauguguccaagcaagcugcugacaugauccuucuggaugacaacuuugccuccauugugacuggaguagaggaaggugagagcaccuuuaagaggccaccgacagcucaucccagugggcaguuagugagcuugucuucagguccucguccgccagucucuucaagccuuauaauaaaaacaaucuugcuuuuccaggucgucugauuuuugauaacuugaagaaauccaucgcuuacacccuaaccaguaacauuccggaaaucacccccuucuugauauuuauuauugcaaacauuccacugccccuggggacugugaccauccucugcauugacuugggcacugacaugguacgugagugucuauaaccacgcaaguaguauuaacauauacccauacgcugcuaccagggcuggauucuugggaccugugagucuggcauaugaagagaaguucucagugaaugucuagguuucuuuccagccucagcaucauuggcuacguguuagcugcccuaggggcaguuguccacauucacuuuaccagaagaaaauucucauuucugcauaauuuacuuuaaaaaacauuagauucccuaauauuauuccauguaccaaaaagaaauacauucagaaaaaaggaaggcaaggugcuagagaggaggcucagugguuaagagagccugccaggucucccauuuaacauacacacacagaaauaaaaucuuaauauuuaaagagggagcaggaguuuuacagcaaacaguuccuaauacccacuuguguuccuucucaccuccccuagguuccugccaucucccuggccuacgagcaagcugagagcgacaucaugaagaggcagcccagaaaccccaaaacggacaaacuugugaacgagcgucugaucagcauggccuauggacagaucggugagccuugucccugugcauggcgggugcuaggaagggcccggaggggugugcucugucuggaguaagcggugauggggcucagacugaagagagacagauaggagagagcccagccguagaguaaggcucugacuucaguucugagugugcaguagagggagacggggaccagacuggagucuuugccauggaagaaguccucagcugccugacagguggugacuuuugugaaaacuguaguucuuuaagcagugauggcaaccuuccucauugagcccuguacaauaucagugccuggguugucaacuugggcauuuucccuggguuugggggaguggcagggcauaucccucugucccauggaauggagaguuugacaucauaaaacccugucaguuugacagccugcuccaugaguccucuccaaaugaugguucucccacccccaucucccacugguuucugcuccagcagacugaccagucaacaggacagcugggagacaggaaacccaaaugcccuauuucuuaaugcuggucuccuucaagggaaccaggugcaagccaccaggagugacuggaucuggccagcaguuaggucugugaacaauugcuagagaaggcauggguuagcaucguauaggaacuaugaccagcggucauuaguugaccccuggcagcaaggccccacaucuuugaggaagaccuacuuuugagagaaugauggcucuguccuggaaaacuugggguguccuggcuggauuggauggcaagagaaaagggguggccaugagauaaucauaucucacugacuggcaaaguggcagugugugggaaguccugaagaagaaaagaaauuauaauuuuuuagauuaaauaguaggaaaacugauuuccuauuggguuugugcccugacagagcagcugauagauagagagauggguguuuuaaaaggaaggccuuuguaucuuacucucaagaguagagcggccuugagcccagugugucccauacacucccucccgucccucagcacuuaagggacagucaguggcuggcaugccuuccugugccuucaucaguuggugauccagaaugggauccaccccauuucuauccccagcuccagaacucucuggggcugcugaggugaugguauggagaguggauguggagaaggggccuugggugaggucuagcacucagagggguuuuccaacuuagguaugauccaggcccugggaggcuucuucacuuacuuugugauucuggcugagaacgguuuccugcccuuucaccuguugggcauccgagagaccugggaugaccgcugggucaacgauguggaggacagcuacgggcagcaguggguaaguaaccgguuuacugggggauggaagccagugcuccuccgacccugagaaccagcagcaaugccacuagcugugagcuggggaagagccaggacugaggugcccgcuuccccuuucagaccuacgagcagaggaagaucguggaguucaccugccauacagcguucuuugucaguauugugguagugcagugggccgacuuggucaucugcaagaccagaaggaauucugucuuccagcagggaaugaaguaaguugugaaggaucugguaauuuuacacaaaccuuuagaauaaauucagcaucccacaucuaugaccuaguuccuggaauccccgccagccuacacccugaaggcagcagcaugucaggauuccugugauuagagcccaacauaaaagucuuaaacuuaaagggcuguuuggguguggguuugcaugguuguuccuaguucuccccaccgccugccguucuuaagccuggucuuuguagaugucaggguguuacagcgucagaacguuuuccacacccacagagaagaaagcucagcccccaccccacccccauccugcagcucagggucuugcuggccgcucaugcuaccaccuaacacaaagcacuaggagagaaaucugccucugcaacuugaaaacuuuugucucccuugaauuuuaggaacaagaucuugauauuuggccucuuugaagagacagcccuugcugcuuucuuauccuacugccccgggaugggggcagcccuuaggauguauccccucaaguaaguugagccucuuacauuccagaagauguggacauaguuuguguggcuuuuucccuugugccgugugccuggcuucugagugcuguauguacugguuccucggcacuagaagauagggaagccagaccugccaguaaaccagaccggcaaaucuagaccugccaggccagggauuugacuaaaggugagacugacaggcucugcuuccuugaaauugcucaacagcagacuguugagcccucagguccucugcuguaaaguccagcuguccuuagagccaccuagagcuagucuaggucuuggaggcccaggcucaaguccuguuugcuucuccuagucacauuaucacuucuccaucuuuugggagacuccaaaggaguuuggagaggacucacgguuccuuugaccucacaguccguugugaguggagcugcguaguuuagaaacuaaauucccaagcuguucuguguugagaagcagcccagccuuaaacauggcgaaugacuuugcgcuuuuguuaggucuugguuuuuauaugcagugcucaccauccagucuggcaggcaguggaaacuuccacguacaauugcugcuguccaguaacugguugaggcugagcaguuacaacucgauuaaacauguggaguugcagaacaggacacucuuccaacaucagauccuuugagagcgucagucucuugaauuccaccuggcccugucauugcucagacucaucuggaccaucucucuuccuggccucuugccaacacuuccauacacugaucucaucuuagaauuaaaacacuuuggccucaucaagugcagagucuauggugcaagguggggcaggccuccaggaugugucucacagccuguccaaggccauaguaggucaguucacuguugcccucucucuuucccuacaucucugguaaggauggucccacccaacccaucaauccugauagucccuuugggcugaagucauugcagcaucucuguugggguugcuauuucugcucuucugauaauaaucuuuauggcuuuuuuuggucacugugagagguuccauaguacccugcauagauuaaaagauggaagaaguguccaaguuggguuauauuggccagagcccuguugaaugagagagggacagagaggucacaggcugccacacagccucugacaaaucccaacaaggaagagcagagccucaggacauugccauuuucugggcaccuugacgcuuuugugaccugacuugucagcuucucuccauuuggucagggcuucuguuccuggcugaggcacugaggucaucuucccacugcuguucauggcacauaggaagggcggagacuacagagcuggcagggcauccuuccuccuuuguuuauccaggagcccguagucaaggaaaccuggugccugugggaggccacccggagccugugucucugcuggggaccauguggcagccucuccaggcucccucucugaagaccuuugucaucugucagggcucagcugguccucccugacuccauggucagagaccaagaucagggucugaauaaacuggcuuuggcccagacuggcagugcuuugucugcaaaugcgaaggcaggagaaaaaugcacuuggggacuuaagcacuuuaggaaaggaagaaggaaaauguucaaggcgcucucagauugucaacagaaaaugcaaccugauuccuagggaagcgcaagguggacggguuuccugcaugaaauguaggcuggccucuggcucuggggcuagcaauagagcuucuacuggguuuucuugccggggggaggugguugguugguuguuuuuaauucugugaaugaauccauguggucagcuaccugaugguuuccgggacggacacuuuggagauguacgcauucucugucucccauugaaugguuccaugugugucugacuuagugcugauuucauuugcagaccuacauggugguucugugccuuccccuacucccuucucaucuuuguguaugacgaggugcggaagcucauuaucaggcggcgcccuggcgguaagugggacaggcagggcuggacuuccucccgucaggucacagguacgcggccacggacacaacugugcuaagguagaaacacaccgugguuuuuaagaccuuaaaaagugcaaggcaaauguagagaaagccuuaacauaaaccuaauaauaauaauauucuuagagagagcuaauuagcuacaucugaggucucagauacacauaugcauacaugcgagcguguauacacacacacacacacacacacacgauuauccuuagcgagucccuguccugguuuuucccaaaagaggacucacuaccuauggcucucucucucucucucucaggcuggguggagaaggaaaccuacuacuagcccacugcccugcacgccguggaacauugugccacacacugcacccaccccuacccccucuuuguguacuucaagucuuggagcucggaacucuacccugguaggaaagcaccaaagcauguggggaugcagacguccuggaaugaagcauguagcuguaacggggggcggggcgggggggagggcugccugagaaacaccguguacggggacgacagcgggcaagguuuauacgugccuuuuuguuuuuguaaaaaaggaaaaccuggaaagacugaaagauuacguuuuauaucuggauuuuuacaaauaaagauggcuauuauaacggaauuugc

SEQ ID NO: 1614 - RNA, 1313 nt, Mus musculus
uuguaauaaaaugauacaauguugacuauggcaggguuggaagcagccagugugguggccacaaaagaugaauuggaagugcuuaagccaguggugguggcagcagccauagaggcagcacagaccuuugauuccagcccuggggaagcagaggcugggcucagcuacagaaugagaucccuggcagccaggacuacaaagauaaagcagcaagacuucccuuuaaccauauggucuagcuuucuuggcaggcagugcucucugugagaagagggaggggcagggaggagaggggucacucagcuuuguuucuuauuaaagaacuuuuacuauuuuuuuuucuaaaaauguuuccauuuuuauuuacgacuguuuugggaauaaacuugcucauuuugcccuccuagaccaugaucuggcuguauuugcaccccacuuuucguuauuuuuauuaugacauacuuuguuuaguguuacauaguuauuuauuaaauaauucauuauuuguuuugcauuuuucccacuuuuuuucuacacagaaaauauuugaauauaaaauuguaguucgcagacuuuggaauuuuuuuuauauauauuuuguuuagcuuuguuacuuugugauucuuuuacuagcuagauagugucaguguuuauagcuuguuggcuuucaacacuuucucucccuagccaucuuugauuuauuuaagauaagcacugcuguaucccaaguuggcuucaaauuuguuauauagccaaggcuauccuuaaacuccugaucuuccugcuuuugucuucuagaaggcugagagagcaggcuagccagccuacugcaccuuguuacaaucuccuuuguaaagagugauuaugugaaaggguauacaauccucuaaguacuauuuacccugauuuaccaguucuccuaagcaguauuuuguaaugguauuguaauuugcucuuuaaccaguguuauguuuuugagcauucuuuuuaccuuucuaguuaaaaguuguaccuuuuaacauuuuuuaauuauuauuuauuugaacauuuugugggcaaagacaauauuaaauccuagaacugccugacuuuuccugggaccuagcaucauuguauuacagugcauucauuguaaacaaaacaaaacaaaacccugcaccauauguguugagaacaacacaugguuuucauuugcugggcucagaacauucuguaaguuaguacaucauacuuguaaucuuacugaaaucauuggcaugcauacuaaaggcuuauaucauucuuuaauaaauauaucaacaucuuccaaauua

SEQ ID NO: 1615 - RNA, 1383 nt, Mus musculus
auaaaaacaaggcguguuuuauuuauaauuggauaugauaagauuacauauuaguaaguucacaguagugauuuauuuguuuuucugauguaacaagauccauaaagagcaaacauuacccagaaauacguuaugcugcguucuaauuguagggucucugcugcagggcucucuucaaaugaucauacagacaucccugucaauuucagucacgaaucauugguuguuucuuuuaaguuacauuaaauagaugcacgggaggcucccuggggagugaaguuugaacaguaacaccccaccccaaguuugccugguuuuggucuuguuucuugcuguuuguaggucacagaggucccaaggcaagaaagaaagaaaugggcaugccugcaaggugacaacgggcucccacagacagcuccucauggagaagccaguauaaagaaugaaggagaggacaaugagccagcuuugaggaacggucgugaacagacucagccauacccacauguacaaacgagacacacaacgacuugucacuggccacguggauguuaugacugccagcgugcaaacauggcaacgcacacuccgagaaguucaggugggaacagguccucuucuucccugauuugcauccaccuguagggagucuugcacagcagggccaggguugaagagggcaaaccaaggucucugcuucguugguucacugggucaaugauuggcaguggugagaguggguagucaauuuccaugaguacaguguguugguaggaguucacagacagaacucugugcuggcuaguuuuaugucaaugugacacaaccuagagucagagaggaggagugccaacuaagaaaaugccuuaguaagauuggucuguggauaagccuguaaggcauuuucuuaauuaguaauccguggaggucccaccccacuguggaugggaccaucccugggcuugugguccuggaagcuauaaggaagcagacugagaaagcuuugagaagcaagccaguaagcagcacuccuccauguuccugccuccagcuccugccuccagguuccugcccuguuugaggucuugucuugacuuucuugaugaugaacuaugauguggaagcauaaaucaaaaaaacccucuccuccccaaguugcuuuggucacgguguuucaucguagcaguagugucucugacuggagcaagcuauugcauuuaauacaugcacuccagaagaugauguagaaauuagagcugcucaccaccaccucugacucaggagauggcaagaucgaguacccuagaccuuucuaaggcuuaucugcauggccagucuccccauucauuagaaagccccacacucuuaaucccagcacucggg

SEQ ID NO: 1616 - RNA, 1383 nt, Mus musculus
cccgagugcugggauuaagaguguggggcuuucuaaugaauggggagacuggccaugcagauaagccuuagaaaggucuaggguacucgaucuugccaucuccugagucagaggugguggugagcagcucuaauuucuacaucaucuucuggagugcauguauuaaaugcaauagcuugcuccagucagagacacuacugcuacgaugaaacaccgugaccaaagcaacuuggggaggagaggguuuuuuugauuuaugcuuccacaucauaguucaucaucaagaaagucaagacaagaccucaaacagggcaggaaccuggaggcaggagcuggaggcaggaacauggaggagugcugcuuacuggcuugcuucucaaagcuuucucagucugcuuccuuauagcuuccaggaccacaagcccagggauggucccauccacaguggggugggaccuccacggauuacuaauuaagaaaaugccuuacaggcuuauccacagaccaaucuuacuaaggcauuuucuuaguuggcacuccuccucucugacucuagguugugucacauugacauaaaacuagccagcacagaguucugucugugaacuccuaccaacacacuguacucauggaaauugacuacccacucucaccacugccaaucauugacccagugaaccaacgaagcagagaccuugguuugcccucuucaacccuggcccugcugugcaagacucccuacagguggaugcaaaucagggaagaagaggaccuguucccaccugaacuucucggagugugcguugccauguuugcacgcuggcagucauaacauccacguggccagugacaagucguugugugucucguuuguacauguggguauggcugagucuguucacgaccguuccucaaagcuggcucauuguccucuccuucauucuuuauacuggcuucuccaugaggagcugucugugggagcccguugucaccuugcaggcaugcccauuucuuucuuucuugccuugggaccucugugaccuacaaacagcaagaaacaagaccaaaaccaggcaaacuuggggugggguguuacuguucaaacuucacuccccagggagccucccgugcaucuauuuaauguaacuuaaaagaaacaaccaaugauucgugacugaaauugacagggaugucuguaugaucauuugaagagagcccugcagcagagacccuacaauuagaacgcagcauaacguauuucuggguaauguuugcucuuuauggaucuuguuacaucagaaaaacaaauaaaucacuacugugaacuuacuaauauguaaucuuaucauauccaauuauaaauaaaacacgccuuguuuuuau

SEQ ID NO: 1617 - RNA, 2313 nt, Mus musculus
cuuugacgugaacucaucauuuauaauauucuggguuauccuucuccccugaccccucucagaagcaucacauuauaagguuacuuaaaucacccagagcaagcuggaaugccauuccaugaaaauucauugugggucuuaguauuacacaggacuccuggagaaccucacacuugaacugggaugucuugcucugcuuuacgugugaagguucuaagugguaaggugaaugggacuccguuuccagacuucuuuggcuuucccaccuuagcagcuaagcaugccgggcagacagcuggauuuacccgaggaaacgggaugcuggacucuagaucugcucuccggagucauuuagaggcugcaguucagguacaugcagaugguggggucauuggagucuggaggcuaggaguguggaacaucguccugccaccgugaacaucuggguguacuuagaaggacguggccuggaugguggagaaaauggaauauagaggaguuaggaaaaagcagacaguaaggacuuccugaggcuacagguucccaaacaaggcuacuucacaaagagccugcauuuucgcaaggcaaaucacccccagcauuccugcaaacaaacugcagauucagcacuucccgcugugcgugccuucgcgggagcauuuugucauggcagcuauagaucugucauucugggcauggauucuaugacgacuaagaaagaagggugagaauauucacaaaaacaguugccaacuguucugcacuuucuaauacuagaauuucaacccuucaaggacauuagaguccucaccacuauccagacagggaaaggaagcuuagcgagggaaguggucucaaucggucuggaacuuuuggcucccugccuucagagaugcgcucuccugguaguuuccaguaggcaggcaugucugcucugguagaagaggagcggggagaagcugcuguaggacugugggcguuggugguuacgggcugggucaucucuugagcuacauuggaguuuaaguguauuaugugugcugaaaaauguaugaguugggggagggguagaaauugguucuugagccauguggauaugcggguuggagcuuuuaaugauggcaaacaaugagggcuuggauuuuaugcacaauuguaagugugugugugugugcgcgugcgugugugaucuuggggguauguuggggugcuggguggagagacaucaaccccugcgucauguauucaggaauucaggaugaaauuuguuaggcugugugcuaguggguccacuugggaggggagaugucagucccuggccaggccguguguguguguguguguguguguguguguguguguguguguguguucaggaugagauuuguuaggcugugugcuaguggguccacuugggaggggagaugucagucccuggccaggccguguguguguguguguguguguguguguguguguguguguguguguguguguguccccgugccccgcccuccgcugcaggugggccgggccggcagcggggcccgcagcgcucgcagcucuuggcuggcggccgcgccgggcuagcagggcugggcuggggcugcggggcggcgccgggacaggaagcggaaagcagcagagaccagcggccgcggcggggcugugccuccacugcagcccagcgcaggccgcggagcccgggcgcugcagccgagagcgcgggcguggagcgcgacgggccggcgccggggugagucccgggagaggcgggcgcggcgcggcgcggcggcucgagacugagcugggugggaggucaggccaacugcgggugucccugcuccccagcaguccgacugggguccgggcccucggaccgggagaccccuggguuccuccgggucgagcuccccgagacgcggguccuuccaucccugccccgggcucucuccgcuccauuccagugcucggaguccuggggcagccugcgcuaccucggacuucuuugccuugucuggccuucggagugcgccccugagugcgcgugccgggugguggccagggaaugacggcgugucggaggcaaccaguggcuggacgcgccuugcagggcagaacgcgauggggguccccgccaggacccggggucaacuggccgguuuuccagcacaggaacggagcuggcucguguuucucacuucgcuuacaaaaccgcagcccgggaggccuggggggcgcggccaguugcgcaucgcggagcgcaacaggcagguaguuuacuuucaaaagcgccggggcggagcagaggcg

SEQ ID NO: 1618 - RNA, 620 nt, Mus musculus
uauggcuaacaagaugcagguacuacggcacuccgagcacacacugaaaacagcucuccucucaaagaacccugugcuugugucacaguaugagaaguuagaugcuggggaacaacgguuaaugaaugaagccuuccagccgugcaauaaccuguuugagcccauuacugugcacucccagucagacuggaucuccucccaccccgaggcuccccaagacauugagcaguuuuucucugacugcuacagaaaggcacccuguacaaagaaacacauaaucuacauucaguccauuggcucucuaggcaaaaccagagucaucagugaagaauauauuaaauggcucaagggcuacugugaagcauuuuucuacaguuugaaggugaaguucuuagaaccuguuucggucucugaaaccaaguguuccuuuagagugaaugagcacacacaaaaccugcaaauccacacaggacauaugcauuuaaaacaagaagcuuccugucugcugucucucgccaguuuuuggauuccaugcugccacucucuuggucuugcucaggaacacuggccucuagugucugcguucuuaguuuauuuuaguguccucccguccaucugag

SEQ ID NO: 1619 - RNA, 844 nt, Mus musculus
agcacugagacgccuuuaaauggcuauacaccaacgaggggguugggggggggcuuucccagcauccuccgacaauuuugagcgcagacuugguagagaacccggcacgugggaagggaaaucucgcgagaagugcugcgcgcgagaucccggccagcuggaccaaccguuaaauugagccggucgcggccagccucccagucccgcgaguucucgggcuuccaggagguucugaggggaagcucacgguuccguuccaugucgucuucauaaaggagcgcacgcggggccacgggccgcggagccugacaacggugaggguguggagggugucggggccuggggcccacguacacaccucugucacgcguguccaggugcuuggcuucgcgggcuucgcgggccagggaggccccgggcccugggccucaggcagucgcgggcggccuucgagguucgggcugggcccguggucgcguggccggcuggaguggagagauggugcggccgugcaggcuuucaccgugcaggccacacgcgccgcagggugacacggacgcugggccccucugagggaccuggcucacuguacuucggccucacccagccgugugaccucuucccuucccccgaggcccaggaggcagcauggagaagcaaaagcccuucacacuguucgucccgccgaggcugagcagcagucaaguguccgccgugaaaccgcagacggcgggaggagacuccaacuacuucaaggucagcuugcgugggcgcuucggagacagugcccgggcccgggacggggcgaaaggcacgugcagccgccgagcccggagaccugagg

SEQ ID NO: 1620 - RNA, 10266 nt, Mus musculus
uaaagugcacccggaagugacgcgauucgcgcugagccagggccggguaaggucugagcgaagcgccuaggcuagcgggcccggcgcgccuccucggccacuaugagcugcacgaucgagaagaucuugacggacgccaagacgcugcuggagcggcugcgcgagcacgaugcggcggccgagucgcugguggaccagucggcugcgcugcaccggcggguggcggcgaugcgggaggcgggcgccguguuacccgagcaggucggccgggggccgagccgcgcccagggguggacgcugcgggcggguggguggggucgcgcggccugauuuaucuuggucuggagggcagggcggaugugugagcuuccugugucgugggugggacugcugccuccuccgcagcaccugcccauguuuacagugccuuagucugucuuucuguccaguaucaagaggaugcauccgacgugaaggacaugucuaaauauaaaccucacauucugcugucucaagagaauacccagauuagagacuuacagcaggaaaacagagguuagucaggcgugugugugugugugugugugugugugucuaggauuuuuuuuuucugguaauacuacuuuggacauucuuacacaagugccugaacaguucacaagcgugcacaucgcauacauauauuuagaucagugcuucaagggucaacugguaacaguaaaaucuguuagauugcucuuuuaaaagucuuccugguugaugaccuugaaagauguauucaguaguuuagcagaguugaauuguuagauggcuggggagugaccacauaccaaauggaggcuucuauaacuaaaguucauagucuccaaauguaacauuucgauauuagagugaacacuaaaguuaagaucgacguuucuuuaauguuccugugcaagauggaaggcuagaacuucgucccccaaauacauagucuuaggguuguugaugacagcaggaugguaguugucugauggagcccuuuuacaucugccauuccacucuaugccccugaccaaguauuuacacaaugcagcuaagaaacagguucacagacaccaguuggaaccagccagaaggccugaacugccaagcuggaggaucugaggccauuccaagggccuacgugguuuaaggagagaacugacuccuggggguucuucucugacccgacaugugccgugguucacacaaaucaacaaaauguaguuuuuuuuuuuuaauuuuaaugagcucauuuuugcuucugagaagucaauuagaaaacugaauucaaauccgugccucgugauuacacgucccauuuuauuugcacaagacucuacugccuagagaguugguuuucagguacacuguucacgucugugggcuugaauacugauuuccaacuuuggauucccagugucccguggagugucugagagcuccagcuguuaggagguuugccuugagaccagucuuagacgucauuguccagauguuugcuuuuguuguuagaacuguggguuuccuuggaggagcaccaggaugcguuggaacugaucaugagcaaguaccggaaacagauguuacaguuaauggucgcuaagaaagccguggaugccgaaccaguucugaaagcucaccagucucacucugcaguaagaaacacugauaaauaaauuguaaauaaacugaacugaaaucguggggucguuccuuuguuugcagaaaacaguguuccucuuucugcauauuuucauaaucacucugaauuuggcuguggcuuugugaagacaugaauaaaggaaggggauaagggccucuuccauccuuuaguggucaaguuaccucccucaccagggauuucuuuucagcuugacacagaaagauugagaguaggccauccugggcuacauagcaagugugauaccagcuaguguugaaggcauucagugacugcuuagcugauuguuguacauucuaucgagccauaaguuuuauaguuccaagggcaugagucggauuuuaucccucgcuuccacauagcaagcagucacuaacuucaucaaaugacucagacuguguuauggggggagggcuggucuuguuccuuuguuuuauagcaguuccuccucuuugauccuucacuguuuaacuuggaggagccagcaauuaccuugcaguuuguaggguguuuccuugcccuauuuuagcuuuuacuguaguaauuaauuggaagcaacuauuuacuacagugaaagaugcaccacguuucaucuucuaucguuaggaguuuuaggcaauggaauguuuaaaauauuugaauguuuuaaauaucuaaauauuugaguugucuguuauauuacuuuugguugguuggguggguguuuuguuuguuuaggguuuuguuuuguuuuuugcagcuaggucucauuuagcccaggcuggccucuuaacuccuaacccuccucccuaggccucccaagggcuaggauuacacguguaugccaccacaccuggucccuggauaucaaacauucuuuugaaaauuggaaauuauuugaaaugccacagauugauagauugauauuauuauagcucgaaauauaguaugauugcaauguaacuucuguaguguguacaaagggagccacuucccacuuacucuuacuucucaagguuuuaauagacauaaaauucuccuguacaugcguuccauggucuucaucacuaggaaccuuuucuucaucuuauuuucacaggagauugaaagucagaucgauagaaucugugaaaugggagcagugaugcggagagcuguucagguggacgauaaccaauucuguaagguucaggagagacuagcucagcuggagguaaggcucucacugccagaaggucaccucuuuuucuuuuauuuauuuuguuaaguucacugguugugaguuuuagaggcucuugggauguaucaccacuguccucacugcaguauaauaauguucccccuuuuuacaaaaaugucucaaagaagaagagaggaaggaaggaagggguucaucucagaauggggccuggacuggcuaagagcucaaaacugcccugccucagccucggccuccuggguugccuugguuggcaguguuaauguucuuuguguccuagugacuuaaaauuucaauuucuccuuuauuuauuuccuuuucaggaaaauaaaugaauguagucagcagcaaucaggggaaaugucaacuguggggcuggggacagagcucgguugcuauaucuauuaaguauaugaauauacuugaaaagcagaggggaggaggaacaggucaugugugagcugacuucucgcaguaauagaaagucaaauacauaaaaucuaaacuugaucaagaaauagcaguacagaagcugggcagugauggcucacgccuuuuaucccagcacucuggaggcagagauagacagaucucuuaaggccagccuggucuacagaaaaaguuccaggaaaagaaaagaagaaaaaaggaaaggaaaggaaagcaaaaggaaaagaaaagaaaagaaaaaagaucaaucgguacaggcaacccuuuagaauuauagaaguaaaugccaagagaaauauaaaaagugggguuggaaagaugcucaguggguaagagcacuggccagaggacccagauucgauacccagcauccacaugguaacucacaacugccugcgacugcuggcacagcacguagugcacagauguacauguagacaaaacuacacauaaaaugaagagaccuuuuacaaaauaugccacagaagaacagugaggugcagcugggagugcagugcuuccuuggcauucuugagccccagguuggcuccccagcacuucauaaacuagguguaaugaugcguggcuccagucgcagaagcuuaagaguuugagacaggaggauugagaguuuugaagccagucugagauacuuagugaguuuuaaggccagccucugauauauaaaacccugucucaaaaggaaaaaaaaacaaaucuaaagggcuggagagauggcucagcaauugagaguacuugcugcccuugggaggacccgaguuuaguuuccaacacuuacauggucacucacaaucaucccuaacuccaguucuaggucaucugacauuguucugaccugaaggaauacuaggcaugcauguaccauacaucuacauauacauacauacauacauacauacauacacacacacacacacacucacauguauaaaauaacaugugaguuggaaggcagaggaucucugaguuugcggccagccuggucuacagaaugaguuucaggacagccagggcugcacagagaaaccuuauugcaagggggggggaggguggauaacaaguaaaaucauggguuuuuuuaaaauguaauuauauguguaugaguguaaaaauaugcagagaagacacuucaaugggugguuugaagauuugacugguuauuucagguccuauagugggcccuuugagaaauuccaaaagaaaaagauaaggucccugcucauaucuaaugaaggaaggacagaguacagaaugguauauaagugcuagaagaaagauuaagaauacuaugacugaagagauagcucagaaguuaagaguacguacaacucuugcagaggacccaguucccagcagccacauuguggcucacaaccaucuguaacuccaguuccaggggaucugaugcccucuucuggccuccaagggcacuaggcacucagauggugcucguacauaagugcaugcaaaacaauacauacacauaaguaaaaaauaaaucaagagaacugagaagccguuuauaugguagaggauuuguucaaccucuuggugaagcuggaaaugcuguaguuuaucuugguguccguaaagaucuggacauggcaacacacaccuguaauuccaggacuuagaaacagaagggucaggaguuccaagccaggccucaccucaccuacuacauaagacccuaucucaaaauagacaauaauuuucuacaaaaaggauaaggauagaguguagccuauccuuagcuaaaaaagaaagugauaggugucaauuaucaaaauuaguaauuaaauuagggacagagagauggcuuagugguuaaaagcccuuguagcucuuacagaggaucugguuugauuccuagcacccauaugguggugacucacgaccuauguaacucuagucccagaccaacagugcccucuucugaccuuccaggguaccagcuaugcacaugaugcacagacauccauggagguaaaacauucauacacauaagauauugaaauaaaucuaaaaugaaaaggcuuaaucguuuaaaguccagguguggcagagcauaccucuaguaaucuggaggcaaggucaggcagguaucuguuuaaggucagugugaucugcauaucaauuucuaggccagcaaacuccacucaguaggacuuugucuuuaaaaaacaauuuuuuaagcgagcaauggugacgcacaccuuuaaucccagcacuugaaaggcagaggcagguggauuucugaguucaaggccaaccuggucuacagagugaguuccaggacagccagggcuauacagagaaacccugucucgaaaaaccaaaaaaagggcuggugagauggcucagcagauaggagcacuugaccgcucuuccgaagguccugaguucaaauuccagcaaccacaugguggcucacaaccacccauaaugagaucugaugcccucuucuggcacaucugaagacagcuacaguguacuuauguauaauaauaaauaaaucuuaaaaaagaaaagccaaaaaaaaauuuuuuuuuccucuuucugggccaaaauaguauguucugacauaguuuaacaauuaaaacacaggaaauaucuuuucuccccagcuugaaaauaaggaacuucgagaguuacuguccaucagcagugaaucucugcagguuggaaaagaaagcucuguggcuccugccucucagaccaucaaguaacuggacuuccgaaggcuggcuacagcuugcccgucagagcgagaagccgugcccuccucuccugccguguccaagaguccugccgcagacuugacuuaguguuggguagagguaugggguggcaguuuagaauugccacuugguauucauuguccacuaacuaguuugggguguacuagugaaacuagacaagucccccauugcugggacagagaugacauuugucacucuaguccggaaucucuauaaacuguuaccugcaguucaauguuguuuuucacagcuuggaaacacugaacacuuuuauuauaagccaggauuuuauuuuauauaggauuauaaaaauuccuucuaagaguuuuucaaagauuuaacuuuuuaaaaauacauauuugguguaaaccuagauuuuuuuuuucuuccacuuguaaaaguagcaugacuucaaagaagcagauuggcagagucucugagugacgucgcucauccaugggguuugauccucuccggugcuaggaguuggcacuuuguggucaggugucuuugcucuuaauuugagagaaucuauuaguccccaggaaauacgcuugaaaacaaguaagccggguucgcguugcuccuccuccuccucaaggauccacagucauucagagagugcugaggaacuugggccugccccaucaugcacagggagcuauuagauguacaugacuguacauguacauuggacuuaaaugccaaaaauagcuuuuauuuauuugaccaaguaguuuuccauucugucugccuaaggagucuucggcuuagguaguugccuuguaugagacauacacauacacacacacacacacacacacacacacacacacacacauaccucacucacagguuccuagcuccuaggcacuuucauggacacacagcugugcugugcugugcugugcagagcagcaccacugggaugguuuagaccggcaucaguacuuugcugucuuuccaucugcuggguuuucucauggaagcauuuuauuacucacagaaaguuaccacauuccugaugccaugcauucaggcaaucaagaacaaccugagauucuaauagcucccugucaguuccuucucaucuugguuugcucauaugucagguuuauaaauaauuccuuuugcacuguuugcccagauggacuuugguuuuuguucccauguuaacuuucacuccagcugcuccccuugauguuuccccuaagggccccaaguguguacuccacaaacccauucagggguggguuccuuuaccacuugucagcugucacagcaggucccaucacagugagagcauuaucagucagucuauuucagcagugagcauggugucccuuucuuuaucugccuucuguucccguagcacucacuacaaaggucuuugcaucuagcuuucagaggaaucucuccauugcaguccugaggguagagcaagcuuucggugcccugugucguauaaauucugccugguguuagugcugugaaggcauugcagagcuagcacauugaauggagaaagaauguuucacacuugugugaagaugcuaauaucucuugcaauggguggaaguauuuaguguauaaaauuuuaguaugaaauuauauuaacuaauaaaaaccuuuuugagaagauuugcucauuuuacugagaaaugagucuaagaaguugagcuggaaaaaaaaaggaaguuuagcugagcaguggcgauguacaccugcaaucccagcacuuggaaggcagaggcacaucucuugaauucgaggacaugcagguuuaccuagugagucccaggagacuacacagggagacccugucuugaaaaaagcaaaaagaaguauaggagauuuuuuucacauauucacauacauagcaaccauggcaaguguucaugacauagaugucauaagcagcuugcaauuauucaauauauucagcaguauaaaccuuugaaaagcacauuaacaaccuauucauugcagaaguccugaauguauaauuuaccacugaagucuauuuccauguuucuuaaaaugcaccuaaugaaauagaaauuuauggauggaaucuggaauuuacaucuuaauaaucauuccagaaaacggcaguaccgguuuaagaacaugucuguuagggcuaggagauggcucagcaggucuaagugcuuaccaugaagucagauggccugaguucaauuccucagaacccacaugagggaaggagagaaccaacuucuaaaaauuaccuucugaccuacaacacacaaacagauaaauuguguaugauguucugugcaaauuauuucacuaggaguuaaaaacaaaccgacuuuaaaaugagaagagugguaaagggauauuacagaggggugggauauagcagcgcuauuccccucuaugcugccugcccgauagcagcagauaaauugggcaugguggcacaugccuguaaucccagaauuuggagcagaagcaggaagagcagaaauccaaggucauucuuggcuacauaguaaauucaaaaccagccugggcuacaagagacccugucucaaaaaacuaaacaaaauguugugcagauaauuuugaugcaguguguuacaucagauguaaguguaggauacagcacagaaagggcuguguuauuugagaaucuaaaaguugaccagggaagggggugggggagggguggugcuaggagaaaacauagaaaacagcugcagaaucgaaguccaggggguccugcaaugguuacuuccuuauacuaagggguuuucugugucagcugacacagcauccccgcuucaguucuuuacaguuccauacauacuagaagguucuaauuuguccaaaguggagccaagaaucacacucaggcacucuucagcacauuucuuaaggaccaaguuaaggcaccuuuaaaugcacauaacuguggaguucauggaucuugaucggcaaagucagucaacagguuaauuaacaggguaagagagacacuauggccuguguguugugaauaccgugacuucuguuuaguucacgcugcugcauggucccuagaaugcugugccugugagugguccucaguguggagggaagggugcauuucugcacagggugccuuuuuccacguuggcuccgucugugaugcuguuaucuuguuauaggcuacugcugugucagaugucaugcccauguggaagacagggaaaaaauagaaaacugccugcccuacacuacagacacauggggaaagcaaacguuuccagaaauucuaauggaguucucuccauaucugccucacuuauuaaauagacaugucuaauugcaaaggaagcuagguacacagccgugccaaauaaaaucaguauccucuuagcaaagagaaaucauacugagaaaacaguaaggccugauuguuacaguaaggcauuuuaccguaaauauaauuuuuaacaaauuaaaauuauuagcugcagggaugccuacguugagucacuaagaaaaugagcuguaguggacacuguuauuucuuuacugacugcucaauguccuacccaugccuggguaaaguuucccugccuaacguggcagagccucccucuuuccuaaagaaucuggaaguaccaguuacccaguuucccagccaccuuggcaucgaggaaagauucagcugcuuugaauuucaaaguuagugauauggcaaagcugggagccacacagaaaccucugaaccuggggaccagcaacacaggcugcugcuggguuuggcuccauagaagagcagcagagcaggucuggagugcuagcaggcagcuguggaagacccaguguaugcaguggagacuggagacuugcugcaaacauccuuauagcauuagacgcaaaccucuuaagucucauuuccuggcugcccaagagauccugagaaauauuuuuaaugaaauuaauaaaaccauuuuuguugaaauuagccugaguugccuauaucuaagaaaucugaucaggaacaaauuucuaaacaaccaugcacauauaaauguuaucagugcuuauuuuugcacuuaaauuuuuauguaauauugggcauuuauaaaaggauaagaugcgcuggguguggu

SEQ ID NO: 1621 - RNA, 10266 nt, Mus musculus
accacacccagcgcaucuuauccuuuuauaaaugcccaauauuacauaaaaauuuaagugcaaaaauaagcacugauaacauuuauaugugcaugguuguuuagaaauuuguuccugaucagauuucuuagauauaggcaacucaggcuaauuucaacaaaaaugguuuuauuaauuucauuaaaaauauuucucaggaucucuugggcagccaggaaaugagacuuaagagguuugcgucuaaugcuauaaggauguuugcagcaagucuccagucuccacugcauacacugggucuuccacagcugccugcuagcacuccagaccugcucugcugcucuucuauggagccaaacccagcagcagccuguguugcugguccccagguucagagguuucuguguggcucccagcuuugccauaucacuaacuuugaaauucaaagcagcugaaucuuuccucgaugccaagguggcugggaaacuggguaacugguacuuccagauucuuuaggaaagagggaggcucugccacguuaggcagggaaacuuuacccaggcauggguaggacauugagcagucaguaaagaaauaacaguguccacuacagcucauuuucuuagugacucaacguaggcaucccugcagcuaauaauuuuaauuuguuaaaaauuauauuuacgguaaaaugccuuacuguaacaaucaggccuuacuguuuucucaguaugauuucucuuugcuaagaggauacugauuuuauuuggcacggcuguguaccuagcuuccuuugcaauuagacaugucuauuuaauaagugaggcagauauggagagaacuccauuagaauuucuggaaacguuugcuuuccccaugugucuguaguguagggcaggcaguuuucuauuuuuucccugucuuccacaugggcaugacaucugacacagcaguagccuauaacaagauaacagcaucacagacggagccaacguggaaaaaggcacccugugcagaaaugcacccuucccuccacacugaggaccacucacaggcacagcauucuagggaccaugcagcagcgugaacuaaacagaagucacgguauucacaacacacaggccauagugucucucuuacccuguuaauuaaccuguugacugacuuugccgaucaagauccaugaacuccacaguuaugugcauuuaaaggugccuuaacuugguccuuaagaaaugugcugaagagugccugagugugauucuuggcuccacuuuggacaaauuagaaccuucuaguauguauggaacuguaaagaacugaagcggggaugcugugucagcugacacagaaaaccccuuaguauaaggaaguaaccauugcaggacccccuggacuucgauucugcagcuguuuucuauguuuucuccuagcaccaccccucccccacccccuucccuggucaacuuuuagauucucaaauaacacagcccuuucugugcuguauccuacacuuacaucugauguaacacacugcaucaaaauuaucugcacaacauuuuguuuaguuuuuugagacagggucucuuguagcccaggcugguuuugaauuuacuauguagccaagaaugaccuuggauuucugcucuuccugcuucugcuccaaauucugggauuacaggcaugugccaccaugcccaauuuaucugcugcuaucgggcaggcagcauagaggggaauagcgcugcuauaucccaccccucuguaauaucccuuuaccacucuucucauuuuaaagucgguuuguuuuuaacuccuagugaaauaauuugcacagaacaucauacacaauuuaucuguuuguguguuguaggucagaagguaauuuuuagaaguugguucucuccuucccucauguggguucugaggaauugaacucaggccaucugacuucaugguaagcacuuagaccugcugagccaucuccuagcccuaacagacauguucuuaaaccgguacugccguuuucuggaaugauuauuaagauguaaauuccagauuccauccauaaauuucuauuucauuaggugcauuuuaagaaacauggaaauagacuucagugguaaauuauacauucaggacuucugcaaugaauagguuguuaaugugcuuuucaaagguuuauacugcugaauauauugaauaauugcaagcugcuuaugacaucuaugucaugaacacuugccaugguugcuauguaugugaauaugugaaaaaaaucuccuauacuucuuuuugcuuuuuucaagacagggucucccuguguagucuccugggacucacuagguaaaccugcauguccucgaauucaagagaugugccucugccuuccaagugcugggauugcagguguacaucgccacugcucagcuaaacuuccuuuuuuuuuccagcucaacuucuuagacucauuucucaguaaaaugagcaaaucuucucaaaaagguuuuuauuaguuaauauaauuucauacuaaaauuuuauacacuaaauacuuccacccauugcaagagauauuagcaucuucacacaagugugaaacauucuuucuccauucaaugugcuagcucugcaaugccuucacagcacuaacaccaggcagaauuuauacgacacagggcaccgaaagcuugcucuacccucaggacugcaauggagagauuccucugaaagcuagaugcaaagaccuuuguagugagugcuacgggaacagaaggcagauaaagaaagggacaccaugcucacugcugaaauagacugacugauaaugcucucacugugaugggaccugcugugacagcugacaagugguaaaggaacccaccccugaauggguuuguggaguacacacuuggggcccuuaggggaaacaucaaggggagcagcuggagugaaaguuaacaugggaacaaaaaccaaaguccaucugggcaaacagugcaaaaggaauuauuuauaaaccugacauaugagcaaaccaagaugagaaggaacugacagggagcuauuagaaucucagguuguucuugauugccugaaugcauggcaucaggaaugugguaacuuucugugaguaauaaaaugcuuccaugagaaaacccagcagauggaaagacagcaaaguacugaugccggucuaaaccaucccaguggugcugcucugcacagcacagcacagcacagcuguguguccaugaaagugccuaggagcuaggaaccugugagugagguauguguguguguguguguguguguguguguguguguguguauguguaugucucauacaaggcaacuaccuaagccgaagacuccuuaggcagacagaauggaaaacuacuuggucaaauaaauaaaagcuauuuuuggcauuuaaguccaauguacauguacagucauguacaucuaauagcucccugugcaugauggggcaggcccaaguuccucagcacucucugaaugacuguggauccuugaggaggaggaggagcaacgcgaacccggcuuacuuguuuucaagcguauuuccuggggacuaauagauucucucaaauuaagagcaaagacaccugaccacaaagugccaacuccuagcaccggagaggaucaaaccccauggaugagcgacgucacucagagacucugccaaucugcuucuuugaagucaugcuacuuuuacaaguggaagaaaaaaaaaaucuagguuuacaccaaauauguauuuuuaaaaaguuaaaucuuugaaaaacucuuagaaggaauuuuuauaauccuauauaaaauaaaauccuggcuuauaauaaaaguguucaguguuuccaagcugugaaaaacaacauugaacugcagguaacaguuuauagagauuccggacuagagugacaaaugucaucucugucccagcaaugggggacuugucuaguuucacuaguacaccccaaacuaguuaguggacaaugaauaccaaguggcaauucuaaacugccaccccauaccucuacccaacacuaagucaagucugcggcaggacucuuggacacggcaggagaggagggcacggcuucucgcucugacgggcaagcuguagccagccuucggaaguccaguuacuugauggucugagaggcaggagccacagagcuuucuuuuccaaccugcagagauucacugcugauggacaguaacucucgaaguuccuuauuuucaagcuggggagaaaagauauuuccuguguuuuaauuguuaaacuaugucagaacauacuauuuuggcccagaaagaggaaaaaaaaauuuuuuuuuggcuuuucuuuuuuaagauuuauuuauuauuauacauaaguacacuguagcugucuucagaugugccagaagagggcaucagaucucauuaugggugguugugagccaccaugugguugcuggaauuugaacucaggaccuucggaagagcggucaagugcuccuaucugcugagccaucucaccagcccuuuuuuugguuuuucgagacaggguuucucuguauagcccuggcuguccuggaacucacucuguagaccagguuggccuugaacucagaaauccaccugccucugccuuucaagugcugggauuaaaggugugcgucaccauugcucgcuuaaaaaauuguuuuuuaaagacaaaguccuacugaguggaguuugcuggccuagaaauugauaugcagaucacacugaccuuaaacagauaccugccugaccuugccuccagauuacuagagguaugcucugccacaccuggacuuuaaacgauuaagccuuuucauuuuagauuuauuucaauaucuuauguguaugaauguuuuaccuccauggaugucugugcaucaugugcauagcugguacccuggaaggucagaagagggcacuguuggucugggacuagaguuacauaggucgugagucaccaccauaugggugcuaggaaucaaaccagauccucuguaagagcuacaagggcuuuuaaccacuaagccaucucucugucccuaauuuaauuacuaauuuugauaauugacaccuaucacuuucuuuuuuagcuaaggauaggcuacacucuauccuuauccuuuuuguagaaaauuauugucuauuuugagauagggucuuauguaguaggugaggugaggccuggcuuggaacuccugacccuucuguuucuaaguccuggaauuacagguguguguugccauguccagaucuuuacggacaccaagauaaacuacagcauuuccagcuucaccaagagguugaacaaauccucuaccauauaaacggcuucucaguucucuugauuuauuuuuuacuuauguguauguauuguuuugcaugcacuuauguacgagcaccaucugagugccuagugcccuuggaggccagaagagggcaucagauccccuggaacuggaguuacagaugguugugagccacaauguggcugcugggaacuggguccucugcaagaguuguacguacucuuaacuucugagcuaucucuucagucauaguauucuuaaucuuucuucuagcacuuauauaccauucuguacucuguccuuccuucauuagauaugagcagggaccuuaucuuuuucuuuuggaauuucucaaagggcccacuauaggaccugaaauaaccagucaaaucuucaaaccacccauugaagugucuucucugcauauuuuuacacucauacacauauaauuacauuuuaaaaaaacccaugauuuuacuuguuauccacccucccccccccuugcaauaagguuucucugugcagcccuggcuguccugaaacucauucuguagaccaggcuggccgcaaacucagagauccucugccuuccaacucacauguuauuuuauacaugugaguguguguguguguguguauguauguauguauguauguauguauauguagauguaugguacaugcaugccuaguauuccuucaggucagaacaaugucagaugaccuagaacuggaguuagggaugauugugagugaccauguaaguguuggaaacuaaacucggguccucccaagggcagcaaguacucucaauugcugagccaucucuccagcccuuuagauuuguuuuuuuuuccuuuugagacaggguuuuauauaucagaggcuggccuuaaaacucacuaaguaucucagacuggcuucaaaacucucaauccuccugucucaaacucuuaagcuucugcgacuggagccacgcaucauuacaccuaguuuaugaagugcuggggagccaaccuggggcucaagaaugccaaggaagcacugcacucccagcugcaccucacuguucuucuguggcauauuuuguaaaaggucucuucauuuuauguguaguuuugucuacauguacaucugugcacuacgugcugugccagcagucgcaggcaguugugaguuaccauguggaugcuggguaucgaaucuggguccucuggccagugcucuuacccacugagcaucuuuccaaccccacuuuuuauauuucucuuggcauuuacuucuauaauucuaaaggguugccuguaccgauugaucuuuuuucuuuucuuuucuuuuccuuuugcuuuccuuuccuuuccuuuuuucuucuuuucuuuuccuggaacuuuuucuguagaccaggcuggccuuaagagaucugucuaucucugccuccagagugcugggauaaaaggcgugagccaucacugcccagcuucuguacugcuauuucuugaucaaguuuagauuuuauguauuugacuuucuauuacugcgagaagucagcucacacaugaccuguuccuccuccccucugcuuuucaaguauauucauauacuuaauagauauagcaaccgagcucuguccccagccccacaguugacauuuccccugauugcugcugacuacauucauuuauuuuccugaaaaggaaauaaauaaaggagaaauugaaauuuuaagucacuaggacacaaagaacauuaacacugccaaccaaggcaacccaggaggccgaggcugaggcagggcaguuuugagcucuuagccaguccaggccccauucugagaugaaccccuuccuuccuuccucucuucuucuuugagacauuuuuguaaaaagggggaacauuauuauacugcagugaggacaguggugauacaucccaagagccucuaaaacucacaaccagugaacuuaacaaaauaaauaaaagaaaaagaggugaccuucuggcagugagagccuuaccuccagcugagcuagucucuccugaaccuuacagaauugguuaucguccaccugaacagcucuccgcaucacugcucccauuucacagauucuaucgaucugacuuucaaucuccugugaaaauaagaugaagaaaagguuccuagugaugaagaccauggaacgcauguacaggagaauuuuaugucuauuaaaaccuugagaaguaagaguaagugggaaguggcucccuuuguacacacuacagaaguuacauugcaaucauacuauauuucgagcuauaauaauaucaaucuaucaaucuguggcauuucaaauaauuuccaauuuucaaaagaauguuugauauccagggaccaggugugguggcauacacguguaauccuagcccuugggaggccuagggaggaggguuaggaguuaagaggccagccugggcuaaaugagaccuagcugcaaaaaacaaaacaaaacccuaaacaaacaaaacacccacccaaccaaccaaaaguaauauaacagacaacucaaauauuuagauauuuaaaacauucaaauauuuuaaacauuccauugccuaaaacuccuaacgauagaagaugaaacguggugcaucuuucacuguaguaaauaguugcuuccaauuaauuacuacaguaaaagcuaaaauagggcaaggaaacacccuacaaacugcaagguaauugcuggcuccuccaaguuaaacagugaaggaucaaagaggaggaacugcuauaaaacaaaggaacaagaccagcccuccccccauaacacagucugagucauuugaugaaguuagugacugcuugcuauguggaagcgagggauaaaauccgacucaugcccuuggaacuauaaaacuuauggcucgauagaauguacaacaaucagcuaagcagucacugaaugccuucaacacuagcugguaucacacuugcuauguagcccaggauggccuacucucaaucuuucugugucaagcugaaaagaaaucccuggugagggagguaacuugaccacuaaaggauggaagaggcccuuauccccuuccuuuauucaugucuucacaaagccacagccaaauucagagugauuaugaaaauaugcagaaagaggaacacuguuuucugcaaacaaaggaacgaccccacgauuucaguucaguuuauuuacaauuuauuuaucaguguuucuuacugcagagugagacuggugagcuuucagaacugguucggcauccacggcuuucuuagcgaccauuaacuguaacaucuguuuccgguacuugcucaugaucaguuccaacgcauccuggugcuccuccaaggaaacccacaguucuaacaacaaaagcaaacaucuggacaaugacgucuaagacuggucucaaggcaaaccuccuaacagcuggagcucucagacacuccacgggacacugggaauccaaaguuggaaaucaguauucaagcccacagacgugaacaguguaccugaaaaccaacucucuaggcaguagagucuugugcaaauaaaaugggacguguaaucacgaggcacggauuugaauucaguuuucuaauugacuucucagaagcaaaaaugagcucauuaaaauuaaaaaaaaaaaacuacauuuuguugauuugugugaaccacggcacaugucgggucagagaagaacccccaggagucaguucucuccuuaaaccacguaggcccuuggaauggccucagauccuccagcuuggcaguucaggccuucuggcugguuccaacuggugucugugaaccuguuucuuagcugcauuguguaaauacuuggucaggggcauagaguggaauggcagauguaaaagggcuccaucagacaacuaccauccugcugucaucaacaacccuaagacuauguauuugggggacgaaguucuagccuuccaucuugcacaggaacauuaaagaaacgucgaucuuaacuuuaguguucacucuaauaucgaaauguuacauuuggagacuaugaacuuuaguuauagaagccuccauuugguauguggucacuccccagccaucuaacaauucaacucugcuaaacuacugaauacaucuuucaaggucaucaaccaggaagacuuuuaaaagagcaaucuaacagauuuuacuguuaccaguugacccuugaagcacugaucuaaauauauguaugcgaugugcacgcuugugaacuguucaggcacuuguguaagaauguccaaaguaguauuaccagaaaaaaaaaauccuagacacacacacacacacacacacacacacgccugacuaaccucuguuuuccugcuguaagucucuaaucuggguauucucuugagacagcagaaugugagguuuauauuuagacauguccuucacgucggaugcauccucuugauacuggacagaaagacagacuaaggcacuguaaacaugggcaggugcugcggaggaggcagcagucccacccacgacacaggaagcucacacauccgcccugcccuccagaccaagauaaaucaggccgcgcgaccccacccacccgcccgcagcguccaccccugggcgcggcucggcccccggccgaccugcucggguaacacggcgcccgccucccgcaucgccgccacccgccggugcagcgcagccgacugguccaccagcgacucggccgccgcaucgugcucgcgcagccgcuccagcagcgucuuggcguccgucaagaucuucucgaucgugcagcucauaguggccgaggaggcgcgccgggcccgcuagccuaggcgcuucgcucagaccuuacccggcccuggcucagcgcgaaucgcgucacuuccgggugcacuuua

SEQ ID NO: 1622 - RNA, 2424 nt, Mus musculus
auuuucauguuuuaaaucuuauuuuauuuuuuucuguugugggagguugcaagggcagagaguggauauagaaggacagggagaugagugggauuggguuauaagcugugaaauucacaaagaaucaauacaaaaauuaaaaaauuauuguuucaagaccaacagauuaggagaguagucauguguaaaacaauguaguagcaucauggcuacaucaucaauuucuaugcauuaauaagaaaaagugaaacacagggaaaguggaggaugugcaucuuaaaaagcaaacacuaugcuaagccucaucagacaucagcgauggauuaguuuugagguaauuuuagacuuacagaggacuuaucagaauaggaagaaacacuucaaccagcuucucccacauaccuuuauauaacaaaagaacaguuuucaaaauugggcaauuaaccuugacaugauaauacaaaucaacuacaaaucugccuggguuuucacuaauggccauuuucuuucucaggaucacauuuaggacuguccacugccuuuauccacaguccucagucuacgguaguucuccaaucucuucuauuucugccuuuacuuuuuggauguauuuuauuccuccgugugcgugugagggugucuuuacauguacacugcacauguaugugggcguucauggaggccagaugucagauccccuggaucuagaauuacaauugauugugagcugccugauguguugggaaucaaacuugaguccucugcaagagcagcauauucucuuaacaguugagugauaacaucagcccucggucuuuaauuccuugauagaagaagaaugucagucaccuauuuugucaguguccccaguuuuguuuuguuugauauuuccucuugaugagauagagauuacauaggcuaauucuauaccacauaauguccuuugaucuguauuaugccacacauaggaaggugguucuguuuuaauggaacugaacaauuucuauugccuagugaugucacaggguagugaauuuguagggaggugcauuagucaugucuuuauggugacgcugguguagacaaacccacggugcugguccuguaagaacauagcacauacaauuauguaaaaugcauaacugauaaugaaaauaagcgguuguuacaauuuuacguaguaaucuaugccuuuugaacauuaguauacucuuacuuauacuguaaacuaguaugcuuuguuguguggcuagcagcuucauaauucuuguuuuucccgacucucagcuguuuugggagguaccaugaguuguuacuggaguuagggggaaagccccagcuccugggagccccuccagacugggcucucacaaagucucagaaagccaccuagagaggagcaggcagugguaaaaugcuugccacacaagugugaggaauugauuuugaauccccagaaccugcacaauauaggcaggugagguaucaacacagcugggacccagcucuccuguggucagcugggagggggagacaggagaaacuuuggaaggucaggaggcagcuagccugguguauguauacaggaggaaacaagagacuuuucagcugacaaggacuggcaccugaggcuacuagccucuaaccucuacauguacaccauggcacccaagugccugcugcccauacacacaugaacauguauacauacauucaaaacagguguucuugagacaggaucucacuacacagauaccaggccugaccacacaaaagaucuuacuuuaaagagagaggagcgcuggugaaggcaacaaaguuguauucacagcauccucaaauaacugcuuagaaagugcuucuguugagaaguguggacccuugggccccugggguaaauaaaagcaggauuuuaaaaaaaugagcaccacugccuucaccguagaccaggcuagaacucagagaucggugggccucugccucucuccugcugggauuaaagcaugccuuuuuguuuguuuguuuuugaggcagggucucacuauaugacccuaacuguucugggacucaauauguagaucaggcucaucucugaacucauagaaaucuaucugcugcuaacuccagccagagugcugggauuaaaagugggcuaaguggccugccuaguacugguaauauuuggguuuugcuuuuguggugccugagguuugagccagggcuuuguguaugcuaggcagguguuuuccccacacugguaauaacugaguucuuaaauuagguaaugaaugcaugauaaugugccugcauugccaucuuaucccuuuuuuuugggggggggguuguuuuguuuuauuugguuuuuuugagacaggguuucucuguguaucccuggcuguucuggaacucacucuguagaccagg

SEQ ID NO: 1623 - RNA, 9688 nt, Mus musculus
cuggacugggugcggccggcugcaagacucuagucgucggcccacguggcuggggcggggacuggggcgccuugggcgccuagugauuacguagcggguggggccggaagugccgcucccuggcgggggcuguucauggcgguuucggggucuccaacagcuucucagguugaaguccaaaagccucccgaggcggggucugcggaguuugagguaaagcuccggccugccuggcgucggacuucucagcgugugaacgccuggcggggcggggagacgcggagacuuggcgagcugaaacaaaggcuugggugggggacucuggcuggcucuggggugauuuucggagccggaaaggggaguuucgggaagugguugugccaggcggaccccagagcuuggguuugcaggaauuggaagagggggguucuuuucccguaaacugagggcggggccgaguagauugaaaaaauagucgcuggucuuuaauccaauaaucuggcccgcacucaucugcaaggaaugcuauguuucugaaucacuuugagaacuuaguggaaggccacguguaucgaaugggugccuuagaaacagaagaguuugguaaacucauagaagcccuugaaguauuguagguuugguuugccaguuuaaucguaauugcugcuuuucuacagguuuuugcuggugugaaaugacugaguacaaacugguggugguuggagcaggugguguugggaaaagcgccuugacgauccagcuaauccagaaccacuuuguggaugaauaugaucccaccauagaggugaggcccagccccugccuggcccuuauccucacuuugggcuuucucuugcccauaacggcucuuugaaaguaaagagaagagaaagcaaggagguauuccaaaaaagcaguaaacaaguucgugcuuacugaggauuuccuuuuaaaagaacacaguuuucauuguuucuuuaugucacagcucuuuaauagaaacguaggucacaaggaaaaagauuguaggcgaucauacagugaggauagagaacucagagcucuggauagucugaaguugucauuuuugaucuaguccagauugaguugggguagaaacaaguugagauuuugagucauuguaucuaggaauuucuucacaauuuaguuacggauauugaggaaaaucaccuaaauccuuacaagucucauauuucuauaugacguuaaauuucuaucacuucccugggauuaauggugcagguauguauaaguccaauuuguaagcauucaagaggcugagggaggagguuucaauuucuaggcuugccugaacuacuuacugaggcccuguuuacaaaaaccaaauauuuuuuucauguguaaaccuguucuaacacacaggaauguuaguuaaauucagaugucuacacagguuacauuuuaauauauucaugaaacaaaauauaagcacauuuccaaaaccacagauaaggucuucuaaguuuggacuauuauauaauaaaaauaagaauuuggccauaaauccauacuagauguuucugguuuuguuauuuuuuauuagugguuuuguuuucuuugguuuuuuguuuuuguuguuguuguuguuauuguuuguuuguuuuuuguuuuugucuuaaccucauaacucaggcugguuuuguuuuuguuuuguuuuuuuuugaaacagggucucacugcacuacccuggcuggccugagacuugaacucacagauauaaauucaccugcccuuaugucaugugugcaugcaugcgugugauuauguauguguauguuuguuugcuauucaugcuacuguuagcggguugaggguaaaucacauagguaggcguauucauccugguuaauuacauuucucugguuuuaaauaaagauugagccuguccuugucccccccaccaccaccuccucacucuuucauauucccaggauucuuaccgaaagcaaguggugauugauggugagaccugccugcuggacauacuggacacagcuggacaagaggaguacagugccaugagagaccaguacaugaggacaggcgaaggguuccucuguguauuugccaucaauaauagcaaaucauuugcagauauuaaccucuacagguacuggggauauuuucugaaacaaaaaauuuguaugugcucugaaacuauacuaaaguauauggacuuaggaaacauacaacuuuuuaacauuuuggugauauuguuuuguuuuguuuuguuuuguggaggccagaacaagugcaacagcagauaugugccaugggaggcagaagacagcuaauaaaagcucccuccuuagggccugggcaucuuggcuuaguuagcaggcgccuuugcccauggaccaucuuuaaaccccaaauauuaaaaagaaucugcuaggcagugauggugcacaccuuuaaucccagcacucaggaggcaaaggcaggcggauuucuaaguucgaggccagccugguuuacagagugaguuccaggacagacagggcuacacagagaaacccugucucaaaaaacaaaagaaagaaaaagagaagaaucugauuuucacugagugugugguguacugucacgguacuacucgggaaauggggucugcuacagaguaacaguaagacuucucagagaacuggugaguuucagagcuauuugggcccuaaggauuuuaguacaacauucuuacucauuuuacauuuuugagacaggauguugcuauguaucccagacuuaccuugaauuuagcacuuggccucagccuuccaagugcuaacuuuauagguauaugccaacacucccagccaauauucugaguucagagguguuagauuuucagaguuguugugauuuuucuguuuguuuguuuaaguuuggucugguuuuaaagacaggguuucuuuguguggccuggaacucuuugaucaggcuagccuugaacucacagagcuccaccugccucugccucugccuccccaguucugggauuaaaggcaugcaccaccacugcccauccauauagcagagguagacccccaaaacacugggucucucucucuuacagcagcauucuaucuuuagucacugucaaaguuaaaacauggcucuguuauuaauuagcuaaguaacuuuaggacaaaauacuaaaucugugugucucuguguuucugaauuuauuauaagaauaccuccaucagccgggcguaguggcgcacgagguguuggcagacuuacaaaguauacacaaugggucagacacuguucugaauauguaugaauuuguuuacucuuggcaacuuuaugggggagguauucuuuuuuaagaagauuuaguuuuauuucuggguacgcguuguuuugcuaugucuaugcacacaugggccuggugcucaaggaggccagaggaggguuccagaugccuuagaacuggaguuauagaugucuggggcccuguguggguacuagcaauugaaccugggucaccugaaagaguagacaguguucuuaaucccugagccaucucuccagccuugagggagguuuuuuuuuuugguuuuuuuguuuuuuuaauuuuuugagacagguuuucucuguaaagcccuggcuguccuggaacucacucuguaggccaggcuagccucaaacucagaaaucugccugcuucugccuccugagugcugggauuaaaggcaugcaccaccacacccggcuagaauuuucuuaguguuacguaucuuaaguuauuuagaauccauaagcucuacuuucuguacuuuuaagcuuaaucuaaagaaccuuuuguaguuuccaauuaaacccagagccaagcuccuuggaaaauauaggagccuaacaaggacaugcaucaguauauuggagcuggaagugaacugguauucacagccucauacagcuucuacaccaagucuaaauugacauucuugacuuagcaggucuagaguuguaugaguguguaagcugaguaauaguagcuggaaggauuuuguaaauuuaccacuuccuuuugugugccagcguacuccuccagaaagcuugcuuugcuuauuaugaucagcugccugcucuuuguucuagggagcaaauuaagcgugugaaagauucugaugauguccccauggugcugguaggcaacaagugugacuugccaacaaggacaguugacacaaagcaagcccacgaacuggccaagaguuacggaauuccauucauugagaccucagccaagacccgacagguaugcuagagauucaagcaagugugaguaaguguuuaaagcagagauguuugauugaucaagugugguagagauguaaucuauguuauguauaauggguuuuggauagugguuucuguauaguuagucuuuguuucuuguuaaacuuuuccccucuuccccuaucaccccccccccaaaaaaaagaacacuacuguacugugggauuucguuguuguuguuguuguuguuguuguuguuguuguuguuguuguuguuguucgagacaggauuucucguguagcccuggcuguccuggaacucacuuuguagaccaggcugggcuccaucgaauuuagaaauccuccugccucugccucccaagugcugggauuaaaggcaugcgccaccacucccuggcagggaauucuauuucugcuuuaacaggcucaacucuuccaagauuaaacauucucuaagcaugaauccuuuuuucugucagcacuugccacuauugaggacuuaacuuuccuggagggauccucacagucaguaguucuguacuguacacccaccuugcccuucuuccuuggcuggacuaucuuuguguuguuuguuuuguaaauaaaacaugccaguuaccagugugauccccuaggaaugcugaauuuggugucuucuuccuaagucaccccaauuuaucagcuauugauuagaaucaaauccacacagagagguggaaaugagagguuacaacuugaacugugccuguuguucguuaguuuuuuuguauguguuuuuuuuuuucuuuuacuaggguguggaggaugccuuuuacacacugguaagggagauacgccaguaccgaaugaaaaagcucaacagcagugacgauggcacucaagguuguauggggcugcccugugugcugauguaguaaggugagugugugcucuuacauuggaaccauagcuucuacuuagcauuaggcaguucagaauagugccagcacuacugacuuuugcaacuuaaaugagaguuuucauauauuugcaacuagaaaaugcaaauauauauuugauucauaugccagcauccauguuggguaucucguagccaacugugacuccagcuccaagggauccacuguuuaugaccuccacaggccacuacaugucacacacacaaacaaauauuaaaaguaaaauaauuuggggcuggagagaugcucagcgguuaagagcacugacugcucuuccauacguccugaguucaauucccagcaaccacuugguggcuuacaaccaucugugaugggaucugaugcccucuucuggugugucugaagagagugacagugcacucacauauauaaaauaaauaaaucuuuaaaaaaaauaaaauaauuucccucauagcaccuuuucagggagugcuaagaucuaauuaauucuuucagcauuuauucuacagacagcuuccuauuuuuaguauaggaauuugagaccuauaugugccaugauuguggaguggacacauugaagaugccauacuaaggauugacaauauagacacuaaaugacacuguguucuuuuguuguagacacuuugaaaguucugucaucagaaaagagccacuuugaagguaggacaaguuugaaaugucuugauugacacugaguuuccuauccugguuucucuuaccuccgucucuguuucagcugcacugaugcccugguucugacaucccuggaggagaccuguuccugcugcucucugcaucucagagaagcuccugcuuccugcuuccccgacucaguuacugagcacagccaucuaaccugagaccucuucagaauaacuaccuccucacucggcugucugaccagagaaauagaccugucucucccggucguucucugcccuggguuccccuagaaacagacacagccuccagcuggcuuuguccucugaaaagcaguuuacauugaugcagagaaccaaacuagacaugccauucuguugacaacaguuucuuauacucuaagguaacaacugcuggugauuuuccccugcccccaacuguugaacuuggccuuguugguuuggggggaaaaugucauaaauuacuuucuucccaaaauauaauuaguguugcugauugauuuguaaugugaucagcuauauuccauaaacuggcaucugcucuguauucauaaaugcaaacacgaauacucucaacugcaugcaauuaaauccaacauucacaacaaagugccuuuuuccuaaaagugcucuguaggcuccauuacaguuuguaauuggaauagaugugucaagaaccauuguauaggaaagugacucugagccaucuaccuuugagggaaagguguauguaccugauggcagaugcuuuguguaugcacaugaagauaguuucccugucugggauucucccaggagaaagauggaacugaaacaauuacaaguaauuucauuuaauucuagcuaaucuuuuuuuuuuuuuuuuuuuuuuuugguagacuaucaccuauaaauauuuggaauaucuucuagcuuacugauaaucuaauaauuaaugagcuuccauuauaaugaauugguucauaccaggaagcccuccauuuauaguauagauacuguaaaaauuggcauguuguuacuuuauagcugugauuaaugauuccucagaccuugcugagauauaguuauuagcagacagguuauaucuuugcugcauaguuucuucauggaauauauaucuaucuguauguggagagaacguggcccucaguucccuucucagcaucccucaucucucagccuagagaaguucgagcauccuagaggggcuugaacaguuaucucgguuaaaccauggugcuaauggaccgggucaugguuucaaaacuugaacaagccaguuagcaucacagagaaacaguccauccauauuugcucccugccuauuauuccugcuuacagacuuuugccugaugccugcuguuagugcuacaaggauaaagcuugugugguucucaccaggacuggaaguaccuggugagcucugggguaagccuagauaucuuuacauuuucagacccuuauucuuagccacguggaaacugaagccagaguccauaccuccaucuccuuccccccccaaaaaaauuagauuaauguucuuuauauagcuuuuuuaaaguauuuaaaacaugucuauaaguuaggcugccaacuaacaaaagcugauguguuuguucaaauaaagagguauccuucgcuacucgagagaagaauguaaaaugccauugauuguugucacuuggaggcuugauguuugcccugauaauucauuaguggguuuuguuugucacaugauaccuaagauguaacucagcucaguaauucuaaugaaaacauaaauuggauaccuuaauugaaaaaagcaaaccuaauuccaaaauggccauuuucucuucugaucuuguaauaccuaaaauucugagguccuugggauucuuuuguuuauaacaggaucuugcuguguaguccuagcuggccucaaacucacaauacucuuccuggaucaaucucccaagugcugggauuacaggcacauuccaccacacacaccugacugagcucguuccuaaugaguuuucauuaagcaaauuccccaucaccuugaaacuaaucagaagggggaagaaacauuugcuaugcuccugagugcuaacacugggaucauucacaugggguuugcauuccuaggcaaacuaaacugcugccuuuuacaacaaggcucagucaucuuccugaagcugcugagaccagcacuuggucuuguuuuguuuuaauaugucuauaugacuggugguggaucccuaaauaguuuauuaauuaaacuccaguuaaggagaaaguuacucaccuugacccguuugaccauaucccgugugugugugugugugugugugugugugugugugugugugugugugcacgcguauguacguacguauguauguagguauguaggugguuuccaguauaaacacagaaacaaauggagccaauucagguuucagaugcccuuacuaacauauauucccacgggguguggguuuuggcacaacagugacaaacuuaaaagccaaguaagagccgggcgugguggcgcacgccuuuaaucccagcacuugggaggcagaggcaggcggauuucugaguucuaggccauccuggucuacagugaguuccaggacagccagugcuacacagagaaacccugucucgaaaagccaaaaaaaaaaaaaaaaaaaaaaaaaaaaagccaaguagguccaguugguauaguaucaaaguguuuuuagaguaauuagugaaggucugcuuuaccucaaaguugcagagccucucuuccugaguuuaagugccuggccggcagucacaaauuaacauguugcuguaaggcaguuaguugaagcuuuguucacacauuggagaguaugaaaauaaaguguucuaagagcgcugauacuggaucuguguaaaccugguaaaugccguuuguccaggacuuagcgugugugaguugguagcucaguacgaguuuacuaguuccgcaguguguacaauggaggcggguuuguuuuagcuggccaccuguagaaucagccuuuaaacugcugugaacuuugucaugacuugaauaugaagauagacaaaaacucuguaaagacaaauguuuguuuucccccuuacagaacgugugagcuugguuuuaucuuccuuuguauuuagucauaaccucucaagcuggcagcuccgaccaaggaucagaagcugugugcguuccaccugguggaauuagcucagcucuauaugagaaguggaguuaauggaaaacguguugacugggugguuucuauuuaaaagagugaugauaauucuugaacaguaguuuuuauuuugcuauuucuuuaagcugacugaugugccacaaaauuauuuuaagguauuuguguuuuaagaguguucucaugagauuaguuguagauauuuuuuaaaauacaacugguuuuuaaaaucugaguauugcucuaagcaaguguuuagacucuuacgggaagguggguggaaguuguuuggcuuccguauuuccaugcgugccgucagacauaggucagaacgccaacugugcauccugcuguuuaaagaccucuuggccucugugacccucaugaaggggcugauauuuuaaguugacuguuugauuguaaauuaauccuuucuaauuuuuaaagacuugcuugacuguuuuccuuguuaaauaauuuuaaaaaaauaaaaaacuggaaguucuuugcuuaacuguau

SEQ ID NO: 1624 - RNA, 67081 nt, Mus musculus
gaagaugugggcgcuggaucccagaggccaccgacgcgagucugggaucccugcgcgaggcggcgucgcggcccaggcagguaggcgacgggaugcagcgagggaguggggccauggggccucugccgcucagcuguuggcgucgccccauggcgucccguguguucguggucagccgagagcuggguaccucgggccaggggaaggcgggugucagccugcgagccgcgggcgcggucgggggugcagggccggggagcccaggcgcucgccgccgcgaggaaacgcgccuaucaggcggucuugaacuuggacgugcccggacggagcacuucagacaagcgguaaagcguguguucgcgcgcuuugcuucggaacuacggggcaggcacgauagaggaagucgucaaguaguuuuuuaagauaaaauuccuacagugggacuggaguaggacuguggaguaaccaggagagaagaugaugauuagauugugagucaaaaggcuucgcucuggagcucagagccgcaaacaaaccgucacaccuccgucaggguuaacucuaagagguguguguccccggagugcaaaacugggacgcucauggguucucauguucugagaggaaugacaguguucuacaaaugucaggcauuguuguuugauacacacacacaugcaccccggagcauguguaguuuguaaaacuacuaagugccuaguacaguaggcacccugguaaaccuuuaucccaaagcuacuacugauucgccuguauuguuagagaaaguucuaacuucuguuuacuauguaaauaaguuaucuaagcgucauuuccacauaaucaccauuguuugaagagcagagcuauucuuaacugagucaugacauuuucuaaaauagcaugcuaucuguauaccguagugcaaucauuuaccaugaagcuuguaccaaucagaaaaucuguuacuuugccuuagauuagcugaagguauuucauaaagugagcugagaguacugccucaaaacaagacuuuuauuuugcaaauucaggggcugcuuauaaaaagaucugaguucucuaaaacaaaguuaauguguggcuguggcauuuguacaguuuuuauuauagacauuuguguucucuacuuguguguguguguguguguguguguguguguguguguguguguguauuuuagggagagaugggaaauuuaaaaaggaauagcagucuguaaccaugagguuucuacuagggauacguaagagugaucuggaguauuuucaaagacagaaaccagcaacuguaguaauugugucucaaggccucuuguuagucuguuaaauguggcaauugacuuuuuuuagaugcagaaauaucaguguuuuugauugagaacaguaggcaauuucuuuccuuuucuuauuuaaaauuuaaaauuagggcauguuugucaccaacgugcaaagaauccuggguucaaucccaguacuucauaacuggguauggugguggucccaucccacucagcauaagagaggugcaagaagggacucagaaacuccaggucacuccuuacuauguaaugaguuugaggccagccugggauagugugacucuguaaaaaagcaaaacaaaacaaaguuaaaaauuccucauauuacagggcuugcgagaugcuuugggaaaugagggcacuucuugccaaaucugaagaccugaguucaauccccaggccauguagaaggacuuagccagcuauguagauuguccucugaccacaaaaugugucccaacacauugccccuuccccaaaguaauaaauguaauaaauuuauuuauuuauuauguguauaugugugggcacccaaggugcauguauggaggacagagggccauuuguaaaacuuaauuucuccuucucuugcauggugcuggggauugaacuugggcucaguggcaagcaccccuacccacugagcuaagucacuaguccuuccuuucuguccuuguaggaugagacuaggguucugugacuacugcuaucagugaaccacaucccugccuccaacuggaaaucauauuacuaguaaaagauuuguagugauccuuaugugcuaggcaaggauuguagagcauuguguaccacaguggaguuuaguggagugcaagagggaaaacuacgaguaaauaauccgauccggugcugcuuuaagaguuuuauuuguggggcuggagaugacccagugguuaagagcacuuguugcucuuccagagaacgucaguucccagcacccaugucugguaguuuacagcugcauguaacuccagcuacaugggaucugacggucguuucugccuuccaaggacaacugcauacagguaacaugugcucacauauacauacauauaaauaaaaacaaaucucuagcccaguguaauggugcaugccuuuacucucaucacaugggggaggcagagacaaguggaucucugugaggucaaggccagccuggucuacauagugagaguuucagguuagccaaaguagagugaaaccuguuucaaaaaaaaaaaaaucuuauagaaaaagaauuuuaugggcuggagagagcacugccugcuuuuccagagggcuuggguucauuucccagcacccacauggcagcucacaauugucuguaacuccuguuccaggggauccgacgcccucacacagacauacguguagucaaaacacugauggacauagaaauaauaaauacauaaaauuuuaaaacaaaaaguuuuauuuaaauauuuucaacaauucacuuggguuuuugaaacuuuuuuuuuguuuggguuuauuuuuguuugcuuuucaagacaggguguguuuugcauuuguguguguguguguguguguguguguguguguguguguguguguguagccuucacuguccugaaauuagcuugguagaccaggcuguccuggaacuuacagagaucugccugccucugcuuuccaagugaaacuuaauuuuugaaacaggaucuuacuauauaaccuagguuagccuuuaacucauuaugucgcucaggcuggccugaaauauacaguaauucugucuagaucccagugcuaggauuucaauguuugccacuaucuaugcuuggcuaaaacuauuuucaaacaagcuuuaauccuguacugaauaaugaguucacugagaauuuauaaucuguugaucuuacagggcuaauaccuuacauucauccuacuuacugaacaacuauccaagguguagcuuagaaccuacauugcagacaugcacaggaaggaugcucuccuaucuaggagaguauguaguccuucuacggagugggcuaaggaaguacugaaaagcuauuuugaaagcugacuaacaauaagaguaucaacugcuacuugugggucuuccucagugcaggcagugcccugaauucauuucauguauuagcuuauuuaguccuccucacaaaaaggcucuccugagggaugcugccauuagcuccucacugggaggcauagagaaacugaguaacuugccugccaccccuuuauguagaaaggggucaggcugucaggccgcaguaacacugaaugcagcccucaaccccugcacuauacugaguuucaaauuuaguaagacccagugcaaucuaacagguauuuaaaagaagcacuuuuaugaacuauaaaugagacagacacaaauacaugagagagagagagagagagagagagaaagagagagagagagagagagagaggacagacagaaaaacugguauuacaagauauagaggcauguccaagcuacaauuuaauuauacuuuguauguaaaacuuuuuuuuuuuuuuuuuuugcugaugaaugacaugggauucuucuuguuuuuaaacucccagccacuuagggcauucucuuagcaauauaagaggugucuguuuuucaauaagaaguuuaaaauacuuguucucaaaccgugacuuaaauguuaacuacaagaaaagaaaaugcgccaagcauggugaacauaccuauaguuccagcacuuggaagacuaaggcaggaggcuaggacauuugguaggcucaccugggcuaagaauggaaaucugucccaaaucagucagucaaucaaucaaucaaccaaucaagucauuaugauaacaauggucuagacagaauuuaaugggaaacaaugaugaaagcaguuguucuacaugugguaggaaggagggcuguagaagggcaccauauuugaguuugguuuugaaggaugauuaggggucugcagagcaaggggaagguaugagugagaaccaggaagcuguaugacuauacgguauguuugagaacugugucuuaguuucuaaagucagggguacagagaugggugguucagcuaaaaauaaucuagaaaaagaaaauuacagagcacaguuguuuguuacauuagaucacugcaauugcuggguaaggucucuggaauaaagaagugagugacuaaguucaguuuggggaaaacccuuucacuguagacuaugguauugaggguauuuuuuuauacugagaaguaucacauauuuuuaacaaauacucaguguaaagcuaugauucgggguaggggagagagaugaaagagucuguugaugucguuauuggagaaaagcuguauauuguaagaacuuugcaauuuugucuagagacaauagaaccagagaaggcuccuuuggaaguaguuaagauugcaccgugauguucugugugguggcuggauugaaagaagccaggcaaaaggcagagagagaagucugaagguugauaagauagauaaguagauagauggaugggugcggccauguuugcuguuguugaaguacuccugguggagcagaugaggaccuggagaaagaaacaaguccagggcagaaagaggagagggcagacaggaaaccggggauugggagugcucaagaccuguuagcuguggagggcaaaaggcaguggcuuuacuucuuagcucagggacacagggccuggcuguauuaucuuuuacaugaugggaugauaauugucucuguucugaacuuguuggguuugaaguguucuauagagcaugggggugcagaugucgggcaagguccagaggccaggaugagcuugguuggugagguuucagaccuaacuagcugaaguucacacaguagagacucacuccgaagagauuuacucaucauaaagcauucaggugagguuuaguugaaaguucaacaguuuucaggcugacuagguagccugguugguagagugccugcgucacuugcuugaagaccugcgauuagccuccacuaucaugcagaacuagguguggugggccuugccuuuacucagcacuaaggacguguggaggcaggggaaucguccuggccuacugggaguuuaaagucagccugagccuuacucucuagcccuuugauauuuccuuuaaaacaggcccuuucagauauuuucaaagagaggcugggaguguagcugaguuaguagagugcccgccuagcaugcaagggguuuuggguuugaucccagacucacauagguugguuguguugaaaauguuuguauuccuggacaucaggagacccugugucacagacagacaaacagacaaguaaauggaguuggaaagauugcucaguaguuaggaacacuugcugcgauugcagagacucuggcuucaauucucagcgccaacaugacacaacaguucagggaaucugaugcucucuucuggcuucccauggcgcagcacacaugugguacauugguauacauguaggcaaaacacucauacgcauaaagugaaaauagauaaaucuuuuacaaauuuuuuuuucaaauuaaaaauaagagacuuaacuuaccacucuccccuuuauuuaaggacagauuugaggaagagccauuauuggcuaauuuaguuauaucagaaauauuggaaaccuugaaggagaauguggcuuuuuaaggucagucuuuuagcuugaucuugccugaucccagcagaggcacaugggucucuuggcuugagaccaggcugguaugcaaagggagccccaggccagccagggaucagcagugugaccaugucacagaaaguacugauuccucgacgugacgugacgguguguucuagaaaccauggaauucugguguuuguccuuuauuuacugugaagaacgugugccauguguucuguauuaagaccgaaagcagccauuacugagccuguugcuauuuugaccacuuaaggcagcucgcuguuccggcugggauuuccaacccuuacccagugaagugcaaaagaaugaaacagacuccucggagaaccugacacgugcaucauccacauguuuuccagacuggaaguaauuuaugcucaggaaaguugccuaaugaaucuuuuuuuaauuuuaauauuuacaugauuuauguuggaauugaaaauaacaaugaaauaauauuugaucuaaacuccaugcuguacuuacauggugacgugugcaugcgcgcgcgcgcgcgcgcgcguguaugugugugugugugugugugugugugugugaaacuacaccagcauucucuacugcuguuguugcccuuccacaacuuuccguugauuccguccaccccacaucauggcugcccacagucuccuccccuuuugcugcugugugucugcugguugcuucccugggacucagucucuccccacacacaucccuuuucuuagccccuuagucuaggcgucacauuuauuguuuugagccggucuccuguaccccgggaacuuugaggcaccaucuucccuugcccuccugggcucuggguuagagcucuaaccagcacacugaacccagacuucacuccugcccucaucguaucuugggcuccucuguuacaucgacauuccauguacacacuugggaagcaaggcauucccugagauaagcguagucgcuaauuuuccuaucuuuggucuaaguuuauuuucuucaggacugugcccagguucugagggaguuuaagaauuauauaguccauauccucuaugaauuaugguauccaacaucagcugaagauucauccccuaaucuguuaaccauagcucauuauugagcagcucuuaaagacguauauccugagacugagauagguaggaggcucagaaguuuaaggcuagccugggcuacuauagucagaaccuaucucaacaaacaaacagugagguauucucaaguagcuaggauuugaaucucaacucuugcuauuuaaaaauccucugcagggcagaaguuauagcugagggguguagugugugagaagccguggggucaacccuagucuucccagaagaaaacaaaacaccuuugccaagggaaccccugugcuuuugcucugggcuuuuuguuuguuuguuuguucuuacaaaggcagcuuuagauaauucauuccucucuaaaccuuugacuucaucuuucuuuucacucucagcccacaaucuugccucuuauuucaaaacaaagaaacaauaaaaacccuuugcaauccugggguggggugucagagaggcagaggcaggaagauagcugaguuccaggacagcccuggcuacacagagaaacccugucaugaaaaaaaccaaacagccucagcuagaacuucuugguguagucccuaacccagcaccucugccugcgcaucuccugcuuacuccugcugcagugggagggcagcccugcuccuggugccugcuucccccuccaggucccaccgaagacucugcccucucuucuuucugggccuucugcucucuauccuuauuucauucuucuuccuuccugacgucuucccacccagguuuaaauauaacuuacuucuuuccugucugaaaaagcaaagcuccccugcagccgcuguucuuccagccugcaccuuaucguccccuugcugccuuggcuuaacugacugccuacaguggcugcucccagucuuuauggccucauccacacuggacugacucacugucaccucuccuucacccuccuucuugccacugagccugcucuugcccggguccugaugaccaacagacacucgagucuuguucuuucccaucuucuuggcuucugcacgccugguguuucuccugucuuucuauguuugugaucgaguuaccaucuaugauccguguacacugagugucugagaacuggcuuguucaggacugucaauguuucuggaauuaugagauucuaaauuuaaccaagugugauggcuuauaaaguuaauuagaaaauaauauuaauuguauagaaugaagaguugugugguacagaaugaaugaguuugagccaggugugguggcaugcacaucuaauaucacuuguaauacuucagagacugaggcagggagauuacaaguucaaggccacccagggccguguacugaagccucaacucgauaaacaaauaaaagagaaagaaaugaagaaguagucuaacuggaaaucaugagaugccauuguguaccagaagggcuagagcucaaaagacacuuccaagggguggcgagaugaggcgggacuaaaucucuauuuguuggugagagugugauuuggucugaccacuuuggaaacauacuuggcaguguguuauaguaauagaccuacuccauagcauagcaguucuagauaaaacuaaaacaaaagggguuaugucuauuaaagauacauguaaaaugcagacaacagcccuuuauuuugugaugccaggaaugaagccagcuaggugaguagucuacucugaccaucaugguuucccccuggcuuuuuucccccucuuguauuuguguauccuucuauaucugcacacacuucucuaacuuguccuuuuuacuaguuguguguuauucaaucagggcuugcuaaccuugugugggucagaggcugaaaugcacuuggcaaugcucuguccccaaggcucugagcccuccucacauccagccgguccaugucccaucucauucuguucuagucccagccuucucucugggaaagccccugcuccugccccugcucaaguggccucucuucugugcaaaggcuuuccuauccuucccuggcauauuggggacaggggugugccuuucucugcuccaucugauggcuuuagaaccccauuguucagggagggaagugcucuuaguaacuuaauaaaaacugcgaucguuucuaaaugauauuguggaucugaaggugcuggguauauugcaagccuagugacccagugcccacaggaagugcuguuucuaguguuuucagugguaagcugaggggaguugagacauuuguucgaaaaccagguagaagaaguuuuacucuuggugcuuucauggccgguugugcuagugugcuuucugcugcugugauaaacacuguggccaaaagcaacuuggggaggaaagguuuuacuugauguauggguccuggucacauccaucgucuacagaacuuaggacguggacucaagcaaaggcaagcccauggaguccgucucacuggcuugcccuccauggcuugcucagcuugcuuucuaauacuaccaggcaccaccuaccuaggauggcgcugcucacagaggccugguccuccugaagcaaucauuaaucaagacacccuauagacccacccacaggccaggcugcgggaggaacuuccucaauugagggucacucuuccuagacauguuuagauuugugacaaguagacaaaaaaacuaaacaauucacccagugagaugaaguaugcaaagcauauagaguauauaauuugggaaugugaguugaaaacucagacuuccagcuucuagcuuagaacuagacaggaaguuacauggugcaauguauauagauuuauguucuagacucuugaaaauugccauccuuuuauguagcuuuaagaugaaaaauaagcuacaauuauaaauauacacuaauuacagcuacauaaaaauacacucauaaaaaaaggccaggaggaaacaccagauuauagcagugauuauguaggcgggguagaccugcagcuguccccugccuuccacacuuccacguuuucugcaaauaauguuaguguuacuguaggacuuuaaaacacgcguacuuaguuuauuaccucuuuacuugugugggcccucucauggcaugcgugugaucccaggacacugaguggguguggggugaggggguguucucucuuuccaccaugugagcccagggacucugaugcagguggucagccuuagcaccgcuacccacugagccaucucaccagucccgagaugugacuuuuaaaacuuuuuuuuuguuuuguuuuugguuuuuucgagacaggguuucucuguguagccuuggcuguccuggaacucacuuuguagaccaggcugaccucgaacucagaaauccgccugccucugccucccgagugcugggauuaaaggcguaugccaccacgcuuggcuuaaaacuuuuuaaauuacaucuuuugagugucuggggaaaaacugcaaucuuugaacacuugggaagugagcguuuggcuagcuuucugguauggugugcagaaaguuauucugaaauaaccuuuguuaaguggucauguuucaguuuagcacaguuuuggcuuuagagaagauuucuucaggguuauuagauaaaaagauuaagguuuguuuaauuaucuuuucuaaugaauuaauuucuaaaauucuaaaaguuuuaugguauuaaagcuacuuuguauauagcuucucacauugugguaguuuguaaaacuuccccuguugaaacuucaauugguuguuuuaccuaagagaaguuuuguuuauccauuuguuuuauuuugagauggagucuuguuauguagcccugggucaccucagacuugaaauccuccugcaucagacacuuugguguuggcguuauagguaagcacugugcuaccuagcuugccuaagccauuguuaagacuuuauuuguauuuauguguauaccauguguaugaggccagaagaaaccacuggauccccugcggcuggugacagacaguugugagccucucagugcagauccugggaaccaaacucaggucuucuggaagagcuguaaguggccuuagccacuaagccaccucucuagccacacugguuuuaaaaucuagaugaacuagcuguuguuaucugcuaggaaggugucagacaucagguccuccuacuuccauauuccugggacccuuucugggacccuaguuaggcaccaggugguuguugagguuccuugauccccagggucucaccccacccccugugccuuugaaggcuuuacaguugucccugugaucaucacaauugacacacacccuugagaaggaucuggaggugauaacugcagagucagauugugcuguucuuagaugugggucauuugacucuuguuuggguuuggaccuuggagaacccugcagaggcucagaggagacaggaaaagccgcauguagcauccuguuacauuaacccauauuguuaugucuacagcccgcauacacagugcuuaaauacgggagcccagacuucuuuuaaccaauccagccagccucagcuuccuuggcuaagaagaaaaccaacacagauaggaaauaagauucacaggaaagcagagggccggugugcuggggaaaagcaccacucucagauuccuacaucaggaagagagggagcucucuugccucauccacagcaaagggaguucuuuggauuuuagaaauagcaauccauaggaugagcuagcuuaauuuacacagugaagacucuaauagucaacguaucauaaguagccagcucaucuacagcaugguaggcuaucauucaaaccacuaauagucuuccuuucucaaaaguaauuuaguuagcauuuuaaaacuuaaaaaccuauuuuccuuaauaaaacgguuauauugguagucauugucucuccagacaguugugaggauugaaugcagucaugacagcagaugcugaaaacagugcucaguacacauaagccuguacauuauacugcugccacuuagauacaucacuguacaagcacaccucuucccgucuuggacugacucucucucucuuucucccucccucccuccuucccccccuccuuccucccucccucccucccucccuuccuuccuuccuuccuuccuucucucucucuuucucucucucuuucucucucuuucucucucucuuucucucucuuucucucucuuucucucucucuuucucucucuuucucucucucuuucucucucucuuucucucucucuuucucucuuucuguauagcucucuuuuuuaaaauauucauuuauuuuaugcauaugaguacacuguaucuguuuucagacacuccggaagaggacaucggaucccaauauagaugguugugagccaccauguguuugcugggaauugaacucaggaccucuggaagagcagcagugcuguggagccauuucuccagcccccuguacaacucuuuaaagcuuuauuuauuauuuuaugcauaugagugcucugucuccauauacaccugcaugccagaaaagaacaucagaucccauuacagaugguugugagccaccgugugggugcugggaauugugagccaccgugugguugcugggaauugaacuugggauucuggaagagcagucaguguuccuaacugcugagccaucucuccagccccuccaucuuggauuuucucuuuuauuugcuaauaauucagggauuguggcaguuuguuuuuauggcugaucagcuccuguguagguccaguuagugugagcacggccaacaucaguugugcugccagaggacgcucacugcucuuuuuaacuuccuuuaggggcggggaauaaauaauguggauaauaaauuguauuguuggauuagucugaaacaauuuuaaacuuugggagggcuuuuucugauugaguauauagcucguuuucucaaguacuugccuagcaggcacaaagcccugguuggauccugagcgcuagggaaccugggugggguuggagguguagaggugagaggucccaaaacuuaaagccagagcacuugggugcugagugauuagaggucagccuggcuaaugaugugugaacaaaacaaacaaaaacacccuacacaacaaaaacaaccuugggagaauuuuuuuaaaguaucuuuuuauuuccuuauguauguuugguugaaugucuuuaaaaccgcugguauuuugcuaaauugagauuuauaggcuuguuuauuguagagucuuuuauucaguguaauuacuuuguuuagucuggggaagugauuggaucaucuugucuuauuagcauauauagggcaucucccuuagacacuuaguuugaauuccuuuuaacuuucuguuuguugguguguuaagaggagguaucuuagcaggaaugcgacaaaacuaguacaaagaaggcuuauuggcaggaagggaagagguccugggaaggggaagcagcagaggaagggggacagagacugacagaaaaaaaagaggagguggggcuggaaagauggcucagugguuaagagcacugacugcucuugcaaagguccugaguucaaaucccagcaaccacauggcggcucacaaccaucuguaaugggauccgaugcccucuucuggugugucugaagacagacaggacuguguacucacauacuuaaaaugaaaaaaguggagagagggggaggagggagagaguaaauggagagagagggagggcaagggacugggcgggggaagggagagggagagagaguuuucagagcuagagcucugaaaacuguucuuauaugcaggcuugacuggccuaaaacuuagagacuucuuaccucugucugcugggauuaagagugugucccuccaaaccuguguaguuugcauugccuuuauaaauucucugcagcagggagagguaccuuagaaaauaacccagugccuguagagccagcggacuauuuauucaguuggcaucauagcuggucauccugggagcucuuuaugcuacuuugacuguuagagugcucacugcauaaagaaagcugucucaugcccuguguugacuuuucuaagguaaugcaucucauuuuccaugaaugagaguuuuuaauaccuuuucacaccacaaagggaaucuguaacuaaagaaaucccuuugcuuguggaggagagcaagaaagcaagaguggucacaaugucuucucuggcaaugaugcuuuucuggcacacaauggccucugaguuccagugaaucuaauuucugagucuguguugggcucuaggguccagugcaacuuuagaaaauagaauuaccuuccaaaugccaaucagcaguuagaugaagagccaguucacauuucuggagggucugaagggguuuccuuugguuucuguuuuacaaauuguuuugccgccuccagauaguuuuugugauugugugacauguggaauucugauaacuuuuuagaggauauauaaaugcuagggucccaagaggcaguguuggugguuguuggucauucagggaguugguugugguuugcuaguagucaugcucaaagaacaaacaaaaagagggaaauuagauuccgguacccacucccacucucuccccucucuccuuucucuucuaucuagucauaggggcugaaacugggaaggggcugggauaaaagguggaaaagaacccacagaguagcaaaggccagcuacauuuaugugugugagugugcaccaaggguaugggggugcuucaaaauguacagcuuucauauuccuuucucugcagucaugcacaaugacugagaaauuuauauuguguauugugagcacuuacuaagauuuuuuuugaaguuucuuugcuauuugggagccauuuuccguuacuuauaacucugaugggagugggaaaaaggccagaaucccgugugugcuucuuugaagauuuguuauuuaagaaaccaucaccaagaugguaaugguuugaagaguagaagccaggugacacuugcuuugguuugcuugauucuucuccuccaauuauuuguuguuuuucauuugcuagaaaucacuuucugguaaauucagugaggaguuuucuguaauucauuacuguauauguuaucaaaaaugguggcacaggccuauaggcccaggacuggggaggcagaagcagguagucgcugaguucagggccagucuggucugcuguagcuacauagugagagccugacucaaaacguuacccagaguccuuagaguuaaguaauauauacuaaaacuucaacguaaauacacuuaauagaaaauuuuuuuuaaauaagaaaggaagaaaaaccaggccuaacgguuuaaugugccgaugcuucccacgcagauuuuguuugccuuucuuugagccguggcucagcauccucucgugccacuguagggugggugacacagugagguccagguugacuucaggucuccucugcagcacuguguacccugacagcccgugcuaccucccuuccaucucaucccugggcuuucuguuuucuuuuucuuucuucuucuucuggguauccccaacaagaaagacuccaguggauaaagguuucugagaucacagaaaagacauacuagcaguuugcuguaaguaauuuguaauuuggagggagccacaguguaaugacgcguacaggaggcgcauagacucgaauaacacugggaaggggcuaaguaaggcuucacagacgcacuuugcacuugcuguugaauaugcacguucuauuauaaaauuagaggcuguugauauagcucggggguagaguauuugcuuagcuugugcaagacccuaggcucaauccccacuauagccaaaaucauaaaaauguaaaaaagguagauuuucacaaagaauuuaauaggcuaugaaauuuauuaagcaguuaugauaucccaggugcugcacaguauuuauaccuuauauuuaaauucacauuauaaauuuugaaguaucuuugucuuuuguggcaagaggugcuaaaacaucucacggcugaucucuuugagucuuguuucuccaucugcaagggaggcuucccaccguaucuggcuuagaugcaguuugggaaaggagcucucgugguagauuguuuaucuagcacugaaaaaagaaaacaaaucaauauuguuaagguagaacugugcauagcucauauugaauacucagaaaguauucauacugccaucauugugagcacccucuagauaaggaggcaggauuuauuauauggguucuguaacuuagguuuacccagcugaaagccaggugugcugggauuugaugcuccuuuguucucuuuuuaucuuuuuuaucuuguucuguuuagaaauuguucuauuagaaauaaugugacauacuucuuuaaagcucaccacacaacuugugagccauuuugguuuuuugcagcaaauuuuagcuaaauacaaggauaaacacucaggagagacucggugaaagaaucuaggauguucguacaguugggaacgaacccugaauuuugacacuuucuuuuuguguguaugugugugggggugguucgagacaggguuucucuguguagcucuggcuguccuggaacucacuuuguagaccaggcuggccucgaauucgccucccaagucugggguuaaaggugugcgcaccacugcccaacugcccagcuuguggugggauuugaacuguaaggccagaguuguaacuguacaagcaggugcgcagaccgcuagguaugacuagagcauguguaggcgcggagcacaaauggcgggacuugaaaggcuuaguuguguuaaggcuaugccacauauaauuuuaucauuuaaaccagaaacuauuuuguauuuacuuauuuuaugugucugaguauguuugugcacacaugccuguucccacagaggucaggggauaacuugcaggagucaguucucagugaauuuuggaggucaaauuuagguugucaaaauugguggcaaaaccuucuacccaaugaaccgucucaccagucccagaaaccauuuaaaccugugacccuguguguguacuauagaagcaagugcauauggcuaugucagcuuugaaaacuuugaaauuguguaugguugguuuuucccaacuuuucauuuuuuuuuuaaauuuuauuuuuaggugugugugugugugugugugugagagagagagagagagagagagagagagagagagagagagagauggauaugugcaugggagugcagugugcagaguccagaagagggagucagaucucauggagcuggucuuacagguggugugaacugaagaugcuccuaacugcagauccgucucuccagccuguguauguaauauuguguguguguguauugacauagggucucacuauguagcucugauuguucuggagcucaauuuguaguccaaguuggccuugaacucacagagaucuaucugccugccucugccugccuagugcuggggcuaaaggcaugugcccccaugcucagcuccaaaagcuuuuuaugagccagcaagauggucagcugauaagggacugccagcaccgcccccccccccccccacacacccuggggaggaccagagagggaaggacgggggagaagaaaauccgaauaaaggaaugauagucuuaaaaacuaauuaaggaggggcuagggcgugccuuggugauuaagacugacuaaucucccagggauuccagguugauuccuagcacccauuugguggcucacaacugccaauaauuccaauuccagagaaucugacacucccuucugaccuuugugggcagcaggcaugugguacccagacauacauucaggcaaaacacccauacacauuuaaaaaacugaauuaagagaaaauauugucaauucagaauuguauauccagcaaaauuauuuuuccagaaugaagggugaaaguaaguuguuuuaaacaaaaaguggagaaaguuuguuaccagcaggucugagccacaggcaucgcuaaggggugcaggaauccucagguuugaacugcaggcacugcuaaggggauguaggcauuccaugguuaauuaaaugugcagcugaggaagcugaagcucagagacuagagcugcuuuccugcagaguuagcacaugaagauuggggccaagcuccagguccuucaucuccaguggaaaaagguagcagguagagacucagauacaccugugaccugugcugucuguaccugcuaaagugccacgcacggggacacaguggaugucaucucuucaccgugcugcuuuuaaagucauucauggagggccgcuuugcuuugccuugccuuucuuuuucuuucucucuuucuuccuuccuuccuuucuuucuuuuuuuuuuuuuuuuuuuugagguagacauuuuuuccuagagacuuuuuuuuuuuuaaucucuuaucuuuuuccugaaaugccaucuucaggaugccaacaacaauucuuuuuccauuuggcuauguuccuucuaguagcuaaguagcuggcagcuauuuucuucagauaaacaauuacuuuggcucuaaacauaaaacaaguguuauuaaaauagccaucuacaccuaauuccccacuuuucccacgaaccaagaagaacugagagcuuagguaacugugguagauaguguauugaauguguguguucuggcuggaauuggagcccuguucuagaacuuucgccugaggccauggguucaacuccagcugugcagaggaagaaucauccgugucucuguuccuuggagauauuaagguucugcagaauuuugagaacaaagaguaccuguuguuuagaauaguuaauacacacugucuagaacacucacuucuuccugagggucugaauucuuacaaaugugaagccaucuuaaauccacauuuuucuuugcucucaaaguagugagguuguaugaaaauugagguucuggaagucuuaccaaaagucaucagguggucuacaagguaaucagggggucuccaaggcagucagguggucuccagggcagucagguguucuccagggcagucagguggucuccagggcagucagguggucuccagggcagucagguggucuccaaggcagucagguggucuccugggcagucaagucucuaggauagugaggugauuaccuuggaaaguaaucaaaugggcucuagagugccauucacugauuacagcaacacgucuauuagcucuguugaauaauuuuugcuuuauuuuuauggguuaaaaagaauaguggcugcuauucugggggcugaacuuuuaacagaggggaaaccauuuccuuuaaauuugauacugggaguguuuucccuuaagcauucagaugcaggaagugcaguccucuuguucaguagcuuuggcugugucagagggaaaaauggagaaauugcuuuuguuuugguuugguuuuuugguuuuuugagacaggguuucucugaaucgcccuggcuguccuggaacucacuuuguagaccaagcuggccucgaacucagaaauccgccuggccucugccuccugagugcugggauuaaaggcaugcgccaccacacauggcuugcuuuuguuuuuaauagugacuguugaauaaaggaaggaucuugggguuuuaacaugggcaguucauucacuucucugagcuuaauaucugucugacaaccuaugcauguucaaugagugcaaaaguaaguuaauugaccuugauuaguaaugaaacuacugcacauauaauaaugacguuuuugugagaggggugugugugugugugcgaguuccagcacugugguacaugacuauagucuccacuacccagucaacugaggccagguuacugaacacaggaauuuggagccugccuaaaugagacucccaucucaaaaaaagguaguuuuucucauucauauuaaaaguaaaacugcacaaacacuucagagaauacuaccucuauucuucauaugauuauucuuuuuuuuuuuccgagacaggguuucucuguguagcccuggcuguccuggaacucacucuguagaccaggcuggccuagaacucagaaaucugccugccucugccucccaagugcugggauuaaagacgagcaccaccaccucccagccauauaauuauuauuauuuuuaaaguaucaacuaguuuuuggcaaauguguggguuuuuuuguuuguuuguuuguuuuguuuuuucguuuuuuugagacaggguuucucuguauagcccuagcuggccuuaaacucagaaaucugccuguaucugucucccaagugcugggauuaaaggcaugugccaccacugccuggcauaaaaguguucauuuauauaacuccucacucuaccaacauguguauuuugucucauggucuucuguggucaguugccuuuagcaaccacacuggcccuuucucccuuugaauaucaguuuuggcuguuaugaacucugauuuaauuagaauucugcaaguauauaagcuuuuguuucugcauaauuuuuuuuuuuugagacaggguuucucuguguagcccuggcuguccuggaacucacuuuguagaccaggcuggccucaaacucagaaauccgccugccucugccucccaagugcugggcuuaaagucgugggccaccaccgccuggcucugcauaauuuuuaaagauauauugaauuuaauaguuuaaugucaacuugacccaagccagucacuugggaagagagaaccuuaauuaagggauugccuccaucagauuggccuguagucaagucugcggaggcauuuucuugacagaugauugauuugggaggcucagcccagugugggcggugccaucccuugccagguuguccuagguuguauaaggaagcagguugagcaaaucauagccagcaagccaagccaggcagcaguguucuuccacugucucugcuuuaguuccucccuggaguuccuguccugacuccucuuccugauagacugugagcagaaauaugaaauaaacccuuucccccucagguuguuuuuggucauguguuuaucacagcgguagaaaacagacuggggaguaagugcagguugucaugcagacuguaacuuuguuucguuuuauugcuggaugccugcuuucuauaguacaguuuguucaagcuggaggcucuuaggaacaaaguugcucugaguauccacgcuuugugagcgcaugcaucccuuuccucuaaggccugcuaguggaguugcuugugcaugugcuauaagaaacucuggugguuccuaaagugcuuggauggcggucugucaccaucgacugggguuauuuaagggcgacaagagcugguguggauccuuucaugugcuuagggugcugauuggcugcucauaguccuuuguaaaguguccucuuacccaugugcuagugccguguggacccaguuaugcuuggggauguguucaggauucaaguucuagggugagugggugugugcgugcaugugggagugagaguaugugagaguguguguguguguaagagagguguuucugugugaauauacaucuucagguaagcuaaggguuuuaauuuuucauaaagucuuaauuuaaaggguuuuuuuuccuuacaguucaugccuuaaaaacaaaaacaaaaaaaaaacaugcugggcaauggugguauacagcuuuaauccuagcgcucaggaggcagaggcugugaguucuagggcagccagguugacacagaaaccaugucuugauaaaacaaaacaacaacaaacagguagaaaaucuuuuucagguucgggagcaguagauccacugcaguaaaguauuuugaguuuaaaacaaaaacaaagacaaaaaaaccaaaacuuuaacaaagagcccccuacuccuuuuuuuuuuccuguuccuuuuccccgagaguuuauaguuuuacccuuaaugcuuaggcugugauguccuucaaguuaguuucugaaaugggucacagucuuuuuccuguauggacaucccuuuauccuagugauaguucaagguuuuucuucuccagcuuugugacaaucuauguagacucugugauguguacugguccaucugucuucugugacuagugugcauuuucagaauuacuguagcuuuuccaacuuuuuaaaauuguauuuguaugggcauuuuugccaguguguauaucuguguaccaugugaaugucaggugccuacagaggccagaagaggccuuggauccucugaaacugggcuuacagaugguucugagcauccauggaggugcucggaauggaaccugggugcucuggcagaauagccuuuacccacugagccaucuucuaguccauuacuguaguucuguaaugaugucucauugugggggagugucuguccccugagcuuauucuuuguuucugcccuauuguuuaguccauuacaggcccuuuacauuucuguuuaaaguugaaaaucaacuugucagccaggugugguggcgcaagccuuuaauccuagcacuugggaggcagaggcaggcagauuucugaguucgaggccagcuuggucuacaaagugaguuccaggacagccagggcuauacaaagaaacccugucucgaaaaaccaaaaaaaaaaaaaaaaaaaaagaaagaaaaagaaaaucaacuugucaauucugccacaaagucugcuugauucagauuaggcuuuuuuucacaucuagggagucaauuuugagagaauuugaugucuuaacaaaauugaaucuuccagcacauuaguauguaauaucuaauuuucuuagcauuaucuugucauuuucauucuucauguuuuuaucuccuucucuuuuuccuuuguucucuucuuuucuuguaccuguccucuccucugcaucugguccuuuucccuucccugauguaucccaggccgucucaaacccaggaugcuccugcuucagccuucugagugcugguguuaugggccaccacuaccagaugacucuuuaaauguagccaugaacuagcuguuaccauccaagaaggagcuaggcacuaguccccgugacucuuuaccuccuugucaagcauucugaguaccuagcugcauuuauauuuuucugccuuuaauacuaaugcagugugcggugugugcccaggcuggccucaaacucagagacccacuuacuugaugagugcuggaauuaauuaaaggcuuaguuuuauuuuugaaauuauuuuuauuuugcauguguguggauguuugccuuacaugaauguaugcuacuugugugcuugauaucccuggaggccagaagagggcaucagauccccuugaacgggaguuacagaugacugugaaccaccucuugggugcugggaaugaaaucuagaucaccuggaugggcagccagggcuuuuaaccacugagccuuuucucuagucccucaaucguauucuuuuguuuuguuuuuguuuuuguuuuuguuuuuguuuuuuguuguuguuggguuugguuuuuuuguuucguuuuguuuuguuuuuugguuuuuugguuuuucgagacaggguuucucuguauagcccuggcuguccuggaacucacuuuguagaccaggcuggccucgaacucagaaaucugccugcaucugccuccaaucauauucuuugaagcagggccugccacugacugacccuggaguucacugcuacaccuaggccggccagccagccgucuucagggaucuuccucuuccagccugcccagugccaggauuauaugugggcugccaugccuagcuuucauuuuuaaauuaugagugccagggacugaacugcccucaugcuuaugugacaagugguuugcugacugcggccucaggccuuugucuucuuccauuuucaagugucaccuucucccuuuaaauaauuaaucuauuuguaauagcugauuucaagucuuugcuaacccugucauucaugucugucaccuuuuuaaaaaaaauuaugcuuugacaauggauauaaucaacaguaaugcuaccauuaugacucaacuugucauuuuuaaaacguuuauuuuauuuggaguuauacuguguguauguguaguguacacgcaugcaggucacaggaggcagagacgcuggaucucccagagcugaaguuccaggggcuuuugaauugccuugugguugaccacugagcuaucucuccagcccugucagagaaaauugaacaucuggaccugcaugaauuuguguuaguccuuuuuccaguucccuccuggcuguuugcuuauugguuguccagcugcauaauuuccccucugcauuagcaucucaaugcuuacccggggcuucagagggucugauaaauugcuggagcucuccccaccccacaccuuuuuuucuggugacuuggccuggaaaguuguuugcuuuaaccuuugucuuugucuucaauuuagugagguuaccacacccugugggggcuccugucucaaugcuucuuuauaggaugucuccagggcgaaagugaggcucauuucccuucaggaucacagucuugugccugguguguaauaucugaaaucguuugucuucuguauaguuuuguagcugcaucagcaaggcaagucuacucuaucauggcuacgggugaguuucucucauccuuucauuaguuucuguuuaauugaggugaaauuuauauaucauaaaauuaaccauucugucccuuuaucuccuagugagucaacuuuuaggguggucuaaauuggagcuugagagauggcucuaggggaaaaugcuugcuaugcaagcaugagaaacuaaguucugguccuagaacccauguaaaugcuaggcgggugugguguccagccuguaauuccaguacuuugaaggcggaucccuggagcaggcgagcaagcuagacuagcugagugggugaacuccgaggucaaguaagaaacccugccucaguaaguguguaaguggagagcaguugaggaaggcuccagggucaaggaugggcuucuacuccaccacagggggaaaagugcucagaauuguuauggcugguucguccauuuagguagaagguuauaaaggauuugaagacacucaguaugagacuugauuuaguaaaugagcauccaaauucucuuguccaaaaagaaauuaaguuaccugacuggguucagauagguuuucuuuaauauggugaccacacaugauauuguaagcugauaacugcauuugaugcagcuaaacccacugcagaacaagauuaaauaaaaugcaaagaagccuaguuuaaaauccccuccaaaccuucgguuuugugggagugcuugauuuacauauuucugcuguucuaaggaacugccgacuccugcuguguugcuguggggucaccuguccugucuugcucuucacgcucuccugagcccuucagucucuuuaauugcuauagaaguuguuggcuccugugguuuuaagaugcagcauucaaacuguuggguccucucagugcuugugcuucugaaagcaggcuugaaaaagcaucguaugggaaauguaaacaaguuggcugcucuuagagaguuuuuuaaaggaugaagguuggaagagaccuuggaaacuagcccuccuuuauggguggaagaucucuucauaguagaggucaggacaagagccuggggguugggaaugggguuagaagguucuugcaggcuaggagagacacggggaggaaguacuaaguagauggcgcagaauaugagaacucuguggcgaguucuguuugacaaguuauuuauuucuaaugggaccauauaaaaauagccuauguguaggcaucaacaagucucauuacgaaaggaaucaacuagcuuggaaaccaggugacuggcccuugcaacccaaguacaggccagcaugagccacaguaugagaccugucucagaaagcaaaacgaaaaauagacagccuucaauuuugcaaaaagaaauauuagaacugugaaacuagcuaucagugcagucauaaacguaguuaaaaggcaucaaaacuuguguguuuauguugagacaggagauuggcuucaaauccccaguccucugccucagccugagcgcugggaucggcacuguucuuggcuuccuucugaaguacuuuauucacuuuugaaaacaugcaagaacgaguaagcucucuccucugccacuagacugccugcugccacuugaccaccauccguguuccucgcuuguacuuaauagaauucuacagauguagccauuuguugccagucaaauuuucagguuuaaaggacuuuuguagcucucaaaguuucuacuuucuucccccucaguuuuuccuauguuaaccaggggaaagggaggaaaaggucuguuauuggaagagucuagaggccuuuccgaagccagauccauuuugucuacaaugaagaaaacccaaaagucaaagacacucgcaaguaugggaagcaagagaaggguguuugguguccugcccugcaggagcugagugcacugucaugccuugucauacuugggugguacuauguuaucaggagcuccugcugggugagguggcuuaugccuguagccaguguuguagaggcuggacggggauugcgacuaguuugaggccagucugggcuucagaauaaaaugggcuucguguacacauguacauacauacauacaauacaacuucugugaaguuuuugcuaugauuuuuuuuucacccacaugagguuaauuucuuaauuuaaaaaaagauuuauuuuuuugcauuagaccaggguuucuuuucccgcaaagcuaauuuuccuacaaacuagugagaauguucacaaagacaaacaucacaugacuuccuuaguguggaagcuagaggggaaaaggagggcacaaaacuaaaguaggagagcugggggugggguggaguaagaaagaguagaggggugagugagaucaaguacuuuauaagcguguaugaaaaugucacaaggaacuccauuguacaaugagcauacaggaggaaaaaugauuuuaaaaacuuguggacaugacuuaagugaaagucauggaaauccugaagugcagcuucuguagcgagaauaaaguguguguguguguguguguguguguguguguguguguguguguguguguguguguguguguguguacgcgugugcacaugagccugccugccugccugucugucugucuguguaugacugguccaguuuugaucagcuguacugacagagcuaggcuaagauaguguccugcuuguuaaucagggcuaggcagaagcagcaggaggaaggaugacccugccucaggaaguuuugaauggcuuguuauuuauaaccaguaugcgguagagcgggagagcaggucucugcuuacugacaggaagaguuucagccggccaguguucacauuugaggaagcgguuuauggagcugacugauugaagcucugcggaaggaaggaugagaaaagugacugcagaucugagucagagguagcagagaugugggaaacccagccaggacaggguaaagggugccuaugccuuuggacugagucccuguagcagcuugugugaaagucugugugcuaauaggucagcugaaauaaauauaugacagacugauguuaccuagcaacagaagacaggaggcgggaacuagcuuccaguguguuugugaauugguuccugucuagacuuguaaaugcacuuuuuaauaauggggugcuguucugauucuguguuuguuuguuuguuuguuuuugagacaggguuucucuguguagcucuggcugucuuggaacuuaccaggccuugaacucacagagauccucugcuucugccucugccuccugagugcugggauuaaaggugugcaccacuaugcccagccuuaugugugauuuuuguaauauugcauuguugcauguuuuauuaagaaacgcuucauaaagaauagauuuaugggcaggagguauaucgagcucagagauagagugcuugucuagcacacauacggccacauacacacaaaaaagaauugauucauuacagaauaauguauacauuuugcagggcauuaaauacagcagaguauuaaagcugacagcuuaagaaauagcaccagggauauuuucuuacuaggcuugacuuuauggagcugaauuacaggcacaguuuuuacaaaugcgauguaauuuauucagugcuggguagacaguguucagugggguuuaaaguaagaaaucauaaaacuaaguuaauauucuugucucguuuugauaggaucauucaugauacaguuguagcuguuuucaacaaagcucggugaugaaaacuguuauuuuuaacaagauaccuccaaguuaaacaugaaacgaaaacacuuggaucguuuccguucuggcaaggcaaagaauacagcguuuuccagcuaacuggucauggcaccucucuaagagugacucgucaugcaccccaccgggaacauggauguuggcuuuacacggucugcuguucagaccuuguccaggagccacugcaaaaacaucaaacagaagauuucccagugggaaggaagagcuaacgguguaaccaagacagcuaaguuucacccaaaggacuuuggagugagguauaacugccaccaagagagucccccucauaagcgucccacuggugaggaaaggaauggggcuuuacccagaaacacggaugucaaaagccgagaucaaagugaggaugaaggcgaggguggagaguguagaggcucccaccccucggaagcuggacuggacuccagccuggugugugcucgggucaaacaaaucgaaggcugccaagcuguugcuguggguccagaggcuuccuuaccgccaggaaacuucuacaccucccagauaccguggagaagcauagacgggcucuccccagauaaacccuuaaauuuggccuuagcaccuuguaacucuacagggagagaaccggaucucaguguucuggauaguucuuacggaauaaccaagagcuuggaaaauauuuauuaugaaccugaggggcaggaauguggccccucuauaaauccuuuacccaaaccccguaggacauucagguauuuaucugaaucugaugguauaccauauaaagaaaggaacugugaucaaaaguacugugaaaguauuuccuguguggacccuucuuuggccucuucucaggaucccgaaccaaagaaauauggcgggaagaucagagggcgguccaaaagguauguauguguucgucuuacagcccgugguuuguaguguaugaguccuugcgcugcuuugaccuucaguccaaguuuccuuucccaccuuggaauacgggcuucagcugagcauagagauguugauagcauagaaucaaaguaggaggagaaagcaaaagugaagaaguauagguaauacagauugugcauaucuguauucccaucaccagaaaggcugaagcaggaggaucaguacaauuuugaggcuaaucugagcuacauaugacuuacaaaaccagcuugggcuccauagcaagacauugucguaucccuuugcccaaacagcaaaagaccuuucugauaagcagguccguucuuuggcaucauuuagggcaugcuggccucagccucacuuuuaauuggggaguaauucauggagaggugacuaaccagauaagagcacuggaugcccuuuagaaggcccagguuugauuaccagagcccacauggcaggucacaaccguccguaacuccaguuccagagguucugacacccucugugggcaucaggcacacaggcaugaauguaggcagaacacauacauauaaaauaaaaacaguauuuauuaucuuguggguuuuuuuguuuguuuguuuguuuguuguuguuuuugacaagguuucucuguguaacuuuggcuguccuggaacuugaucuguauauguggcuggccccaaacucacagagauccacuugccucugucuccuuagugggauuaaaggcguguaucaccaccagccaucuucauaauuuuacacacgucuuuucaauuucugucuuaucauucugagaucaaaguuuuugaagguguaacuuuaaaauacaucuucuuucguaaggaaauccuuugaauuugaagauauccagcacuuucggaacucacgaaagauccaugaagaacuuggaagaaaugcuggcucagcacuuuacuacacacaguccgaggauaauaucuaugaggauauuauauguagguauucaugcuuuggaguuaauguaaugcauguuugggggugcucaucauuguacggggucucuuacaaucaaacguaucugguuuuaacuuuguuuuucuaauuuggaaacacguggcguaugcauuuucucaucaugagugagauugacagcuggaugucauuacagaugacucaguuggaaagugaaugcugcaguguaguguuuucagaguucuuuagcuuggaugaacacuggagugauagaucaguuuaaaaugacauuggucuuacaaccuuacauccccaugagaaugaagaagaagaagaaaagcauuguuuucuuuagcugcagucacaggucccacuuaauuauguuccucuaaucagcauugcuaugauuucuaaagauccagccaaggaaaauccauacgaagauaucccagugcagucguucccuguuuggagauccccuucagcguggaggcugccaccugcuaagagcgccuuccgaacacccaagguauaagcggaggcuuccccaaagagcacauagaugcuuguguguggucguauagaagagcacauagaugcuuguguguggucguauagaagagcacauagaugcuuguguguggucauauagaagagcacauagaugcuugugugugguuguauagaagguucuggugguuuagcuggggcccaaacuaagaggcacugaauauagauuuuauugucaguggggguguuuucuuuuguuuuguuuuaaagaugcuauacugguuucuuuuaaaaauaucuuugcuuugcuauugguuggguaaucuuaguauuaaaaaaaaaaaaaaacaacuuaauaugaguaagauuaggccagaggucuuuaaacuguucuauuugcaaccccuuuucacucaaggggggauugagacaggucucacuauguaaaccccugauagucuagaacucacuuuguagaccaggguggccuugaacucacagagaucugccugacugugucuccagaguacugggguacugggauuaaaguugugugccaccaugcccauccacccaaaaaauuuuuacaugaccacagauauauagguauguaauugguauacaaauuaaaccuuugcagacaauaaaucauaaauauauuuuauaauauauacauguaugcauuuauaauuuuguuauuuauuaaagacaaaagcaaauaugcacacuaaugaaauaggugugcuuauuuuuacauaaaaaauugauuccuggcuggacgugugguagguggaucuuugugcauuugaggcagccuggccuacauagugagcuccagaccagccagugcuacauagugagcccuaucuuacauagugagcccuaucuuacauagugagccauaucuuacauagugagacccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagccccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagacccuaucuuacauagugagacccuaucuuacauagugagcccuaucuuacauagugagcccuaucuuacauagugagcccuaucuuacauagugagcccuaucuuacauagugagacccuaucuuacauagugagcccuaucuuacauagugagaccuauuuuacauagugagcccuaucuuacauagugagcccuaucuuacauagugagugagcccuaucuuacauagugagcccuaucuuacauagugagcccuaucuuacauagugagcccuaucuuacauagugagcccuaucuuacauagugagcccuaucuuacauagugagcccuaucuuacauagugagccccuaucuuacauagugagcccuaucuuacauagugagcccuaucuuacauagugagcccuaucuuacauagugagcccuaucuuacauagugagcccuaucuuacauagugagcccuaucuuacauagugagcccuaucuuacauagugagacccuaucuuacauagugagacccuaucuuacauagugagcccuaucuuacauagugagcccuaucuuacauagugagcccuaucuuacauagugagcccuaucuuacauagugagacccuaucuuacauagugagcccuaucuuacauagugagcccuaucuuacauagugagaccuauuuuacauagugagcccuaucuuacauagugagcccuaucuuacauagugagugagcccuaucuuacauagugagcccuaucuuacauagugagcccuaucuuacauagugagcccuaucuuacauagugagcccuaucuuacauagugagcccuaucuuacauagugagccauaucuuacauagugagcccuaucuuaaccuugccucuguuccaaccucugaaaaaaggaugaaaucuuuacugcauauuuggugcuguaauacagaaugauagaaguuuguggcuauuucagaaauuggaaauucucuccuaaucuaaagccaacauuuaucacaugauguuuaaaguuuuuguuauauauauggguguuuaucacuugcccauggguaugugcacacaaaagcaguauucuacagacuguugugaguuccccaacaugggggcugggaacugaacucagguccucuugacaucaauaagcacuccuaaccacugaggcauuucuccagucccaucauuuaaugauuuuuuuuucuuuuuaaugaaacgcgaguuuuuggcucaaauaggaauuuuaauaucaaauauucuaacacaauaaaauucagcaacaacacacacuaagacacaaaagcaggaauauauuaaagucuuugcuuucuguaauuaaaccaucauguuugcaaagacagaaagaacacugagcguguaaaaugagaacauuacaguuucuaacaugcaguagucucuagucugagccagcugugugcugguguuguguaaaacgacaucaugcacagugcaaagggcaugugcugugugcucccagccaaggcugccgugaaguccccacgcagcacaggugagcauugccaaaaccaccccagacucuuaguggccuggguuuaaauucauuuuguuuguucagaaaccuuuuacuguuaccuauuuuuuuaauggcuucccccaucagucacacuauugucacaaccuauggcugcagacaggccaggcacuuuucaguccucugcaguuaccagugcuuagccugggccucaguuacucaaucacucccugaaacucagaccaauagcuggaggaggucaaagugaugagcuauucucccuugagaauuugaucauagcacaggguagaauuuuggauuagaaaacaacuacauuacugggaugagaaggaguugcagaauccccauuugggaugaauuuaaaggaaaaagauaagcauuuauuuucugggggagcguugacuuuguuuggaagcauagacauuuccuagagaucuugaccagugugucuccuguuuuagcuuccucccaaaccccaguucuuucagcggaagacuauggaacugaagaauucucaagcauauuuucgaucaaaaaucacaaaggauacuacuuugccugucacccuaacggaauggaaacuguuccgagcuggagagguggcuaacaagaagaagagaaaucucccaccggugaggagaccagcacacucagucuucagauucuaauaaagucgaauaagcauuaggaugagcugaauaauagguuagaacuuuccuguuggacucagacuugggaaggccucuauugucuuggcaaugguuggaaucagcuaccgaucucacauaaacuccagacucucuaacaacaggagaguguuuauaugccaguuccuuuauguaccagagcaagggcagccuugugccgggcuuuacagguuucaguaaugaugaaguaugugucuuuuauuaggauuacaaugucuacucagagguggaaaaaaagaaaccagacuguuguuugguucucgagacuaucaaaaaccauaugaaguaaaugaccuugccuucaagggaggggaaaggcaguaagugccccucugccgucuugacuggaacuguuacaaggcagaauauuuuaaugagaucacucguagcuauaucuucuuuuaggagagacuuuuugggguuacaugaagauauuuucaggauuggcacaauacaauagcagauauauacauaaugcaaucagaugauugaagugauuuuccuuccauaaugccaggugaauuaggucauuuuuucauuuagcacacacauuuuguaccugacuuuaacauaaacaaaagucgaaccuguuucuuggguuagugacuaugaacagaucgguuccuugguaacuguguuucauagucauuuagucugucuguuuucugcucuugcucuugggcaggcauccugcaggagccuucuccucaggaaggugggucuggcacacacagacuccaugggacucuagcggaucauguguucguaaaacaagaugcagacucuuaagagauucugcuuaagauuucugaccuugaaauggcauuagcaacuguuucagaggauuguggguuaaaggagacagaagagagccggcauguugucccacuugggugaggcccuggguuuaguccucccugucacaaagagacaaacaagagagcccugaggaaacuccaggugcugugggugcuucuuccggugggugcuguucuaugcauugcugaggcuggugugagucugauacccacaacaacagcugauaggaucaccucuuucaacucuucuuaagaaagaaagaaagagagagagagagagagagagagagagagagagagagagagagagagaaaggaaggaaggaaggaaggaaggaaggaaggaaggaaggaaggaaggaaggaaggaaggaagaaagagaaugagauaggucucauguaucacaggcuagucuccaagucacuuugaagaugaggguuuuuguuguucuuuugaaacagcuucucuguguagcccugguuguccuggaacuuguucuguagaccaagcuggcuucaaacucacagauccagcugccucugccuccgccucugccuccgccuccugagugcuaggacugauggcaugcaccacccugcccugcuaaagcaggauguccacagcauacauacauuuaaaaauaaugagccgggcggugguggcacacgccuuuaaucccagcacuugggaggcagaggcagguggauuucugaguucgaggccagccuggucuacagagugaguuccaggacagccagggcuauacagagaaacccugucucgaaaaaccaaaaauaaauaaauaaauaaguaaauaaaaauaaaaauaaugaaaacaaaaucuuauaaaaguauuuuaaguucuuuuagaaugucccauaugcaauacaaauuuuguuguuugaacaucuucagaaacauuccguaagaaaagcaguuuucauuuauguccucuuugaccgcuccagcuguuccuggcggggaaguugcuuucagaucuaauccauaugccugguccacacccuuccuuccuuucucugcucuggaagccugugugcgauugcucguggcuucccugaugcugucguguuuguggcugucacguaaagcagcugcuucuguuguuucuuagagcauucugcaguguuugcugcagcugcaaguaagcaugggugccuacuccuggcccauaacugggauucuagguugcgacuugcucugauagucccagaacaauaguuuccuucauaauaugugggcguacuuuuuauucuacuuugcaaauccacuuaauauuuaugcuaucaugagaguuucugcaccuaaaacucgcuugcucccaaaagucuucucuauaguccauaaagcaccuuucucuuuuggauucucucuccugcuugagagugaggaacacuggcaguguuuuacuugaauggcagcuacagaaauccuguaagagaacaaacucauccacagacuuggcgaaggucugugcuuaggcuauaguggacugacuggcuugccugcaggaucagacauggacagucuguugacucguccagaggugggcuuaacagcucucgggcaguguguucccucaagaugaauacuuaagcuugaaacuuuaggaaaaaagaaaaguaggcacagagaaguuacucaguuuuauuuguccgcuaaugucacagcucuucuccguuuucuguuuuuccucagccuguaucucugagugucugaugucucucuuauacacacauaccucuuccccagcguuagggaagaagucugaguuucacuuacuuaaaagaaacagcaaugaaacaaguugaaaaucaaugaucuggcugcaguugcgugaggugcagcuugaugaguggagcggguggaaauguaguuguguguggaguaauuugaaucccccacuuuuaugacagcucuaaaauuaguugcagcguuuguccccacacuggcagagugcacuccuuuugacaaaagcuccaugagugagauuaucucuucuugggagaaacucgugagagcagaaauagccaagccccacccugcagugggugacgguuccccuuccuguucucagcaagugaaaacuugagccgucuuaaucaugguagggagugcgguagccgcauucccugcagguuguggcacggagugacacacaaucgcuccccaagaagcugcacuggguucaucuagaagggcggguggggguccucugcaauuuucuuuccuagguuguagacauuaguaugagaacacacaucaucuaaugauaccauuguaauccaaaauugaaaaacgugaagguauuuuuuguuuguuuguuuguuuuggcuuuuugagauagaguuuaguuguguaucucuggcuguccuggaacucacucuguagaccaggcuggccucuaacucagaaauccgccugccucugccucucugccucugccucucugccucucugccucucugccucucugccucucugccucucugccucucugccucucugccucucugccucucugccucucugccucucugccucucugccucucugccucucugccucucugccucucugccucucugccucucugccucucugccucucugccucugccucucugccucucugccucucugccucucugccucugccucccaagugcugggauuaaaggcgugcaccaccacuggccagcaacgugcagguuuuuauuacucagugacucuuggagaacuuaauguguuagugcagaugugucaugcagaugccacagugccuuggugguggugacuuuaacuuguacuuuucuugccuuuuuuuuuaacagcuuguuuugaaaauaaaugauacauuugaaucuaagagagggaagaagaggguaaaguuacagccuuacacuggaaaggaagcccccuccucaaaagguaagcauggucugugcuuucaguuuguagccgucagugucaguguuagccuccuacugcugggaccagcguauccucuaggaacaauuagcgaugggaagauuuguuuaggcucaugguuucaguccuuucgugguggcgggagcuugugcaggcuaggaaaccgggggacaccaggggugggguuauagccuguggcuguccguuaggccccuccugcuaaagcucuccagaaccuugccagcagcugcagaacaagcauucagaucacgagccucuggggacaucuuggauugaaacccuaacagcacaugaagggagcauuguuacaugacucagcguuugaucagacagaguucuaguuggcccagcacuccccauguaucgcaggcuggcccugagccauguaucgcaggcuggcccugagccauguaucgcaggcuggcccugagcuugggaugagccuucugcuugaggcuuccagcaacagucaucgcauucaaaccaagugcuucccgggccauuuucaauuccuucuuacugaccucaaaguaagaacauuaugcgaguggauaaguaaaacaguuauaagcaaugaggcuacauuucuuagaguaaugauuuugucauuccacuuugaucucuuguuuguuccucuuuugagauuggaucaugaucuguagcccaggcuggagcuugaaguccuucuuucugccucggggucucaggugcugcagugcagccauacaccagcauggucagcagacaugcaguacccaacugaaugacugccauucaaacuaauaacagucuaaacuugguaacuucuuuugcauacagcauucugaguagauuaucuuuuuaugcuuaugagauuuuaguaaaauuugacucuucagauaaauuucguguguugagauguagcucuguguugaccacgcuguccuuaaacugaggcuugaacaaccaaugcguguggccucuaggacuucagguacaccauaccuacugaagacaagguccugaggaaucagauuuggcuuuuuaaaaaaauuauaucauuggaaaaaaauuucuucaguagcuugaauugcuaacuucuagcacccaaaccaaacagacugacagucccuagaccuccauggaaccuggagaaaguuagcauucauucccccagcuucugugugaggcgcuccugacugucagcagagcacacugcucuggcucucauuucucaugcuucugucuguacgucagcacugccugauggaccuggagaauugugugugcccacucugcacuuaagccgugcgcucaccuccaaccuggacauuucuuaacuuccagucucgguuacaaaacgacacugccuuucuucaacucuguuauaauugcauguguugaaaucaaaagagagacagcccagggcuuuuccuaccccugcagguucucggugccucguucucuggcccuguaacgcacacucugauggcugcaagucagcaagucuuuaagcgaccuuugacaagaccucuggcacuugaguugcgcuuucuucccuuuggcuuucuuucuauaaacuucacaagcucacaagaauacuugauucuaaggauaauacuuuuuuguaaagauuuuauuuuuaagcuggacaugguaagguacgccuuuaaucccaggcagaggcagguagaucucugugaauuugaagccagccuggucuacuuaaugaguuccaggacagucagggcuacauagugagacccugucucaagucaacaaagccgacuuuauuuuuagcuaugugccuauauguguggcauauauguuucggguucccaaagagacugaagugguguaagcgcuguggagcuggaggugcagguggucgucagucaccugacgugggugcuuggaaccaaacucagguucuuuaaagagcaggaagcacucauaaccaccucgccauccuuuagccccugaugacuuuuucuguuuaagucauuuuacauuauucagacuuauucuguguuuuucuuuuuaaaagacuuaguucauccucaaaacccuuucaguaucagcacagagaguucuacuucacuucacgguguagaaauggaggucacuguggcuggccgagcugcucauucugcccccagcaccuccaucuuuaaaaaucuaagugguggacauuuuggauguuucuaacauacuuaaccuauggagauaaacugucuguaaauacacacacacucacacacacacacacacacacacacacacacacucacacacacacucacacacagacucacacacagucacacacacacacacacacacacacacgcgcgcgcacacacacacacacacacacacacacacacaaauaauauugcaguguucauuuuugugcuuccuuaguguguuguauuuguaaacuaaguuccuuguaguaggcucacuugaccaaagacuauuuggacuuaaaacuauucuagcagcugaggcaggaggauuaugcaaacucagggccacccugaguuaccuagugaguuccaggacagccugagcuacagagacucugucuuaaaaaacuaaaauaaaacauuuuuauagcuguugucccacaaauggcugguaguagccuguuucuacaaaaaacaugaauauacuuuuccauaguuuucaucaaguugauuaaugaaacaauuuuuguuaagguuaaaauguauuaauuaucuuauuuuuugcuuuaacuuauuuauuuuaaaaguuuucacauuuaucaauaauuuauaaaucucuuuugugaauugccuauucauagccauuuaccacuuuuucuggcaugugaucuuuuucuuauguguguguauguacacauguacauguuuguggugugugugugaacauuagugcacauauguguggaguucagagaccagucuuagcugguccagccuaccuuguuuuccgagacaguuucugacuguccuagcacucacugaguaagcugugcugucuggcuggugagucccuuuagugggauuauaaacacaugccaugguagcuggcuuuugauauggauucuggggaggagacccaggucccccucauguuugugcuguaagaacuugaugaauugagcuauuuuccuagaccacgugcccuucucucaucugauuuguaguagcuauuugaauauuaggaaacuuaguuuugagccagacaggguggcaagcuuuuaaucccagcacuuggaaggcagaggcaggcagaucucugugaguuugaggccagaauggucuacauagugaacgaagauaccuuggcucaaaaaaccagaagaagaaaggaauuuagcuuuaagcugcugagcaugguggcccgugucugcaaucccagcauuuggaaggcugaggcaggaggaauaccccaaguuugaguccaggcugugcuauauaaugaaguuccauguuagcuugggcuauuauagaaugagaacuugucuuuaaaagcacaaaaaauuuuugguuucuucaguaaacagacuucuuuucccaauuuauuuuucaucuuuuuaauuuacaacuaaacucuuuuuuuuaaaaauggaagccaggugguaguggcacaugucuuuuuuuuaaaaaagauuuauuuauuauuauacauaaguacacuguaguugucuucagacacaugagaagagggcaucagaucucauuauggaugguugugagccaccacgugguugcugggauuugaacucaugaccuucggaagagcagucagugcucuuaccugcugagccaucucaccagcccuaaacucuuuuuuuaauuagauagaaaauuucauuuuuuucucucuugcuuuugaagcaggucauguaggccagguuaucuuaaaacccacucuguauacgugaagcuggcauuaaaccccugauccuccaugucagccucucauggccuagguuucagguguggccaccaggccugacugaauuucaaaaugcuauauaaucaaauuuauacguguuuuaaauuuacaaauauuaggcucugauuuucuugauacauuuaaagauuuuucuuuucuuuugcaguuucuaguuugauuuaauuuuuuuagauuuauucuagaauuuucuaaaaagacugaauuauaucuuauuuacucauuggguugugggugguggugcauugguggugugguguggauuuggacguuagaggacaauugagagcaaacagugauccacaugguccugggauuuagcucaccagccuuugucuuuuuuugagaaugagccucacuauacauaaggaagagcuccuugccuggccuggaacucuguguagaccugguugaccugguugaucccaggugcuggggucaagggcgugaaccuuuguacccagugaaguguuuaauugacuuauuuaaaaucccauuagagggucugucuacacacacucuacagaagggcagugcucuuccugaguccuucagucccuugccauuuuuaaaaauauuuuuuauuuguuaucuuuuggcaaauuauaucuuuagaauuaugguauagaauacuucauugguagccaggguacaaagccccuauguuuaaugguuuguacacacacacagacacacacacacacaccccaacacucccuugugaagaguguagccccugucuucagaguugacaagcuugagguguguguggggggguggggugucacugugguggcaggugguggaguugucaucugcccucuccuucccaggcugugaaccaggucucuguguagcucuccuguguggcgcccaccugucaguagccaggcaggcagcuucccugggucacagugcuucuguucaggccucccuuuggucgcagcuuacugcaucauacagagccugcuccauucccucacuucaugucaagacauaccuguuggucccaaaucaccccaguacacugucaaaguaugggaagagagagucgcggucacagaacucucauuuggguuguguuauaacugcuguauuuugaccuaaguuacuaauaucuuacuaugguuaauuuauaaauaaucucacacacucacacuuagagcaaaaauggaaacuucaucuugaauguaggauucagugcuguguuucagaucccgcagagcuguucuuuuucaacugcucugcuaauuugaccuuugcuaacuccaccuccaucccucuuggggguugggggggcugacuguggcaguuucccauuguucucauccuccugcuucccacuaggagacaauaccaacggaagcucuccucucuucccuuuuuccaggugaaaccagugggaacgagagcgaugccgaguaccugccaaagagugagugagucagcaagcugcucccuucgugauccugggcggguggagcagcgccugccuuugugauuuaagagugguuuuccccaugggaguucacgguguaggccauugcuucauucucagacccuguugagauuugcggagcuaaacaguacauucagcuguuugacaacaugacaaaucuccccuaguagagugagguaaaccaggaugguucugaggacgaguucuggagggcgcaggccggcaccacauguccgggcgugugcacaugccagaagagugugugaaugauccgcauuggcaagcacuuagccugacauggcugauuucucucuaguaacucaggcgcaauuauuaagugcauuuuccaucugucguuaagaaaugagauagauauuuacauagcgcuacuucuguuccaggcuauagggcuccuguuagguacagaaucuucgcauuucuggcucuuguuuguacaagcccuuaaugugcucugcaucuucaugagacaaauugucauagcagguuucguuuuguuucuuguuuaauuggcugacgcacagcaccacaaagagcagucacaagguaucaaagccgggccagcucugacacccugaucucaugaguaacagccuugugcuccccgauggccuaaucugcuccagguguuagauuuuguagccugacuaaagaugaaacuaggagcaucgucaugggcuucagcauugauguggaaggaugacuaauuuauugcaguugcuaaugagaagcagaaaccgaugugucuugacuugaacucagcccuuuggagggucagcacacuuuuuccuagaacauccaguaaacugggugguuucuagggaaccauuccugguuguauguuuaaagaguucuuaauauuugauccacaacguaacauauuuaguggcaaaagccauuguaccuggcgagggggguaacagucucgguguggcugaaagccaucguaccuggcgaggggguaacaacgucggcgugguugugauggcuauucauucuucugaugcugaacauucuuucacauacuuuugccaugcagaguucuuggcuugacagugucuguucggucugucgccugcuugcugauugagcuguuguccguucuguucuccuguguucuaggaaucgcucuccugucagauggguguacggcggagguuccuuccucuuccuaccucucuccacuuuuccauaagcuuucuaauguccuucggucccuuuagccguucuugcucuuacuuuugagcuauccauguucuauucaaaagucauuaucugggcuggcgagauggcuuagagcauaagagcacugacugcucuucuaaagguccugaguucaaauuucagcaaccacaagguggcucacaaccaucuauaauucgauuugaugcccucuucuggucugucugaaaauagcuacaguguacucacacaaaauaaauaaaucuuaaaaaaaaauaaauaaaaagaacuaggaaguuucagcuucuggcuuuauugcuauuccagaggucuauaugcuuaguuuuuaaaaauuauuugagauuuguuuucuaucaaagugggcauaagugcaugcgaguacagguggccagaggugacaggucccccuggagcaccugacauggggcugggaaccaaacucaggccuucuggaagaacaguauaugcucuucaccacugagucaucucuccagcuguugugugucuuucuugaagaacugucauugguaaaagccacaccucuuauuagugaugugugccaaggaagaaagggaaaggauggcucuuuauugaaagguuacuuugguuuugguuugcccugccuguucuuagucucuguguaggacccuguuuuuguuuuuguuuuguuuuuuaagauuuacuuauuuauuauauguaaguacacuguuuucagacacaccagaagagggcauccaaucucauuacagauaguagugagucaccaugugguugcugggauuugaacucaggaccuccagaagagcagucaguacucuuaaccacugagccaucucuccagcccaacccuguucuuccauuggauccuucccuccuucgugcuuucacaacaucaccagaaagggccucuauggucagucuaguauuuuuuccuagauguuuuacacauguccuggugagggauauauauaauacauacauagagagugcacuacagauguccgauacaccaguuaggacauggaugugagucccagugcuuccuagagguggacuaggacuaggacuguugcucaugucuucucccaugucauagcccaaacagagauaucuguggagaagacacuuaucugcucaucugacaaaugaccacaaaugauucucccuuugagagccauggcuuuuggggcuagauaggaucaggguacaagggaaccugacgcuguggccucguuacagaucgccacaagcgcuuggcacagcugcagccguccuccaagaggaacccccacuaccagaccuuggagcgcgaccucauugagcuacaggagcagcagcucuuugaacucuucguggugguuucucugcagaagaagccggcaggguacacuccccaggucauacagcaguucccuagcaagguaggugcaagguggccaagcggcagccacaggcuccuguguacuccuuguucauuuccucuuaguuacugaugucucugccagcuuguaccaacacugagacaggaucuuacccagguucuccuugaaugggcaauccuccugcuucagcauccaagugcugggaacccccacgccagccuggcuguuguuaacacucuucuuuggucugcucugccugucucacaaaggcauuuguccguuuagucaguuauuacagcacugacuguccgcgggucugugcuugacccuccugggcucugggcacugugacccuaaauaaaacuuauagcaguucccagaccacacaugaaaggaaaaggguuuuuuuuuguuuguuuguuuuuguuuuugauuuuuuuuuuuugguugguugguugguuuugauuuguuuugauuuuagguuuucaagacaggguuucucuguguagcccuggcuguccuggaacucacucuguagaccaggcuggccucgaacucagaaauccgccugccucugccucccgagugcuggaauuaaaggcgugcgccaccacgcccggccaaagguuuuguuuuaaucuuuuacuuuugguauucuuuuuuagucuguuuuguugguuuaguuugggaguacuuuuuauuguccacguguuuuugagaugagagcuagucuccuucugucauaagguuucuagggauaagccuugccucaccaggcuuggcaguaaacauccgcaccugcugagccagcucacuggucccugaaguuauguuuuauuugauauuuaauuuuugucacucauugcacagaggaccgucucugugaacugugcguucagcagagggacccuuaagagcacucgcucaccugcuccacucuccguuuguuacuugcaccaaagcacuucuuaggguuguuuguuuguuuguuuguuuguuuugagacaaagcucuguuguauagcccagucuguccuagaacuuaguauguagcuuagacugacuuugugccucaacuucccauauacugggauuuuuagacaugagccucaauggucaaugauaccucuuauuuggaugacugcuuggucacuguagggcuggacucucuaacccugaauugcguguuucaccagagaugacgaaguacaacuguacuggggaucuaaaagacauuuccugcaaauggccuuaacacggccagguauggugacacgccuguaauccuggcacuuaggaggcagaggcaggaacaucaaaaguuugaggccagccugggcuacauggaaagacuguguuucuaagaagaaccaggagagaaggggaccuuagcaacauccccauagugaauaacucuacaagucagagugcucauaaaguucuucaguuuacacaggagugcaugucucagcaauucgcagucagauaacacuauuguaaucuaaagaaauauccuuugaguaaucacauuuccugccuggagagaacuuuuuucccuuuuaaacauuuuuacacuguaaucuagguuagacuucaacucccuguguaacucaggucagcccugaccucaugacccucugcuucagccuccccaguguuaggauuacagguaugugccaccaugugccaccauguccagcuuaggaagaccuucacauuccccuucccaagcuuuaauuaauuuuauagcaaagcugagccugaauuaauagauguuguaccagaggagcguauacuuacguggucagaugugucaagagugccuucagugggacuggaaguguggcacaaugguuaaaagcaacugcuguguuugcagaggaccaggguucaguucccagcacccaugucagguggcucacaaccacugguccuccaccacccaagaauccaaugcucuucucuggccuccgcagacaacugcacucauaugcacagccacacaggcauacacagaauuaaaaauaaaacaaaugcccccagguagauugcuugcuguuuuugugccccgggugcugucaguuggagggauggagagagccccguggagcccugucuggauuguuuguggaacaccugugaugacugugaacauaccgugucaccacuaacaaaauguguuaggugcuuuuuucacguguggugcugggcuugagcccacucgcuugcuaggcaggggcucugggagcugagcuuucagagcagaacuccauggcagagaauaugugcauuuuuuuaaaaagaauucaaaacuuugauuuauucucuuaaaagcuguaucccaaugagauuucugugcugcuuuuuauagauaguucuacucauuucuuuucauguccuuucauuuaacugaauuuagacugccuuuugaaguacaguaucacuuuuuuguuguuuugaaacagggucuugugcaucccaggcucacguugagcuuucucuguagccaagguuagcccugaauuccuaauucuccugcuuccaccuccgaaaaccugggcuauagguggacagcaccagaucagacucauaccacacuuuuguaagagucuucugugcugaaaauuuacaggaagucacaacccuauaauuagguagcaaagcuaagggaaugauuauauacagggcaacauuuaaaaauaguaccucuaaauaacauuuaucugccuuuucuaaacaucucugauuauuaaucagauaaugauuucagcuggcuagguuuuugcuguauaauagaagggauuuuuauuuaucuuaaauuccaugauucauaaaacaccggccucccaccaggcugagaacugaguccagcugcucuucuggaugagaaacuucagcacucucugccuuacccuggguuauggggucuucgcuggcucagucugcucgugggguucuuuauucuuagggugcugucaguccucuguauuguaaagcagcgcaagugucccugagagaaacucucucgggcugcgccaggaccaggcugaggcuuguuagcuucugcucuccguuuucauagguugauguucugugcugcucucucucagggugaccauggcuacaagcaguccaaagacacugaggaaaggcucaaagucauccccagguuuuguuuuccugauucagaggacagcgcaccaaccuuagaacucaagagguaagucagcuccugauggccguuugcuggaacuguguacagaguccaucucugacaaacggguagagucaggagcagggagccacaugagugaccacugcagagcaagcuucauuggggcuggggaggaauuagagcucaggaaagaaaagcauugauuucaguguaaggagaagcaaauuugcgaauacccuuaguuuaccaauccuucaaaauggguccacaucaccuucaguuagauaauggcccaaaauaacuggguuaaaccuagaaacagugaagcagaacaauuguaguugucguauuucuccuuuaaguugucagaaaaagccacagcccagauucuguguuccuguguaggguguuucuuugugggucuuguacagagggagaccucagccuaauagauguggguaacugaagcauuaaaggauuuugugggacgggggaauggcccaguaguuaagaacaaguacuucugcagaggaccugcgugugggucccaggaccuuugguccagugccucagagcugucuguacuaccagguucaggaggauuccaugccucugcucuguacucacauguacacagaggguugacaugcaugcuccuguguggaggacaaaggacaacauugugucaguuuuugccucugucuuguuugagacaggguuucuugucuccacuguuuaugucaagcuagcuggccuuaaucccccuuuuggcgauucucuugucugccucccaucucacuguagggagcuaagauuacagauguuguugcaugcagcuugguauagaccugcaggucuguauccaggucuuacuagugugccaagcacuuuauccaaugagccaucuucccagcccaggauauggucuuuucuaucacuguuccauauggccucagaaccaaaccgaagaauuugcaagggagaaaaugacauuaucaagacccuuuacagcuugcuuaccuguauguuuggcuaaauuacauguucaacaaaagggaaacaggauugauuaguagcuaaugagcguaaauaagaaaagggggagagcaauaccaacagcuugugccauacucacucacuuaccaggacaaggccgggcccucugcaggugaauaugacuugagaucaauggcuauuucuguugccuccuagaucacaaaugucuccuuuuacuuguucagugaaugccuuaagcagcuguguuucauuuuguuuucagugaaaccuucuccuucgugcugacuggagaagauggaagccggugguuuggcuacuguaagaagcuuuuggugaguuccagauuggugccacaaaguugguuaaggaacaagaaagaccagcuagcaacuugagaagaacugucccuacaugacuuuaaggguuccuuaauuauuugcacaaccaagaagcuccauuagggcuagacauggcuuggugguuggucuuccagagggcccagcuuccacucccagcagccaugggaaggguggcucaguuaugaauauagaacuccagucccaggggaucuggugcccucuucuggcaugucacaggcacugcacacacaggaacauacaugcagacaaaacaccuguacacaucaaacaaaaguaaaguuuuuaaaaaagaaauuaugguagcuuuacauaguaagagcaaggugaaggucagccauagaaugauccagaauagaaaggcugaggguuucacuggcuuguuccuuugcaguagagaaaguaaccuagagauugaauguuugaagaauacuguccagagagguggcgggagaagccagguuccucguccucuaucuuaggucuugucuuuugcuuggucacuaagccugggggagucaugcuuuccuccugaguacuccccacccuuuacugucacucaggacgacagguucagcuccugcacugacaauaggaaaagaagccuaugcacacucauagucugucgacuucagugucuggggcaagugucagccaccagaggaggggucuauuaaauaaauauuaacaguuaaaauuagugaacccuugcucugcuuguuuuguguguuugcagccagaaggcaggggaaagcggcucccugagguguacugcaugguuagucgcuugggcugcuucaaucuuuucucaaaggugagugaagcgaguaucugugggagagugauggcccucuaggucugaggccguuuuauugcugccggcuucacuggagaguacugaguggcacagacuuuaauguacuacuugaaaaguacccucugaugggugaagagccacaggcucagacucucacgauggcucagcagguaaaggaacucugcaucaaggcugauggccugagcuugacuccuggaacccacaugcuggagggaaagaagcaaccuguccucucccuacaugugugcugugacaugugugucccucuccuaacacaguuaacagugcaagaauaauaacccauaggcuugaaggcuuaaacugaccagauuccuccauaaugguuuuaguuugcaaaaaugccugggucuggugcucucucccccucucccucucccccucccccucccucucccucucucucucccucucucucccucucuuucucucucuuccucucucucucucucccucucucccucucucuuucauucuuucuuucuuccuccaccuuucaagacaggguuucacuguguaaaaggguuucccagcuaucccagaccuugcuuuguagaccaggcuggcuucacacucacagaguuccuucugcuucugugagggcuggcauuaaaggugugcacucggucaccagcuuggguuuuuucuucuaaagauuuauguuuauuuugugcgccugguguuuugauugcacgcaugucuguauacaacauguauacauggugcccauggggccagaagguaucagauccccugagaguggaguuuagcugguugugagcuaccaugugaguguugggaacugacccagguucacaggaguaacaagugcucuuaaccacggagccaacucuccagucccccaaacucauaguucuaaaaaucauauccugaaguauaucuuaccuugcuuuucucuagacccaguuuacaggauaucauugucacuguuauucuuugccuguuagugaaauaaaaauggucucuagaagcugcugagauggcuacccgguaaaggcacuugcuaccaagcccaaaaaccugaguccaaucccaggaccuacacagugaaaagggaacagcuaacuccuacaaguuaucuucuggcuuccacacuuaagcuauggcaugccauaccuacacacacacacacacacacacucgcacacacacauauacacccacaaucaauaaguguaauaaaauuauuuuuuuuaaaagaaaaaauaguuucuaaauaaguugacuuacauaauuuugggguguccucaggauauguauccuugagcuuucagagucgcagagccugucugucugucuguuuugacucuacugcuguaauuuaucuauaggaggauuucuuuguuucuggucugaggccuuaauaaacugugggguguguuuguuggucugugugcaugcacauaugcagauccuggaugaaguagagaagaggagagagaugucuccagcccuuguguacccauucaugcgaagugucauggaagccccuuucccagcuccuggccgcaccaucacaguuaagagcuaccucccuggggcuggagaugagguaaguaaauucauccccugaaguagccacuucaaagccagccuugcagcgacugguacaguugccaggagcuuguucauggaggaauuguuuuuaccuugcaagggaauggguguuacuuccuagaaacacugagugaauaugugagguaguuaguugauccucggccccagguuuccuaccuuacauagauugggucccucucuaguggcagucucaacaugauaaaucucacacacacacacacacacacacacacacacacacacacacacacacguauauauauauguauuuaucaaaugaaauuauuuuuaccagaacuuaacagcagcuucauaaacccuuugugccacaccucccccugaucaccacacgguaucacuuguugcccuagcuguccuagaacucucuguaguccaggcuggacucgaucucagagauccaccugccugugccucuugaguacuaggauuuaaugaauuagaagugcgccacccuacccuaccuggcccaaaguaacagacguuuucagacuagagaaagagcaagauggucgguuaaugcugccguuugaggguaagguccagcaucagcucuuggauuucccuugucuuucagucaauugaacucugccgaccacucgauucacgccuggaacauguggacuuugaaugccuuuucaaaugcuugagugugcgucaucucauccgggucugugccucucuccuucucgagcggaggguaaucuuuguugcuaacagcuuaagguaagaaauaaguggaauguuuuucaugcugguguuuggcuugcuuuuauuuuauuuuuuauacaaugcaaauauauuuaaaauaucuagaccuagggcuagagaccugacucacuaauugcaguacuuguucuugcaaagaacccagauucgguuuccaagacccaaaaggagaagaaagaaauugaaaggcuucuguacaaaaucacaaagauagcuggguauggugguaacaccuuuaacaccuugaacacuuagguagcaggaguagucagaucuugaguuugagaccagccaaaccuacacagugaagcucuauaucaaaacaaacaaaaaaaccaaccaacaaaacagaaaaccaaaggcauuucuagcuuuuguuucauacuguguuaucaucuacccaggaggccugaggcacaagaaucauugagccuaggaguucaaggacagccugggguugccccccaaaucuuuuaaaaguaccaguauuguuuuucaugcacacaucuuuuuuuuagcauaauaaauuauagugaaccagacugagaugacuguuaaaaugacuacguauucacagaauugcugaucugugaaggccagugcggucacuguguaguucuuugauguaauaucugaaacucauucuguguguugcuuuaccugugacaucaugugcuuucuccugucuagcacccuuucaaaaugcggccaugcugugguagcuacacuguauccguucaccuggcagcacaccuacaucccagugcugccaguguccaugauugacauagugugcucaccuacuccguucuuuaucgggaucuugucuuguuccuuaccccaccuccaggaccuuccgauugaggagguaagauggaguaaauugugccuauggggaacacuagaguauuggcaacggaaucaaaugaucuuuuaagagggguagaauuguuauuaaucuaguaauuuuaucagcuucagaaauggcucaucaguuaagaccucuuuuuuguuguuguuguuguuguuauuaaagauuuauuuauuuuauuuuauccaugaguauacuaccauugcucucuucagacacaccagaagagggcaccagaccccauuacuuaugguugugagccaucaugugguugcugggaauugaacucaggaccucuggaagagcaguuagugugcucuuaauugcugagccaucucuccagcccccuguuaagaccucuuauucuugcaaaggacuaagauucaauucccagcaccuacauggcaauucacaaccaucuauaacuccaauuccagaugcacauggcacacagucacacaugugagcauagcacucauacuuagaaauaaaauaaauaaaucagaacauuuuaagaauauaauaauuagcugaacaugguggcccaugccuuuaauuccagcacuugggaggcagaggcaggcagauuucugaguucgaggccagccuggucuacaaagugaguuccaggacagccagggcuacacagagaaucccugucucgaaaaaccaaaaaaaaaaaaaaaaaaaaaaaaagaauauaauaauuuacaacuuauuuauuauaacgaaaacaauuccaugguacauuugcaucuaacacuccuugcaguagugagaauggacucaucuguuuauaaaaaaguuuuuuuuaaaaaauuuuuguauucuuugugaauuucauaccauacaauccaaucccagucauauuccuaucccuuuguaucugcccuugcaaccucccccuaacaaaauaaaauaaaauaaaauaaaauagaauuuuaaaaagucuuauccugggagcugguagugugugacgguguguccuacaguauacccuuuguccacacaucuucacuugcaaauguucacuguagugagucauuggucuguuuuaaggucucuggcuucugcugguuuuuucuaagcuggguauugaugccuuuagucccagcacucagaaggcagaggcagguggaucucugaguggaucucugaguucaaagccagccugguuacagagcaaguuccaggacagccaggacuauacagagaaacccuguuucaaaaaguagcaguugcaauuugugugugugugugugugugugugugugugugugugugugugugugugugugugugucugugaugugaauagaguaccguggcacacauggaggucaggggacaauuuggugggucaguuuucucuuucacuuuaaugugggcaacagggguagagugcaggccacccagacugaucuugccuuguuuucuuuuuuaaaaccaacacaaaauuucucuggauuuacuaaaaaaaaaaguugcuucaaauauagcagauguguagauaagugccuuaaacagagugcaucucagugaaguauuauuacaaagugaguacuuaagugacucagcaugggauuguaaugggacauaacagcaaaagauucaagucuccuaaucucguggucccuuccccaugccccagaaaaggaauccacuguauuguaucuuguaguacucaccuguguugggguaaauauuuaauccagggauucuacuccaccuuagaucauuuacuucccaaauaaaagacacaaaaccuuuauauuuauaagccuuacagcauuagagcugggcagauaucaacucucuaugcuauuuuauuuacuucccugucaguaacccagagauaacacuugccuuggucugccugggccacuccuacuucaacuggcccgcccucauggccauguucucacgauccacccaccccauggccuccucucucuucccuccccaagccugguaacugaagcucuuccuaccuuucuguccaacuguaggcuguaggcaucucuauucaaccaguaguuuuaaauuaaggagccagguuacauaguaucacuuggugugugugagaauuuccuuaucccuaggggcaaccagaccccagaggccaguauugagcauuacaauacaucacaacagaucaaauuucgacaaaucuguuuguauuucuuuauaauuguaucuccaaauaugugugguggcucagcagguaaaugugcuuacacuaagaccugacaaccugaguuccagccaaagguggaaggagaaaacggacuucugcaaguuguccucuguacaccauggcaugccagggcuuuguguaucacauacacauaaacacacacacacacacagaaggggggggagagagagagagagagagagagagagaugcuaguaacauuuuaaauaucuagcauucuuggcuuugaagcuugguauagaaggggaguguaucacgucuuuaauuugaguaaauuaaauagaauuuuuuccuucagcuuguauaguuuggccucccccggcuggugaccguggagcugugugcucacuguagucucauugguauuccuagauauugaccauuggauauccucuauuauaaauuaguuucuauccccuggauuauuuauccucuaugauuucuaagauguccuuguuuuuauuguuuauuuuguuugaugguucuggggaugaaacccaggccucauaguugagcuucagcucaacccaguuuucuuauauucuagaaaucagccucuugguuuguuuauuuuauuuuauuuuggagagggucucaggaagcucgggcugaccucacacucacucuguagcaugagcuccagucucugauuaugugacucuguccuaguucugagggugcaggcguuaggaagcacccugguguauucagugggaaggaucacacuccgggcucugcgugcaaggcaagcacucugcugacugggcuacagugccaccccugagauuuuguuuuccaaaacaaugaucugaguuuguuuucugggguguauguuuuguuggauuuuggggugaagggcaugauaucuucaggaccucacuauauccaggcugggcuggaacuuggaaggcauccugucauggaguccagacugcggcuguuuuaucuugcaccacuauacccaaccagaaugacuuuuuuuuuuuuuuugaaugaaggggaguucauuuugaugugguuaagaugccagucuuuucauuuaugacugauguuuucaugagcagcuuaaauuucacauuaacuuagugaagaggaagauucccuccucuguuaucucccuauuaguuugcuugugagauuuugucucuaacuccaccuugugcuucauucguuuguaaauagugugguguagcgaugacuuggggauuucccaucucuggagcgacccaccucuucaguaucgcuagcugaaaaggccguucuuccccauuucaccacaccgacuccguaaaucccuguaauauguauugugcacaucuuuuucuuuuuaaaauucauuaguuguuuugauggauuaacuuuuaaauuggcugcaauguuaaguuaauuuuguuugaaacuauucccauggccugaaagaaucaaaaggcccauccugaucuggcagcgccuggucuaucugugagcgucucugguuuaaccugccugccuccuuuauuucauaggugcugauaguugaucucugugcagacagguuccuacaggaggugagugacaaaggagaugguuacauaauguuuggggacacaggugucucuguaggcaaucacaauuagacagaaaauacgugaaaguacuuagagaguaugacucagaaagaacuugcaggucauacucaucucugaguugacacugcagcuaaccauacaagauuguccugaaacuuuuggcuugaguguauagguguccaucccaaaggaggaaggaggaaacagcauaaaugccaugccauucucaaaagaaguaaccaucccuucaccuccagagggguuggauuuaagccucuaaguuaguaaaauauacuggacugagaagcagcucaguguuagaguacccaucuggauacauaagcucccauguccaacucagcaccgagagagagagagagagagagagagagagagagagagagagagagagagagagagagagagagacugagacuuacuaacuugucuauuuguacauucucaggcaguuagaaucugaagaugaguaagacagaaagacagagucuaauagauaagggcaggagacauuuccaugaugcuuuagagaugguauaauagcaaucugaacgaggaauacuggcguggaaagaggugguccuauccaguggaugcucaggggaaagggagacagggagcagugagucucaacacagcucaguuugagcguggagccuggaccccuccucucucgaggaucacuugcuugcucacguuuagucgccauuuguuggggacuaaccuuggaggcaaggagugaaacuuauagaugagagauuuuguagaaaagccccagagaauuuuauaagauguugcuugauuuuaaaaaguaaaguuaaaauacacuguaaacaucaugcauuuuggcucuauguaggagauggaauuucuuuuuuuuuuaagauuuauuuuauguauaugaguacacuguagcuguacagaugguugugagccuucaugugguuguugggaauugaauuuuuaggaccucugcucccucuggucaacccugcucgcucuggucggccccucucauuccagucaacucuacucgcucagucccugcuugcuccagcccaaaaauguauuuuuuauuauuauacauaaguacacuguagcugacuucagaugcaccagaagagggcaucagaucucauuacagguaauugugagcaaccaugugguugcuggaacuugaacucaggaccuuuggaagagcagucagugcucuuacccccugagccaucucaccagccccuggugacagaauuucaaaugacuguucaggcagaauauucagaacgccgccucugauggcgguuguagauuguacuugucugacacucucauaaggcucaugcagaguugcuucucucucaggugucugaugaggaugaaauucugccaccuaaacuucaagcagccuuggugcagauuuuagaagaucgagaugaagucuuggcucaggaacagcaguuuucacaagguaugggcugaggacuaaagauuaaagcagugaacacucacugaagacccagcauucaguuaaagaaugugccaaaguagugcaccuugaaaauucacacccuuucuuaccaguccccaaaguauuagccccgcuucuaucgcaugaccuuugaaaauuacauuuauagaaugcuuucuuccuauaggucugucucauaugucauuuuuucuucgaauuaguccuguccuguaaaaaaaacaaaaaaacaaaaaaaaaaaacaaaacuucuucaccaguacuagcuuguuucuuccccuccccuccucauggaucuuauaaaguaugugucauuggcauagugacacgcacuuuggaggcugagucugggucucuaugaguuccaggccagccugauuuacacagugaguuccaggccgacaaaggcuacauaauaagaccuugucucaaaaaaggaaaacaagagccagguagugguggcgcacacuuuuaaucccagcacuugggaggcagaggcaagcagauuuaugaguucgaggccaaucuggucuauagagugagguccaggacagccagggcuauaccgagaaacccuagcucgaaaaacaacaacaaaaaaaaaaaaaaacaaaaaaacaaaaaaaaccaagaaaaagcaguguccuuauggacguuucggacggggaaguaagguugucuacugauuggaacagaguuagugcagugagaaagccugguucugaggcaggguguaauaacaagccuuuaaucccagcagagacugacacagguggaucuacauagugaguucuaggccaggcuagagagagcucaucguaaaccaccccucucaacccccgggcaacugaaguguugccaggcacaggcacagacacucacuccugcagucucagcacuuggaaggugguaaagggucugaaguuugagaccacaccagaccagccuggugacagaaagagcugagagaaagaggugcauauuggaguaaaaauguuuggacagacaagaagcuagggagcaauggaaguauuucugauuauuaucuuucaaagaacgcuugguguagugccaaugcacuuaauacucaaaaaauguuuacugcaguaaaucacagugcagcaugaggugagaagaucaagaagugauuuguagagaaauauacuacauuuguguuuugacaucuuauuuuaauuggcucauagccuaccaaguuuuguguguuuucugauauggugacuuuuagaagaaugaaauuuaugcacuuuauaaaugaugcaauuuauaaugggacagccaagugaugacagucauagacagccugagaacagacagggugaagugccggucuggagaguuugacuuggacugcagagccagcucugucgaugcagguuggccuuguuugugcugccucuucugcacacacaggaucucaggcagcccaaaccagcccagaguucacuguagggcugaagaugaucuuggacuucugauucuccugccucugacuccugaguacuaagacgacaggugugagccaccacacaugacuggcaguugacuuuuuaaggugcagaguagaauguugaagagaagugguuaaaggacgacacucgggaggaugaagagaaagagagaaccaguagaagauugagggaggaaaaugaaggucaggacagaagccauuugcuucuugcaugccaugggcuguguagcaagcuaggaaugcgcauuccuaauccguccuccaguuuuucaugacucuuuagacauggcuuccacauggcuuccacgugucaggauuccuccauauauguggcuuccacgugucaguguuccuccauacacaaaacuaagauuuucccucuuauuucuuuccuuuugaaacagaggugacacucaguucucuggugucggaagcguucgucagguuuuuuguggagcucguggggcauuauucucugaacaugacugucacagagcguggggagcguguguuccaaagggagccauuccggaagucccacacuucccgaaguguccgccacuuccuagaucucuucauggagacacagauguuugcaggauuuguccaggaccgggagcuucggcaaagcggaguuaaaggugggcuuuccaggaaccgcugccuccuuaucagcugucuuagucaggguucugucacugcacaggcaccaugaccacagcagcucuuauaaaggaaagcagugaauuggggcuggcuuacaguuuggcuuuaguucaugaucacuguggcgggaaacaugguggcgugcagguggacauggugcuggagcagcugaggcaucuauaucuggaucagcaggcagcaggaagagacugagacacacuuccuccaacaaacccacaucuauuccagcaaggccacaucuaauagugccacucgaugugacccugugugugccauuuuuuuuccaaacacuacauuuggugaauucuuagaaggauugaauaauagauaagauguguagacuaucaaggcauaucugaguuacugugggauuaucuguaauaguauuuaauuuaagaauaauauacuauaguaggaacaggauuagggauacagaaauggaucaucaguugaaggugcuugcuagcaaccuugacaaucugagcucuauuccugggcucagugaugggaggagagaacagacacccacagguuguccucugacaucuacauguauguuguggcaugcacaugccuaccccacauacauacauaaaagcaugaacacauacaaaguuaaguaaacagcuaaaauaagaucauuaaagaaaagacucaucuuaggcuugggguuuagcucaguaguaaagaaccuaccucgcauguacaaagaucagagcuugcccacaacacugccaaaaagagaaagaaaaguguguuaggauuuuccugcugugaagagacaccaugaccaaggcaagucuuauaaaggacaacauuuaauugggcuggcuuacagguucaguucauuaucaucaaaaguaggagcauggcagcauccaggcaggcaugagagaggcagaacugagauuucuacaucuucaucugaaggcugcuaguggaagacugacuuccagacagcuagguugagggucuuaaagcccacacccacagugacacaccuacucuaacaaguccacucccugagccaagcauauacaaaccaucacaaaaaggaaagguuuaauuuaacuguuuuccaggcuggcauguugaacagucucacugaugucuucuucguagguuuguuugaaguccgggcucuucaauauuuggaaacaauuccugagucggaacccagcggggugaauagaauuuuacguagucuuggugagucgcuuugcccuauuggaugauuaaccuugugguauaaguccccgagucaugaccaugaagccucucuagguuguacucuuuggggauacauuuuaaaaaguaguucuauuuaccagaaaauaauguauuuauauauacagauaaauuuugcauauaauucuaggguguccauggacuucagacuuaaaauccuugggggcugggaagcagaagaggauugccucggccuuauucugcauuucauaaacauggguccuucugauuuuuaaauucuggacugaugugaggacaguggugugccugucacaagacaauugccuuaaacucugggcuuuggaauguaugcuccugauuagacccuguccuuaacuagcugagagaccgugggcauuuaugccgcaggcugugauuucauccacaccuuggguuagauuagaucagaugauaaucuuuagggacuuuagagaggucucuuuugagcauuuagaauucucuagggagugagccagguaauuugaaacuucaguccaauugaaaaccacuugaguuagauuaugucuugaguucuuucccgccucuacaauuagacauucaugggguuuuuuuaguggcuaaacccaucaacuaauagcuuuccauuaguggaacagaaagccuaaaguaauaaaagugaggcacuagagcagugguucuaagccugagggucaugaccccuuugcaaaccucuguuuccaaaauauuuacagcucauggcaguagcaaaauuacaguucugaaguagcagaaaugauuuucugguuagaaggucaccacagcauacauggucucugcguugggaagguugggacucuguucuggaggcugacuuaggcuccuagugugggggguuucagcccacggcugauugguccugaugcuuuggggccugcagcaagacacagguagaagagccugcuuguguuuuggcugcuaggaagcagagcaaagaagggaccaaguaucuggaaggcacucauggccaggucuucucccuccagggcccaccuuuuuaagguuccauuacuuuccaguggugccacaagcuagggaccaagcucuuacacauaggacuuuggaagacacuuauucagaagugacacugagagcauguaacaaggcagcuaaccuccggggugauucugaauggcuagguuguuagucccuuggcucagguguacagcagaugaagaggaaguaaggugaaaguuuuuuuuuucucuuuccaggaaguaaaaugaaauuucuucacaagaagugaaaucuuuucuucauucuaaacauagcuggaagugccaacgacaguguuuucccaaggaucuggaugcucgggagaguccuguaacaucugugacuguaaaaggagaaagacuguuggaaaacucuccuguugcugcagaccaacugggagcagucuagaaccagugcgcucucuucuccuucugauuuggggacuguuuuguuuguuuguuguuuuugagacagggucucucgcuauagcccugacugugauggaacucguucuguagaucgggcuggccucaaauccugaugucacaaaucucaaagaucucacagagguccuccugccucugccucccaagugcugagaucaaaggcgugcaccgccaugccugggcucguuauuuuacagugguguuuuaucuuugguuacugaugggugcaagagccucugcuuugugcuugugguuguccuuuacaaggagaagacucagaaauacuugguguugaguuccuaaaaacaaugcaaagaugagauugacagagaaauaaggagaauaaugagaguuucagguacuagggagacagacauggaggacaccauggucacacgauucucaucacugaagcaucauauugcuuuaaauacguggacgguuugugcuuucuaauuccaguacugucaccauugauuaaaccccccuuuugucccauguccuaucuuggagaauuucacucauguuagaacuuuaaaaaaaaagcagacaccaggcauggccuccucagaacacguguccugcugggauagcuugcuucucauaugucagcauuaugcuuuauggaauggagccaacauuaaaauguccuuuuaaggacauagcuaucugaguuuugguguuuacaauuugcagcacugugauaaucuacaugucaucuuauucaagcuuuagaucagcuucaugauauucuacaagaaacuggaguucagagaagcuaaggaauuuggccaguuauauacaagaaagaacuaagccaaacacuugacuuaugaacacauacaaagcugguuaguccuacagcuguaaaugaacucuuuauagugauguuuaaaguucucuguggagcacaccagagcuuccuuuuuggcucugaugagacguuaagcuaugggggucuagacaagguuuguuccuuuguuucuucuucugcugcuggggauaggacccagggccuuuugugugcucugccacacugguuauuuuuacaucggugugaguuuuuaguguuuccuaagccucuucaucaaccagaugcugaaaaucuaaaguaggaguagcaccugggaaagggaguuugucagugaggguacaguuuucauugauaagugagaaauguugugguaaaugucaguuguuuucuguaaccuuugcccacugcuuuaccuggcauggaaaauacucauucagacuuggaaaguguuguuuguuguacugggauacaacucacugacuuguauaguauugucauugucacucauacuagggugucugaaugaauccauuuaagacuggugcugugcaauauaguucccacacauggguccagggaagagaacugagucuguccuuucaaauguuagugcagcucacccaggggagcuccucccagacagcucucuccuuuccuucuuccuacacuccaaucccgauggaacaauucaugacugguuguuuauaagauggggaaggaggguuuacuguggucaaucaugacugucccucugcagggagacugcuuuugggagagucuuaaccuucuuaagaucuaaagcugcuuccuuuccuugaguuuguuguaauuuguuuuuguaaauguugugaauucuaaauacguuuguaaaaagaauuguucaauauuucuaucaaauguuuacagauaaaggcauuuuaaaaaaau

SEQ ID NO: 1625 - RNA, 7512 nt, Mus musculus
cccgaaucgaagccccaaaggcagcggcgugugugacgucauuccaggcgcaggcgcaguggaauuagaaccgaggcugcgcagacucagaaggcgcucuugaagccuagugccgcgcgauggcgggcacgggcuugguagccggagagguggugguagaugcgcuaccauauuuugaccaaggcuaugaggcacccggcgugcgggaagcggugagugcgggucaugugcggcggguccgccgaaggcacgccgcccuuucccgccgcgacccuggccuguucucguucuuaggcggcggcccugguggaggaggagacgcgcagauaccgaccuaccaagaacuaccugagcuaccugacggccccggauuauucugccuuugaaguaagugugccuuugaaguaagccaggaggcuugcggacuuugauacgggagugagggcuuuagcuguguaaagugaacuccaccuuccaaguuagcuggugccugcagcucguacugagugccauguaggugugagucgguuugaaaccgccagaugcgcaugucacgggcuucguacuacaagaaccugcgaaaugcuccauuaguuucugcagauuuguuuaauagugugcaccuccguguguguguguguguguguguagaagagucaugguacauuucacaaaagggcccuuuauucucuaagguccacucaagaacagguaucacucacgagauuuuaauauuuauaaucuuaaguaccuguacucuuugccaccccuggagggagauucuuuuguaccaagucucagauaguuaacagguguaugaaugccugaacaagcaugucuaacugcaugcuguuuuuaagugguuauucuacaagugcaaccaaaaaacaccacuuagauguuguuagaagcacuuucaggcugaaaggagacugcuccaugcgcagggaugugugauacuucggaucuagaugccagguuuuuaaacuggguugugacuccucaguggggguuucauaacugaugugggagcugcaagaaauuuggcaagaguaaaaaguacuaacccagaaauuaauugaaaacucaagucccagaucuaagcucugguccauguuacaucaugugacuucaccauuuacacuguacccaaacaguuuacacugugucaguucgucaugcagcagcggagacuuccugaaaugauucaagacuguuguguguugugaauuacaacgugacguggggcugggauuaaagcuguuuucagaguuccacagcuggcugacuacagggcauugaaaacugcugguuuaggguuaauccuugagagguggacucuucuauguccaccuccuuucaugccugggcagaauauggaauuaaagaauaugccuauuucuucagauucuagauagaauuaaccucaacugggggaugugucaguggcccuggguucaaauauuagcauccuuuuuuuuuuuuuuuuuuuuuugaguagugauugagaagggaaaagauucgcuauaauguguaguacaaaguauaaaaucucaguaaacugcauucauuauuuucagcaugauucuguuacuaauucuuugugguguuugugcaucagacagacauaaugagaaaugaauuugaaagacucgcugcucgacaaccgauugaauuacucagcaugaaacgguaagaugagguugagcuaugguaacagcugcuuugccagugguuggaagaguguuuguguuugcugcuguggguaggaagugagaauaaaaagagaguaccagccggucguaguggcgcacgaggcagaggcaggcagauuucugaguucgaggccagcaaaggucuacaaagugaguuccaggacagccagggcuacacagagaaacccugucuuggaaaaaaaaaacaaaaaaaaacaaaaaaaaagauuuauuuauuguuauacauaaguacacuguagcugucuucagacacaccagaagaaggugucagaucucuuuauggaugguuguaagccaccauguggcuacugggaauugaacucaggaccucuggaaaagcagucacugcucuuaacugcuaagccaucucuccagcacugcuuaucagcuuuuuaaaaaguugccuaaagggcugcugagguggcucaucgguuaagagcacugacugcucuugcagagguccugaguucaaaucccagcagccacaugguggcucacaaccaucuguaaugcagauccgaugcccucuucugguguguggaaagacugcgacaguguacucacauacaugaaauaauuaaucuuuuaaaagucuuuuuuuuuuuuuuuuuaaagcugauaauuagacauuaccuaagaaaggucaugauagacaaauaggaacaagagacaugagagucuuggugacugucacagcucauuuaacuaguucacauuuauggaaauaggguuuuuuuuguuaguuuuaucuguaaaucaguuuccaaacuaacagguuucuuuguacugccugaucuacauuauauccuuggucucugugcauguguggucgggaguugauaauuugugucuuugucuuuauguagugggcauauguccaugagaauucuguuggaaggagugaugaaggcuuugaaagauacauugguuuguuuguuauguaauuucagauaugaacuuccagccccuuccucaggucaaaaaaaugacauuacugcauggcaagaauguguaaacaauucuauggcucaguuggagcaccaggcgguccggaucgagaaucuggagcugaugucacagcauggaugcaaugccuggaagguguacaaugaguaagaggcgcugggccuucucuuucuuauccugucccacccagaguugcuagugucuuuuaaagugugguauguuuuuaauuccagcaguuggugugggaagcuaagguguggaggagggccugccuggcuuauauuuugaguuuagucauccuaagcucauauagcaaacccuguacccaaaauaauaacaagaaugcuagauuugacaugggauugucucagaacuacaccaacgaaaggcuaccuugaguccuaccuuagaguucacuaaugcugagcuauccuacauccacguaacuaccuaccacguucacuguacuguauaagaaaaugagcucugagggugaucugcagaauaucacuugauagaaugcacuccuuaaugggcagaugcuuaaauaauggguucucguauucacaugucauguugcuuaaaguccugaccaggguggccggccgcucaccuucuguccagcaaugcucaggaggcugaggucuggggauuuccaugaguuucuggccagcucgggcuccagagugagaucuugccucaaaaaauaaagcaauaaaguuuccccugaacacagaaucaaggaauacuauacuguuucuccuaggggaaguaucuguacacacacauauacaucucucacaauuaccucuuacaacuuuuaagucuaaaaaaagagcugagcgcacaggaguauugcugcacauuugaggcuagccuaagcacacaaagccuccccuggccacaaaguuagucccuggcuuauuaauagaucaaugcccagcaccuaacuucuaaacuaugcugcucacuggagagcuaaaauuaaguggagcgggccugcagccuuagcugugggccagcaacccaaaucguucacugcugugcgcaugcuuaugaacugcugcaaauuaguaguagcuaaaaucaaauucaguuaaguacugaauuaaacaaacuaauguuuaugaaucaucugacauucuagacacagaucuccagauuuuagauuuuuagcagaaaaacauggcuuaguauauaaauaggcaauucuuccucagcguuaccagauuucaaggugccugugcguucuuccuucuuuagaaaucuuguucauaugauugaacaugcacagaaagagcuucagaaguuaagguaaguugguuuuuuauucuguuugaauaaaauuuagauuagccucugauagagaggaagaaaaacuacuaauacuauguaguccuaugaaaguaaaaauucaacuuuuauuaaguaauuuuaaucauguauguugguguguguaaaauaguuacuuuugaggaaaauagaaauucauaauauucuaagagguagauaucagggaauagcaaaaaaugaaagcuuguauccugugguaugugucgaagggaagcuuugcauguuguggcauguguugaagguaugcuuuggauagacaaccuugaaugucugcugguuuaugagaaguggguuaggaaaccucugaacaacuaauagauagagcuagacguguggccuggugcugggucaggaggaguuugagcucaaagccuggcuacauggugaaaaauuguuugaaaagccaucuaggggaacaugauuguggucugaaggauuugucccugaacauacuucggucagcaggggucccugagcagucaacagggaaaccugaaauugggccuccaauuagaggugcugacacaccuucacaguuagagcuugggagagccaacuccuugucuaagggcuggcagauuuggacugcaggaccaaauggcuggauagugcagaccuucacauacgcuguaauacauuagggaguauauuacaggugcaugacauuguuuucauuuugcauuuuuguuucuaaagugguuuugauuuuagacauuagguagaccauauaacgaauagcuauuaaaauacuaaguaauguuaauagaauuuacugugauauuuuugaucuguguuuagcaucuggcacugaguuugcuguaccaaaguggagguaaaaauacgcuugaaaccugaaaacauucucuacaacucccaagucugcaaaccuggaaagaacaccuugggaguuagacagggcaucaggauaccacacugcagacguacacacauaugggaaagaaccugaaaggacacccacugucuuaguucauguucucuugcuaaugauagcacaggcuugguaagguggaaggaaaagaccuuuauuuugacuuacaguuucggaaauucaagguugaagaacugggucuguugauaacccccuuagggacagaucccaacaugguacuuggaaucacaugacaagagacaagagggcugcaugugugagauuuagucucuaacuaugaagccacucauauucaguuuuuggaguuuugcucugauaaccuuaucuuauccggccaccaccuuaagucugccucuaaccaccguaauuggaucaguuccugcucuuaguaucucucaauggcucuuaggcuccaguggggauguggguagaauaagcauugaaaguguaguguaguacucacggaacaccccacagcuguagccaggaagaguccaggaaggaggaggcugcaaucuauguauauguugguugguuggugguuuguuuguuuccucccucccacaaugaauaaauuuuaugaaauuuguaauuaaaaacaauuaagauaaaguuaauuccuagaauuagcuguaguuguguuugugagcacuaaagaguauaaagauacucuauuguacuauuguucuguugauuuuuguuguaaauaacuuuuuacaggaaacauauucaagauuugaacuggcagcgaaagaacaugcagcuuacagcuggaucuaagcugagagaaauggagucaaagugagugugugacuccguguuucaugugugcauggacugccgugggagucacagaagggccauucacaugucugcugugugcugaggaaggggaggcauacagaguaacugaccgcagaaagggcugacuuacugcucagugcuggcaucacagccccagcuccaggacggcaaucuuguagacuuugccuaauuugugccuuaguuuguuugccccuguuaaugcauagccuucugcacacacagauuuauagaaaucccuaacuguaugggcugugugugcccauaaaugccuuaguccucacauguuggaacuaaggaagaaagauugugacuuuaagucuagccuuggcuacagaguaacaccgucucuuuaaagaaaaagguuaaaugcauaguguggugaugcuugcuuacggauuucugucuucccggucucuccguugcccacagcaucuucucaccaugcucuccaucuugagaugccaugccggcuccuuucacagcucucuccacgcuagugcucuuuacauuuguccuggagauuuaguuacaggaaauaguggcuaaggcuaugggguuuggugguagugguaguuuguuuugucaauuccagaauuuuguccaucguguaaaccucugccuguguucuuuuaaucuuaugcuguuuuccugucucuucugucucccugagucucuuguuucugcuuauuucuuaagguaacuaucaugagacgauuguuggguaacuuaaguaaugcagagagccccuguguacccuuccccugcuuucccauaacguuguuuuuuaauggaaaguuaaaaauguuagugcccauagugaaacuacauauguuuaaaauaaacugugcaagaaauuuuacauccgcucauuuuucccucuucucucuuuuuccuuugacucucuuuccuagcugggugucgcuggugaguaagaacuaugagauugagcggacgauuguccagcuggagaacgagaucuaucagaucaagcagcagcacggggaggccaacaaggaaaacauccgccaagacuucuaaugacucaggcgacgugggcuccgcagacucagcggggacuuucucggagcgacuguggugguuacaugguuagagaccauggacuauguaaacuguuguauugcuucugugugagugucuuagcaaaauaaaguugucaacauguugcuguuuuuaugcuauaaaaaccugguuuucagaaugaguaugacuuuagaauaauuuugacauauuuuguagcagaauuuuuuuuuuaaggcuucaaauuuuguaaugaagcuccuuuauuuuuaaggcauccaacauguucuggaagcuggaaaccuugaauuuguguuuuuuguugaauaaaguuacaguucuaagcauuuuuauguguggcuauagugaacuuuauugaugguauucaaaagaaugaggcucccuucuagggaucuaugauagaaauagguguagugagaauuguggaauuuuggauucuuuuuuaaaaaugcagaaauauaagaauauguuuugggcuggugagauggcucagcggguaagagcacccgacugcucuuccgaagguccggaguucaaaucccagcaaccacauaguggcucacaaccacccguaaugagaucugauucccucuucuggagugucugaagacagcuacaguguacuuacauauaauaaauaaauaaaucuuaaaaaaaaaaaga

SEQ ID NO: 1626 - RNA, 7512 nt, Mus musculus
ucuuuuuuuuuuuaagauuuauuuauuuauuauauguaaguacacuguagcugucuucagacacuccagaagagggaaucagaucucauuacgggugguugugagccacuaugugguugcugggauuugaacuccggaccuucggaagagcagucgggugcucuuacccgcugagccaucucaccagcccaaaacauauucuuauauuucugcauuuuuaaaaaagaauccaaaauuccacaauucucacuacaccuauuucuaucauagaucccuagaagggagccucauucuuuugaauaccaucaauaaaguucacuauagccacacauaaaaaugcuuagaacuguaacuuuauucaacaaaaaacacaaauucaagguuuccagcuuccagaacauguuggaugccuuaaaaauaaaggagcuucauuacaaaauuugaagccuuaaaaaaaaaauucugcuacaaaauaugucaaaauuauucuaaagucauacucauucugaaaaccagguuuuuauagcauaaaaacagcaacauguugacaacuuuauuuugcuaagacacucacacagaagcaauacaacaguuuacauaguccauggucucuaaccauguaaccaccacagucgcuccgagaaaguccccgcugagucugcggagcccacgucgccugagucauuagaagucuuggcggauguuuuccuuguuggccuccccgugcugcugcuugaucugauagaucucguucuccagcuggacaaucguccgcucaaucucauaguucuuacucaccagcgacacccagcuaggaaagagagucaaaggaaaaagagagaagagggaaaaaugagcggauguaaaauuucuugcacaguuuauuuuaaacauauguaguuucacuaugggcacuaacauuuuuaacuuuccauuaaaaaacaacguuaugggaaagcaggggaaggguacacaggggcucucugcauuacuuaaguuacccaacaaucgucucaugauaguuaccuuaagaaauaagcagaaacaagagacucagggagacagaagagacaggaaaacagcauaagauuaaaagaacacaggcagagguuuacacgauggacaaaauucuggaauugacaaaacaaacuaccacuaccaccaaaccccauagccuuagccacuauuuccuguaacuaaaucuccaggacaaauguaaagagcacuagcguggagagagcugugaaaggagccggcauggcaucucaagauggagagcauggugagaagaugcugugggcaacggagagaccgggaagacagaaauccguaagcaagcaucaccacacuaugcauuuaaccuuuuucuuuaaagagacgguguuacucuguagccaaggcuagacuuaaagucacaaucuuucuuccuuaguuccaacaugugaggacuaaggcauuuaugggcacacacagcccauacaguuagggauuucuauaaaucugugugugcagaaggcuaugcauuaacaggggcaaacaaacuaaggcacaaauuaggcaaagucuacaagauugccguccuggagcuggggcugugaugccagcacugagcaguaagucagcccuuucugcggucaguuacucuguaugccuccccuuccucagcacacagcagacaugugaauggcccuucugugacucccacggcaguccaugcacacaugaaacacggagucacacacucacuuugacuccauuucucucagcuuagauccagcuguaagcugcauguucuuucgcugccaguucaaaucuugaauauguuuccuguaaaaaguuauuuacaacaaaaaucaacagaacaauaguacaauagaguaucuuuauacucuuuagugcucacaaacacaacuacagcuaauucuaggaauuaacuuuaucuuaauuguuuuuaauuacaaauuucauaaaauuuauucauugugggagggaggaaacaaacaaaccaccaaccaaccaacauauacauagauugcagccuccuccuuccuggacucuuccuggcuacagcugugggguguuccgugaguacuacacuacacuuucaaugcuuauucuacccacauccccacuggagccuaagagccauugagagauacuaagagcaggaacugauccaauuacggugguuagaggcagacuuaaggugguggccggauaagauaagguuaucagagcaaaacuccaaaaacugaauaugaguggcuucauaguuagagacuaaaucucacacaugcagcccucuugucucuugucaugugauuccaaguaccauguugggaucugucccuaaggggguuaucaacagacccaguucuucaaccuugaauuuccgaaacuguaagucaaaauaaaggucuuuuccuuccaccuuaccaagccugugcuaucauuagcaagagaacaugaacuaagacaguggguguccuuucagguucuuucccauauguguguacgucugcagugugguauccugaugcccugucuaacucccaagguguucuuuccagguuugcagacuugggaguuguagagaauguuuucagguuucaagcguauuuuuaccuccacuuugguacagcaaacucagugccagaugcuaaacacagaucaaaaauaucacaguaaauucuauuaacauuacuuaguauuuuaauagcuauucguuauauggucuaccuaaugucuaaaaucaaaaccacuuuagaaacaaaaaugcaaaaugaaaacaaugucaugcaccuguaauauacucccuaauguauuacagcguaugugaaggucugcacuauccagccauuugguccugcaguccaaaucugccagcccuuagacaaggaguuggcucucccaagcucuaacugugaaggugugucagcaccucuaauuggaggcccaauuucagguuucccuguugacugcucagggaccccugcugaccgaaguauguucagggacaaauccuucagaccacaaucauguuccccuagauggcuuuucaaacaauuuuucaccauguagccaggcuuugagcucaaacuccuccugacccagcaccaggccacacgucuagcucuaucuauuaguuguucagagguuuccuaacccacuucucauaaaccagcagacauucaagguugucuauccaaagcauaccuucaacacaugccacaacaugcaaagcuucccuucgacacauaccacaggauacaagcuuucauuuuuugcuauucccugauaucuaccucuuagaauauuaugaauuucuauuuuccucaaaaguaacuauuuuacacacaccaacauacaugauuaaaauuacuuaauaaaaguugaauuuuuacuuucauaggacuacauaguauuaguaguuuuucuuccucucuaucagaggcuaaucuaaauuuuauucaaacagaauaaaaaaccaacuuaccuuaacuucugaagcucuuucugugcauguucaaucauaugaacaagauuucuaaagaaggaagaacgcacaggcaccuugaaaucugguaacgcugaggaagaauugccuauuuauauacuaagccauguuuuucugcuaaaaaucuaaaaucuggagaucugugucuagaaugucagaugauucauaaacauuaguuuguuuaauucaguacuuaacugaauuugauuuuagcuacuacuaauuugcagcaguucauaagcaugcgcacagcagugaacgauuuggguugcuggcccacagcuaaggcugcaggcccgcuccacuuaauuuuagcucuccagugagcagcauaguuuagaaguuaggugcugggcauugaucuauuaauaagccagggacuaacuuuguggccaggggaggcuuugugugcuuaggcuagccucaaaugugcagcaauacuccugugcgcucagcucuuuuuuuagacuuaaaaguuguaagagguaauugugagagauguauauguguguguacagauacuuccccuaggagaaacaguauaguauuccuugauucuguguucaggggaaacuuuauugcuuuauuuuuugaggcaagaucucacucuggagcccgagcuggccagaaacucauggaaauccccagaccucagccuccugagcauugcuggacagaaggugagcggccggccacccuggucaggacuuuaagcaacaugacaugugaauacgagaacccauuauuuaagcaucugcccauuaaggagugcauucuaucaagugauauucugcagaucacccucagagcucauuuucuuauacaguacagugaacgugguagguaguuacguggauguaggauagcucagcauuagugaacucuaagguaggacucaagguagccuuucguugguguaguucugagacaaucccaugucaaaucuagcauucuuguuauuauuuuggguacaggguuugcuauaugagcuuaggaugacuaaacucaaaauauaagccaggcaggcccuccuccacaccuuagcuucccacaccaacugcuggaauuaaaaacauaccacacuuuaaaagacacuagcaacucugggugggacaggauaagaaagagaaggcccagcgccucuuacucauuguacaccuuccaggcauugcauccaugcugugacaucagcuccagauucucgauccggaccgccuggugcuccaacugagccauagaauuguuuacacauucuugccaugcaguaaugucauuuuuuugaccugaggaaggggcuggaaguucauaucugaaauuacauaacaaacaaaccaauguaucuuucaaagccuucaucacuccuuccaacagaauucucauggacauaugcccacuacauaaagacaaagacacaaauuaucaacucccgaccacacaugcacagagaccaaggauauaauguagaucaggcaguacaaagaaaccuguuaguuuggaaacugauuuacagauaaaacuaacaaaaaaaacccuauuuccauaaaugugaacuaguuaaaugagcugugacagucaccaagacucucaugucucuuguuccuauuugucuaucaugaccuuucuuagguaaugucuaauuaucagcuuuaaaaaaaaaaaaaaaaagacuuuuaaaagauuaauuauuucauguaugugaguacacugucgcagucuuuccacacaccagaagagggcaucggaucugcauuacagaugguugugagccaccauguggcugcugggauuugaacucaggaccucugcaagagcagucagugcucuuaaccgaugagccaccucagcagcccuuuaggcaacuuuuuaaaaagcugauaagcagugcuggagagauggcuuagcaguuaagagcagugacugcuuuuccagagguccugaguucaauucccaguagccacaugguggcuuacaaccauccauaaagagaucugacaccuucuucuggugugucugaagacagcuacaguguacuuauguauaacaauaaauaaaucuuuuuuuuuguuuuuuuuuguuuuuuuuuuccaagacaggguuucucuguguagcccuggcuguccuggaacucacuuuguagaccuuugcuggccucgaacucagaaaucugccugccucugccucgugcgccacuacgaccggcugguacucucuuuuuauucucacuuccuacccacagcagcaaacacaaacacucuuccaaccacuggcaaagcagcuguuaccauagcucaaccucaucuuaccguuucaugcugaguaauucaaucgguugucgagcagcgagucuuucaaauucauuucucauuaugucugucugaugcacaaacaccacaaagaauuaguaacagaaucaugcugaaaauaaugaaugcaguuuacugagauuuuauacuuuguacuacacauuauagcgaaucuuuucccuucucaaucacuacucaaaaaaaaaaaaaaaaaaaaaaggaugcuaauauuugaacccagggccacugacacaucccccaguugagguuaauucuaucuagaaucugaagaaauaggcauauucuuuaauuccauauucugcccaggcaugaaaggagguggacauagaagaguccaccucucaaggauuaacccuaaaccagcaguuuucaaugcccuguagucagccagcuguggaacucugaaaacagcuuuaaucccagccccacgucacguuguaauucacaacacacaacagucuugaaucauuucaggaagucuccgcugcugcaugacgaacugacacaguguaaacuguuuggguacaguguaaauggugaagucacaugauguaacauggaccagagcuuagaucugggacuugaguuuucaauuaauuucuggguuaguacuuuuuacucuugccaaauuucuugcagcucccacaucaguuaugaaacccccacugaggagucacaacccaguuuaaaaaccuggcaucuagauccgaaguaucacacaucccugcgcauggagcagucuccuuucagccugaaagugcuucuaacaacaucuaagugguguuuuuugguugcacuuguagaauaaccacuuaaaaacagcaugcaguuagacaugcuuguucaggcauucauacaccuguuaacuaucugagacuugguacaaaagaaucucccuccagggguggcaaagaguacagguacuuaagauuauaaauauuaaaaucucgugagugauaccuguucuugaguggaccuuagagaauaaagggcccuuuugugaaauguaccaugacucuucuacacacacacacacacacacacggaggugcacacuauuaaacaaaucugcagaaacuaauggagcauuucgcagguucuuguaguacgaagcccgugacaugcgcaucuggcgguuucaaaccgacucacaccuacauggcacucaguacgagcugcaggcaccagcuaacuuggaagguggaguucacuuuacacagcuaaagcccucacucccguaucaaaguccgcaagccuccuggcuuacuucaaaggcacacuuacuucaaaggcagaauaauccggggccgucagguagcucagguaguucuugguaggucgguaucugcgcgucuccuccuccaccagggccgccgccuaagaacgagaacaggccagggucgcggcgggaaagggcggcgugccuucggcggacccgccgcacaugacccgcacucaccgcuucccgcacgccgggugccucauagccuuggucaaaauaugguagcgcaucuaccaccaccucuccggcuaccaagcccgugcccgccaucgcgcggcacuaggcuucaagagcgccuucugagucugcgcagccucgguucuaauuccacugcgccugcgccuggaaugacgucacacacgccgcugccuuuggggcuucgauucggg

SEQ ID NO: 1627 - RNA, 1336 nt, Mus musculus
aauggagucaguuauguccaaguaugaaaaccagauucuuauuuucccugacuaccuggaagaauucccggauacagaugagcugguauggauucuggggaagcagcaccccuuuaagacagaaaaaucuaagcuguugucugauauaagugcucgccuaugguuuacauacagaaggaaauuuuccccgauugggggaacaggcccuucaucugaugcuggauggggauguaugcugcguugugggcagaugaugcuggcucaagcccucaucugcagacacuugggaagggauuggaacugggagagacaaaaagaacaacccaaagaauaccaaaggauacugcaguguuuccuagauagaaaagacuguugcuauucaauccaucagauggcacaaauggguguaggagaagggaaaucaauuggcgaaugguuuggaccaaacacaguugcacaggugauaaaaaaacucacuuuauuugaugaauggaauuccuuggcuguuuauguuuccauggauaacacaguggucauugaagauaucaagaaaaugugcuguguucuuccugugggugcugcugacccagcuggugauuuucugacuguauccaaucagaguagagacaccucugucccgugcucagccuggaaaccccugcugcucauugugccccuucgcuugggcauaaaccaaaucaauccuguguauguugaagcauucaaagaguguuuuaagaugccacagucuuuaggggcuuuaggaggaaagccaaauaacgccuauuauuucauaggauucuuaggagaugagcucauuuuuuuggacccucacacaacccagacuuuuguugacauugaagagaguggacuaguagacgaccagacuuuucauugccugcagucuccacagcggaugaguauccugaacuuggauccuucuguggccuugggauuuuucugcaaagaagagaaagacuuugauaauugguguagccuuguucagaaggaaauucuaaaggagaauuugaggauguuugaauugguucagaagcacccaucacacuggccucccuuuguaccuccagccaagccagaagugacaaccacaggggcagaauucauagagucgacugaacaacuggaggacuuugagcuggaggaagauuuugaaauucugaguguaggcuaguuagaacucagugagguggucuucugccuuccaucgggcaucacaagcacgugaaaacuuuucuggucagcaagugccugauaugcagauagcauacaaacucaauaacaaugaugacugagccaguugucccuuguucagaag

SEQ ID NO: 1628 - RNA, 16216 nt, Mus musculus
cagagcuaacgggcuggagggaaagaggccgaaugcacacacuccucuggccccacuuaaggcugccauggggcccagugcuccucugcugcuccucuucuuuuugucauggacgggaccccuucagggacagcagcaccaccuuguggaguacauggaacgccgacuagcugccuuagaggugagggacuuguuucucuucucacccaggaugaguccacaucuauaggugcaacuagcugucagggcucugggagugacaagaucggguuguguaagaaguccuuaaugacgaguagccucuuaacuacagacuuuuauuuccccaacauaagacaauugcccagcaaauaaacgcaacacggcucccucagauuagauggaauaagggggcaggggaaaugagagucagaaucgggcugcaucuaugcugcuauacuguucaaguuucccaggcaaucugccugcaacuuccuguccguuucuuccccgcaccccacaucuacucccuuuuggacaauuugaagucuguagcauccuaauuuccuggaggcucagaucacugagaacgcaaggugaaggacucuuauucaggcaaauuaagccagguuccucggaugggaugguaccacugacuagucuccucugcugugggagcauggcugagcuggucccuuuccuggcccugacucccuggcugggccucugcuugucugggagcuauaaaccugcaacccacccuuccugacuccccgaucccuucaggaacggcuggcccaaugccaggaucagaguagucggcaugcugccgagcuucgggacuucaaaaacaagauguugccucuccuggagguggcagagaaggagcgggagacccucagaacugaagcagacuccaucucaggaagaguggaccgucuugaaagggagguagacuaucuggagacacagaacccagcuuugcccuguguagagcuggaugagaaggugacuggagguccuggagccaaaggcaagggccgaagaaaugagaaauacgauauggugacggguaagugaucucacagagguccagacaguuucagaacuccccuuuccugcuuuucuucuugucccaagccaccauagcucuaucuuucagaaugacacauucauugagaguuucuagaggccuguccuuuaucgguacuccaucucucaacccuccgugaguggacacaugcacggaaaagugugucucuguuccccagguggcccacucugggggaaguuccuguuauacacaucuaacucuuggccucuguuuccuucuccugugcuuucuccucuuccccaccagacuguagcuacacagucgcucaggugaggucaaugaagauccugaagcgguuuggugguucaguuggccuauggaccaaggauccgcuggggccagcagagaagaucuacguguuagacggcacccagaacgacacggcuuuugucuucccaaggcugcgugacuucacccuugccauggcugcccggaaagcuucccgaauucgggugcccuuccccuggguaggcacggggcagcugguguacgguggcuuccuuuauuaugcucgaaggccuccuggaggaccuggaggggguggugaauuggagaacacucugcagcugaucaaauuucacuuggcaaaccgaacagugguggauagcucaguguucccugcagagagccugauaccccccuacggccugacagcagauacauauaucgaccuggcagcugaugaggagggccugugggcugucuaugccacucgagaugaugacaggcauuugugucuagccaaguuagacccacagacacuugacacagagcagcagugggacacaccaugucccagagagaacgcagaggcugcguuugucaucugugggacccuguacguugucuauaacacccgcccugccaguagggcucguauucaguguuccuucgaugccagugguacucucgccccugaaagggcagcacucuccuauuuuccacgccgauauggugcccaugccagccuucgcuauaacccccgugagcgccagcuguaugccugggaugauggcuaccagauugucuacaaauuggagaugaagaagaaggaggaggaaguuuaagcagcuagccuugugcucuugauucuuaugcccagacauuuauauuccugugagcucuccugcaguucauccuucaaaacgaaggccaguggugguagcucauauacccuaauuucuaaaggacaaccaaauucucaagccccucuguuuuaugcagaacuccagauccuggguagcauuuuagaacugaacagcaaacaaacacccuaaaucuucacuccugccuuauguccacaaaguuuaguuccaaacucagagcccuguccuuuggagagggucaaccccagacagcaggcgacagcauucuugcccucaguaugaccgaagggagagaacucagagacaaagcugcccucccucccuucccccuccaguguaggggagaauggggcuuuccccacaucacuuuguaugguaacaguuugcauuaaaaggaaaacccaccauuccucucugguguguuugggguagcccucugaucagaguucucguggcucugccuucuuccuccugccccagucucugcuccuuagccacggcugggcugggcuggccuccuuuagcucccucgggaacuucucuaguuacacauuuuacuguggggcacuguuggacaaaggccucccccuccacacucaugugcuccacagcagccgcagagaaccagcaauggcacucagccucugacugcuggacacuggagcccagccagagccagggcuucccauuccaccucuugguggauuuugaaccagaaagugacucuuacuagcuguggaaucuaguguagaaaccagcgugcgguaucuaugugugucuagccucaccucugaaguggauucugucucugagcccaaguccccacucccaccuccagcacuggggcuuccugggucuggguugcacaauccuuggucugagccgcuccgauuuuccugcugccacagcgucugcgguuugggcagggaggaggggcagugaccaucccagauguuggucugucucaccagcuccccaacaaacacaucccuacuuuccuucucuccacccucagcugugcacccucccaccccagcccuggaaacuggaguccuggaaacuuaaccccuguuggucuaaugugcacccgacuucaggggggcaauccaggaaggauuggaagagcaagaggcuuuggauuccaucucugggaaccugcuggucucugcacgaugucccuucccaggucucaucuccagggucaacuuccagacaaauaaggcuagcugauggauaaaagucagugggggaguuuaaccucaggcagcccuucuggauuaucacccagggaggaagggggacaggaacacagccuucucucccaaguagaacccucccuccuuccacccaggaugggguggaucagucaacacuccuccuuuugucugucuuucuucucuccacaggcagagcugcuccugacguagguugguaaggaagaggaaagaaaggcagcaaagcaccucacaaaagcgcuauuguagggagccugaggcgggugggggcccucucccauucaauucucuccuaauguggggcuggcaacaguaaucaccgccugucagcccauagaggggucugcccacggaacaucuggcugcaacgcagggcauaucggagggcuguggaggaggggauucucuguggaggccuugaggagaacagguccaggggaugacaagguguagaguggcgcuguggcgcugugugcauguguaaugugcgugugcacaucucucugcauggcugugcggcugagcaccugugugagacugggcuacccagggagacugcacguauacaaaugaguggcuuuguuaggcuguguacaugcgaccgaaagggauuuuagguuugagaaagaccgaggagggcacugaacuccgaguguguugugugacugcaacugcacguguaugagcacauggcaguagcuugcccccuucccaguguggcugcgugccuagagggugggccugggacugugccuuuuugaugccccuaaugaggcuggcucaggugauguauguaagcaauaucaguaaaggcaaguauaugggcugugucuuuaauaaauggcugcauugucuacagccuggguccuucaaacaggugugugcuugugacaucuucguuugccagaauccuuauugggaaagaaaaaauagcaacucacuuuuguuuuuuugucguugauuuguuugaaaauuuucuuggaaaggcuugcauagacuuaugugaaagggcagggacuuggucucccucuccccccccccccucucuuuuuuccuucccauuuuggcucuugcacaguggcugggggcuauuuuggaagucuuucagaagcugagaggugcuguguggguagaugucgugaacuguccaaauucaucaaaugaaacgaucugcugcucaaggagacagucuuggcagcugaaucccaucauuaaaaucagccuucccuacccccagccccaccccagaucuccuaggccucccccuuagcugaaacaggcugugaccucuugcuggcuaaaagagcuugggaaacccagacccuacuggaggagagugaguugaaagcccacaaagaaauuccacauuuucccccaauugcaggccagaggacauccaccauuuaaaaccaggaagggcccuagcucuggagauacuguccuccagcugugcucugccggcagaagucaggguugagaggaccuucucaccccacuccaggcccccaaacuuucugucucacugucuaaagcucuucuuuuugcuuuaaugugcuugccuccuuggugccugccagggaaaaugaagugcuuguccgcgccacuuaauuggaggcccaugagccugggguaguggggggagagagagagagagagagaaagagagagagagaggcauugaaucagcucugucccgguuuccucugugauacaccugagcuagucaggaaccaagagcccuuucccuggcuuccuccuucagccucagauuuuccaggccccuuucuuccuggccguguacagaagcuguccugaggcuccugggagugucccuuuucuuucuuuuuuguuuguuuguuuguuuuguuuuguuuuuguuuuguuuuguuuuguuuuuuuucuagacaggauuucucuguguagcccuggcuguccuggaacucacuuuguaaaccaggcuggucucgaacucagaaauccaccugccucugccuccauggugcugggauuaaaaaggcgugcaccaccaccacccggcgagugucccuuuucauaucucucuauuuuucuagcuggcuuaggucaaaauugagagcuucugagagcugcugagacuacccuagugucccuucuggccuuuccauugggucuccaaggcuugcuauucagccugucuggcugcuuuacggcaugcucuccguaagccugcccuuucuucagcuggagggcaagaccuguuuaucugguuggaaucuucuuggugccagcagccugggagaggaugccacguccuuugcugcugcagcugccaagacugguaagcucucucccacacaugaguucacuuuucucuuugucuucugcauauggaugguuuugucuagauguaugcugugcaggccuggugcccacagagaccagaagaggguguuggaccccaggaacugcaaauacagaugguugugagugucaugugggugcugggaauugaauccagguccccucucaaagagcagccgauauucuaacugcugcggcaucucuccucccccucuuuaaugccuagacucacaaggcagagcuucagagauuaagucuuuauuuauggauuuaauaacuacacagaagaaugaaaacauagauuccgguguguaucaacuaaagggcagcagagggagaaaggaacagggaaggacucccagccccagcuugccagaacaguucccgggccucugggguccacccccuugaacauuugccucucugagaauagacuuccugaccacagcugugaugcucaggaagggacaagucagauucuccuuucugggcauuuuagaaaugauggaucagagaacuuagauccaagggcacuuucccuccucaauuaaaaaaaaaaaaaaagucaucucuuuggagucacuuuugucugcuguggagagacggugaaagccagacugcgggccaaagugggcauugguagagaagcaggcagggaagaggggcuggcccaggucaguguucacagccugccuacagccaucucuccugggcguggggggugcacagcacauucuaccucacaggucccacaaagugucugcauccuugcauaccuccugguauagguuuacuggcuuuguguaagcccuaaaaacugggcuucucuuuccuacaccccagucagugacuuauagucacccuaccucccaaccaaccaguuguuccaugccugagcuaccaggaaagagcuacgaccccggaggauagucuuccuugagcacaacccaggaaguuuacuagaauaaggaaagagccugugguaggccuguggcucucccuguggagccucacucaagccaugccuccuccauaggguucccccucaacccaggcacuuucucuccugcucuauccauucauggcuguugcaguuuggcucuuuaaauguugcuuuguuuuauguguguguguauggguauuuggauugcauguuugucugugcaucacuugcaugccugcuuaccuuuugaaaccagaagagguguuguacucccuggaauuaaaguuaaaaaggcugugagccaccauguaagugcugggaaguagacaccagaucucuggaagagcagcuacggagccaucucucuaguccacauaguuugcaucuugaguggcccugcaaaguacugaaggcuugggccccagaugaugucacuaggaaggcuuugggaccuuccuaguucaagaagggugagucuguggcauuagccuguggagagagagaauugggcucccagccccuuccucugucuucucaaccuucauagaagucaccuuuacuucaucacucaccccccaccccccacaugaugccuaaugcagccaggccugcuuacccuggacugaagccucaggauuggucaaagugacaaacccuaaucuaaugauggugucuuuucaucccauuguagcuggagcuuauuguguucagaggugaccuacauauucuagagucuuugaagucagagaaccuuagugagaguuucaggucagaaucugcccucugauccaaguuauguaaaucaauaaaauaauauccacucaguaggauucuuccugugggguaaagacaacauaugcaagcucaguaacagugcagaugguggugguucucaguuauccccuccucuggguggguuuucugaucauuugcacucucagccacacaaggucaggcaccucugcuaugggcaccuauccacucuggagccugucaccaccgucauucgaccaucauuguguccucugagcagagcccagaagagcacacugucccuggaauugagaaccugacucgggaguggcccacuguggacaagcaguaaauguucucgauggacaaagacgaucaauggguacacaaagcgaucccagcuccacugcagggcaugccugucugcccaugguggugacaccugaggugacgcuagccugucuaugucccauggcuccagaaaacaaugacucagcagaagacagugggaagugauggggcucuggaguacuuaagccugacuucacaugacuguccuuccacucgcuggagugugacuuuggagcaaguuaguucaccugagucucucacuucuuccucgacacggggagacgccauuccaaccugacagacugugaugagaauuaagugaaggaauguggagcaggaggucaaaggauccuguacacacauuauaguuugucaugcacagggccuuuaaaaacagcaaguguucaugguguucuccuuucauccucacugcaaucucaggagacaggcagguccucagaagcuagggagcagaggaauuaaagucauguaaggugauauggaugauaaccaugggagcuggaaucugucuugaaggcggugugcuggaguguaaacagcugagacacgagcuuggguugaacuccugcgcuugcuccgccaugagcuggcugugugcuccuguacaagucacuucugugugcaucccuggguaguuccuauuucauaggucagguaugaggaguagaugagcuggugcuaauuagauauccagcagagcauccagugggugcuuaauaaauguucguccccaggcccgugccacuugcugucuugcuguugagccauguguugguagccauuucugugaagcauuagaaagcaucugcugugaggcguaguggugcaugccuuuaaucccagcacuugggaggcagagucaggcagauuucugaguucgaggcuagccuggucuacaaagugaguuccaggacagcuagggcuauacagagaaacccugucucaaaaaaaaaaaaaaaaaaagagagagagagagagagagagagagaaaccaucugcuuugaaccaguggcuuccaaacugccuucuguccuuccgucuccauuacacauuguucuguucaaagguggggaagguagccaguuuccaucguagaucucugcaagaguagaagugauggcuucugcaccagcugucagggaagagagcaaggugggucauagugugccuucucugugacugcagcaaaucuacuagagaggagagagagagagagagagagagagagagagagagagagagaucauguacacaagugagcaugguguaauuucauaguuuuccaaaccuggcuuuuuucauccacaucauuuucuaagauauuucgguuguucagcgugugucccuguggucaucacuauugauuuuuuuuacuuaauccugcuguugguuuugacagaucuuuuaaugcuguuauaacugcauuucaucuuacagaugcuuacuauggaccaguugcacauggguuuuguuugcggcuguugaauuuuuguguuucaggccugcaguuaucaaaugaucuuuucuccaucucuccugacugccuuuggagagagggaauuggagaaugagcauauggugggaauuaggggguggggccuacgugcuggaagcccaucaccagagcugggccauggaagguuacuagccugcccccuagauuggaccacucucugcuuacuauucuguagccguauggacaugagcugagcccacauaaguccuuccucccuuaagguguuucugucaaguauuuuggucacagugauauaaaaguauuuuaugcuucaagucccaacgcaugaaacauccugaagucuuagaagggcuuuagggaucaucuacuuugacucccucuaucuuuuguuguugaaacugaguuccacagagcccuuugagggcaggggccaagcuucauccaucuuuccucagacagaaucgggugcauuccaugugugaaugauguuuuguaaaugaguugauggccagaucccagugacauagccacaguuucacuucccuccaugacucagcuauugccaagguccauuauaguuaccaugccaccaugcugaaaccccaucagaacuaauuacaccaugcacaacguagcugcaugugcuucugcucuucuuaguguuuccuugccucucccccugucaccugucagcccucccuguaaucaggagccagauuuagacucucucucucucucucucucucucucucucccucucucccucucucccucucucccucucucccucucuccucucucucacuguuauacaccagcuguccacucuacucuggggcaaaacuggagugagaaggauuugaaagauuuaaaguuggcaugcaugccagguaccuuuauugaccacaagaaggauggcagacuuuuccagagacaaaagcagcaccuguuuuaagcuggaagaagccucagagucaccuggauuacucuguuccuucaggucauggacauguauccuaauucacacacucugccuggucccuucuaugugcaguauucauuuacucuuaugagucaagcuguguguauuaugauaguaguggcugaggcugcacuaguuuccagccccuggaauugcuacccacugaccuggauuugugagcagcauucccucccagcacagggaaaguaaaugcacacacacgugaauccccuacuacuuucuaauuaugacauagcaauucugcuucuccuucccgcucuguccuuucuagcccucuuuagucuuaauugaaguaaaauguuuucacugucgcauguuuguuagacaucuacggcaagcuuaagagauguaaacuggaaacacuugggauaauuaaguaguaaguagagacaugggggaaauacuaauugugucaguggauuuuaaauugagauaggaauaaucucauuuaaacccaacuucacuacucacuugaaagccuguaaauuacaggcaaauuauuggucauaaguugugauuuauguucucaggguuuuuaaugagggcaagcgaggcagaaaaacacucuuaccaauuuacagucuggagaagaucaagccgaguuuuccucucuggaggacugcuugagccuguguuuguggucagccugggcaacaaagaaaaaaaauucugucucaaaaaaaaaacaaugcaaacauugucuuguguucauaucccaugugccaugcuagagggacaguauguuacaaaauaugacagguguguggaggggcagugucuuaccccugccuugccagggggaaggaaugguuccuugccaaaagccucuccugacacaucucuucuugccuccucaugcaucaauauugaugucuguagaugcaacucuccaggcuagacguggcuuugucccuuucauuauuuccagauucagugccccguggucuggcucacuagugacucuauaugaaauaggacagaaaaagccugggaggcacagaggaagggggaggggucuucggccucuuggagcugccuuuuccuuccgaggaugcuccaugagugugagaggugagugccuggcaccauguuuucuccagguuuauauucuuccagaaacaguugauucuccccagaauguagaacccugccagcgggcagcagccagggagccagaaaccagcaggaguagaacccaguugcuguugcuugguguuucuuauuuuguuuguuuuuuuuuguuuccggucuuuuucuccguguuuacaucccugacauucugaacucaccugugaacucaucuuugccuugagccacagcuucugcuggacacucaccucuggccccagccacucagagaaacaaugaacaguagcacugcuugcuccucugagccaccggacagacugcaguggggcagaccuuguccucuaacgcagcugaugccaccugcaagcauuugacaagagccaggcuuugugcugggggccgaggaagacucaggaugguucuuugccuuucaaggcuuacagcucaugaagagggaaugaauucagcggcucagaguggggugauuaaaaaaaaaagugccugagccacugguguucuguucaugaaguugucuccuguaccaauguacaaagcccuuucucacuuucucgucuauuagguuuaguguaucugguuuuauguugagacccgugauccacuuggacuugaguugugugcauuuuucuccaugcagacauccaguuaaaccagcacuauuuguugaagaugcuuucuuuuuuccguuguaugguuuuggacucuuuaucaaaaaucaaguguccuaauagguguauagguuuacuucugugucuuugauuugauuucauggaucaacaugucuguuucucuuacaaauaccauacaguuuuuuucacuauugcucuguagcacagcuugagguuagggauggugagucuuuuauuguucaggauuguuuuggcuauugacuagaaaucugcaacugacagggguggagagguaggggacaucuucagagugucacagagaccggggauggggaugagggaggcagccaagaaucaauggggggggggaccuuggcugucacucacagcauuggggauauggaaccugaagaggccaccuccuuuagccaggcaggaaccccaguggagcgaugggacaccaaccuacccacaaaacuugaaaucccaaauuuauccugucuacaagaaaugcagggacagggguuggaauagagacugagggaauggccaaccaauaacuggcucaacuugagacccaucccaugggcaagcaccaaucccuggcacuauuaaugauagucuguuauguuugcaaucaggagucuagcauggcuguccucugagaggcuucacccagcagcugacucagacagaugcagacacccacagccaaacaguagauggaccuuggggacucauggaagaaauggaaggaaggacuguggguccuaaaaggguuaggaacuccauaggaagaccaacagggucaauuaaccuggaucuuuggagcucucagagacugaaccaccaaccaaagagcauacacaggcuggaccgagaccccccugaucauauguagcagacauggguccccaacaacuggacugugcgggguggaggcuuucccaaaaguuguugccuauacaugggauauguucuaguuggguugccuugucuggccucagugggcgaggaugaggcuagcccugcagacuuaauaugucacgguggcucagaggagaaaaagagggggaauuuggggaguauuuugggagggggugaccaggaugggggcagugagagggacauaaaaugaauaaguaaaagaaaagaaaaaaaguguuguuuccuucagagguuuaagagaaguucccugagaaaaacauucuguggaggaagaggcuguacaccaaugagggcuauuugaagaggcuccacagggugaaggaaagucucaggacagaagcacagggugugagcgugcacugccaguuaguacaacgugguaaggacacagaacuaagcucauuucgugggacuauuaaacggccucuaaggcuguagauagaaauaccccagcaaacaacaacaaaugaguuaauagccaccaaggcugcacuacuguggggacucacucgcaucagggucaacacauuggaacugugacuaucaaggaacuaacagugaauaacuugccuuguuugauacuuaccacaagccuacagauaaggagacaggcauuagaccuugccauguaucccaugcugcacaccacugccucucauaagggcucccuccagaggcaggagucuguggcacuuagccagcacagacguugacaauggacagccgaagagaagggaggggaggcagugagacaggaagaaaaggugacccacaggugcccagagaaggcacacaggagaagcagggugaaggccacuguuauaaguuguguuuuuaauuaugaacuauuuugcauacacagaaaauaauuuaccuggagacuguggacuaccacucagacucagugugcuaauacacaggccuugcugcagaucuuucucuuaaacaguuucuacaucagucucuagauauagcuaaccucuuccucaagcccacucucuuccucuccucaccaauagugaccacauucuuaaguuagugucaucccaggucuuuuguauagggugugugguguguguauauguauaggccaaagguuggcaucaaagcucggcauagguggcuuccucugucacuuuuuauuuauucuucucucauauauuacauccucaccacaguuucuccucccuccucuccuccccaucucucccuccaccucuccucuccccuagauccaccacuccuccacuucccuucagaaaagagcaggccucccaggacaucaacgaacacagcauaaugaguuacaauaagacuaggcauagaccuucauaucacagcuggauggggcaacccaguaggaagaaaaggguucaaaagcagacaaaagagucagagacagucccugcucccacugugaggagucccauaagaacaccaagcuacacaaccauagcauagauguggaggaccuaggucagaccccugcaggcuuccugaucacuauuuuuugauauaaggucucuccuugaaccuggaguuuacugaucagguagccuggcuggccagagagcuuuaggaaucugucugcccacccauacccccagggcuagaguuacagauuuguguagcagcaccagacuuuuaucugugcaccagggagaguacucauucaaagaccuuguauuugcacaauaagugcuuuacaggaagccaucuuuccaagucccucccaugcuuuuaaaaauacguuuguugcauauaccuauacuacuauaguuuauauacaugucucugugugugugucugugugugucuguuugugucugugugugucugugugucuauguguaucugagucuguguacugagagacaagucucgaguauccgaauauggucugauccuguacacaguauguagcagaggaugaccuuuaagucuuugguggcuggaggcagagggggcaugaguuuaacaaaagcuuagcguuacguaucagguaggaagagaaccaagaaaagcuagaacauuuuuaaaaauuuaaacgaaaguccauuaaaaucccuccauacgcucacaagaacauuuucugacagcugcuuuacugcgcuccuugucaggaucuuuuucucgggucuccaaaagcuagacucaaagugaugaaagcagaguucacuaucaggugcuuuguuagcugugggaguggcuagaaucagcgugagguuccuuccugauggggucuguauaugggcaguuaaauuauuauauuuugucauuucucaggcaaaccacaauacaauccaagucuucaugugcugugucuuguaaagagaaugaucuaugguuggcuguggucaccuguucuguucucagaggaacaucuguagggucucuucguggccauauguuacuagaaauguggguagccccauauugguuaccauauguuaccaaggaaacuagaggucuuuccuccuguaaaugaaguggauuuggaaggaaauucaacuugcuuucucuguuuguauaggccaggggauucuagcuagggaauggcaccacccaccucagggaacauaagaucaucuucccacaggcaugcccagaggcccauuucccaugugaguccugauuuuuguuguuuuguguuuuugaaacagauaugucuugaacacucuuccugccucagccucccaaagcaaaaggacaagcaagggaugcagaaagcaccuggaacuagagagcuugccuuagaaaauccugcucaugcugggaagacaagggagaugacucacugggacagcucacagggaaggaagagggacccagcucaacuugguccgaguggaagugagaaagucucuguaucugcagucgauucuccucgagacuccuccuccucuugaacugucaacugaaaacgccagucacauccucaggcaauagcaucuuuccagcuugugaccuuagauuguuuaaaggcaaggugggcuacacagaugggcucagugauuacaagcacauacuggcuucuucaugcagagaaccugaguucuggucuuagcccccgcuugagguggcucacaaauaccuguaaaucuagcuccagggugauccagcuuucucuggcuucccugcccacccacacacacaugcacauaacgacacaaagacaugcaucauuaaaauaaaaucuguacaaaagac

SEQ ID NO: 1629 - RNA, 17455 nt, Mus musculus
cuugguuugaagaauauuucgguaaaguuuuugagauugaagcuagaggcugccaaaccgguaaagcagcugacaaaaauguuggcgcugguuggcaggucguuuuuuugauagcguccugaacaguugaucucuggacauuguaguuuacagauuuuagagcaaguugaucaguaaugagauuuaaaaucaaaccagaucuuccuccugaaaggaaaaaaaaucagaguugacauuucucuggaaaacagaauucauuccuuuuuuguuuuuguuuuuauaagcacagaacuagcaaugcuuuguugguagcgaucagugagccagaccugccugugaacuuacacucggaacuugugcagcguguuagcuuuguauuuuaauugguucuuuuguaauuugaauaacuuuguaagccugagcagccugaucugucaacuguucuuucuuuuggacugugugacaacaaucuguguuuguuacagaccuuuccccuacugcuucuuagccaguuucucuccuuacaauucaugccauuuuggacacaaguuauuaaaaucauuuccuugagcuaacacuuacucugauuuucuuuuuguuugcuguaaagagcacaggcuagugcuccguugaccaggcuugaucccacuccugagcugaaggggugguccugccccagccuacugaaaagucaugguaccugggaugggucucuuuugguuuugauuuugucuuuuaucguuuuuuaguuguagaaauucaguuaguauauguagcauaauguauuucucaguaguguauauuuguuacauuuuguguaugcgugccugugaccgugcgcacgcauucaggaaaaaacaaauuuugggaauugguuuucucuaauguggauccaggggauaaacucauuuuuaaaggcuuagcagcaagugccuuuacccaaugagccauuuugcuggcccucuagugccuuuuauacuuugauuuuauuauauuuuauuuuuuccuuuuuugggugccauauccagcagcugucuaaggguauugaauccccuguggcuucuuuuuuuuuuuuuuuaaagauuuauuuauuauuauauguaaguacacuguagcugucuucagacgcaccagaagagggagucagaucuuguuacagaugguugugagccaccauaugguugcugggauuugaacucuggaccuucggaagagcagucgggugcucuuacccacugagccaucucuccagcccccccuguggcuucuuuaaaggcaccugguaccguauuuucuuuguuacuuuaugaaaggaaccagcauuuugcucauuagcucuggguaaaacuuauuuggccuuuuuuaguuucuagaauuagggauuuaagaaagauuuuuuaaaaaguagcuguaaaagucaaguacugucuuuuuuuuuccugcuuuuucuccagucaaauacacuuccuuccuuuacacagguacucguuuuccauaucccuuguagccuggcaaagguauuuuauuguuuccaaaagagccucgguguacuucccgucugccaaaccauuguuaccuucuuuaagccaggcuuccuuuggaucuuugcuggcugaucugauggggcccucacuugcuauuauuuguguuuuauggugaucucuacuuguuagucuaacucuguucuuauguuggaaacucuuagugcugucauuuuauuucaaacuuuauagccuuguugacuguaucuugucuacauaguaagauaauaccuuuccccaauacucuucuuuuaucgcuaucgauuuguuaugcagaaccagcagguauugagacucgggaaagcacguuacccagaaggaaagauccuuuagccaguuuaccaaaacagcagagcaguuuuuaaaugacugagguuacacagcuguaggugcucuccuggcagcuaauaucaccuuuccacacccuguuuugcaauacuaguugggaaacuugcuuguaauccgcaggcccgaaugcaggaaggaaggaaauacuacugcaaagggguggcuaacuuguuaugcaaaugcuguccuucgggguuuaagcuuaguuuuuugccucuguguuacuaugcuuacagcaguaauauuuuaucacagacaaaagacuaguuugucacauguguuucucuaauucaguugggaucauugcugagauucccuuacauuuaugucaggagcaguagugugaucuucauagucagucauguuaggaagugauugacacauacuguaaggcagccauuaugauggaugauagugaugcagaaaggaagaagagaaaaauaacgauaguggcucacuacccugcuacugaggaccacccuuacagaauuuaaacuucagaaaagaaguuggcuuuuauuuuuaaaauuauuuuuaaaaaauauuuauuuuaugcauguaauuacauuguaacugucuucagacaccagaagagggcaucugaucacuuuacaagaugguugugagccaccaugugguugcugggaauugaacucaggaccucuggaacaauaaucaguguuccuaaccacugagccaccucuccaguccgucguaaacgauuuuauacaugcgugcgcacacccggcaagggacagcucucuuccucugugguucuggagauuaaucuacucagcuaucucacugcacccgaagucacccuuaaaauuuucuuaguuuuauuuauguguaucaguguugugcuugcaugugaauauguaccauguguauaccuggugccuaaggagaucagaaaagagugucagauuccccauaacuggaauugcauauggcugugagccaucaugugagaccuggguaccgaacccugggucaucugcaagagcaacaagugagccaaccauggagcugacucuuaacuuccaccucuguccucagaggucaacuuuuaaauaagucuaaauggugaugcuggaaaaaguuagaggaacuaccccugcuugccucuuuggguucugcaucugccuuucccauucuucugcuacacagaagauacaggcuauacacagaauaucacuaucuguguaccaacuguucuuggcuaucauuuagaucgcuguuuaaaugccaacaccauaaaaagauuuccuugaccaccaucucguguuuuuuucguagcuuaucacugguugcauaucuaucuaucuaucugucugucuauccaucugucuaugcaugaguguugggauguacaaacuaucccuccuccuccuccuccuccucuuccuccuccuccuccuccuccuccuccuccuccuccuccucuucuucuucuucuucuucuucuacuucuucuucuucuucuuccucucucucucucucucucucucucucucucucucucucugacagcauuucucuguguagcccuguagcccuggcuguccuggaacucacucugucuucucucccucccucccucccucccucccucccucccucccucccucucaagacaggguuucucugucuagcccuggcuguccuggaacucacuuuguagaccaggcuggucacugugucucuugugucuagaacaguuccuagcagccaggcagccaggucuucgguguaugcuuguuaagggacuaaguuaaauaaguguaacuauaaaggaggucugugcuaugggagccuuucaggagccugaccuacuauaaaauagcccuagggaagacuucugaguauuuuuaucugacuaaauaaucuaguagaggaaaaauuguuucuguuuuauguaacagccuaauuguaaauguucuaugucaaagugguguccaagcuuauuaaucugcucucugcugcagggccacucacagacccgggcuucuuccagcuuguuacucuacuaguacuugggugucaucucaggguagaagcuuggaucucugaaagccuuauuuuaugcauuguucucaacuggugaggaagacuggucaacauagucuagccaugugccuaauaaaggagaaaguagauuuuuagacaacucagcaagccuaacacacugaaguaagauuuauguggcaaagagaaggcuaagaagggacaugaaguucaguucaggaagagcaagcacauuauacaugaacaagcacauucuuccaagcacugaaacuuaggagagugugcccuggggaaagaguggauaaaauaaagccuugagaguaaucacaggucggacuuuauaaggugugcuaauuaaaaaaaaaagagagagagcuuuuggacuuuaucaugaaggcuuaaauggugggacagauguuuauuauuuuuccagaugugcauuuuuaagcaggcuaguaagugaagagugaccuggaaaagugagcucugacaagaugcuuaagagcaucacuuggggaugcuguguaggcugucugagagguucagaaggugaguguugagugaguagcgugggugggcuggaggaggcugagaggagucaaagguaguuaggguucuagcuuaagaacucucuuccuaaauuuucauuuugcguuuauguuuguagguaaauguguagagaccagguugauguugugugucucuauuaguaaccaucuucuguucugagacugggucuuucacugaaccuggaguuugccgauuggacagagagcuccagggaucugcccaucucuuucugacccagcccgccugcaccucagcaccucagcaccuaacugggugcuagggauugaacucagcuccucaugugcaccucaugugcuugcuuacugacaccccccccccccagcaccucuugucugucauuucuuucucuuuccuucuuuucuuuuccucccauuucuuucguuuguucuuuuguuuauuuuauuuauuuauuuuauuuuauuuuugugacaguguuucucuguguagcccuggcuguccuggaacuccuucuguagaccaggcuggccucgagaucugcuugccucugccuccugagugcuaggauuaaaggugugugccaccacugcccggcucuuguuuuacauuuacaaaaacuguauucuugagcuggaaacauggcuuagugagcagaggugcuuguuaggcgccuggccggguauccuuggaaccuauguaaaagcagaaaggagaacugauuccacacuguuguuuucugaccucuagacaggcacuguggcacauaugaccaccaccauggcauguauauacuuguaaauguaacuuuuauucuccugaaguaauugucucugaagcuuacugccuccaacugcuaaccuaggccuaguccuggaagcuucuagcuuccgaacaaucuuaucuaugucuagaauguuuucagcucugagacuuaaugcugaauuagcuaaauagcucaccuuuucuuguucuuucugaucucugguuggcugguucaaaacucagcuguucugucucgaacuccucgagaagcugacugauucaaucucucucucucucucucucucucucucugccucucuugaccucugcacuugaccucaaguuaacucuagcaaucguucuaucuucuggcuccuucuuguucucuggcuuuaccuaauauuuugucuuuaccuuuagcugugucuggcuuguucucucuucagccuguguagcccuggcuguccuggaacuuacucuguagaccaggcuggccuugaacucagaaaucugacuaccucugccucccaagugcuuggauuaaaggcgugcaccaccacugcugggcuucugcacugcaugaaguagcuucccucucauaagaguuggacagauccuauucugacaaaucuuucucugaucugcaacucaauuagacaucacuuucaaacauggcuggcugcuuccuucuacaaacuaacuugaccuucauugugugauaguaaagguguuuacuaagggcuugucuauauuacagccaaggggauuaaaguugugugcuaagggcggagccacaccacaacuagaaacagguuuuuccaguaaacaacacaaucuugggcuucacaaaugugaucaaauguccuguaauauauacacucacuaauaauauauauaauaaaugaaagcauguucuuuuacuucccugucuaauguuaagaauguguaucagaguguauauuggagaauguauacuuccuugaccaucuaagucaggacugaugacuggaagaacucaauauaaaauauugguuuuagguuauuuaggucaucgguuguuaaauugugccagagaggaaagaugacauugaacaaaagcagcaugaauuuaguauagguacaugggggaggggaugaggaaguuacacacgccuuuagucccagcacuugggaggcagaggccggggcaucuuugaguuugaggccagccuggucuacaaagugagccuuaggacaaccagggcugcacagagaaacccuguuuugauaaaaggggacagaagcuuugagaaaaugauuaucuuugcugugacaccaaaccacuccaugcaguguuacaauuuuuuaacuccuuguggcaggaccaccugccuauaguaauugcagucuggagucuguagaguagagaagcucugaaauaaccguguuugaaagccuuuuuucagcaagggccagcucgcuuuugaguaguaaacacaaguacuaaacagccuuugccuauuaauucuaguuugggauuauugcagggagcaaauuuguuauuauaucacguuaguugucacuggaaagugauuuuugaaaugaaacuauugcuagauccaagaggugaaacauuucaggaagucagaaauagcauuugauuuauugggagcuaucuucuugugcacugaaaaguuugugguuuguuuaacagagcguucuauauagaaaaauacccacaguuguuaauucuaccccauauuuuuugggaaaucuuaccuagcaagagaauugauccucauuugcaaaggcagauuugugggacaguaucugugccuagaaaugacuuuuuaaauccucaccugaaagaguggaguauaaauaacaguauuggguuuucuaggccauuuugagucuguguuuacuucucaccuuguuacugaggucgagugagugucagccacaugaagagucucggugcugcaauauguaccugggagaagggcucaugaaauucugggguuuuuucuuuuguuuuugguucuguuuguuuguuugccugguguggacuagguguguuuuucugaguuaaguuauauucaaaauguccuagaacauguucucauguucucucccucuuucucccccucucuuucucucucuucucuaaggugauguugaauuaaaaacucgaaguuuuugcaauuuugcuauagggucaaaaguuggugauaacaucauucuaaagaugcaauauuuuuaaaggcuaccuaguuaugaacuuuacaaaaaaaaaaaauuggccaagcgucauggugccugcgaauccugcguucagaggguaucgagaggaggggcagaaguucaagggcauccucagguacaucguaaguuugaggccagccugagcucugugagagacagucggaaaaaacgggaacaauaaauaaaaggauauuugugaguucuuugcagugugacuuuaugaccuugucauuuuuguuuugaggaaggaucauaaaaccuaugcugaucucacagugaccacacuuagccugauuuuccugcccugcuuuucaaguucaaggacugccuguaugugcuaccaggaaccucugcccuuuuguaguugcugcaaacuguaaauuuuauauugcauaaauauuaugcuccuuguuuuugguugaauuuuuaaauuucuauuucaguagggaaaacaaaucgaugauuuaccuacuguuuuuuaguuuggcucaauuuuaugauggcaaguaaugcuuugcauguauuuuaauagguaaauuuaguaaaggaacuacuugguuucagguuuuuuuuuuauauuugguuuuuuacauaggugaugaaaguaggccaagaugcuuugcauauucaugacuuuguaaguugaagugcacuggccuuagcuuucaacuugugcuuuuuuucucuuugagguucauauaaauuauggaaacucuugcuuagaguaaauucaagcaccauuuuagaaauugaagguuggagauacauuuuuucuuugcagcugacuccauugcagauagcuuuaaguuguaaucaagcacaaagaagugcacacguguccccccuccccgcucgcucuuuauacacagugccagggaucaaaucccagucccgugcauucugggcaaacacuauuucagaccucagcuucagcccuacacagugcuuuugaugcucuguaacauccguugucauguuuccuuccuuucuaauuguauguuuauuuacuuaugacuuguaaaauugugcuauguggguuugaguggugacuucacccauaucauaagaaccaugcagauaaaacagaaggauguguaaaaaaacaaaacaaaacaaaaaacaaagcaaaacauuugagaauacagcaguuuauauacgaaugauagugaguuguagauaaugaaguugguaggcaggagucccgucuuuuuuccagcaaauacugcguuuauguuacacuaauagaauguggaaggaccugggugauagaagugaagaagaaaacagaaggcaaucuauaguggaagggauggcuguggaucacugagauguuggggugugugugggugagagagaggaagagaagaguuuuguguuagcagccagauggaguugcuuugcaggaacuagugagcuggguauaguggcauaugccuguaaucucagcccucaagaggcugagguaggaggaggcgaguccaaguggggaugcuggccagcaaggacauucagagagguuucuggagagucuguguacauguuuguguguuugcagguacuacgggcauguauguaggcuagugguggcugucaugugucuuguucaauugcuccccauaugaguuuacugauugagcuagacuggacggccaccaagccucaggaaacuugucuccaucuccccucuguugggauuacaggugcauauugcugugccuggucuuuuuugugggugcauacaucuuaacgcagguccucaucaccccacugaucuagccaucuuccuugccucuuggugaacauuuuuaucuccacccccauguacugaggguugaaucagugcuuuccacauguuaaacuuuacaagcuaagcuaacuuucuaccacugagcuauagucccagcuacugccauacccacucuuucuuguuguuauuuuuguuuuucaacuuuauuuugaaacagggucucucacuaaguuacacagacuggccuuaaauucagucuguagcuuaccuucuuuugauucuccugucucagccucuugagaaguugggauuaaaggccugcaccacaagaucuguuuugaagaucuuuuagcuuuaaugcccaaagaauggaaaacuucugggggaaaugggaagagauuaagaaaagacugcuucuagccugcuguuuaaaagcaaagaugucaaaaguucaaugcccuccucagcuacauagcaagcuugagggcauccuggauacuaaagguccugucucaaaaacaaaacaacaaaaaacaaccccagcaacaaacaaaagcaaagaaucccuugaguauuuaaggcaguucauaagaggcuguuugcaucgugaacuagcaugguggaaaaaaaugggugacuugaauuauacuuagacuguaguucagccaaguaguaguuugugaagaaagggagaagagugaguccauauaaugaguaugugccagaagcuaccgcuuugccuauguuaaauagcugcguucucugaauagcuccaagagguggcuauugcuagcgcugguguacagaagaggaagcugaggcucguuguccccugguuuuuggcuugcgugacuggguguuuguuguauuccauaagugagaggaaauugagagugcaguggaggcuuguaaauuuaaucuuggacguacagaauuuaaggugucugucuuauaaucaagugggcauaagauaagacuuggauaagauuugcagauuuggugauaagaguagaaagaggagucgagaagaggagucuggauuugagauagaauuuuuuagauuuuuuuucucuuuuuuugcaagggacauacuagguuauaauuacugcaaagagggaaaguauaggucuagaaaagggguuaacugucgagcuucaaggccucugaaguccugauggcaaucugagaaccgaugaauaugugcuagggcuggguguuugggcucuauucuuuaaacaaaacagcuucgaguguagucuugggcuuacugagcuugagggauccguaggauacucagggcaguuggacuguucucacuuccucuccccauaucuucuuuacguucuuuacaguucucucucccucuuucucuucccucccccaacccccaauguaguccagcaugauuucacggaugugauaaguaugucaugggaagacugugggaaggcuguggaggacauaggacaacugcugggaucaccugucuccuuccaccauaagugucugggaagaaaacucagguuguugggauuguccgcaaagcacugagcuacgccaccaccugaucgugucuuguucuaagaguaacuuucuguagaguaacuucuucagaagauacucuacccuggucaucagcugguugauuucuuuuggucaguggcaaucauuuccaguguuagagaauagaacacuauuuuauguuugacuuguacagaguaguuagccuuugcuuuggcacaguauggacacuauaugugugacuugccuuugagaggagggagacaguacaguguggucuuaucagcuacaccuguucucacaugagcuguuggugagcuucgcaucgugagcccuguggucucauucuuccuucucuccguguagguauggccucacagcugcagguguuuucgcccccaucagugucgucgagugccuucugcagugcaaagaaacugaaaauagagcccucuggcugggauguuucaggacagagcagcaacgacaaauacuauacccacagcaaaacccucccagcuacacaagggcaagccagcuccucucaccagguagcaaauuucaaucuuccugcuuacgaccagggccuccuucucccagcuccugccguggagcauauugugguaacagcugcugauagcucaggcagcgccgcuacagcaaccuuccaaagcagccagacccugacucacaggagcaacguuucuuugcuugagccauaucaaaaauguggauugaagagaaagagugaggaaguggagagcaacgguagcgugcagaucauagaagaacaccccccucucaugcugcagaacagaaccguggugggugcugcugccacgaccaccacugugaccaccaagaguagcaguuccagcggagaaggggauuaccagcugguccagcaugagauccuuugcucuaugaccaacagcuaugaaguccuggaguuccuaggccgggggacauuuggacagguggcaaagugcuggaagcggagcaccaaggaaauuguggccauuaagaucuugaagaaccaccccuccuaugccagacaaggacagauugaagugagcauccuuucccgccuaagcagugaaaaugcugaugaguauaacuuuguccguucuuaugaguguuuucagcacaagaaucauaccugccuuguguuugagauguuggagcagaacuuguacgauuuucuaaagcagaacaaguuuagcccacugccacucaaguacauaagaccaaucuugcagcagguggccacagcccugaugaagcugaagagucuuggucugauucaugcugaccuuaaaccugaaaacauaaugcuagucgauccaguucgccaacccuaccgagugaaggucauugacuuugguucugcuagucauguuuccaaagccguguguucaaccuaccugcaaucacgcuacuacaggcaaguacaaaauacugugcuuaacacgcauaggauagaacuguaacuguucuacccaggagccuacuuauuucuagauuccaagauggcagcaggauuugucucagcuuacguguauaugugaaguuccuauaaguaacacacaauucuugcuucaauccuacuuaguacuagcaaauaacucacauuuaauucugaagauugcuggcugaauugugcuaguaucugguucauucuugacuaccauuacaucuaacuaacuuuucccacuugaaggacuguacagagaugaucaaucuuuacagauguuguuuuuccucagcucauaccuuuguauguaaaauguuuugggaauaucuuuagguuucaccuuagaagcaguuuauucuguuuuuuuuuuuuuuuuuuuucccuccugauagcaaaaauugaauuagaugauugcuguggucuucuguuugaacauucucaacaagauagcuuagugauuuuuauuucuagauuaguacuucuaauacaagauccuuuuaugauauucuuguaacaguacuuaaauguuguguacacaauuuuguguguacuauaaccaaggcuuuaaaauauucuuuuauuuuucagaucuuuauuuuaucuaguuauuaaucuuaaagaaucugauaccuaauuuaauauauauaaauugaauauugauuauacagguguccaaucaagaaaugagcaugggcugggguacguagcucagagauacagggcuugccuaaccugugugaggcugacuuuaaugcacccuaucccaaaauaaaaaccuccaccaaaaauaaguaguuaaccacaaaauauguuuucuuuuuuuuccuuugagggagguaucuuuuuugggggacaaggucugacugucuagccuggaacuuucuguauagaccaggcuagacuugaacucacagaucacagagaucugucugaguauuuggauuaguauauuuacuaucuguuuuuguuucuuuaagauuuauuuauuuauuauaaguaagugcacuguaguugucuucagacacuccagaagagggugucagaucuccuuacagaugguugugagccaccaugugguugcugggauuugaacucaggaucuucugaagagcagucaguucucuuaccggcugagccaucucuccagccccugguuuguuuuuuuaauuauuuuuauuuuauguuuauauuuuuugucaguaugugcgucuguguaccaagaguguaccuggugccugcagaggcaagauccaguccucuggcccuugaguuacgggugcuugugagcugucauguggaugcuaggaauugagcuuggguccucuggaagagcaaucagugcuccuaagcacugagcuaucuagcuagccccaucccuagauccuaugauucugaggucagucuauucuguaacacgcaucaggaugcuaccacuucucggguugagugguguuacauuguauguacuuacauuuguuuauccaucuuugauaggcacuuggguugucaccaccuuugggcuccugugagugaugcugcugugaacauugcugacuguguaucucaguucuuauucucaggccuauagaguguggguagacuugcuaggaccuagggaauuguaguagcuuugagaggcuacuagacuuuuccauuccuaccugcagcauaugggagacccaguuuccccauguauccuccaacacuugucauuuucuauguauuuuuauaguaguucucuuuaugaguauaaaggugucucagguaguuuugauuuccuaauuagugauacuaacaguuuuucaugcccuuauacuuuguuuggagggauauucauucuauuccucugaccaaauuuucaguugauuuuguuaaauuucagaaauuaaaaaaaaaccauucuagacacuaauagaugugauuuuucaaauauuuuugucucuguuuauaguuuuugaaccuguggcuaguauuuaauacgcagguguucugagccuugguagagucugguuugucugcuuuuuuuccuguuuauucuucagguaucuucauuacagagccagcaucauguaguuuaacuucuuuuugcuucuccaaucuugggcuuuuagcuacugcauuuagcuauuucauuuugagacaagguuuugcuguauaacccugguuguccuggcgucagugacucaggcuggcuuugaacucagcauuucuccuugccucagcacucauuggaagugcuuggauugcaggcugugcuacugcaccuuguccaguuguuauuguuuaaggugauggucagauuuaauucuccgugggauuguuuaguucacacgaugacuuuugcucuaaaaacugcuuguuccuccacugaguggucuugggagcuuugaccauauauuuaagagguccccccccccuccacugccugucuauaggguagauuuuucuauuuuuucuucagaaaacaucauagaauuuaauaaaaguaacauugacauaguacugacauuuuaaugauagucuuuuaauauauucucacuuaaaauuuuuuuauaguuuuauaaaacucugaccuguuuuacuugcaaggaacuuagagggccugugguuucugguuucccgccucucuuggcaaccucugcuaauuuugagaauuucacuucaguuuauuuaugacgugggauauuuaggauccaacuacauuugcucugauccccuuuaaguacucccccccacccccaccccuuauaguaccagugcaccgcaugccaucggguguugaaguaaguaugcccccccacccccaccccuuauaguaccagugcaccgcaugccaucggguguugaaguaaguaugcccccccacacccaccccuuauaguaccagugccccgcaugccaucgguguugaagggcuggugccguccggcucacuugacuggggaugcgcgggaucagcucuggcgggagcuugucagcucugccgcagucucggagugugcagguguucaguaaccguccuucagaaacaaccaagcagcuuuaaaacggaaaaaggcugaacaaaaggagaugcaagcuauuuuacaacaucauuuuuggcaccauuuuuacaucaaagcgaguugugggacagaguauccugcuuagccuucccugauuggcaauccacgugacuaauuuucaguauuagguugcuagucuuuggaccuuuuucguauccuuuuaauuuugguauugauuuuacaaaaaaauaagguuuccuaaguuuuaaaguguucuucaaagcgucuuacaaauuuagcuguuggcuuuaagaauacuuucaagaggaaguaaguuuccuucuuaaagguucauucuguucccacaccaucacugcgugcagcucaguggccaggggcugugacuggggcuaggauuugccugugugcucuguugucucacgguaguacuugauccuuaggcugugcaggccacuguguggcccuccucaccaccagucucuccucagugggccuuaagcugccucauaugccuguguugucagaggucacuaacaccuuagauucuugucuuuugcaaaucucugugaaacccuuggggcuggugaagcugccuucaaauccagcuuuuucacccuucuuuuaaguuuauguugcuuuguccugaugauaaguaugcucagcgacugcauauuuggcagaaauuugccacacuguuagccauaggcauggcaaaaugacccaggcccuggaaauguuucucuagccugcucauguacccugacuacuccaagcaaagcugcugucuuuggggcuugaguuuuagggacacaaguuugccacacuuaacagucccaaugcuuuuacuuuuuuaaacaaacuagcuagcauuuauuucaagcucagauuacuuuguuauuuaugggcagacacugccuaaaagagaaaaguauagcuuaauuuaucugauacaaacaaucuaauuuccugcaacagugaaacuacaguuucaauuuaagccacagaugcaugcaggaagucggacuuuauguaacaucucuaaucugguaaauaaguagauuuggugccucagaugggaagaaagaaacugagugugugaaaccaagcagagaaugauuugugcucccucgcuguggaugccagugaacaagggcucucugaccuuggaggagcuuuucaguaugaggaaguugaaagugcgaugaaccugcaggggcugcugcucugccacugggcucuuguaauuaugcccaguguuuguacuuuaagcaugggguuguacccucuaaguucucaaccuuccugaugcugcgacccuuuaauacaaauacucauguuguggugaccaccgaccauaaaauuauuuuugcugcuacuucauuacuguaauuugcuacuauuaugaauuguaaugaaaauaucauuauacaaaauaucugauauaagacccccaaggaggucacgacccacagguugagaaccacugcucgagggugacccacuacuuccaaagcacaauugacagcauuuuccuauugcaguaaacaccaucauggcugucauagcucuagcuuucuccugcccuuguagucuuuuauugccuuauguuuacuauaauuuuagagcugaaacagaugaguaauuaccuaacucuuccuuuuuuaaaauuuuaucuuauuuuugagacagagucucaguuauagcugggcuggccuuaaacacuuauuccuccugcuucuguuucuuuccuaagugcggagaccacaggugugugcuuggcucacccuucuuauacagaguaggaccaggguuuucauguccauaggaucaaaugcagggccuugugcuuguuaaagauguucccuagagaguggagagaaauuaaagccaagaggaaaauacugugaaaauaauuucaacaaucguaaucucagcuuggagguuaaugauguugucauuuuccaguaaaggggaaaugcuccuuccucacuuccuagaagugaaggugaauauuuauaguuuuagguccaagugaugaaaaacacccacugaagcuuucuuuuucuuuuuuccuuuucuuauucuuugccugccugccuuccugccuuccuuccucacccagcuccaguccacuuuuaucuguauaccuuuccguuaguuuaaguccugcgguuuucuguaguccuugccucugaggaagggagcgugguugucc

SEQ ID NO: 1630 - RNA, 1382 nt, Mus musculus
cgggcacaggucgccuagaggggagaggcccuccagccaggggcuggagccaagggaaacucaaacacugaaaggacccugguccccaagguggggcgugcccagcugggcagggggcggggccucggagcuggagcccgaaggcgauccugggagugcuuugccuggauccugggaguccagugcccagcuacuccgaacgguggagccacuaaaugggccuguuaaggcugaaacggauucuacggguuugaauuuguuaauucguucaaugaauguucuuaaaugauccauuggcgaaauccuguuaauugaggguaaaauacaguccagugcucgaaugcugugugaucucgggcaaguuagacagccugucggaaacaagcugagagugaagaucauuaauuacacuagcuacugaacuccaagaaugaagaaaacagugauccugcucucgaggagacugcagcuuagcgagagagacugacuagaagaucauuugaggaaagcgggaaggagauggauuaaaaaacaaccuggugccugcggagcuaaguccugacacugguggcuugaccuugaccagaucucugcuucgcgucugcuuguuuguaagaagguggaagaagugacucagaacaagggagaccucagaucucucccagcucuaauuuuucagaaacacuuaagcuuuuuuucuuccuucauugaacgcgugcuuucucgucuuuggaaugcccucuguucguaaauguuucaccucauccaaauagucguccaguauuucuuggaaaguguuuucucugaacuggggcacuugucucacuuuugugacagggcaugucuucugacucccuuuaaugauagcccuuauuuuaaacuccgaggagcucuacaaacuagaucaagcuucagacagcuacagugauuuccuucacaccauugaacuggggaaauaaaaacacuaaaugugggcuggacucaagaaacaauaagggaaguggagcccuggagcugcaggcuugggaccugccaggcagagacaggaccuuuaucuacacccugauggagagauugccagacuguaaccuucaguccuugauugucugcugagcagucacccaagagagaaacuacauuucuuuaauaccacccuccauccugcugaggcucccucuggccaaguggauuggaagccagauggccuucacacuuaugauggggguagagaaagcccagcgucuggaacccaauggaguaaauacuuuucacaggcaucauguggaucauucaaauagaccaacaucugaaauuuaaaaaaaaauuuaacuuguuuuauggacaacuaguuaauacuaauaaauuccugaaugaauacucga

SEQ ID NO: 1631 - RNA, 1382 nt, Mus musculus
ucgaguauucauucaggaauuuauuaguauuaacuaguuguccauaaaacaaguuaaauuuuuuuuuaaauuucagauguuggucuauuugaaugauccacaugaugccugugaaaaguauuuacuccauuggguuccagacgcugggcuuucucuacccccaucauaagugugaaggccaucuggcuuccaauccacuuggccagagggagccucagcaggauggagggugguauuaaagaaauguaguuucucucuugggugacugcucagcagacaaucaaggacugaagguuacagucuggcaaucucuccaucaggguguagauaaagguccugucucugccuggcaggucccaagccugcagcuccagggcuccacuucccuuauuguuucuugaguccagcccacauuuaguguuuuuauuuccccaguucaauggugugaaggaaaucacuguagcugucugaagcuugaucuaguuuguagagcuccucggaguuuaaaauaagggcuaucauuaaagggagucagaagacaugcccugucacaaaagugagacaagugccccaguucagagaaaacacuuuccaagaaauacuggacgacuauuuggaugaggugaaacauuuacgaacagagggcauuccaaagacgagaaagcacgcguucaaugaaggaagaaaaaaagcuuaaguguuucugaaaaauuagagcugggagagaucugaggucucccuuguucugagucacuucuuccaccuucuuacaaacaagcagacgcgaagcagagaucuggucaaggucaagccaccagugucaggacuuagcuccgcaggcaccagguuguuuuuuaauccaucuccuucccgcuuuccucaaaugaucuucuagucagucucucucgcuaagcugcagucuccucgagagcaggaucacuguuuucuucauucuuggaguucaguagcuaguguaauuaaugaucuucacucucagcuuguuuccgacaggcugucuaacuugcccgagaucacacagcauucgagcacuggacuguauuuuacccucaauuaacaggauuucgccaauggaucauuuaagaacauucauugaacgaauuaacaaauucaaacccguagaauccguuucagccuuaacaggcccauuuaguggcuccaccguucggaguagcugggcacuggacucccaggauccaggcaaagcacucccaggaucgccuucgggcuccagcuccgaggccccgcccccugcccagcugggcacgccccaccuuggggaccaggguccuuucaguguuugaguuucccuuggcuccagccccuggcuggagggccucuccccucuaggcgaccugugcccg

SEQ ID NO: 1632 - RNA, 19801 nt, Mus musculus
uggaccaagaagauuguuuuuuauagauuuagcaacacauauacacaucuaacaauuauaaagaggccaugaauuuguaugagaauaaggaaaacaugggagggguuugaaagagaaaaggggaaaaaugauuuaauuauaaacuaaaaaaaucaaaauauaauuuuguacauacuguucaucucagauggugaagauguucuuaauuuucagacuugacuggacacguuccugaucaguguaguuuaaguguacugauuugaaacucauucaguaauuuucccacucugcuauaugugacaguucaugcccagcucacaucuauuacccagcagccacggcuaugugaacugaaaggacuugagacaaaaucagcauucaaaggagugacggacaaggcucagagugcccacugcucccaggcccgcuuuacagcacagcugauagccacgauagagaaugaggaagggacagagaaggccucugcuaagugccacacaggcuucacuaacacugaccuuauguaaauccuauggacuguggcuuuagcccagugacagagcaauugcuggacccaauguuccuuuaaugggaaaaaccucaagacuaagcagcuaacaaaaaguuuaauagcaaguuccaguuuuauugcaguuuuggcuuuugauuauaaacuaagaauccuuucugaagaguguuggugacccuguaucauaaauccugggcucaacccugagcgcagacacaccugcccagcaaaugcagcuucgcgcgcucgcacacacacagagcucaaaauuccaccaucaacagagacuuucauuuuuauagaagagaaagguucacagaaguaugacauggcuucacagaagauaagaguccaaaccaguugaugucuguguaaacuuucaagguuuccucucuaaauucucaccacauucucaccacaacacuuuauauugcaaggugguucccacagugucuuaaggcuaacagcaucaggggaucucagcucaagaugcggucuuaaaauccuucccugcuugucuuaacuaaaggaggaaaaucaacauaaaaugaaccauauguacgagucaagguauauaaauggacgauucaauauuagaaagguuaaaauaaaauaaaaauuaguaagaaugaagacaaaaauaacaugucucacaaauaaacaugcggaagaacuguuuucuaaaaauaaaauaaauguuuuauuuggaaaaagucagcuucuuacacaagguuuuaaaucuauauucacccugucaauuacaaugguauuuuaaacacauugaguacaauucagugucauaugucuuauuuuuuucugccucuauucagaagacaucagguuaaaaaaaaaaaaaacccaaaacacuguaguuccaaucugguccaucuuuccucuuauccuuacacugaacccauuuuucuacauuucaggugagugaaagggucaugaaaguuaagguguggagguaagacuaugucaaauaaucguaaagcaugauacaaguucucagcaaacuuccucccauuuuaucuuuauuggcuucccugaggccaaacucuaacccucgugguuuugcaaauacugaaaaacaauguaaaaaaaacaaaagcacauccauucagucgguacugaaucaucccacauacagcucuaaacuaguagugguauaaauggaacuaucaaaaaccaagagaaaagguuucaggggucaaggagaaggauuccagggugccuguggguuguggcucagugguacagcaugcacuuagcaugcuuguggcccuggguucaaaccuaagaaccaacaccucagagccccucaaacccacacauaccuaagauucucauaccguaacuaagguuuggggaaaccuacacugaauucagcugcugcuugaaauacugcauacauuaaaucagacguguuaaagaguuguuuuguagauguuaauacuaaccuuuugcaguugauuucagugucucugaauaggagcaaaggugacaguuuagugauaacacuucagcacgaggcuguaguaagcauuugagaagugcccagcaggugacaggcuguggcuggaacugccaagauguucccaaaauuuuauguuucaaauuucuuaaauauauaccuagcagguggauaugccaggcaacuauaaugcuagaaaaauacuuuagucaguauuuuauaaaccugcgacuuuuaaccaauaccucuauucauaaauguuccaguaacaaugucugacaaagcauuacaaacaacaacaaaacaagauuaagguuaguuaccucaagcaagcuaguuguuauuuuuccuuuuaaaaugacauuuaaaacaaaugaauucagcagaaugguuuuaaaaguuaaggcucucuaaagaguucuaaaaacuaaaacuuaaggcacauauuauaaucuucaugacacuguuaaaagcuaagauuaaaacaaaacaaacaaacaaaaagaaaaucacuacuucuuucccauauccuuugccaaccacucccuaccuaaagcauaguauauuuuaaauucaggcauugguaaggagugaaaaaaaaaaucccaccaaugaacacccgguagguuuuccacacaaauguccacugucugcacugagcaccacugguagacuagaggccagcaggaugguuuuggaugucgugggucacacgcugcucucuccaggcuucacaggucagacagggcucuccuccucugugggguccccggagcugugcugcugcggcgacugugcagcuuucaucgucuccuuuggcuucucgucgacaucggugcuggccucguccucuuuuccuucccuuuucugcuucuccuccgcuuucuguucuuuggcaagaagucgauaguugaugcccaugccaaugaagagauagauacccgcgaugaugaggaucacgccacaagcccaguacguguauuuguagucuccauacaugucauugaggcggccuaagaugcagaagacaaggcuauguggguaagagcaagcaagugcaaggaucuacucagaaagaugcagagcaaccuucagagcccacaaccuaaggaccaaaaaugaacugcaagauuuucuauuuauaguguuccugauuuugacuggccuuguauuuucuauuuucaaauuggcaacaauuaacucuuggcaaaucucaaugauaaaugucagagaucacaauccauuuucucacugcacaaaggguaaacuguaauucaaaggaaguuugaguguccaaggccacacagaucuacuccaaucaccaaggccaaaguucuuuaucagcacuuccggagaacacugcucuguagccaaacagcacacucucagcaccgaaucuacaauuuaucuccagcaguuacagaaauucaaguacagcaacaguaaguuucugcuucgaggucacaggacuaguaagggaacacagggucugaguugaggccugcaccugcuaccuuggugcgugcuacaggaagccccucuacuguuuugacaccaaaugaauuuggaaaauggcucaucacacacauucucucccaaacgcuugugcgguuugacaguaaugaugccgcuugaccaaucugaaaggaacucuauauggcuauuuuacaaacugacaagugcuacagggagagaucugggaccagaacaagggcguggagacgagugaagaagugaggcaugcugcuccuucugaagcugaggcagcaggaagauggaaaagauccaggccgaacagccauugcaaagcauagggugugagcaagaaagcaaggguuggaucuuagggcagagagcgagaaggcaggguaggaaacaggcuggauagacagauggggccaagcucuguagagccuuggaggccauauuagggaacgagccacuccaaaacaggaguugguagaagaggggcagacaugguaaagaaaggggcagauuagaaagggugggggugaaaacugauaugaacuggcaguucaccagggagagcuggaaggaguacuaucaaagcaucuguaagucugguggcaugugccuguaaucgcagcaguugaggggaggacacggaagggucaggagguccuggcaaucuuuggcuauaagaauuuuaagguaaguugguuaaaaucuuaucuauaaauuaaucaccacaaauaucuaaaaggagguugggacauuugggaggaucuuguugugcaggccaaugcugaucuugaacucauaaucaucuugccugagcgucuaagugcuggaauaacaggugugcgccaucaguccuacaugggauuuuuaaaaaguuuaagccagguggugggggugcaugccucuaaucucagcacuugggaggcagaaggaucuuggcauuugggaccaguuuggucuauagaguucuaggacagccagagagcuacacauaaacuuugcuuugaaacaaacaaacaaacaaacaaacaaaaaaaccaacacuacccccccucaaaaaaaacccuaaaacauucaaagagaaaguuuaguaacccaagcucucaaauuauauaaugacucauaaacuaaaguaacugaacagaauuaucuauggaacugcuacuaaaauaacccuaagcuuugugaguccaagaugcacagggguuaggaaggacgguggcugguacacuugaugccacggaagaggacgucuuccgccugccugacuacugcugcaaugugcacuauuacaaagcucagcucucaacucugcuuuaaagguagacaugcuuuucacaccuaguuuuauaacuggaucagaaacaaaaauguagggagacauacuauaccuaaaagugguggcccuaggaggacagggcagcauuccacaauggucaccaagcccacagcacuggagaaccucugggguccaaugagguccaucaauguuucaaauaauacagagcugagccaaccaaaggcaaauccaaagacuccggcguagacacagaacccaacguagguuguagacaaaggggcaagcaaauggcacacuccauuugcaacaacagaagcagcaaaaaaguacuggauccgaggucugauccacuugguguuggcugcaagucccauggacggucuggcuaccauaucaacaaaagccaaaauggaaagaaggaaggcugauuucucacuggaaaaauccuuacucuuaccauaacuacuaagaaagaccaaagggguaaagaguccaaaaaacaugaccacauuuccagacagguacaguaaaaagccccuauggguaaacagcgacaaguccaggaauuuguuaauuguuuggaagacggacagcuuuucuccuuugggacuuccuccaaugagaucuguauuugcaucagauuuuccagcuuccuguagagauucuuuggacuugaguuuuucuagcuugacuugcucaggcccuauuggucucaucagggauccagcuacacaacaauuuaggaggaggcccccaagaauuaggaagcuuccucuccagucaaaaauaucaaagaaagccugauuaaguggagccaggguagagaggaacacagggcugccugccauggccaguccguuggccaguggucgcuucuuguagaaauacuugccaaucauagucagagcuggguucaaguugaaagcaagcccaagaccuagggaaaggagcagagauagcacacacugucauaaacagaaguaucucuucaauuacuuacuaagcaaagacauuagaguaaguggggcauggcuaaggcauguauuccucuugcaguauccauacugggaagcuuauagccaccuuguaacuccagcuccaggaaauguggugcuugugaccuggcuaaaccugucuccuggauccagcuauauacuauaaacccugucuugauacaguuauguacaguuaacccuuuucaacuguauauaauaaccaugcugagauuucuagaauugccuaucugaucccagcuuuccucucuauguacuguguguccuuccuucauucccucacugccccaauaagaucaauuccuggagcugggcuagauguggcaaacuuuguucugucucaaauauugaaugacauuaauaaucgccguucguaauauauaguuaacugaagaaaaaugacaaaauacacucauccucuuuggucuaaacaagcaaacaaaaaaagguuaguuuuguacacugaagaaaauguauggcagcccauacauuugaacauuauaauauucaacagcucauuuuccuaacuggaugacuaaauaaaaacugagaagacccuuaaccuucagaagugaaggaugaagcaugcaccauauccuauuaaaauaaaagccuauuccucaugggaaaaggagguuaggggagaacagccaaugaccacccuuccaugaaucacugcauaaacuuuaucucacaucccuagcuguccuggaauucauucuguaggccaggcugacucugccugccucugcuucccaagugcuggcauuacaugugccaccugcccggcuaccacugucuauucuuaaaaugaugcaauugucucuuaaauuaaauuagcaauagcuacauauuacauggcaguaguuuauucuguuuaaucuugccggacauggugugucuuagucaggguuucuauuccugcacaaacaucaugaccaagaagcaaguuggggaggaaaggauuuauucggcuuacacucccaugcugcuguucaucaccaaaggaagucaggacuggaacucaagcaggucugggagcaggagcugaugcagaggucauggagggauguucuuuacuggcuugccucaccuggcuugcucagccugcuuucuuauagaaccaagacuaccagcccugagauggucccacccacaagaggccuuucccccuugaucacuaauugagaaaaugccuuacaguuggaucucauggaggcauuuccucaacugaagcuccuuucucugugauaacuccaguugugucaaguugacacaaaacuagccaauacauggugcaagggcaggcauaggcagauaaaucugaguuugaggccagccugguuuacauagcaaguuucagcccagccaaggcuacacaguugaccuugucuucuaaaugaaaaaaaaaaacaauuuuauguguguaugggcaugcccaugccauggugugagagaggaaggcugccccuaccagauuugguucaucccuuacaccauggggucaggggaaggcucaagcuuccuuuacccucugagccaccucacuaguacucagugagcagcucucuaaaaugacaagucagaaucaaacagugacaauaaauaaauaugaaaugaaucaguagccacucaccuccaauaacaccaaugcacaaguaaaguuccuguacuguguuacagaaagaagcugcgaucaagccgcaaccagacagacaaccaccagcgaucauuacuggacggcugccguauuuauucaccaagauacugcugauaggaccuaggagagaaccaaaaauguaguaguacaaauucccacaucuauaaaagaaaggcuaaaugcgaagguagaucauuucaacuaggaaacuaauaaguccaucaccaugguucacaagccuggcagcugcauuuugugccauuguaugaggcacaccuucaaacucuaacaaacauuuucugcugguuacaaaaugaaguauuaaacucauuuauuuggaaauuuaaaaaauugaauuucacacuuuaaagauauggacuugaggaacaaaugacugcuuacaggacacuggaagcugccagguuacagcggacacuggaugacuggguuccauccucacaugguaggggaaaaaaaucauguuaaaauucaauccaaaagcaagaguacuaaguagcaagaggcaagaucuuuaggaaauaauuaggucagacagagccucaugaguuuaucaagcaucuuucugaaagagggcugaggaacguaucuuuccuccugccacgugaggcaacuaacaacucaaggaacaggcccuuaccagaggccuaaugaaugaaagaaaguagcuaguuccugauaucacaggucacuuggaaacuuaaguuuacagucuguauaggacauugauagaauaucuuguuagauaucucacaagacaacauggaacacugccaaccuggcuaaacaaaaauacuuugccccagaauuccucaaguuuuaugguagguuuaacuuucauguuuaauugugguuugacaucuccagguaaaauaaacacguuuuaaauaagcaauuuacuuucuacauagccuucacaccaugccaaagaaaacaaaaaggaaaauagauacaauucaaguuuaagugcagccaaaaugccuuuagagccuacaacaucacaggaacaagugaagauuuuauucagcuggucucuugggugugcacaugcauaugaggaugcgagccaaaggggccgggggugggguggggugggggggcucgccgguuguccucaccucucugugcuugugggacaagccuaguccuuaaauuacaaauuuuaccugagacuuugaacuauacuaguuccagacacuugaguaacuuuuuaaaaucuugcaacucaauauuuaaaauguuuacuuuucaaguaucuggcagagagcaagagaaaugaaguuugcacuucauuucugcuccaaaaagccacaaugggauaagggcguaagagcugccaguguugucagagaugaaaagcacgcuuaauacaacacuucaggaaguaacacugagcaagagaguaaaauguccagacucuggcugcccaacguaagucagacguaagucagaggagcgguggguacucaccuccagcauacaugacagccaacauuauagaugauauccaugauacuucacuggucguugcacugaauauaacuucuaucucuuuaaagaagacagugauggauuugggaaaugcauaggagaagccaauagaaaugaaggcuccgacuaacacugcccacccccagccuccaucuggggggguguaucccacuggcccuccaaucgcagguggcauuuuaaguguagaugaauuccaagaugcagcgcaaaucuaguaucugaaggauaugaaguagaaaaaacuuaugucagcaacaaaacaaccuccacaaaucccuuuucugcacuaaaggccuuucaacaaacagaaugaggaaguaucuuguuggguuuuguuucagucaagggaaggauacauagugagacccuaucuucaaaguggggggggcaaggggagcaacaaaccucucacccuacaacuccaauggacugauacucuuacucuuauguuuugguuuccaaucuuuuguuucuuuguaguuuauuuuaugugauuuuuuaaaaaaaugguucucuuguuaucaguguugggugacacuuuguggaaaauaaacaccacguacuguaaaguggccaguuuucacaaccaagcaaaacaaauuucugucaauaaauuacaugucaauugugauaaccaucucaauucuaacuaggaaaucagcaaagcaggaguuuugacuggccguaugggagaaggucuuuuuuuuuaaagguccaagaucuuuuuuaaaaauugguugccuuaagagaggaccacaugcugcccaggcugacuucaaacuucuguguuugaggcuggccucgaacuccugguucugcuucuagcuucuaagugcuggaauuauagggauuuuaaaaaacauacccaguuuuguuaucaguguaccacauacugagugucacuaacauuugcucagauugcacccccauucucgugucagucagucugccccuucuucccaaucuccauuccaccuccaugucuuauguacauguguacauugucuaagagagaagacaugagagcugcuuuuucuuccuucucucacuccagaaaccucucugauuucugacaaaggguucucccuagaucuauguaguuacaaauucuuccuuccuuuggggacccagcuuuucauugcaagagacagugaaccccagcacaauacaggaugaguaaaguuacacuucuucuguaauagggguaggucgacaaagaccucagguacccagguucuuagaaaauauggcuuuuuaucauauuuaguucuaucuaaauauuaaggaucuggauugauuuuuuacaaacauagccugggggugggguauggggaucuguuguaggaaauuucauucaggccagauaaaaacaucuuuacaagccaagguuucuuaaaaauuguaccugauugaauaaaaaaaagcuacuuaacauaggugugcugguagauuuaaaucugcgagguucaagugcuccaggcacccauccucucucuccuuuaucugagcauaaagccacugcuuuacguuuuucaaggaacuacuaaaaagaucucaggaguauuuacauacacgaaaaacaccuacacgcaggcagcagcgcugucuaacacaucaagcccugacuagaacagcaauacgugcuggacgugauuaaacuuugugcuuagcugccagcuaugguuugucccaauuaaaaggcagcucuaauuuucagucacgaagacuugccucaucaaguuaauaaaagcuuuucuacagaaucuagauuuucaacuuuuaaguagcuuuaggaagauucacaaguaaaucaaugucaaaauagguuuuuugggggguaggggugggaggaggcagaacagcaaacauuuaaaaauuccauaaacagauucaauacaguucuaccaucaccugacaaauaauuguuacaauuaacauaaaauucugauuaaaagucuccauuuauaccagcauuucuucuuacacagaaggccuuaucccaaaagaaaauuauuggacuagaaccuuugcuuguaguucaguaaaagggaacacuauaaaccuuacauguuaaagucccgaggcugaaugauagaacaaaagucuuuaagauuuuaaucuuauagugugcagcagccccgcaguuuaaacguuacugccuuaaaguaacaggaggguaaaaaauaagugacugaaugguaagaugugccuucuaaaggcuaagcauaguguggcauaccugccccggguggagagcagaggcaggaggaucuucugcauucugagaccaguuuggucuacagaguauuucccaaacacccagaucuacaugagacucuaucccccaaacccaacacacacacaaauuacaccagugguuagagacauagcucaguaguuaaaaacacaugcuauucuugcaaaggaccucaguucaguugccaacacccacuuugggugguucauaagcaccaggcuauccagcucugaggacacccaccaucacaugcacauucucccacacaaacacagggguuggggggcgggggagggggaagaauacauuauacuaucaagccaauguuguacuccagcccccauucccuggauucucuccagaaguuacaaaagcccuaggaaacuauuaauuucccuguacucucauacuacuuccuaaagagaagaggcaggagaacagcaagcaugcugugaguguaaaagauauagaauguaucuaaagcucaauguacauuacuaagcauaaacuaguuucuggcuucaaauucagacacucagaucccuaagacugauugauuuuauuaacaugguaaccuccuguuuaacuguucugaucuagcuucuuguacaaaguggccccagagagagagagagagagagagagagagagagagagagagagagagagaagagagagagacagaaugagaaugaaugaauuaagcuggaaguguaucucauuagcagaaugcacagggccuuggguuuaaucccaagcaguuacugccccuaacccccaaccaaaaaaaaaaaaaaaaaaacccgggguguggggaggaacaucuaugaaaaguagacgacuccuggaccggaguaacaaaacacucaucaaucacaauuagauaaucuuaaucauacugcauaaagaaacaccacacaaaauguaagcgugccucuacaaacuucuacuugcuucugccuacugaguagcaggacugaaaccaugcacuaccaugcccagcugacacuguuuuaggacucuacacagcuuggugggcaaagguacuucuccaggcaagucuggccaucucaguuugacuccuggaaucuucaacaaguugacuccaaagguguccucucuuccacaugaauggcacagcauauaugucugcauauauacaucaugcacacagucauacaguaauuuaggccuaaauaagaaaagacaauucugucauuuguacauggauggaccucaaggacacuugcugaauaaaauaaaccagcuccagaaaaagaaauacuguauuuuuaugugucaguucaagugugauacugcucuacauuguguuucuuuuuucuuuuuuuuuucuuuuuuguaaaagacuuauugcuaaauacacugaacacuaacuaggcaagcacucaccaacugaacugaacuacaucaugcccagccuuuaaacagccuuccuaauuacugaugauauaaaccucacacuauguugucauuaaaauaauuacuggguuuuuuauuagaaauauacaauuuccaaaugaguaccugauuucccucaaauuagaguaauuauuaaaccacuugcuucccuucuacucaacuaagguuucuaagugacagagagcuaagaguaaguacuauaauauaaucagaagaggcugaaggaaggaugugugcuucuaaucggcaagaauuucaaggcugacguucaaugaccucuuuagagguucuuccaacuguauaguucaaugaaugugaaguauauuugcugaugugaacugaaccuacuggaaacagggccagaaagcccaagucaaauuaagacacccauuuaauugguggcaccucacuuucuaauugaaaaauauucuguuugaauuugugacuuaaccugugacguuaugauuacauaauccuaugacacgaucucucugcugugugucuuuauaggucuggcuagccucacucucacagggaacaggaguaacgcucgcuuccccuaaggggugucagauucuuggggcacuuuggcaauaccuguggaacucaucagaauacacuuuuaaacuggguauggcagggcacaccuguaaucccagucucuggaggcuagagaaggaggaggaauuguaauccucauagugaguucaagaccagucuaggcuacaaagugagccccauccuuaaaaaaaaaaaaaaaaaaaaaaaccaaaaccaacaaaaaaaacaagaguaaauguauauaugcauaagaaaaaucaaaauuauaucugucaaaacauuuuuaauuggacauuguuaagugcuaguggugauuuugaaauggugccaauuucaaucugugucuaacagcuaauaaagucugagauuuacuaguuucaaaguugcaggcacuaacacaacaagccuacacccguagcugugauuccaacaaauuuacaaacucuacugaacuccacacaccuuagagauuaauccugcacacugguaaguuuaaaaucucugauaaggugaaaaaauaaauaaaaagcccuuccuauaugaaaauaaaagagaaaacuaaguaaaaacauugcuuugguucucaaaccccaguaacugggcuggcaagaugacucggcaaguaaugcacuugccacugugccugacaaccaguuugaucccagggacccacauggugagaaucaacucuugcaagguguccucuuugcuccacaggaauccaaaaagaaaaccuagcuggaugguggugguugguaggcagaggcaggcugaccucagauuuugaggcuagccuggucuauagagugaguuucaggauagccaaagcaacaagaagaauccuuuuuuaaaaauuuuuuuuuaaaaaaagaaagaccuuuacucuccaagauaguuuacaaacaacagugugauuuucuucaauuuuuaaaauguauucaaagagaaagacugucccuguguaaagguguguguggacagcacuccuguggaggucagaggaaaacuauccugaguuggguucucuccugccaccuuguggacccaggaguauaaugcaagcggucaggccugcaaagaacuaccucuaccaaccgacuaaagguuccauucauucuauuauguacuggguucuauccuguuaugauuugaaagcagaauguuccucacagguucauauaucugaacacuaagucacuagcugguggcaguguuuggggaaguugaggaccuuuaggagauaagaccuagcuaggaguguguccuagaggcagguguggagggcuauagcauagcucugcuuccugauuggccagaugugagcaagcagccuuaugcugcugccuguuuccugcugccaugccuuccucacucucaugugauacucaaacccugggcugaaagaaagccugacucccucaaguugcuucuuggagguaucuuggucacaacuaugaggaaaguaaccaauacacaucuccaauauuccaaacccacaaacgaacaccaccaaccaccagaggcaaaaccgaagcauggaaaagauuugcuuuucaaccaaugaucaguuaugcaacuuacaauaccagaacauuuuaaaguucuuuucucuacaaaggcuaauucugucaaaucaaauugaacaauauuaugggcuguaauuagcaacaggguaguagugugacaauaaacaggacuggguccuguucacuauuuauggucaaugauauccuucaaaggccgagccuucauuacuuggugaagugagcuagcucauucugugacugugaguguugagcuuugaaacuccuuuuuguaugauaccagggcucacucuuacaguagaucccuuacaguagguuaucuacuguaagaucuaugaccugucaccacuccaccaaaagaaaaaaaaauuaaagcagagggaagaaaaugccacgugguuaagacaaauuaaagaacacacagaauuuaaaagauuguaauuauguaggccugguuguccuugaacucgguaugaagaacaugcuggccucaaacucacagaucuaccggcccccaccucuugagugguuuugauuagggagaugaccagaaacuguuagagcgguguagaaggaagaugauacaaucacagaagucaaaggcuguagcuuagucagaauacuugccuagcacauaugguggcucuagguuuguccuuaggagcacacaaaccagguauggugacuuagacaaucuuucagauacauagguuauuuggauccagcuuaggccacaugagauucucucugacaacaauaauaauaccacugaauuaaucacaaaacaaucuaaacuggguaacacuaauaguaauggaagagagucagagaggcaaagaugauguggaagcuaccugugcguaggagaaguaggucuaccaggggaaguacuaagacgauguaagaguauuuaagcauggcuaccuggaagaacaguggaaucacaagauuaggguuccagggugaagaaguagaaaacagaauaaguauuagauuaaacuuaaaugccucagagguaacuggaaaagguagaucaaggcuccacugcuuaaaaacaccccucccccccccaagaacuugaagggcaucugaugaccugaguucaauccuuggaacucauauaagaguucauauaucauauuaaauaaaaauaggauuacaguuggcacgguggcucaugccuguggucuuacuaacacuuggaaaguggagacaggaggaucaugaguucaaaccaagccauucugguccacggcaagugugaggccagccuaggcuaucugagagggucucagaugcaaacaugcacauagaaagcugguaaaaaacuaaagugcaaucaaauuacugccuuuucaaaccaagaguagguugugaauacagcagaaagaaaaccaucacaugucuucaaguagaaauagcaaacaugaaagauacucgaucuccccuccuaaaccuuuucucagagauaaaaaccugacugcagugcuuggucuucaagugagcuuccaaugugaggaaacacaaagggcaggagauauacuaauuagaacauguuaaaacuaugccaggaggaccaacucagaaucccaagcacagaagacaagaaggaagaggaagaaaaagggccuaucucuuccaaauaaauuagacgagaaaccuauagauuucagacaaacauaugaccuuguuuguauccuugaucaagagaaccaauuacuaaaaaaccuaaacuaauacauagauauauauauaacuugggaaaaucugaauacggacagauaucuggugauguuaauuuuuaaaagcaggacaaugugacuccuaucuuucagauagcuauggauauaacuaaguuaguaaaguuauuauucuuucaucuaggauuugcuucacaaggaaaguaggaagggauagcgaugacacaggagugacucaaccgccugcuaauuagcauuuuccauacuuaaaguagagaagguaaagaggaaacaaaauaauuucaguuucaccaaugaaaacagacaagagggcagaaauggcuuugaauuuaaucuaugaguuuuauacauugggcaguucugguguagucacaguaccucaggauucccauugguuaaaaugaagauaaaaaaauuuauauuugcuccagcuagcaacuugaaccacauucuuaacuucacccguuucuuaucuccaacaccuaacuaguccccuacccaaaaccugcuuccuuccuuuucucaaggauuccccuagguauucauucacauauggucccacucuaaaaccccucuaaccagcuauccccagaaugauacuaaaaugcaaaucugcccagccacacuaaguucuuuuaacuguucagucucuuccuguggccuuacaaugacugaaggcacuccacuggcugacauuucuagucccucuuauuauuuuugaccuuucuauguuuuaguuuuugaugaaauucuuucagcuucaaaaaugcccuuucaaccuaucaccaccuaugccaaacuagcucccaccccuuuaucaaacugcagauuaaguaguauuuccucagagaugcaggcauaucuaguguuuccuuaaauugagcauuuucucacaccuauacaaaacaguguuuguucccaugguaaccuuacuuuccccuaaacuguuugcuaagaguacucaacuaccucugcuuuccagcuagacuacaaaccaaggguaaauacuagaaucuucuuuucugcugaaucuuaacuucucuauccacaauuuucaguuuuguguucaaguuccauauuccuaguccauauucccuaguaugggaaauaaaaaaagucaaguaggcauuauacggggacccagaccuugcaugaaaugcauaauaggaaguuccugaggcacagugggaaugaaaguuucaagaaguugggaaaauacuaaucuaacacuauuuuuugucagaguuuauagguauccaaguuuacaccaccuuaucccccacccugccccccuuaaucuguuuaggauuauguaaaucguacagcuaaagcuuuaaaacucucaaaaugcuccucaaacuaagaacuuucauauuuaacaaggucacaaucugauaaaccaacagcaucuacuuaaacccacaaugaaaugacugaaauacacuuaauuaaacauuuauucuaggacugggcaugguagcagacgcuuuuaauuccagcacuggggaagcagaagcagaucucuucugcgcucaaggccaaccuggucaacagaguuccaggacagccagggauacacagagaagcucugugucgaccccccccccccaucuaaagucuugaauuauuggucauuucuuaugauacuuggaaagcaaaguuguaaaauuuagucauuuuuacuuuuuuuuuuuuuuuuuugagaagggucucacuauguaaagccuauaccuccugccuguacaccuuggauuuaauuuccgaaagguuaaggcgauggacugaccacuuccuucuccuuuuuuccucucucucucucucucucucucucucucucucucucucacacacacacacacacacacacacauacacauccccgaagacuuggacuuagaagcaccauuuaccacuuaauuaaaauaaaugaaugaugaauaaauaaauucaagagucucuuauucagcugagaaaaacaagcaaaacacgagaacaaaaacccacccugcuugauuuaauucccauccacccuuucccaaacucucguacaauuacuaaucucacacaucagcauauacucauuuaaaaccaaaguaauuuuuuuucaaugccgacgaucaaacuuuggagccucaggcaugguaggccaggcagguagguacucaugccacugagcaacacaccccgagccuaagcggaaugacgccuuaagauuucaaaauuaguuauggguaaaaaaaaacaaaaguaguuugucacuguguaacuacuagcaguagcccgccaguuuauaaugagccacuggaaaacgggaaaagacugaaguaguaacacgugcguuuccugguugagugaucagacgcuaguuuucguaacugcugguugcaccaaaaacgccaucauaaagaaaagcuaaaauguacucggcaaagggauguacuuggcccagaaagugugcucugaccaaauauaaggacguuuaaaucugcuccacagggaugccuugggaccccgugcccgcggcagacgcgccgaagccacagguuggaccauaaagagccccuuccucaaaguucacucgaaccccguagucuuguaccggcgguccgcaaugcagcuccucacauuccucacaccacucuagcaagucaccuggugggacaccgauuggcagaccggggaggcugggcggguaugccacgaguccuaaguaacucccgccccagcagaaggcggcaggagugcaccacgugaagcggccucaggucgucccucuucccgaccuaagcaucucuccaggcgccuagaguaggcagcgcuggaagcgucucccccaaggucaccgggcaccaugacccgacucccgcagcccggcggccgccaccugaccacgggcccgcagcucggccgggagagacgcugugcccagcgccucaagguccccuucacccacgccacguuccgggccacgcggcuccgcgcgcccaggaugccgcgucgcucgccccgacccuugccccagggaggaaaguccccgcgugcccgcggggcuccgcgaccccaccggggcaccaagggcaccgcggauuccgugccgcgcgcugcccgcucagcccggacuaaccguuaugugugucucgcggcgcccggaguaugcgugacgcggcggcgcgggccgcaguuccucggagccgggggggucccgcucguguccccugcccgccgccgggcuccuuggcugcugcaccuacacgaccgaccagucacgucgcagcucgccacuuugucug

SEQ ID NO: 1633 - RNA, 4965 nt, Mus musculus
gcccacggucgagggcggggcacggaggcagcaugcuaaaccgggugcgcucagccguggcgcaccuggugagcucggguggcacuucuucccagcgcuccaaguccccagaucugcccaacgcuaccucagcgccucccgccgcccaagaaacaccuaagaguucccgggagaagccugggaaccaggucggcgcgccccagaagaccgcggagacuacugugagcuucucucgacccaccuuucugcagcugagccccggagggcugcggcgcgccgacgaccacgcaggccgggcugugcaaagccccccagacaccggccgccgccugcccuggagcacaggcuaugccgagugagcgccccggggcucccagacgaggaugggacucccauucucccgggagacgcaucccggcuucaggaaccaucccaggaaccugcaccccucccagacaucccccggacggggugcaaauuccacgaccuucuucaggaccuuguucacccugccccucgucgacucaggacaguccccacccagggagggcgcagggagcaccgccgaggaugaguuggcggguuccaagucgcggcccgcgguucacaggcuaggggaggggagguuugagaaggacuaguuccuuuugccagggagaucgcggguggaaagacucgcucauccgcuuccuggccccagcuccccaguucccuguccuucuuaccgguccccucccccuccacacccagaaauagcccgcgacaccagaaggccucuggcuucccgggcgggggagggguccgcccgcagagcacgacgguucccuuugguuauggguguguagacagauaggugccgguagagaucagcguacucucagaaccuguauauuuuaaaaucaucuucggggaaagccaagccaagccaccaggggaaugggggcacugaggucguggaaggaggugguggguagccccgcaccuccucauuagcuucuccguuggaagggguuuguagcuaagagauuccugcccaguccaggugggucuacauacccuauuugggccggagcgcuuacccacucuuaagaaaaaccggaacuuucacugggucguuuuaggaugaggguuaaugugugcaugaaggugaaggugccaugaaucacugucugagcugguugagacuggaggugggguguaguauuuugaccagcaggggaguaaaauuuacuguuccuguuuggccacucccacccccacccccagcaccaccuuccggaaagucuccuuagccaaggauggaggaacugaggcaggcaguuacuguugcgggccuuucuaugaggcuguacguucugccgccagacaguacuucuugcuggcccugccuucuccucuucccucuggcuuggagcccaggcagcugugaccuuuuucagcuuggccagcgagcaggagaggauguguguguguaugugagucuaagguggggguuauuccaggaccuagucuggugucuaaccuggugugggacgcucucugguagggucaucaaugcuggcaagagcaggcacaaugaggaucaggcuugcugcgagguuguguauguggaaagucggaggagcaggagcguuacaggggucuccagggagccuagccauaaccagguaauacuccauccccuuuccuaaucuccagagaugcgauggcaccucuccccugggguuucaggcauugguucuaaaugggagagguguggagguucucccucugucacagaagcccuaaguggcuucgauuugauuaguucugcuaggaaaguuuacuauuccauuucacaugugacuguucaugcacuuauggaugauuaaacuaaucaguacugaccuuugcauucuucauguuuugaacuuggcuccucuuucucuugacacaguaggcugugcaugaauaagugaauagaucuaaauugccuugauaucacacucagaucucccaugugaugguuauauggcugcuaaccugcccugucucccuccaucccuaccgacuuccaacuuuuucuucaccagggcuucugcuuuuacuacuggggccuguuugaugggcacgcugguggaggagcagcugaaauggccucccggcuccugcaucgccacauccgggaacagcucaaggaucuaguagaaauacuuaaggaucccuugccgccuccccucugucucccauccacuccuggaaccccaggagcccccaguccuucacaguugguuagcccucaauccugcuggucuccacagaaggaagugacccaugacagccugauaguaggagccauugagaaugccuuccaucucauggugaguggauggccuaggccaauaaugugcuaaguaggcauucuagucaacacugugagguggaggugggugggugaacccuagaauccacacugccuuugagagccugagcggagcuugguccuguuacccugugugguccucuucucuuccacucuggccuggagaggugcaagguggaguaggugacuaugugccgcagguuuuucuguuuccuuugacccuuccucaccuggcaggaugagcagauggcucgggagcggcguggccaccaaguggaagggggcugcugugcacuaguggugcuguaccugcuaggcaagauguauguggcuaacgcaggugacagcaggugagugggaagagggcuuugagaguggccguaaaaggggaacauccucccuaggaugaggggaaugcagagagugaaggggugcuggguuaaguauuaaagaccgcagugaucaguaagauauaaggaaagguugccauauccacgggggacggagagaugaggacccaggcaagacaucaucaggcucauuauggggagggccugguccuccugcauggaauucuccacucagaccgagaaagccagguccagacucuuucugucucugggcagggccaucauuguccgaaauggggagaucauuccgaugucccgggaguucacaccagagacggagcgccagcgucuucagcugcuuguaagcaggggcuaaaaucccuaucccuggucuuuccucucaagccuuucaaagcuucccacugggaacuuccugggaaggugcugcguggacgucugugggguguugggugagcugaagggguaaugcagccggaaggagccugggcugucuguguagccccaggaaggaaguagagucagaggugggggcgggggugagaauaacaaaggccggagcaaggguguguuaucuucgugcauccucucuuguggucucucuauccugauuaccugggguugaauccuauguugcuaauugugugaccucugacaagccccuuacucaauuguuugugcuuugcuggcuucugugaggggcgaaugaguccauucaugcuaauauuagaggaguguguggccugcaguaaauuuuaagguuuaguuauaauuuaagagcuacacauuggcuaagggugcgauauaaaugaaauggccucucuccugucuggcccuuccuaaccucagggcuuccugaaaccagaacugcugggcagugaguucacccaccuugaauuuccccgaagaguucagcccaaggaacuagggcagaggaugcuguacagggaccagaauaugacuggcugguaacuucccucagagcuggggccguucccauggcaaagucaccaguccuucaccagcaguagguggacgcuggaggcugggucaggcuggaaguugggaaagauggccacuccuggacggguuugggggcggggggguugcuguuccuagggguaggggcuuugccacccgcgugaugccuccucuacuccucccuccucagggccuacaaaaagauugagguggaggaucucagguuuccucuggucuguggggagggcaaaaagguaaaacccugagguagaggugggagagggcaggaagacccaucgcugcuuguccagggauccagggagguggaggucucaccagacaguagguguggguggacgcuaugguuucagugagucugagagaggaacuaaaucgcagcguucuuucucauuuccacaggcccggguaauggcuaccauuggggugacacggggcuugggagaccacaaccuuaaggucugcagcucuacucuguccaucaagccuuuccucuccugcuuuccugaagugagcacaccuucuuuccuuuuaggaggcuguggcuggcuucuaucuccaaccuccuuuccucaugaacaccaccagccccucucucuuucuccgccucccagguacgaguguaugaucugacgcaguaugagcacuguccagaugaugugcugguccugggaacagauggcuugugggaugugaccaaugacucugagguagcugccacuguggacagggugcugucauccuaugagcccaaugaucccagcagguaggggguugccuggcaagguguuggggggggguaguccuggugaaggaaggggcaaagggaaaagaagcccggagacccacaugugggcccguguaucugucuucucauauacguauugguacaugaauguacacauguacuccuggcagguauacagcucuggcccaagcucugguccugggggcccggggaaucccccgggaccguggcuggcgucucccaaacaacaagcuggguuccggggaugacaucucggucuucgucaucccccugggcgggccaggcagcaguuacuccugaugggcucagccccaucccucucaaugccaccccagccucuccacuaucacccuucuccugcccaaacacggaaguugugucccugacucgagaguggccauuugaacaaagggaugccugcuagauccaaaauuacagcaacuggcaaauaaaccagauggauaaac

SEQ ID NO: 1634 - RNA, 6113 nt, Mus musculus
ggaaggagauacaggaucagguaaguaacaccucagauugggaucaacagcacaacaauacaauaggagugugaggucaguuuccagcugaggacacggcagcacuuccaggagugugcucuuaacaggacgucgggaaauucccagcgaaggaaggaagggacuuuuaaggcgaugguggcuggggacugcagaucacaaaaggucuccagggcucuggauagcgucacguugcacuuacugcagugauuccuggauaagagagugggcagcuucuguauaacccauccccucggucacggguaggguguaggaaauacuggagcuucgaggucuggauggccacgcgagggcagcaguggcccucgcugaccccacccuggaagccgcucaacuuucccgaagcugguccgccccccacggguuggaaguggggcagaggccgaguuauccggggucccacccgcccgcucaccacccagcaauccagacaucuccgggcacaguuccuccagcuccagccagcccuacgccccuugccggguccucagccggggugaccugcggccgcccggggccgggagcggaggcgggccaagcuaagggccgcccccgucgacccccccccccuucccuugauggacccgccccagagcggugcuggagaguggggcggggcccgggucagucucagccuccggcacuggccgcgcagcuggaggcgguggagcccaagguaccggggccccagcugguggguggcgaggcgucgugggaacugaccucggaggagagcacuuucccgauucccggaucgcuccgggagcggcuuggggggcgggggguguuccgggccaggcaagagagagcgccccaagcugugggccaggcgcucuagccuuccaagcucucgaaccagagcccagaguccuucccuuucugagucuuuccuuucuggaccucccuagcugggccagggacacacuuagaucuccgugagcgacucaacccagacgcuccaguuccgggcagggaguaagaaacagggccucaggcuggcuaggggugggaguucuggccugggauggggaauggcgggaauagggaugggaugugaccacuggaggcugcuacugcuuggcgggucuggacgccgcccuagacggguuuuggagcugaucugagcugagagguugagaagacuaggaaagaucccgcuccuguguuguguauaugugucugagagugaagggggguggggaagaacaaaacaccccaauccccaacucuuccucguacccucuugggaaguuagggaguguuagggaauugggcugaaagcuggaguccagcucuuccuugacuucuggcuuuaaaguuaaggaaaagguguugcccgaagagugauuccucgccuagaucucggggggagcagaguacaaaggccuguuggaucaccugggaaaucaagagaauaaggaaggcuaguggcuuguccuagggaaggucccagaaguuccagaccccucucccggcccugggugaaguuuucguugucucucuuaggguuaguggggcaguuccgcuggagccgccuuucacagggaguguuagccaggccauccaugccauguuggccuucggccuaaugucccggcuuggccugaguccccaauuauucuggccuaagcagagccuagaugcaaagucuucggagcuggaggcucuaacacagccacgaaguuccggccucugccucccaccaucagaugcucagccgccuugcugcugugggacagccggggcucacgcauggggaugugacuaguguuuaaguguccuagggaucacgcuccauccacacugcccacccuggcuuggggcuguccccgccagccuguguacagcuagacugguugaauuaaugggaguagguggggaaguuggaggaaauccuguggguuaccuggauauaccucucagaccucauuuuugaaggagauaugcagcauagcgaaugccuucuucccagucuuucggggguaccagggaaagccccuugagauggggggugguaaguguggcugugcauacgcaacuccuauaaauucucugugacucauguccucuuuccucacaucccaguuuuguguguguguguguguguguguguguguguagguguaggggagggaggaaccacccaggcgccugaugcugaaaagaaucagccuggggcuggaguacucugcuuccuaaaaggcaggcacaggccaggguuugaggugguuuguagggagcuaagaguugagcagagccagacaggaugugggacugaaaggcaaagccaaguuuggggcugagcucagguuacugugcccuucuuaacugcucccugccuggucaaaagcuuagacugauccucacuaguccuuucuuuggaggcuccucccagcccaggcucugguucccucccccacagccuucgcuucaucucuacucugucuggcaugauccuugccaggcuguguaggucuggagaccucacugacccggucagcucccuguggucugaacugcucguucacgugugcugggguguaggacacauauaaacucugagaagcugacuccuuccuuaucuugagucacagggaggugucugcugggccuaagggucagcuggucacaaggaggaaggggcuguuccagagaguggguggaggugauucccgaguggguuuagcuccgucacagcaaugcugugauagauguguggcuccccacaguguggucauuguccccugucaggggcugagugacccaguguugcugccaggcccagaaaaggggauggguggugguggugguggggaggcagcggaacaggcugccugaccgugagcugccaggacugagccuucuuugugugacuugagacuuuggggaagggaagggggugggucagggaagccagccugcuuccacuggccucuggcuuagcuucucccacuucugcucucaccugugaagugccauguaggcaagacagacugcaucacaaaguccuguuuugagagcugucccuguacuuuugucuaaaccacacugagccucaguuuccugcuuaugucaggaaggcccggagucagcgagagggacccgggagaugcucagugggcguggugcuugcaaagcaagcauagucaccugaguuugauuccaggaccccaugcaaagguagacugacuugucuuuuaccaccacauguguaugugccucggccaauaaagaguuuuuuguuuuguuuucaaaugggaaggccaccauccaccuaacaggcagcuggagagaugaaguuguaaggucuucugccugcaggauugguucuuggcaagaacaggccuuggcgaacccucuucucuuccuuugcuggaugcugugguuucuaggcaggcuugaggggguggguggcuagauaaguguuauugaauuuacuggcuuuccccuccucaaauccccacugccaccugccugccaguuucagccauggcugcgauccgaaagaagcuggugauugugggugacggugccugugggaagaccugccuccucauugucuucagcaaagaucaguuuccagaggucuacgugccuaccgucuuugagaacuauauagccgacaucgaaguggauggcaagcaggugaaagccauguauuucuuguuuuccuggcugggaagccuguucccccagucacacggggcccauggauguccuuccuuaccacccaccuccuucuuuauuucccugcuggaaccagcagaaguuaggaagugaaacuggaacuguagaaaaccuggaugcacuaucugguuggaccacauacuggcucuggaaucugagccaagucccuuuugccugugggcuuaacuucucccuacugcaaaaugugaaugagagugagacuucucccaaaggguuguccuaagaacuaaaugcugcugacaguggcagcucauacuacaccaagaucaaacccaucuuagaucuuaagagaaguggaucauugguuuugugacugaucaauacaacccagcacauagcgagcaguuaagauguuguucagcuagcuuauaggaugagugauuucagagggccucagggugguaggguuggggcccucaggccaacugcucaauagccuugugugucagguggagcuggcucugugggacacagcugggcaagaagacuacgaucgccugcggccucucuccuacccggacacugacgucauccucauguguuucuccauugacagcccugacaguuuggguaaggcuuuggaagaaucuugggagcauguagguccugcaagucuccuuugcuauagagacaguagcccuuggggugaggaguguucacugcaaagggcuuugagcugugcaagguacugccuguucaguagacuccagggcugcuauagaagaccuggcuucuguugcuaaguagaaguggguacauccacguuuuggugauaucucugcagaaaacauuccugagaaguggaccccagaggugaagcacuuuugucccaacgugcccaucauccuaguggggaauaaaaaggaccugaggcaagaugagcauaccaggagagagcuggccaagaugaaacagguggguggggcugcgcugcugguggugaggcaaguuucccagccgagaugcaaacagcugauagccagugguagcgggacugugacguucaucugcuguccuguccgaaugcugggaagaacuagaagggcccccaaguaacugaaguaucagagaagcgacuugcccgagggugugggggcuguguguuaagaguucccuggggagggagggcauuauacacugcugggagaaggcucagaggggugaguacucgaggacuugcuaaauaacucuagccaguggacuguuuuacuuaggggaagguaggcuaucuugggaggcuaauuaaggcuuuagguggggguucagucucuguuaguaaaaguacucugguagcuauguaguauagacgagaacagucucagccugugggucaugaccccuuuggggcugcauguuagauauccugcauauuagguauuuacaucacgauucauaacaguagcaaaacuacaguuaugagguagcaacaaaaauaauuuuauaguggggggguguccccacaacaugaggaacuguauuagaggguugcagcacuagaaggcugagcgccaccagacuagagaagacggaguaugaagucaguugggcaguagguacuuguucagggggggaaugggugccguaggggugaggcugggcgggggagggaucagacagaauucugcaauggcaaccugggucuuauguccccagccuggaaacuggccgugguagcuggaccuaggaauucugcagggccagucuggaggaugcucaguuaccccuucuuuugacccuguaucuugucuuaucaggagccgguucgaucugaggaaggccgggacauggcaaacaggaucagugccuuuggcuaccucgagugcucggccaagacuaaggaaggggugcgggagguauuugagauggccacucgggcgggccuacagguccggaagaauaagcgccggaggggcugucccauucucugacuuccccaaagcuuccucaacccucccacccuucccuucccagggguacaguuacccucccccacgccauccuuguaggacuccaugcugccaguuucuuuuuugguuccuuucugcccaggacugcaugaguuucccagccccaagugggggcugcuaggcccuuccucccugccucugggaaccgggcuggugcccugccuuuccugagcagggcuccuccuccagaagcggugguccaggggguggggcucuuagucccucuggccuuccccauauuacacaccagcacuuuauauauuuuuggcucacaggaggagucuaggguagggacugggguuucugcuuuggguaguagccuuguuauuugacuuaacuugguggggacaugaauaaaggucaaagguugcaccgugu

SEQ ID NO: 1635 - RNA, 23735 nt, Mus musculus
aggcuuuugcauagaacagcauuuuguuuuucuuaaagcagcucaggggcagagugcuugccuagcauauuugaggcucuggguucgauccccagcacugcaaaggagaggguuuaaaaaaaaaaaaaagcuuucuuccucccccuuccuccgaguuuuagcagcuuggguugucuucccuagcagaggaaggggcggaauggucugggcuguaaacuucccggccuucccaucucuugcagggacaggagagcuggguucugggucagggauaggcagcaauaaggcuuggcuggugugagaaggcgggcggcuguggccucagagcucauuucuccacucuggcuccacuuguaagggcaggcccccuucacccucccgcuccugggggagauucuggugacggcggggcccugggagaaaaaaaagagacauccuugguuauccugccggcuucccacacuucaccucccuggcccagcagggcccauccauaccugagguagaggggcugaguuugcucagaccuuggagcaaguccugucccugcugcagguccaguuuggcaggaaaggggcacccgguauaucccccguuuucuuuacagaacuccaggaaccugugggguucagaacaucggcaugcauggggaacugccaaggagccgagucuggcggccucugcucggcacugucacaucugaggcagaguugcuccaccucacuuauuaauacagggugggcauuguuaacaccaacagcucugaggacuaagggagaaguaagccagugcuugucgaggacaaaccugccccaggcuggggcucacgguggcuaagagcaacuaugggggcugggaacacuuacguuuuccagucugggucguggccuaggaggaggggguugcccacuacgaugagcaaagccuuggcucgggucacagcaacauugaaccucuggauggaggaagcggugaugucaucaaagggacaggccccauggaaggacucacgccacccacaagccuaccaaccuugggguucuuaaggaaaccgagguuaaagucuagauccagcuguacaaagcucuggcugcuucggacgguggagaugaggaugacgcugcguucuuggccuuggaacucuuccacagagcccaccuagagugcagacacagggcuuuaaagaucagauaggccuaggaggaaccacggugacagaccugcucuaggggacaaagcugccagggagguacagacaagacacuggguacuuggagaugaguaagagaaucgcagagcccggaagagggcagaaggccugcugugaaggucugugggacagagccaguuauaggguggggggccuggaaacuguucaaagcaaacggcacugugcugcaaaggaacagagugggaguucucaucccuggaggcagccaccaauuuggucagaaauucugagggagaggccaguaaauccuaacucagugguuuucaacccuggcuccacauaucacacucaccuguggaucuuuuuaaaaaccauaacaauaagaacaaacacucuaccagagcccuggcucugccucgggcagcuauguuaauugucugggugggauccaagaaguggcauuauuaaacuuuaaucugaaucaguguugagccaccccucaagaacaguuaaacuacguaggaggcuuggggcaauaucaugugacagguguuaucacguaacaggagggguugguaaagggaguuuggacuuuaaccuuaggcagaggccacacaccugauuaaggcaguaugcguuaacuggcagccugccagguuccaccucagaaccaccugggggaaaccccaguuccacuuugaguaaacagggugggacaggacauagcacaggccuagauaaggggaguaugaucgagaguuagguuaccuucaaaucuuugaugucauccaguccgcgaaguucucggucaaguuuugugaugcaguaacggauuuuuucuaccuggagggaggaauaggugcccuucucuuaggccaucccccucacacaagaggaaggcagaggcaggcugcuggccagggugcuggcgggcaaagagggaaguccuaggcuuggacugagggccugaccugcuuccgguacggggagaugacgcccacauuucgggggcucaggcgggcuuuacccuucuuggaggaaggggccaggaguuguuucagguaugacgucacuguagcagccucuucaggguugaagaaggaugggcuauugccuucucucucaucuuugcccauuacaccauggaaaaugauggggaagcccuggacgccaugaaauaagaggaaaccuucaggcucaucucccugccucccaauccuccaacccagcuagagaaucagggguuccagacugugcucugccugcuaggccucaccugcugaggcagccccucccagcggcagaaccguucucgauccaccacaucugcgcaggccugcagcucuccgucguaguacagcugguuagggauguccaggaugguggggugagaccuagguggcaggaggaaagagagcaagauccaagaccucguagggagcucugcuucaagugcuccccacccuagucgcuggcccuucagccaugcccaguaacagccaucaguguuugcugucaggugcugcaaaccacagagagccaagccaaaggcuagggcucucacucagcagccuuuuaaauuccuuuuaacaaacuuagaaauuaggauccauucucggguuuaaguuuaccaaacaaagauaguccagcaaacagauuaucaucuauugucaucacucuuuaauuauguuacaccucaaaacuauuaaguaucgacccagaggcaucuacagaacuucugcaauugucacugaguggugugaacagucaugcuaugccauggguguggaggucagaggacaaccuuguagagucaguucucgccuuucaagugggcucacugguuggggaaacccaacuuggguugcuagauauguauagcuguucuuuuacccacccaucucaagccugccuuuuugagauagugucuuacuguguagcccagucuagccuuaaacacucaauccucccgucucacucaaccuccaaaugcugggauuauaggcacgugcagacacggcccaguuuacauuuaccaaaccuuaagugauuuuuacuauuuuuaauuauguauaugugugugcaugugaccgaaggggccaaagaugucagauccuccaggggcuggaguucggaggccgaggcacccaacccgggugcugaacacagguucucuguaagacucugaagucccacauuuaccagacucacacugauggucaacaacucacguaagcauugaugucucaacucccuuuacugcacgugcauaagauggcgaggguggugugcaccuacaguccuagcuacucagggggcuaaggcaagauugcuugagccaaaagguaagaucagcauaggcaauacaaacagauccugucucaaagggaaaaagagagucgaggauguacauguacaucaguaugucagacacuugaaagcagugugcaagguccugggcucaagaaaaaccaaccaaaaaauaaaauucacacauauauaggacacaguuguaaaugcaauucaaccaacaauccuuuuaaggaaagcuguaugcuuccugccuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuuuuugguuuuucaagacaggguuucccuguauagcccuggcuguccuggaacucacuuuguagaccaggcuggccuugaacucagaaauccaccugccccugccucccgagugcugggauuaaaaggcgugcgccaccacacccagcgcucccugccugaaucgcauagaaacuuagauccauccagacacucuuugcucuggugaccuucaauaugcagauaaaucauugguccccaaaccugcuaagucccaagacaagcagcuguaaagggggcuaccaagagacccccccccccuuccagcuaacagccacugugacgaugugagaugaacugcaggggaggggacagugauaccuguaguugcggagcaguuuggugaugaacugggggucauagccauuggggcccuucuuauacaaggaguuguaggcgagcaggcgcucuagcagagaguagccaaguccaugcuucagggcuaguggcgagcgcagcacaggccccagcugccgagggucuccugccaguaccagcugcccuccgggauugcccguuuccuugacauccaucaguccugggaggcaggaagagaaagguuaaauggugggauuaccaaaucagugugggggugcuguaccuguaacccauccugagcccccucaccugcuauggccaccagacucucaggcuccaugcaguggccagccucaucgaugaagaugugugugaagugaucgaugggaaacugggcugacaccaaccugggagugucaggccaagcagggucauucccaggcacccaacuaccaaaccugaacucugcccuucaguucacccugcccucgggaacccuuccucuuucccuagcccauuacucuuccuagcacuuaauacacaaacccuauauguaccugcuggcagugaugagggugguaauuaagacccgauauugcugcaggugcuucuuagcaggauacacauauucucccuucuuagcaucccaguuacagcaggucuauggauuacgaaagcaucagaaaucagccuagcucuucccuuucucacgucuccccuuggcuaugaaccacuuauuuaccugccucccuccuuuugcagacaaggaaacugaaguccccagagggguccugacccacccaaagucacacagcaagucuucaagugcucugagaaccucccagacacccgucaucccuuggcucucuguacuuucuuacauuaccuuaauguccucaggcaccauucggaugucccugcugggggccaggagacgguagauggagcugggcagguggacccggagccgcugacagaggaggucagccccugaguuggauggagcacaggccaggaugugggcuuugggcaaaugcuucacuaccugagaaaaaaaagacagacugggcagacgugcucuaugacaugggacucagacugcguuugccuuccagaugucugcuaguccugaugacaccuuggugcuggauaucaguaaauucucgucugcauauauacacaccaauacucaugacucuaaucccuacuuccucuuugggugacuguucaaguauaggcacauucagcucgcuggaagcaauauaauugcagacauaugcugggggcugcagccucaccuguuugauggccuccacuaaugugacagucuugccgguaccuggaggcccaaagaugauguagggggcaggccgggugguaccccucacaaugugcuucauggccugcaguugcucaggguuugacuccagacuccgaucguacagccuggaaggcaaaggguccaagaauaugaacuugaagucaucuaguaucccaagaggcuucugggacuccauucccaacauccacaccccaaguagccccuggaucccugcccacagucucacuugaacuucacaucugagggcagcaacgagaccccacgggaggccacaggaaaaagcaugggccauagcacccagcgccccgucaacucuagggcccggugcuggacccgaaggggcuggcgguugaagguaaaguucaccuugaaggucagcccauccacaaaucggcucaggaggcuuugggaaagaauuaagugggagaguuguaguuagguggaauagguaguaaaaauucaggacccucucuaccucccaaccauucugcuccccacccucuccuuucccaaaagguccuuacaaaguucuccgagagaagaagccauucacacagcugugaacccugcauccaggguccuaguccucucugaaagcaagaccuccuaugcccagggcuuagaagccugaaggucaccuagacgauuugcuucuuccaacacucaccuuguagaaaagcucagcuugacacgguccaguuccaccuugugcacgaaacccuuguaggugacagggucguccuguugggucucagaggacaaaagggcaaaaagguggucaccucguagcacugagggacggcucucugcgacaccaggaaccugcaggguaugaacaaaagcaagcuuuugcacgcaguggccuuagucucucccuggcucucucuggccuuacagcuccaacucaccccagcuuuucucuccuacaaggcaaagcaagaaucggggaaaggccgggcaguggugccaauguccccaguccagcuagcugcuucuuggccaguucaguuccaguuuugccuuuagcaccuuggugagaacuccuucuuguaacaaccuuuuccuuagcaucuuagcugucucucuuccugccugcauuccugugcauuaggccauucuaguaagucugaguuuguguguauauauucaaaauuugaggguuggugagauggcucaguggguaagaaugccugcuguuaaguuucacaaccugaguuccaucccugggaccuacaugguggaaagagaaaacagacuccugccaauugucuguuguccucuacauguagguuauauaugcuguacacacacaaaauaacuagauagauaaauaugauuuuaaacaccaaaaugugaacaucugaaaggcgucugagaauuaucuaauaaaacugggaaaacaagagacucaucaaugucacacagcugggggcaaaaaucuagauuauaaaauuccacuacccauaaacacagcacuggggugguagacacaagaggacuagccugggcuagaaagaaaacacacugcccugcucuggcauguuuuggggggacaggaaucuuauccugccugcucuuugcccauaccuucugaaauaggaauucuuuuauguuugucaggcuguccuguuuacccugugaccuccuucaagcugucacgggcccaccuuccccacagcaggucugaguucuaaccuccagggugagcagccugggauucugguccacagggucccaggucauggguaccgaguccaggucauagugccggaugucaugcuccaucugcagcucuuccaggugcagcagcagccggaguuucaccucauaguuccuggauuucaggguugucuccagcugggcccugggaagaaugguugaguugcagcaggauuauggugagucagguaacccuccugcucugggguucaaucauccccagauugaacaugcugugggugccaaggacuguucaagaggaacuggugagugaguacagacggggaggaaccagcagagagaggaagacaagggagcacgccgcacaaggguugccacuuacuugaucucagcaaccuccuuuggggcagugaagauacuuggucccugaagaaggguagggagcaguugucggaggaggauggguggguaauagguccccagggccaaacuuagcucuaguucauagcccuuggcucugugagaggaaagaaagcaugucuuaaacacagaaacaccucaucuucaaagacucuggagagguccccaugggccugcaggaaacauuucuacugacuucugcaguguggucagcagccaucuagagaugcgguacuccuuagcuuaugcagcuaagguuagaccagcugaggugaugcaguccaagguuagaccacucucauuuuuguaaagccuaauacuuggaauauuuaaaagaaauauuuugggcuggcgagauggcucagugguuaagagcgccgacugcucuucugaaggucccgaguucaaaucccagcaaccacaugguggcucacaaccauccguaacgaaaucugauacccucuucuggggugucugaagacagcuacaguguacuuacauauaauaaauaaauaaauaaauaaaucuuuaaaaaaaaaaaaaaaaagaaauauuuuaugagcugggugugguggcacaggccagcacuuagcaguggagaagaauacaaaaaaaugcaaacauaagcaauacaugcucuuuugaagaaaccccaccaaagcaauacauuuuaaauaaguaacauucuuaacauucagggacagucaacuuuaacuuuuugguauauaaucuuucagacauuuuuucuuucuuuuccugucuuuuuuuuuugagaaagguuauuauauagcccaggcuggcuucaaacucgaucaguagccaggguugaccuugcacuccugcuuucgaguuccuaguggugggcuugcaggcauacauccauggccuuuugauugacuguggugcuaggauaaccuagggccuaccacauaccauaauuugcauaauuuguuuauacauauauaucauuaaaaggaacauauguuguaacuauaaagaccuaauuacaugguuugcauuuauuacucauuaucuuaaaauguuuauccuucuaugaauuuguguguaugaagagagugccagagccccuggaaaaggucuaugacacacugccauuucccuacagguuaaauacuugagagucuucacacuacgcugggaucugcuucucucacgcaccuugcuccucugauaugaaagggaugagacccagaggagggagugaccugaagauggggaaggggguucugucucuccuugcucagucuucccaagugcccaagcaguccuaucuaguuaccggucgggccucucuccuuccucgauccgguuggucaacacagaguuucuggugagccgaggggggcguuugaagggaguuguggguuucaacugggcagccaggggacugugggcgacagccgccaggaaucgggcaauguagaaaguuucugcuccuucugcucccgacuccccgggucccaggaguucccagaggacaguggcugggaaguaacccacaaugcuggucuuacaguagauguggaguucauagcuuucaccuggaaaaaguuagcugagugaaggagcaaccuaacccagcacccccaucacaagucaggagccugcuggacagagaccacucaccggggcccagugggcagggcagguccuguucuccaugguagaagacaaacuggggcguccagcacagugggaauaggugagugagggugacagguuugcuuccgccguuccgaagccguaggguuaguaccuccuugcgguucaaauccagguggauaaggaguugcccgucucgggcuucauggggccccuggaccuccacgucuaccccaugcuucccaugaagguacucagcccuggggagagugcaaguagggggaauggugagggggaaccuuggacugaaauugcccugaggaaggcuuaggauuaauucccugccucucuuccucccuugagggggugggggucuacccuagcccaaggaaagccacuguguuuuaaaccagauaccccauucccuugcccucccugccccccacacaccugucgugaaagauccuggccaacagugaucuguguuguuugcugauguucgacccuggcuuuauucgccucuuuucugguaacugcacaucagcccagcggucuaguuugaagaaccugacccgagucuuggugacgaaggccagauuugcgaucuucauuccauacagcauggaggagaagccaggggcaggggucccauagcugccagaagcagaggauacugggaagugagggaaggcaggguggcuguggagacgaugcuggggaaggcccgagggcugcuuuaugaagggacacagcagcccugcuucgaggcaggaugggacucauggcagagacucuggcuaggggugguaggaaucuuuaacaacuuaaagcaaaggcauuggagcuuuccaacacaaaauaaucggcuuaaagagcacuguggagaaaaguccaauauugggcuguuggcugggaagagugagggaagacagagagaaaaacagauuuuuuuuuagaugggaacuauuuuugggauauuaaaaauaaaaaauaaaaaguacagugagaagagcuaaggcccagggaaagcugaaaagacggcucacaggaacggccagggcccagacuguggggagggcugagaaaggggccagagagagcagagauguccagggugugggcaagguagcggaucggacagcaguuuccaccggaagucaaagggugcagguggaacccaagcaggaagggaaaggauccuucucccgagaucaaaagccuggcuuugugccuagagaggugaagacaggaaaaguggucagcaggacagccucacggcucagcacccggagugcagugucagccacugcacacacacuuacgaaggcaugguaagugccaggcacugcacuugcagcuggguuccaagcuaucugaccaggccuugagaagcacucagggagcacccauacguuccagcacggugauggugccuacuugcugacugccuggagcagcucacuggcccaagccagggcacugaggacugucuggggcaggggcaggucucugaggaaugagugggcaucucuugggcaaaggcagcacagguagagcaaauugaucgauggguagguacaacggggcugugcaucagcugggccaccccgcccguacuuugcuuucuucaacuauugagaucuaugaagcucagagcuaaggguacugucuagcauuugugaggguugagguucaacccuuagcaccaaaaccccaaaaaacaaacaaaacaaagaaacaaaauaccaccuaacccaaccccuacucucuuacccccucccccaaaagauaaauaaauaagauggggauugaagaccuggcuuacagggcuaccauaaggcucacuugagguacugacauugcaggaaaccauuuaguccagugcuuggcacaaagcagaccucaguaagggagagugaugguuagugucacauaacaguugguuuauacuacagugaaauguuccaagaaagggaugacaggagguggcagagaugggcagagccagauaguuuuucagggcaggccaaagagccuggacuugaccuugacuuucagcagcccuucccucucuucugguacccaggagacugaggauggucccaaacacaugaugcacuugaugaacaaagucaagaucuggaggaguguggauaaccucccucaaaacuugcugggacuguuggguuguuagucuauccuagcaacuguguggugauccuuaguaacccaucaccugggcuaaacgagcaagguugcuuguaagagcacacaguaagguccucguggcucagaacaccccccuggcucccauaccuguuucucugccucucuccuucaucccuagaaaggagagcaguacaaaucagacaacaccgaagaggcuaugauuucuuuuaaaaggaugguaagucauuugaaagcacagggaggaaugcuuggccagcguuagcugcuacuguuaguguuuguauuaguaggaagaggcagggagcaguaacaacuuacuuucagcccuugucagaggcuacccugggguuacagaaccauugcaguugguggguuuuaagcaggggaguggcaagaucauaugugcguuucagaucacucuggcaucgggauuggaggauggagaugcuggaggcaagacuguagguagggagacaguuagaagaaggccacugcaguugucugguuaaaagauaccacaggccugaauuaggcagugcuagagacagaggagggggccgaucugauuguauucagaauguaaugagcagaauuuggugacagauaggagggagaacagagaguggaaagagggaggcauuuagaauacccaaaucaaggacuuugcuuuuguaacuguugcugaggaaggagaagguagguugccaggcggaccaucacauuugaauuggaugcacuggguuugagaugccugugguccaaaggcagcuuugcuuaugugaggcucacacuaaagucaaggucagaaccuaauacuacuagagaguuccuugauaguaguuaaaaccaagaacucaugcuuaggaccucccugagagcccuagucgucuucaaacagccaacgccaacacaggccaggcaggaagggaagaccgaggcgccucacaagggagaagaaucagaagagaaccuuguagaaccagacauggugguucacacccacaaucucagcagaggcugaagaccaccccaaaucuuagauuagccuagccuguguaauagguugugauuauccagggauacacaguaagauacucucucaaaaacaaacuagguugagugcuguagcacacaccuuuaaucccagcacuugggaggcagaggcauguggaucucugugagucugaggccagccugaccuacacagugaguuucgggacagcuaaagcuacacaucaacaaacaaacaaacaacaaagacaagagaagacugauggaaauagcugaacgucaaagugcuugcugcccauucugacaaccugaguuuaccucugagcuaccuauagauggugggaggaaagagcugacucauucccaggagcuguccugugaccucuacacaagcacacacuaaauaaguguaauuuaaagaggaauggaaaugggauguugauauggaggaguccacagugaaaagcaugauagaaaaagacagaagauaaggugcuauguaugcggacucaugugacuaaauaugaaugcacacggagaaaugaaagguauucauuguaaguguuaggauauuuaagugagccggcacuggacaugcagugaaaggccuucacuccaaacucuugcuaaaguagaucacacauccaauucuuacuugauaagcacuccuaaacucuguauacacaaugcuuuaugguaucuuccuccugaacagcagcagcagagaguaccacagcuuuaauuuaaacgguguagucaguucuccuaugacagaagcaggcugcccaguuuuuaauauauaucuuuuuuuuuaaaaauuauuuauuuuauguauacgaguacacuucagcugucugcagacacaccagaagcaggcauccaauugaucccauuacaugugguugcugggaauugaacucaggaccucuguaugaguagucagugcucuuaaccacugaacuaucucuccagucccugcccacaguuuuugauauuacaauaaucacacacacacacacacacacacacacacacacacacacacacccacccacccacccaccccuuguacuuuuaaacuagacacacucuuggagguagacuuucuaggugggccaaagagaacaaauaaacuuggacaacuuggccggguggugguggcgcacaccuuuaaucccaggugggauuaaggcagaggcagucggauuucugaguucaaggccagccuggucuacagagugaguuccaggucagccagggcuauacagggaaacccugucucgaaaaaccaaaccaaaccaaaccaaaccaaaaaaaaaaaaacacccuguacuggcuaguuuugugucaacuugacacagcuggaguuaucacagagaaaggaccuucaguugaggaaaugccuccaugagauccaacuguaaggcauuuucucaauuagugaucaagggggaaaggccccuugugggugggaccaucucugggcugguagucuuggguucuauaagaaagcaggcugagcaagccaggugaggcaagccaguaaagaacaucccuccauggccucugcaucggcuccugcucccugaccugcuugaguuccaguccugacuuccuuuggugaugaacagcagcauggaaguguaagccgaauaaacccuuuccuccccaacuuguuucuugguccugagguuugugcaggaauagaaacccugacuaagacaaauugguaccagcagagugggguauuccugugacaaucugaccauguuuuggggaggacuguggaaggacuuuagaacguugugcuugaagauccauccguuguuaagagcucugucagauguuguguaggagcuuggaagauaauguugagaacaccgcagaagauggagcucuggcuugugaaauuucagagggaaaauuaaagacucuuuucagggccauuccuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucauugaggugacauuuucugggaaguguuuucugagagcacaguggcuguguuccagauauagccaaaguuguacauugugcuguggcuggacuugguaauguguaagggucacccaggugguacugguuuugaaggcaugaaggaguugagcagagcagcugagguuuggcacugugagaggccauggaaggccauuggugaaagugcagccucaguugcaauugauggcccaggacugaaggggucaugcaguguuuuggagaugccaguaccaugagaugaccaccaagagcagcagcagcaguggaguacaggcaucuggagccuagaggaugacgcgugugcuacaaagggcauggcuggagaagugacccaagcccuuggaggagcccagaagaucgugaguuggaucccagacauuggacgguuggagauugacuuuugcuuuugauugugacugugcccugauauuuucccucuugaaggaagaaacuguuuuaguggagcccacaguaaagagacuuuuaauuguaaaaagucuuuggauuuuaagagagauggauauuuuaaagagauugaaauuuuaagaauauguaaagacugugggacuuuuaaaguuauuuagaucuuggggaugaauaagauuguaaggguugaggcuuacuagugauguuuuugugugucaaguugacaaggggucaaugguacuggcuaguuuugugucaacuugacacagcuggaguuaucacagagaaaggaccuucaguugaggaaaugccuccaugagauccaacuguaaggcauuuucucaauuagugaucaagggggaaaggccccuugugggugggaccaucucugggcugguagucuuggguucuauaagaaagcaggcugagcaagccaggugaggcaagccaguaaagaacaucccuccauggccucugcaucggcuccugcucccugaccugcuugaguuccaguccugacuuccuuuggugaugaacagcagcauggaaguguaagccgaauaaacccuuuccuccccaacuugccucuuggucaugauguuugugcaagaauagaaacccugacuaagacacaccccaaaaccaaaaaaauuguacaacuuagguaaaaaggaaauuuccauuuggagagagaaacuggccucuaacucaggauccuacugucucauccucucaaauacuggauuuguagguauaugucaccauacccugcacaacagaauauucaaaauugccuccuagccagcugugcaaauuuauguucucauuaguaugaguuucagacugcccuuucccuagucccuaacacuggaacaacucaaccauuuauauuuuuuacauuguuuuuguuuguuuguuuguuugcuuuuuucgagacaggguuucucuguguaucucuggauguccuggaacucacuuuguagaccaggcuggccucgaacucagaaaucugccugccucugccuccugagugcugggaucaaagggcucuuuuuacauuguuuuuaagaaaauauuuugagauuaggucucuuguagcucaggcuagcuucaaaguccugauccuccuuccuccaccaagcaagugacacaugccuggcuaguuuaacauuuuuuuuuaaauaaaguauuuuauuuaaaauuuuauuuccuuggucaguuacauagcugacagggucucacuguguagcucugacuagccuugaacuugaauagauucccaagugacgagauuacauuacacauaaacuuuaccaagcuugucaguuguauugccucuaacaccugccuggucauauccguguuguuauuuuucuagguucuguuacuguugacuguacuucuggcuuuguuugacuaucuccuccuugccgggucaaucccuuccauaggcggggcuaccaaacacagauccaacuacuaacaacuccauguugcacaaaccuagcuaacccuuagguaugucacacuaaguguaguuacagugcaaggcagcaacaccucuucuaccagcagcucccugcuccaaggacuuaggaggugcugugcuaaguacccaggugucugacuuggccauuucucacuuuugugacagcagccaguaagacugaucacccaugcugaguccagucacccauccgaaggaauuccagccacucccaucagugcuccucagccggcuuuccugacuaugcagacagccuuaaucuccaccacccugcccugcccuccguuguuuguaguucuucugacagcuaacagaaaaaaaaagaaaagaaaagaaaagaaaaaaaaaaaaagccaaagccagcucaacaagguaucagauuuagaagugaucuuaaggaauaucuaguuuuaccaagucggguugcaguucuuauuagugggucaaaaccaggcucgacuuuauuuuuuaggauuuuugaaacaaagccuagguauguagcccacacuacccuuaaacuuguguccuuuuugcaccugccucccaaccacuggaauuacagacaugagccaucaugcauggcaucccaguacuuuugagaguggaggcagggggacugcugccaguuugagcacaaccuccauuacacagaccuagagucucucuuccucuuucacaagcacguauccgccucccccaaagucaagagccaauaacagaacagaguauauagccauuguuucagguagacaguuuaguuuuguuauguucuucgagaccggguuucucugugcagcccuggcaguccuaaaauguucuguagacuaugcuggccuugaacucagggauaccucugccucuagauugcugggauuaaaggcucacugccuggugagcugcugguuuuguguguguuaaaggcagacaguuuugugaaggcuguguauagaacuaggacaccaagaauagugcaguuuaugcuggggaugaaagggaagacagcaaaccaugauccaugcaagaagccaaggguauuuucuuucucuuccuuucucuuuugguucaguuugccauuauuuuuuuuaaauuauuuauuaaauuauuuuauuuuacaauccaaauguugguccccucucccagaagucuucaccucacuggcucucccuuuugccugacagggugcucuccccuguauuuuauugguccccccccccccccccccccccgugacagguuuucucuguguagcccuggcuguccuggaacucacuuuguagacuaggcuguccucgaacucagaaaucugccugccucugccucccgagugcugggauuaaaggcaugcgccaccaccaccuggcccguauuuuguuucuaaaaccuuuauuaugucagucuauuuuauuuuguugauuuguuuuuguuuuuguuuaaaaaaaaaaaaaaaaaaaaagaguuacuugccaaaaaagaguuacuugccgggugugguggcgcacgccuuuaauccuagcacuugggaggcagaggcaggcggauuucugaguucgaggcuagccugaucuacaaagugaguuccaggacagccaggacuacacagagaaacccugucucgagaaaaaaaaaaaaaaaaaaaggcuuacuuauuauguauacacuauucugucugcacguacaccugcaugccagaagaggacaccagaucucauuacagaccauugugagucaccaugugguugcugggaauugaacuuaggaccucuggaagaguagucagugcucuuaaccacugagccaucucucugcuugcuuuugauuuaaaaaaaaaaaagauuuauuuuuauuucaugugaacagguguuuugugcucuguguaugucuguguaccaguccuggugugcucggugccugcagagaccaggagaggguacagaaaggucccagaacuggaguuacagauaguugugagcugcccuacagguccugggaauugaaugcaggucuucugugagagcaacaagugcucucucaaucccggagccuucucuccagcuuuucaugaauauaauuuguucuuugagaauuucauacauguguacaauauauuuugaucacacccacccccuacuccaccucccugaauuuucuaccaacacaccuuccucuccaguauaugccuucuuuacuuaauuuuguuuaaacacucacuuuucuuuauuguaugugcagcguggcagcagaggugugcaagagggcaacucuugggaguugguucucuccuuccaccaaggagaucccagcgauugaacucagguucucaggcuuggcaguaaguauccuuagcagcugagcccucuccccagacugcucccugcccuaaaacaucauccaccaagaccucuggggugccacccacuggaacauggguaaccuaccagcuucccccccccccaaaaagacccuuucuuguccugcagccaucaacuuccaauaaacccucagcuagaguggggccuuacgaacucuuuccucacugaugcggauguaacagagcuauugugaguucaagggcuugucguguccggaagauagcacucuacagccccccacuccuaucugcccacucucauacuuuucugaccccacuucugugauguucucuuagcacugggucacacaggugcuuuugauuuuuugagacauggucuuacauagcucaggcuggcuuaaaacuuccuauaugccaauggaaaccuuaaauuccugaucauucugcucccuaaccauuaaaugugguauuauaggcaugaucuacuagaucacgcugucaaucuucuauuuugaaaagaaggcuuccaucuguaaucgcaguaguacucaagagguugaggcaaaagaauugucucaaaauuuaggccaaucuggguuacagaaugaguuucaggcuggacagugguggcacacgccuuuaaucccaguacuugggaggcagaggcugguggauuucugaguucgaagcuagccuggucuacagagugaguuccaggacagucagcagggcuauacagagaaacugugucucaaaaaaccaaaaaggaugaguuucaggccagccuagcagggccuaguuucaccacccuacccuaccaaagggugagggaugggaguggggagaccaacaaagcaaaaccauuuccuuccaucaccuccugugggcuccagcuccugccuccuguucauucaauauaaagaccuauucucccuagcaggaagcuccagagaggggugacuugugcucacuauagcccauuuucuuggaauucaauuggauucugcaagcacuuacugggcaucuacuacuuauaaacuguagguuguggacugagagccuagacauacagaacuuucaaagcaggggacuugaauguguggugcagggauggaguucuauugagacgcacagugucaucuaguuggaaauaggcuacacccaauguagaaagagcaagccaugaaaaucuagaggaagaagcaaauaaucacggucugaguuuaaagaacagaguagaucagaugagauggcugaagggggaauggaacuggcauuaaaccugauggcccaaguccaacacacacacacacacacacacacacacacacacacacacacacacacacacacacacacacgcucucacagaauaguaguacauagcagaguguucuucuagcacauacaaagcucucauagguagaaccccacccaguacuggagaucagaaggcgggagcuuaaggccaccaaggucaguuaaggauacaaaagacccuauuaaaagggguggggaagcagagaacacuauucaaguggaaaucucaguccuagcugggaagucuagagagcugagagguaacaccuacuacuucugcuuuuuggaagacucugggaacaaucuacucacugacugucucuaaggcaucucagucagacauuccucaguuuuguugacuaggucucaugacaggauauaugcccaacacucuagguuguagucaaagacuuuaaaccaauacagacauuugauaguaagaagcacaaauagaaacuuaaaauuugcaucuuuuaauugucaugugcaaagcuaauuuuuuaggaaaagauauccucccugugcacuaaaacucuuaucugucauucaaggccaaggccagucucccaguuuuauuuggguaaaauacaagagcauucaggcaaauguuaccuuagggcuacagaugcugcucaggggcgggcuguuugcuggccuagcaagugcaaggcccuggguucaagcucuagcacugcaaaauaaauugaaaaacuaggagcaaagccaauggcggugggugggguguaauucuagcacgggagaguggaaguaaaaaaucagauguucaaggucaaccuuggcaacguaguaacuucaaguguugcccggauuacgugaaaucccaucucaaaaguaaaccaggguuggagggaugauggcucagugcccagagcuggauucuggaguaaccaaguuagaugcccaagcauggucaacagcucaagacugcauggaacuccagcuccggggaagccgaugcccucuucuggccuuggugggcacuuauauauagugcacacauguacacacauauaguacacacauguacacuugggaaccugaggccggagacccauuuaaguuugaaaguuugaggccaaccuguaugguuauaaacuugacuagaauaaaugauagcccugauaaauuagcuuagugagaaacuuuaccgcucagaugaucugaucaaguuccacacccuccacuuuccauauguaaccuucuggucuguuuauagcaagaauugcucuugauguaugauguuuccauucaguaaacaacacccagacaucugcuuuaagucccuagcaauccguuguauuuggaguuaggcacucuuuuuucccuacuuccaaaguacuggacuugugaucagagccacacugcacuuuguggacauaggugaacacauggguggagacuuguugacuauccauccugugcuaagugcucuuuaccuuccuucagcauuuuccuuaccaucccaggcgucauuucagccuguuguauggcauacuauagacuaugcuguaugcauaucauaccuugcguacugcauaguuuucaucuguguguucccacaguacccagcacaggguagagcauaauacaggucuuugccucuauuucaagaagccacucaacccuuuuaauguuccuuuuaagacauguucaugaauaacaguaauauucugguuaacgcggacuccuaccuucuccccuagccucaagcuacacuaucauuauuaauuccgucuaaaacucgccccaaaucacguaacagcagccauaucucacccauacuagcauuuuggucaguugcaaggcaaaucucucaaaaucuguuaaggcccaaucccauuccccugcuuacuagugcaccucuuuacacucaucccagcuaaauugcuucuccggcuuccauccauagcagcagccuguugcuagagguguucgucuaugguuugacagaagucucuuugauuuuuuuacuugggugguaacaggaaaaggaaaccaaauaucuucagccauagggaaaaggggccucuaggaggcugucccuggccccgagucuccauggagaagccacaggugcuaagggagguuugauugccuacgcaguuuguguucuuuucucccuaaagcuccccgagauucucccgccuacccugggccucuucagcucucccgcagcguggacccugcaggcaguccucccuuaacaagggggcggggauccccgcuuggcccgcgccugcagcgccuucccugugggacuccccucccccaccaucgagccccgaccaccgcgagccgcgcgugggcaccgaccccuccccgccgggcugggcugugcagagcgggcgggcuacggguggcgcuggcugggcgugggcagacgacggaguaggucugccaggaccggaccggccugaucggccccgggcugcaucccugugcacccgcggcgggaagguggccccaccacccggggcgcuggccccgcgucuuggggcccguggugggccggcccguaccugggcuugaagucgugguuguaaaucguccgcagccgcucacgaucugucuccagguccaguccacguucggccagaaaacucucgaaccucuggccggucucccggagcuuucggcagcugaacuugcuaggcaucgcggcggcggcggcugcggcccaggcaggaggguccgcggaaaugaaacugaaagucgccgccgcgguuuagaguuggcuggucuggggugagggugcaaaggggaaaagcccccuaccucugacgucugcuccggccagccaccuucuccccgacugccuccccuccuccguccuucuccuaccugagccuuccuuucggucucuucguccuauccccucccccccuucacauuaacucuuuccuaaggagucugaccccucccucagggcccuccccuuaccccgagcucccuccccuggcagcgagccaggauccgaacguggauaucgccuggggcccccuaaacagcccggaggaccuuggagccucagcuagggcuacucccacgcccacucuccagagccucgggacauagaaaagcugcagagcaaagggcagagccccggacaugggucggcugcagcuggacuggggccgcucguccag

SEQ ID NO: 1636 - RNA, 23735 nt, Mus musculus
cuggacgagcggccccaguccagcugcagccgacccauguccggggcucugcccuuugcucugcagcuuuucuaugucccgaggcucuggagagugggcgugggaguagcccuagcugaggcuccaagguccuccgggcuguuuagggggccccaggcgauauccacguucggauccuggcucgcugccaggggagggagcucgggguaaggggagggcccugagggaggggucagacuccuuaggaaagaguuaaugugaagggggggaggggauaggacgaagagaccgaaaggaaggcucagguaggagaaggacggaggaggggaggcagucggggagaagguggcuggccggagcagacgucagagguagggggcuuuuccccuuugcacccucaccccagaccagccaacucuaaaccgcggcggcgacuuucaguuucauuuccgcggacccuccugccugggccgcagccgccgccgccgcgaugccuagcaaguucagcugccgaaagcuccgggagaccggccagagguucgagaguuuucuggccgaacguggacuggaccuggagacagaucgugagcggcugcggacgauuuacaaccacgacuucaagcccagguacgggccggcccaccacgggccccaagacgcggggccagcgccccgggugguggggccaccuucccgccgcgggugcacagggaugcagcccggggccgaucaggccgguccgguccuggcagaccuacuccgucgucugcccacgcccagccagcgccacccguagcccgcccgcucugcacagcccagcccggcggggaggggucggugcccacgcgcggcucgcgguggucggggcucgauggugggggaggggagucccacagggaaggcgcugcaggcgcgggccaagcggggauccccgcccccuuguuaagggaggacugccugcaggguccacgcugcgggagagcugaagaggcccaggguaggcgggagaaucucggggagcuuuagggagaaaagaacacaaacugcguaggcaaucaaaccucccuuagcaccuguggcuucuccauggagacucggggccagggacagccuccuagaggccccuuuucccuauggcugaagauauuugguuuccuuuuccuguuaccacccaaguaaaaaaaucaaagagacuucugucaaaccauagacgaacaccucuagcaacaggcugcugcuauggauggaagccggagaagcaauuuagcugggaugaguguaaagaggugcacuaguaagcaggggaaugggauugggccuuaacagauuuugagagauuugccuugcaacugaccaaaaugcuaguaugggugagauauggcugcuguuacgugauuuggggcgaguuuuagacggaauuaauaaugauaguguagcuugaggcuaggggagaagguaggaguccgcguuaaccagaauauuacuguuauucaugaacaugucuuaaaaggaacauuaaaaggguugaguggcuucuugaaauagaggcaaagaccuguauuaugcucuacccugugcuggguacugugggaacacacagaugaaaacuaugcaguacgcaagguaugauaugcauacagcauagucuauaguaugccauacaacaggcugaaaugacgccugggaugguaaggaaaaugcugaaggaagguaaagagcacuuagcacaggauggauagucaacaagucuccacccauguguucaccuauguccacaaagugcaguguggcucugaucacaaguccaguacuuuggaaguagggaaaaaagagugccuaacuccaaauacaacggauugcuagggacuuaaagcagaugucuggguguuguuuacugaauggaaacaucauacaucaagagcaauucuugcuauaaacagaccagaagguuacauauggaaaguggaggguguggaacuugaucagaucaucugagcgguaaaguuucucacuaagcuaauuuaucagggcuaucauuuauucuagucaaguuuauaaccauacagguuggccucaaacuuucaaacuuaaaugggucuccggccucagguucccaaguguacauguguguacuauauguguguacaugugugcacuauauauaagugcccaccaaggccagaagagggcaucggcuuccccggagcuggaguuccaugcagucuugagcuguugaccaugcuugggcaucuaacuugguuacuccagaauccagcucugggcacugagccaucaucccuccaacccugguuuacuuuugagaugggauuucacguaauccgggcaacacuugaaguuacuacguugccaagguugaccuugaacaucugauuuuuuacuuccacucucccgugcuagaauuacaccccacccaccgccauuggcuuugcuccuaguuuuucaauuuauuuugcagugcuagagcuugaacccagggccuugcacuugcuaggccagcaaacagcccgccccugagcagcaucuguagcccuaagguaacauuugccugaaugcucuuguauuuuacccaaauaaaacugggagacuggccuuggccuugaaugacagauaagaguuuuagugcacagggaggauaucuuuuccuaaaaaauuagcuuugcacaugacaauuaaaagaugcaaauuuuaaguuucuauuugugcuucuuacuaucaaaugucuguauugguuuaaagucuuugacuacaaccuagaguguugggcauauauccugucaugagaccuagucaacaaaacugaggaaugucugacugagaugccuuagagacagucagugaguagauuguucccagagucuuccaaaaagcagaaguaguagguguuaccucucagcucucuagacuucccagcuaggacugagauuuccacuugaauaguguucucugcuuccccaccccuuuuaauagggucuuuuguauccuuaacugaccuugguggccuuaagcucccgccuucugaucuccaguacugggugggguucuaccuaugagagcuuuguaugugcuagaagaacacucugcuauguacuacuauucugugagagcguguguguguguguguguguguguguguguguguguguguguguguguguguguguguguguuggacuugggccaucagguuuaaugccaguuccauucccccuucagccaucucaucugaucuacucuguucuuuaaacucagaccgugauuauuugcuucuuccucuagauuuucauggcuugcucuuucuacauuggguguagccuauuuccaacuagaugacacugugcgucucaauagaacuccaucccugcaccacacauucaaguccccugcuuugaaaguucuguaugucuaggcucucaguccacaaccuacaguuuauaaguaguagaugcccaguaagugcuugcagaauccaauugaauuccaagaaaaugggcuauagugagcacaagucaccccucucuggagcuuccugcuagggagaauaggucuuuauauugaaugaacaggaggcaggagcuggagcccacaggaggugauggaaggaaaugguuuugcuuuguuggucuccccacucccaucccucacccuuugguaggguaggguggugaaacuaggcccugcuaggcuggccugaaacucauccuuuuugguuuuuugagacacaguuucucuguauagcccugcugacuguccuggaacucacucuguagaccaggcuagcuucgaacucagaaauccaccagccucugccucccaaguacugggauuaaaggcgugugccaccacuguccagccugaaacucauucuguaacccagauuggccuaaauuuugagacaauucuuuugccucaaccucuugaguacuacugcgauuacagauggaagccuucuuuucaaaauagaagauugacagcgugaucuaguagaucaugccuauaauaccacauuuaaugguuagggagcagaaugaucaggaauuuaagguuuccauuggcauauaggaaguuuuaagccagccugagcuauguaagaccaugucucaaaaaaucaaaagcaccugugugacccagugcuaagagaacaucacagaaguggggucagaaaaguaugagagugggcagauaggaguggggggcuguagagugcuaucuuccggacacgacaagcccuugaacucacaauagcucuguuacauccgcaucagugaggaaagaguucguaaggccccacucuagcugaggguuuauuggaaguugauggcugcaggacaagaaagggucuuuuugggggggggggaagcugguagguuacccauguuccaguggguggcaccccagaggucuugguggaugauguuuuagggcagggagcagucuggggagagggcucagcugcuaaggauacuuacugccaagccugagaaccugaguucaaucgcugggaucuccuugguggaaggagagaaccaacucccaagaguugcccucuugcacaccucugcugccacgcugcacauacaauaaagaaaagugaguguuuaaacaaaauuaaguaaagaaggcauauacuggagaggaagguguguugguagaaaauucagggagguggaguagggggugggugugaucaaaauauauuguacacauguaugaaauucucaaagaacaaauuauauucaugaaaagcuggagagaaggcuccgggauugagagagcacuuguugcucucacagaagaccugcauucaauucccaggaccuguagggcagcucacaacuaucuguaacuccaguucugggaccuuucuguacccucuccuggucucugcaggcaccgagcacaccaggacugguacacagacauacacagagcacaaaacaccuguucacaugaaauaaaaauaaaucuuuuuuuuuuuuaaaucaaaagcaagcagagagauggcucagugguuaagagcacugacuacucuuccagagguccuaaguucaauucccagcaaccacauggugacucacaauggucuguaaugagaucugguguccucuucuggcaugcagguguacgugcagacagaauaguguauacauaauaaguaagccuuuuuuuuuuuuuuuuuuucucgagacaggguuucucuguguaguccuggcuguccuggaacucacuuuguagaucaggcuagccucgaacucagaaauccgccugccucugccucccaagugcuaggauuaaaggcgugcgccaccacacccggcaaguaacucuuuuuuggcaaguaacucuuuuuuuuuuuuuuuuuuuuuaaacaaaaacaaaaacaaaucaacaaaauaaaauagacugacauaauaaagguuuuagaaacaaaauacgggccagguggugguggcgcaugccuuuaaucccagcacucgggaggcagaggcaggcagauuucugaguucgaggacagccuagucuacaaagugaguuccaggacagccagggcuacacagagaaaaccugucacggggggggggggggggggggggaccaauaaaauacaggggagagcacccugucaggcaaaagggagagccagugaggugaagacuucugggagaggggaccaacauuuggauuguaaaauaaaauaauuuaauaaauaauuuaaaaaaaauaauggcaaacugaaccaaaagagaaaggaagagaaagaaaauacccuuggcuucuugcauggaucaugguuugcugucuucccuuucauccccagcauaaacugcacuauucuugguguccuaguucuauacacagccuucacaaaacugucugccuuuaacacacacaaaaccagcagcucaccaggcagugagccuuuaaucccagcaaucuagaggcagagguaucccugaguucaaggccagcauagucuacagaacauuuuaggacugccagggcugcacagagaaacccggucucgaagaacauaacaaaacuaaacugucuaccugaaacaauggcuauauacucuguucuguuauuggcucuugacuuugggggaggcggauacgugcuugugaaagaggaagagagacucuaggucuguguaauggagguugugcucaaacuggcagcagucccccugccuccacucucaaaaguacugggaugccaugcaugauggcucaugucuguaauuccagugguugggaggcaggugcaaaaaggacacaaguuuaaggguagugugggcuacauaccuaggcuuuguuucaaaaauccuaaaaaauaaagucgagccugguuuugacccacuaauaagaacugcaacccgacuugguaaaacuagauauuccuuaagaucacuucuaaaucugauaccuuguugagcuggcuuuggcuuuuuuuuuuuuucuuuucuuuucuuuucuuuuuuuuucuguuagcugucagaagaacuacaaacaacggagggcagggcagggugguggagauuaaggcugucugcauagucaggaaagccggcugaggagcacugaugggaguggcuggaauuccuucggaugggugacuggacucagcaugggugaucagucuuacuggcugcugucacaaaagugagaaauggccaagucagacaccuggguacuuagcacagcaccuccuaaguccuuggagcagggagcugcugguagaagagguguugcugccuugcacuguaacuacacuuagugugacauaccuaaggguuagcuagguuugugcaacauggaguuguuaguaguuggaucuguguuugguagccccgccuauggaagggauugacccggcaaggaggagauagucaaacaaagccagaaguacagucaacaguaacagaaccuagaaaaauaacaacacggauaugaccaggcagguguuagaggcaauacaacugacaagcuugguaaaguuuauguguaauguaaucucgucacuugggaaucuauucaaguucaaggcuagucagagcuacacagugagacccugucagcuauguaacugaccaaggaaauaaaauuuuaaauaaaauacuuuauuuaaaaaaaaauguuaaacuagccaggcaugugucacuugcuugguggaggaaggaggaucaggacuuugaagcuagccugagcuacaagagaccuaaucucaaaauauuuucuuaaaaacaauguaaaaagagcccuuugaucccagcacucaggaggcagaggcaggcagauuucugaguucgaggccagccuggucuacaaagugaguuccaggacauccagagauacacagagaaacccugucucgaaaaaagcaaacaaacaaacaaacaaaaacaauguaaaaaauauaaaugguugaguuguuccaguguuagggacuagggaaagggcagucugaaacucauacuaaugagaacauaaauuugcacagcuggcuaggaggcaauuuugaauauucuguugugcaggguauggugacauauaccuacaaauccaguauuugagaggaugagacaguaggauccugaguuagaggccaguuucucucuccaaauggaaauuuccuuuuuaccuaaguuguacaauuuuuuugguuuuggggugugucuuagucaggguuucuauucuugcacaaacaucaugaccaagaggcaaguuggggaggaaaggguuuauucggcuuacacuuccaugcugcuguucaucaccaaaggaagucaggacuggaacucaagcaggucagggagcaggagccgaugcagaggccauggagggauguucuuuacuggcuugccucaccuggcuugcucagccugcuuucuuauagaacccaagacuaccagcccagagauggucccacccacaaggggccuuucccccuugaucacuaauugagaaaaugccuuacaguuggaucucauggaggcauuuccucaacugaagguccuuucucugugauaacuccagcugugucaaguugacacaaaacuagccaguaccauugaccccuugucaacuugacacacaaaaacaucacuaguaagccucaacccuuacaaucuuauucauccccaagaucuaaauaacuuuaaaagucccacagucuuuacauauucuuaaaauuucaaucucuuuaaaauauccaucucucuuaaaauccaaagacuuuuuacaauuaaaagucucuuuacugugggcuccacuaaaacaguuucuuccuucaagagggaaaauaucagggcacagucacaaucaaaagcaaaagucaaucuccaaccguccaaugucugggauccaacucacgaucuucugggcuccuccaagggcuugggucacuucuccagccaugcccuuuguagcacacgcgucauccucuaggcuccagaugccuguacuccacugcugcugcugcucuugguggucaucucaugguacuggcaucuccaaaacacugcaugaccccuucaguccugggccaucaauugcaacugaggcugcacuuucaccaauggccuuccauggccucucacagugccaaaccucagcugcucugcucaacuccuucaugccuucaaaaccaguaccaccugggugacccuuacacauuaccaaguccagccacagcacaauguacaacuuuggcuauaucuggaacacagccacugugcucucagaaaacacuucccagaaaaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacaggaauggcccugaaaagagucuuuaauuuucccucugaaauuucacaagccagagcuccaucuucugcgguguucucaacauuaucuuccaagcuccuacacaacaucugacagagcucuuaacaacggauggaucuucaagcacaacguucuaaaguccuuccacaguccuccccaaaacauggucagauugucacaggaauaccccacucugcugguaccaauuugucuuagucaggguuucuauuccugcacaaaccucaggaccaagaaacaaguuggggaggaaaggguuuauucggcuuacacuuccaugcugcuguucaucaccaaaggaagucaggacuggaacucaagcaggucagggagcaggagccgaugcagaggccauggagggauguucuuuacuggcuugccucaccuggcuugcucagccugcuuucuuauagaacccaagacuaccagcccagagauggucccacccacaaggggccuuucccccuugaucacuaauugagaaaaugccuuacaguuggaucucauggaggcauuuccucaacugaagguccuuucucugugauaacuccagcugugucaaguugacacaaaacuagccaguacaggguguuuuuuuuuuuuugguuugguuugguuugguuugguuuuucgagacaggguuucccuguauagcccuggcugaccuggaacucacucuguagaccaggcuggccuugaacucagaaauccgacugccucugccuuaaucccaccugggauuaaaggugugcgccaccaccacccggccaaguuguccaaguuuauuuguucucuuuggcccaccuagaaagucuaccuccaagagugugucuaguuuaaaaguacaaggggugggugggugggugggugugugugugugugugugugugugugugugugugugugugugauuauuguaauaucaaaaacugugggcagggacuggagagauaguucagugguuaagagcacugacuacucauacagagguccugaguucaauucccagcaaccacauguaaugggaucaauuggaugccugcuucuggugugucugcagacagcugaaguguacucguauacauaaaauaaauaauuuuuaaaaaaaaagauauauauuaaaaacugggcagccugcuucugucauaggagaacugacuacaccguuuaaauuaaagcugugguacucucugcugcugcuguucaggaggaagauaccauaaagcauuguguauacagaguuuaggagugcuuaucaaguaagaauuggaugugugaucuacuuuagcaagaguuuggagugaaggccuuucacugcauguccagugccggcucacuuaaauauccuaacacuuacaaugaauaccuuucauuucuccgugugcauucauauuuagucacaugaguccgcauacauagcaccuuaucuucugucuuuuucuaucaugcuuuucacuguggacuccuccauaucaacaucccauuuccauuccucuuuaaauuacacuuauuuagugugugcuuguguagaggucacaggacagcuccugggaaugagucagcucuuuccucccaccaucuauagguagcucagagguaaacucagguugucagaaugggcagcaagcacuuugacguucagcuauuuccaucagucuucucuugucuuuguuguuuguuuguuuguugauguguagcuuuagcugucccgaaacucacuguguaggucaggcuggccucagacucacagagauccacaugccucugccucccaagugcugggauuaaaggugugugcuacagcacucaaccuaguuuguuuuugagagaguaucuuacuguguaucccuggauaaucacaaccuauuacacaggcuaggcuaaucuaagauuugggguggucuucagccucugcugagauugugggugugaaccaccaugucugguucuacaagguucucuucugauucuucucccuugugaggcgccucggucuucccuuccugccuggccuguguuggcguuggcuguuugaagacgacuagggcucucagggagguccuaagcaugaguucuugguuuuaacuacuaucaaggaacucucuaguaguauuagguucugaccuugacuuuagugugagccucacauaagcaaagcugccuuuggaccacaggcaucucaaacccagugcauccaauucaaaugugaugguccgccuggcaaccuaccuucuccuuccucagcaacaguuacaaaagcaaaguccuugauuuggguauucuaaaugccucccucuuuccacucucuguucucccuccuaucugucaccaaauucugcucauuacauucugaauacaaucagaucggcccccuccucugucucuagcacugccuaauucaggccugugguaucuuuuaaccagacaacugcaguggccuucuucuaacugucucccuaccuacagucuugccuccagcaucuccauccuccaaucccgaugccagagugaucugaaacgcacauaugaucuugccacuccccugcuuaaaacccaccaacugcaaugguucuguaaccccaggguagccucugacaagggcugaaaguaaguuguuacugcucccugccucuuccuacuaauacaaacacuaacaguagcagcuaacgcuggccaagcauuccucccugugcuuucaaaugacuuaccauccuuuuaaaagaaaucauagccucuucgguguugucugauuuguacugcucuccuuucuagggaugaaggagagaggcagagaaacagguaugggagccagggggguguucugagccacgaggaccuuacugugugcucuuacaagcaaccuugcucguuuagcccaggugauggguuacuaaggaucaccacacaguugcuaggauagacuaacaacccaacagucccagcaaguuuugagggagguuauccacacuccuccagaucuugacuuuguucaucaagugcaucauguguuugggaccauccucagucuccuggguaccagaagagagggaagggcugcugaaagucaaggucaaguccaggcucuuuggccugcccugaaaaacuaucuggcucugcccaucucugccaccuccugucaucccuuucuuggaacauuucacuguaguauaaaccaacuguuaugugacacuaaccaucacucucccuuacugaggucugcuuugugccaagcacuggacuaaaugguuuccugcaaugucaguaccucaagugagccuuaugguagcccuguaagccaggucuucaauccccaucuuauuuauuuaucuuuugggggaggggguaagagaguagggguuggguuaggugguauuuuguuucuuuguuuuguuuguuuuuugggguuuuggugcuaaggguugaaccucaacccucacaaaugcuagacaguacccuuagcucugagcuucauagaucucaauaguugaagaaagcaaaguacgggcgggguggcccagcugaugcacagccccguuguaccuacccaucgaucaauuugcucuaccugugcugccuuugcccaagagaugcccacucauuccucagagaccugccccugccccagacaguccucagugcccuggcuugggccagugagcugcuccaggcagucagcaaguaggcaccaucaccgugcuggaacguaugggugcucccugagugcuucucaaggccuggucagauagcuuggaacccagcugcaagugcagugccuggcacuuaccaugccuucguaagugugugugcaguggcugacacugcacuccgggugcugagccgugaggcuguccugcugaccacuuuuccugucuucaccucucuaggcacaaagccaggcuuuugaucucgggagaaggauccuuucccuuccugcuuggguuccaccugcacccuuugacuuccgguggaaacugcuguccgauccgcuaccuugcccacacccuggacaucucugcucucucuggccccuuucucagcccuccccacagucugggcccuggccguuccugugagccgucuuuucagcuuucccugggccuuagcucuucucacuguacuuuuuauuuuuuauuuuuaauaucccaaaaauaguucccaucuaaaaaaaaaucuguuuuucucucugucuucccucacucuucccagccaacagcccaauauuggacuuuucuccacagugcucuuuaagccgauuauuuuguguuggaaagcuccaaugccuuugcuuuaaguuguuaaagauuccuaccaccccuagccagagucucugccaugagucccauccugccucgaagcagggcugcugugucccuucauaaagcagcccucgggccuuccccagcaucgucuccacagccacccugccuucccucacuucccaguauccucugcuucuggcagcuaugggaccccugccccuggcuucuccuccaugcuguauggaaugaagaucgcaaaucuggccuucgucaccaagacucgggucagguucuucaaacuagaccgcugggcugaugugcaguuaccagaaaagaggcgaauaaagccagggucgaacaucagcaaacaacacagaucacuguuggccaggaucuuucacgacagguguguggggggcagggagggcaagggaaugggguaucugguuuaaaacacaguggcuuuccuugggcuaggguagacccccacccccucaagggaggaagagaggcagggaauuaauccuaagccuuccucagggcaauuucaguccaagguucccccucaccauucccccuacuugcacucuccccagggcugaguaccuucaugggaagcaugggguagacguggagguccaggggccccaugaagcccgagacgggcaacuccuuauccaccuggauuugaaccgcaaggagguacuaacccuacggcuucggaacggcggaagcaaaccugucacccucacucaccuauucccacugugcuggacgccccaguuugucuucuaccauggagaacaggaccugcccugcccacugggccccggugaguggucucuguccagcaggcuccugacuugugaugggggugcuggguuagguugcuccuucacucagcuaacuuuuuccaggugaaagcuaugaacuccacaucuacuguaagaccagcauuguggguuacuucccagccacuguccucugggaacuccugggacccggggagucgggagcagaaggagcagaaacuuucuacauugcccgauuccuggcggcugucgcccacaguccccuggcugcccaguugaaacccacaacucccuucaaacgccccccucggcucaccagaaacucuguguugaccaaccggaucgaggaaggagagaggcccgaccgguaacuagauaggacugcuugggcacuugggaagacugagcaaggagagacagaacccccuuccccaucuucaggucacucccuccucugggucucaucccuuucauaucagaggagcaaggugcgugagagaagcagaucccagcguagugugaagacucucaaguauuuaaccuguagggaaauggcagugugucauagaccuuuuccaggggcucuggcacucucuucauacacacaaauucauagaaggauaaacauuuuaagauaaugaguaauaaaugcaaaccauguaauuaggucuuuauaguuacaacauauguuccuuuuaaugauauauauguauaaacaaauuaugcaaauuaugguaugugguaggcccuagguuauccuagcaccacagucaaucaaaaggccauggauguaugccugcaagcccaccacuaggaacucgaaagcaggagugcaaggucaacccuggcuacugaucgaguuugaagccagccugggcuauauaauaaccuuucucaaaaaaaaaagacaggaaaagaaagaaaaaaugucugaaagauuauauaccaaaaaguuaaaguugacugucccugaauguuaagaauguuacuuauuuaaaauguauugcuuuggugggguuucuucaaaagagcauguauugcuuauguuugcauuuuuuuguauucuucuccacugcuaagugcuggccugugccaccacacccagcucauaaaauauuucuuuuuuuuuuuuuuuuuaaagauuuauuuauuuauuuauuuauuauauguaaguacacuguagcugucuucagacaccccagaagaggguaucagauuucguuacggaugguugugagccaccaugugguugcugggauuugaacucgggaccuucagaagagcagucggcgcucuuaaccacugagccaucucgccagcccaaaauauuucuuuuaaauauuccaaguauuaggcuuuacaaaaaugagaguggucuaaccuuggacugcaucaccucagcuggucuaaccuuagcugcauaagcuaaggaguaccgcaucucuagauggcugcugaccacacugcagaagucaguagaaauguuuccugcaggcccauggggaccucuccagagucuuugaagaugagguguuucuguguuuaagacaugcuuucuuuccucucacagagccaagggcuaugaacuagagcuaaguuuggcccuggggaccuauuacccacccauccuccuccgacaacugcucccuacccuucuucagggaccaaguaucuucacugccccaaaggagguugcugagaucaaguaaguggcaacccuugugcggcgugcucccuugucuuccucucucugcugguuccuccccgucuguacucacucaccaguuccucuugaacaguccuuggcacccacagcauguucaaucuggggaugauugaaccccagagcaggaggguuaccugacucaccauaauccugcugcaacucaaccauucuucccagggcccagcuggagacaacccugaaauccaggaacuaugaggugaaacuccggcugcugcugcaccuggaagagcugcagauggagcaugacauccggcacuaugaccuggacucgguacccaugaccugggacccuguggaccagaaucccaggcugcucacccuggagguuagaacucagaccugcuguggggaaggugggcccgugacagcuugaaggaggucacaggguaaacaggacagccugacaaacauaaaagaauuccuauuucagaagguaugggcaaagagcaggcaggauaagauuccuguccccccaaaacaugccagagcagggcaguguguuuucuuucuagcccaggcuaguccucuugugucuaccaccccagugcuguguuuauggguaguggaauuuuauaaucuagauuuuugcccccagcugugugacauugaugagucucuuguuuucccaguuuuauuagauaauucucagacgccuuucagauguucacauuuugguguuuaaaaucauauuuaucuaucuaguuauuuuguguguguacagcauauauaaccuacauguagaggacaacagacaauuggcaggagucuguuuucucuuuccaccauguaggucccagggauggaacucagguugugaaacuuaacagcaggcauucuuacccacugagccaucucaccaacccucaaauuuugaauauauacacacaaacucagacuuacuagaauggccuaaugcacaggaaugcaggcaggaagagagacagcuaagaugcuaaggaaaagguuguuacaagaaggaguucucaccaaggugcuaaaggcaaaacuggaacugaacuggccaagaagcagcuagcuggacuggggacauuggcaccacugcccggccuuuccccgauucuugcuuugccuuguaggagagaaaagcuggggugaguuggagcuguaaggccagagagagccagggagagacuaaggccacugcgugcaaaagcuugcuuuuguucauacccugcagguuccuggugucgcagagagccgucccucagugcuacgaggugaccaccuuuuugcccuuuuguccucugagacccaacaggacgacccugucaccuacaaggguuucgugcacaagguggaacuggaccgugucaagcugagcuuuucuacaaggugaguguuggaagaagcaaaucgucuaggugaccuucaggcuucuaagcccugggcauaggaggucuugcuuucagagaggacuaggacccuggaugcaggguucacagcugugugaauggcuucuucucucggagaacuuuguaaggaccuuuugggaaaggagaggguggggagcagaaugguugggagguagagaggguccugaauuuuuacuaccuauuccaccuaacuacaacucucccacuuaauucuuucccaaagccuccugagccgauuuguggaugggcugaccuucaaggugaacuuuaccuucaaccgccagccccuucggguccagcaccgggcccuagaguugacggggcgcugggugcuauggcccaugcuuuuuccuguggccucccguggggucucguugcugcccucagaugugaaguucaagugagacugugggcagggauccaggggcuacuugggguguggauguugggaauggagucccagaagccucuugggauacuagaugacuucaaguucauauucuuggacccuuugccuuccaggcuguacgaucggagucuggagucaaacccugagcaacugcaggccaugaagcacauugugagggguaccacccggccugcccccuacaucaucuuugggccuccagguaccggcaagacugucacauuaguggaggccaucaaacaggugaggcugcagcccccagcauaugucugcaauuauauugcuuccagcgagcugaaugugccuauacuugaacagucacccaaagaggaaguagggauuagagucaugaguauugguguguauauaugcagacgagaauuuacugauauccagcaccaaggugucaucaggacuagcagacaucuggaaggcaaacgcagucugagucccaugucauagagcacgucugcccagucugucuuuuuuuucucagguagugaagcauuugcccaaagcccacauccuggccugugcuccauccaacucaggggcugaccuccucugucagcggcuccggguccaccugcccagcuccaucuaccgucuccuggcccccagcagggacauccgaauggugccugaggacauuaagguaauguaagaaaguacagagagccaagggaugacgggugucugggagguucucagagcacuugaagacuugcugugugacuuugggugggucaggaccccucuggggacuucaguuuccuugucugcaaaaggagggaggcagguaaauaagugguucauagccaaggggagacgugagaaagggaagagcuaggcugauuucugaugcuuucguaauccauagaccugcuguaacugggaugcuaagaagggagaauauguguauccugcuaagaagcaccugcagcaauaucgggucuuaauuaccacccucaucacugccagcagguacauauaggguuuguguauuaagugcuaggaagaguaaugggcuagggaaagaggaaggguucccgagggcagggugaacugaagggcagaguucagguuugguaguugggugccugggaaugacccugcuuggccugacacucccagguuggugucagcccaguuucccaucgaucacuucacacacaucuucaucgaugaggcuggccacugcauggagccugagagucugguggccauagcaggugagggggcucaggauggguuacagguacagcacccccacacugauuugguaaucccaccauuuaaccuuucucuuccugccucccaggacugauggaugucaaggaaacgggcaaucccggagggcagcugguacuggcaggagacccucggcagcuggggccugugcugcgcucgccacuagcccugaagcauggacuuggcuacucucugcuagagcgccugcucgccuacaacuccuuguauaagaagggccccaauggcuaugacccccaguucaucaccaaacugcuccgcaacuacagguaucacuguccccuccccugcaguucaucucacaucgucacaguggcuguuagcuggaagggggggggggucucuugguagcccccuuuacagcugcuugucuugggacuuagcagguuuggggaccaaugauuuaucugcauauugaaggucaccagagcaaagagugucuggauggaucuaaguuucuaugcgauucaggcagggagcgcugggugugguggcgcacgccuuuuaaucccagcacucgggaggcaggggcagguggauuucugaguucaaggccagccuggucuacaaagugaguuccaggacagccagggcuauacagggaaacccugucuugaaaaaccaaaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaggcaggaagcauacagcuuuccuuaaaaggauuguugguugaauugcauuuacaacuguguccuauauaugugugaauuuuauuuuuugguugguuuuucuugagcccaggaccuugcacacugcuuucaagugucugacauacugauguacauguacauccucgacucucuuuuucccuuugagacaggaucuguuuguauugccuaugcugaucuuaccuuuuggcucaagcaaucuugccuuagcccccugaguagcuaggacuguaggugcacaccacccucgccaucuuaugcacgugcaguaaagggaguugagacaucaaugcuuacgugaguuguugaccaucagugugagucugguaaaugugggacuucagagucuuacagagaaccuguguucagcacccggguugggugccucggccuccgaacuccagccccuggaggaucugacaucuuuggccccuucggucacaugcacacacauauacauaauuaaaaauaguaaaaaucacuuaagguuugguaaauguaaacugggccgugucugcacgugccuauaaucccagcauuuggagguugagugagacgggaggauugaguguuuaaggcuagacugggcuacacaguaagacacuaucucaaaaaggcaggcuugagauggguggguaaaagaacagcuauacauaucuagcaacccaaguuggguuuccccaaccagugagcccacuugaaaggcgagaacugacucuacaagguuguccucugaccuccacacccauggcauagcaugacuguucacaccacucagugacaauugcagaaguucuguagaugccucugggucgauacuuaauaguuuugagguguaacauaauuaaagagugaugacaauagaugauaaucuguuugcuggacuaucuuuguuugguaaacuuaaacccgagaauggauccuaauuucuaaguuuguuaaaaggaauuuaaaaggcugcugagugagagcccuagccuuuggcuuggcucucugugguuugcagcaccugacagcaaacacugauggcuguuacugggcauggcugaagggccagcgacuaggguggggagcacuugaagcagagcucccuacgaggucuuggaucuugcucucuuuccuccugccaccuaggucucaccccaccauccuggacaucccuaaccagcuguacuacgacggagagcugcaggccugcgcagaugugguggaucgagaacgguucugccgcugggaggggcugccucagcaggugaggccuagcaggcagagcacagucuggaaccccugauucucuagcuggguuggaggauugggaggcagggagaugagccugaagguuuccucuuauuucauggcguccagggcuuccccaucauuuuccaugguguaaugggcaaagaugagagagaaggcaauagcccauccuucuucaacccugaagaggcugcuacagugacgucauaccugaaacaacuccuggccccuuccuccaagaaggguaaagcccgccugagcccccgaaaugugggcgucaucuccccguaccggaagcaggucaggcccucaguccaagccuaggacuucccucuuugcccgccagcacccuggccagcagccugccucugccuuccucuugugugagggggauggccuaagagaagggcaccuauuccucccuccagguagaaaaaauccguuacugcaucacaaaacuugaccgagaacuucgcggacuggaugacaucaaagauuugaagguaaccuaacucucgaucauacuccccuuaucuaggccugugcuauguccugucccacccuguuuacucaaaguggaacugggguuucccccaggugguucugagguggaaccuggcaggcugccaguuaacgcauacugccuuaaucagguguguggccucugccuaagguuaaaguccaaacucccuuuaccaaccccuccuguuacgugauaacaccugucacaugauauugccccaagccuccuacguaguuuaacuguucuugagggguggcucaacacugauucagauuaaaguuuaauaaugccacuucuuggaucccacccagacaauuaacauagcugcccgaggcagagccagggcucugguagaguguuuguucuuauuguuaugguuuuuaaaaagauccacaggugagugugauauguggagccaggguugaaaaccacugaguuaggauuuacuggccucucccucagaauuucugaccaaauugguggcugccuccagggaugagaacucccacucuguuccuuugcagcacagugccguuugcuuugaacaguuuccaggccccccacccuauaacuggcucugucccacagaccuucacagcaggccuucugcccucuuccgggcucugcgauucucuuacucaucuccaaguacccagugucuugucuguaccucccuggcagcuuuguccccuagagcaggucugucaccgugguuccuccuaggccuaucugaucuuuaaagcccugugucugcacucuaggugggcucuguggaagaguuccaaggccaagaacgcagcgucauccucaucuccaccguccgaagcagccagagcuuuguacagcuggaucuagacuuuaaccucgguuuccuuaagaaccccaagguugguaggcuuguggguggcgugaguccuuccauggggccugucccuuugaugacaucaccgcuuccuccauccagagguucaauguugcugugacccgagccaaggcuuugcucaucguagugggcaacccccuccuccuaggccacgacccagacuggaaaacguaaguguucccagcccccauaguugcucuuagccaccgugagccccagccuggggcagguuuguccucgacaagcacuggcuuacuucucccuuaguccucagagcuguugguguuaacaaugcccacccuguauuaauaagugagguggagcaacucugccucagaugugacagugccgagcagaggccgccagacucggcuccuuggcaguuccccaugcaugccgauguucugaaccccacagguuccuggaguucuguaaagaaaacgggggauauaccgggugccccuuuccugccaaacuggaccugcagcagggacaggacuugcuccaaggucugagcaaacucagccccucuaccucagguauggaugggcccugcugggccagggaggugaagugugggaagccggcaggauaaccaaggaugucucuuuuuuuucucccagggccccgccgucaccagaaucucccccaggagcgggagggugaagggggccugcccuuacaaguggagccagaguggagaaaugagcucugaggccacagccgcccgccuucucacaccagccaagccuuauugcugccuaucccugacccagaacccagcucuccugucccugcaagagaugggaaggccgggaaguuuacagcccagaccauuccgccccuuccucugcuagggaagacaacccaagcugcuaaaacucggaggaagggggaggaagaaagcuuuuuuuuuuuuuuaaacccucuccuuugcagugcuggggaucgaacccagagccucaaauaugcuaggcaagcacucugccccugagcugcuuuaagaaaaacaaaaugcuguucuaugcaaaagccu

SEQ ID NO: 1637 - RNA, 1951 nt, Mus musculus
aacaagccacaaaucuaaccaaccacgaucuaguuggagaccagggcucagaaucuguccgcucuuggcuguugguccagugcccuguagugcauuagaacugucucucacucaucagucagcuuguuuuguggucucuaaaauucuccugaaguuucccucuauucacuguguccuuagauaugauaaacugugaccacaaaaauccaauauaucaaauggaauaagagucagacaaguuuuaaaguuuggagugaagggaagaaauguauuuuccauuguaaauuauuccuuuuuuacauucucauuucuuacacauuugacuugacugaugucagguuccgggccuaaugcuacauucauguaucauaucucuaggcauuuaauaucacuugauuaacucagaauuucaaaugauaaggaucaguaguuaaugaugcauagcauuuugauggauuucacaagcagccaucucuuugaguuguuguauguguaucagaugaacuuaucccagugcuuucccauagaugcccuggaguucaccgacauagcucuucugggacucugagccuucugacacagucaccucauaauaaagcucugggcucagcauucugguuucucuguauuccccaauguauauaguauauacuuguuugaaauuccuaauauauugcuuguacauucuugcuuguaagccucagcacacaccaguuccuucaacauagaaugccuuccucugacugccguccagcuguucaugccuuaucuuauaacauuccagcucucgggcaccuccuuuggaaaagcaccucugauggaucucauucauacuuuauucuaagauuuguugcccagucucuguuugucucuguguaacugcuguuucuguguguugucucccaacauucauaaugcuaacaaugauggccauuccccaacccccuugccuuuuuacucuacacaaaccuaugaaaaccuacugacagccuguccaaggucaucaguguccuagugcaccuuucucccuuuuacuugauaguuguauuccuuggagaaauaaggcaucuguugaggcaaggccugcgugucagcauguggguccucacguuuaggaaauacuuaagccuuugauuugucccaugucugcauucuucucggacaucuucaagcuacagacaugaaaccaggaguagacccaaagauagaaguagggaaauuuccacugaaagccaagguagaauuuuccuuccuuuucacacaagaucuaugaagcugcuguugucagcagcucaccagacauacuccugcucugacucuuuuccaggagucaggguuaguuuaagaaaaaccucuugcuagaagccaugaccucguacuuuuaucccuuccaucuggugugcggccucauggggcugugcugcuaugcaggaggugagcaguggaauucuuuagaugaugacuucugagcccacauguggaggcaguuggggguggagagcaggagagcagugagagccaagauggauggaccaaaaccuaagaguugcugcaggagaaauccugacuguagguagguguucuuuccccagcucaagcaggggcccaggucagagagcugcaacgucccaggcuaugauugaugagcacugugcuccugcagcuucgccucuggcuucucggcugggguacaccagugagauacgcaggggauaugagggcuuaugcuaucuuaaccaaguguacuccagugcaggacaggaaaggcuuggcugagcugcuuuuuuuuuuuuuccucugcuguccacgauuaaacugagaccccaauuuugagugaguguagaaggaggaacugagagaagcaagaguuuuugaucaaauaaaaucugcuucugucucaucuuagagauuuuucucugcaucauagaucuccuuugucuuagcugugucc

SEQ ID NO: 1638 - RNA, 1951 nt, Mus musculus
ggacacagcuaagacaaaggagaucuaugaugcagagaaaaaucucuaagaugagacagaagcagauuuuauuugaucaaaaacucuugcuucucucaguuccuccuucuacacucacucaaaauuggggucucaguuuaaucguggacagcagaggaaaaaaaaaaaaagcagcucagccaagccuuuccuguccugcacuggaguacacuugguuaagauagcauaagcccucauauccccugcguaucucacugguguaccccagccgagaagccagaggcgaagcugcaggagcacagugcucaucaaucauagccugggacguugcagcucucugaccugggccccugcuugagcuggggaaagaacaccuaccuacagucaggauuucuccugcagcaacucuuagguuuugguccauccaucuuggcucucacugcucuccugcucuccacccccaacugccuccacaugugggcucagaagucaucaucuaaagaauuccacugcucaccuccugcauagcagcacagccccaugaggccgcacaccagauggaagggauaaaaguacgaggucauggcuucuagcaagagguuuuucuuaaacuaacccugacuccuggaaaagagucagagcaggaguaugucuggugagcugcugacaacagcagcuucauagaucuugugugaaaaggaaggaaaauucuaccuuggcuuucaguggaaauuucccuacuucuaucuuugggucuacuccugguuucaugucuguagcuugaagauguccgagaagaaugcagacaugggacaaaucaaaggcuuaaguauuuccuaaacgugaggacccacaugcugacacgcaggccuugccucaacagaugccuuauuucuccaaggaauacaacuaucaaguaaaagggagaaaggugcacuaggacacugaugaccuuggacaggcugucaguagguuuucauagguuuguguagaguaaaaaggcaaggggguuggggaauggccaucauuguuagcauuaugaauguugggagacaacacacagaaacagcaguuacacagagacaaacagagacugggcaacaaaucuuagaauaaaguaugaaugagauccaucagaggugcuuuuccaaaggaggugcccgagagcuggaauguuauaagauaaggcaugaacagcuggacggcagucagaggaaggcauucuauguugaaggaacuggugugugcugaggcuuacaagcaagaauguacaagcaauauauuaggaauuucaaacaaguauauacuauauacauuggggaauacagagaaaccagaaugcugagcccagagcuuuauuaugaggugacugugucagaaggcucagagucccagaagagcuaugucggugaacuccagggcaucuaugggaaagcacugggauaaguucaucugauacacauacaacaacucaaagagauggcugcuugugaaauccaucaaaaugcuaugcaucauuaacuacugauccuuaucauuugaaauucugaguuaaucaagugauauuaaaugccuagagauaugauacaugaauguagcauuaggcccggaaccugacaucagucaagucaaauguguaagaaaugagaauguaaaaaaggaauaauuuacaauggaaaauacauuucuucccuucacuccaaacuuuaaaacuugucugacucuuauuccauuugauauauuggauuuuuguggucacaguuuaucauaucuaaggacacagugaauagagggaaacuucaggagaauuuuagagaccacaaaacaagcugacugaugagugagagacaguucuaaugcacuacagggcacuggaccaacagccaagagcggacagauucugagcccuggucuccaacuagaucgugguugguuagauuuguggcuuguu

SEQ ID NO: 1639 - RNA, 17391 nt, Mus musculus
cagagcagguggggacgcggcgcgguggcgccccguagaacggaggggaggaggcggccgccacaccuagggcgccggggagcacccgggcuggcgcgggcggagccgcgcugaaggccgcgcguguccccggccccgccccgccccguccaaugagagcugcggccgcaggggcugucggcgcgcucuggcccccgccgcacuccgcgccccggagccacugacaccgcacccgaccgcccacacccggcucagcgcucgucggucuccuggcccugcacgcucuugggaacccugcgucuggcucccgggcuccacgugccuugagguccucggucgcccaugguccccauggccacucuguggggcgaucuaggagacgccugaggaagcccagacagugcccguccacggcccugcgggcuucggggcgggagucugcggggagcuaugcugaagcugcagggugaggaugaagccgcgcagcucgccccucggcgugcccgcguccccgugcccagacccacggcccccgacguguccccaucuuccgcccgccugggucuugccugccugcugcugcugcuacuccugacucugccggcccguguagacacguccuggugguaaguaugguucugggguugguaggcuuacuggaacgagugcauugcucugggcaucggcugcuuaggcaccagaauugccuaggaggaauuagaggaaggacacagucccagaaguuuccaguggccagugaggaguuggagaaaaugaggcgcuggagaggagagcccugggcaucuggaaggagggagcugaugguugaaguccccuaggcugccccauugugccccuugguauuucuacugaaaccucuaccgcagaagcuacuuggugauucucucucagggugggaacuagucgccucuccacauccugcagugucuguuuggcauggucauggucuucaaaaaaccuuacaccaccuaagagcccuuggagacacgaguagggggggcagcuggcugucccccacaucccucugcuagucuagcccacacaacgagccaguagcauccacggaaaggcuuagaagugaaauugaggcacaaacuuccccuaaugcccacaaccgaaacaaauuaaauccuugggguugcauaacgcaggcguuugucaccagccuuggcuuugaggguguaauuuggaacaccgaugcccccuuuugcuuuccugucccagauaacauaaccucccgccuuuccuccccaagccccaggggcuucuagagucucaagaguugugagacccucucuucagaucucuuccugcaggccuuaaucuucagacacuuccaaagggcagaugaggcaaaaggcguccaggauccaccggaugccugcuguguucuuuguagaauucccgacccggccccaggacuccuucaucccccuuuggauacgcauccucuuuccaggaagggcaaggaggguagaaucggacugcaaaaagauucggauggcucauccuuccuccucaccucuccagucgaacuggccucuugggcugggccagugcccucucuaacauguagugucucccuuccccgcuugcucugcuccuccccugaaacaagcacccccuccucacccccaccccuaccucccacagagcgaggucucuucucuugcacccuguagcugcuuucuccccuggacuaggaaucugggcuggaggggugagggguagcuggcugaggggcaaggcagcuugggcugcagauuccuaucauuucaagaugcugcucucuccauccccacccccaccccuguuuuccuguuagagaaaaaucuuccuuuuggaucuuuuuuaucucugcaguguuggagaaggcaaaaaggcggguucggacgaggaagcagagaggccuauaucuuacaucuggcuugaaacauuccuuuagaaagggaaagggaaagaaggaagauggagaaaaagagccuuucagugacuagagugccccccacccccaucuuuaugacccaguuuggcuggggacuucagguucccugugaaaaagcauggaagcauguaguacccagcgcucaccuuaaucuggcccacacggcaacuggcuuuucaaaacacuugacugcuuuucaccaguuuuagucucccugggcuggagagauggcucagugauuaagagcacugacugcucuuccagagguccugaguucaauucccagcaaccacaggguggcucacagccaucuguaaugagauuugaugcucucuucuggugucugaagacagcgacaguguacucaugaauuagagagagagagagagagagagagagagaagacagcuacaguguacucacgaaucagagagagagagagagagagagagagagagagagagagagagagagagaagacagcuacaguguacucacgaaucagagagagagagagagagaaagagaagacagcuacaguguacucaugaaucagagagagagagagagagaaagagagagaaagagagagucagucagucuuggugacccuuggaugcuucacucuggacuuucccacauucuggucagaccuaaagacucgccugcaacucuucuagccccauuuucacuccugacuacuacucccuuucccauuuccuuccucccucccuccacaagugguucauauuaaagauguugcaaaugcugcuagauggaagagcagagggacugagugguuccuauguccaugugaaacaaaggaaggcagcaucagggccaggacgagugugggugcaaagcucauuggcagaugucugucucaguggucaguacuuguaggaggaggagaccugaguucuaaaggcggggcgggucuggcccccaaggugaucaaacccauaagauuaguacuguguacagucaugaaguucccggaggagagggaugucgacugacucagugugucuguguucuacucuggagcagaaggcuaucccuaugagcagucaacagucugaucucacagcucaggauucuucccuuuccuuucccauaacuccucugcgccuucccuuaacuagaagagacacgcgguuucuucucagucugugacaagaaacguggauauauggagacucacaagagcugggcauguucuugggcucauagagagagggcagagggcagcgucgucuuagcucuccuguuaccaucacaggcacucuguugugcucccuugcuaaguuccagcaccauggccaagugccuugagaagcaucaccuuuaaucuccaguuugagugagugagguagggacuguuauaaucccuguaacgccaaugaagagacugagagauaggaagggaaaacaacaaaaccaaaaggagcugggagagguggcacacagcccgaaccccagcacguuggcaaguuccagaucuagcuagcaaguucuaggcaaaagugagacccuaucucaauaauaauaagaaaaaauugcuuaaauuugcaccaauuuuggagucguacaguuuuauuucuaaucaagcgugcugggggaaucaacucuuaggccagucuuggauguauagugagacgcagaaacaaaacaaacccaccaaccacaaaagccccuuguguuugaauugagguggcuuccuucauccugguuucuccucaaguauccuucaccgaguaggcuuuccaucaauguuucugaacccauaauguugagauuucccugacucacacucugugguaucaucuuguucguuuguuguuguuuuuaagagagcaacucauuauguaugcaucccuggcugcccuggaauucuauacagaccaggcuggcuucaaauucagagaucugccuguuucugccuucugaaugcugggaucauauaugaaccaccacugccagcuaugucuugauuuuuuuuuuuuuucagaaugaucugagaccuguguacuaugcaaagaagagauuugggggggggggagcuaacagucuucucugcauuuuaaguccaguuuuuguugaguugaaacacuuauacuaaugaguagacacaaaaggaaucagauaggccagguguaguggcucaugucuuuaaucccaguacuuggaaggcagaggcaggcaggacucuguagagaguuggaggccagccuggucuacaaagugaguacagaacccacguuggugguauaguggugagcauagcugccuuccaaagugaguacaggauagccagggcuuuuacacagagaaaccuugucucaacaaaaaagaaaacgaaacaaaacaacaagcaaacaaaacaauaaaacaaacacaaacaaaccaacaaaagguagugggagaucccugauucuauuuaaaaagauagaaacauaaagcuucuacaaaagaacaggcaguguugacaggaaucaggcuaacuggauagaaugagggaugccuaggagagauggaagcgggggauaaucagcaagcacauagugcuacugagcacuuacugugugccaggagcuuuccuuagcacuggguauacugauucagcagauguggaggccaagggagucuagguccuuucagaccccaagcaaggggcuaguguugguccuagugacuuugccaaaggaaagaaggugaauuggucaaaagcaggugaagggagcccccuggcacaggaggcuggggcagaaaugaagaauuaauuucugaaagggaaaagaggaagucaggacugaggcauccucucuaggacaaugagcugggggauggagaucaugaaguauuugugccccuaacaacuaagcucagugacuggcacguggcaggcauggugcaagcguucguugggcugagggcgauggguucggcuucagagucaguaucacuggcaguuuccacguuugacuacaagggcucugagaaccagacagcaggcaagccccaugcagggucuugaagcaguuacuuaggaaccagcaugguaguaggaaaaccuaauuaucuucccaucauauauaccgaccagauguucccaugcucacugaggacguaauaagaaagaucagugugggcuacagcggaauggauuaaagucagaccacaggaaggccuuuucaccagaguuuggccuacccuacuccacacugucuaugagggcuggauucuuggucuaccauucccauccauucuccucccuccaagccccagauaaaaaaacaaacacccaucgccuagaucaguaaucuagggcugagcuggggaagcagagcgguggugagacagggacaagcuccaacucugaugguuucaauacuccaaacaaagcaccagggcaguggguguaacucaaagcugugcgucaggcaggccuuuccggccuggccuggccuggccugggguguuuauuuuguuuguuccuggaagcugcugcccugauggacaguguuggggaugcugaguccaugggauuuguuccuggaggaucagcccucucacccuucuaucuggacagauggggcucaucagaccuccugaguucccgacgaggccaucgccaacccuccuuguguuugccugaguuacugucacuaguggugaggguuggcugugggaauguauggugggggcagggcugguuggguugccccuccucuauuggcugccuucucuucucuucucuccacucacuuuaggcccacuuuggggccauugccaaaccacuggcucauucauaguucagaccgaaguuuuucuguuugcaguagcaacuggucacuacaguucccaccuguucccuccaggaaagacagcgauaguuccauuuagguguuggaauagaauauacugaaaauacaaagggcgagugucgagugugugugugugugugugugugugugugugugugugugugugcgcgcgcgcgcgguacaugugucuguguuuguagguuauaggcgagacagaaaggcagagaagcugagcugcagaaagagggagugagucucaucucuuugggggacuucuuggggagaaagggugauaugcuccuguuuucucuccagacucucuugagaccaugguagagugcaagggcaacaguauuugaaaggagagguaauauugccuugagcaguuucugaaugaugcuggcagcccaccuauccuucaguggcugucuugcuuaggcuuguaaauuugucaaacuagagacucuaucacauuuuaauugauugaauggauugauugaugauugauaaagagacugguucucauuauguagcucuggcuggccucgaacucucuauguagacuaggaugccccuagaacucagagagaucugccccugagugcuggucucaaaggccugugcuauccuguucagacuucccauugcgaccagcucuuugucgguggagguaaagggaacaggagugggggcgggguuaaagaugggggccuuguuccauagccucaggauuuagaacaggauguuuuagcuaccagauccaaagcuguaaacauugcucaaaccugcucacucugcguucuccagcccccuccucucuucauccugcuguggccaagcgaucuucaugggccagccacugugucgugccucucacaccagcguguaagaguguugucgcagauccuuauuuuguuaguuuguuuugcugugaggaucuugguguuuauuaaauaaaccaaccguugaguuuguaugauaugccacaagccuggccuguguucuagaagugugugucacuuuggccuuuggcuuggggccugguaaugguggagaccacucaauuacccaguuacucucuuccugcaacugcauagcuuuuuuuuuccccucucucucagagauugcagguaaugguucuacccaucagccgcagagaaugucuugggaaaggaaggaauguuuuuuaaggucuauauaucaaauaacucaccucuuuauccuucugcugacgcccagccccuuucagaaaggaggcuaugacaaggccaucuccacuuuacagguacauaggggcucugggagcccgagugaucugugacaacauccccggucuggugagccggcagcggcaguugugucaacgcuacccagacaucaugcgcucaguaggugagggugcccgggaauggauccgagagugccagcaccaguuccgucaccaccgcuggaauugcaccacacuggaccgggaccacacugucuuuggccgcgccaugcucagaaguaggauccucuuccaagcuucugacgccccuucccuuccuaugcuugggguggggggaguuagaaggguaggcaccacccucuucauuuccccacacaaacuuuauacuuuaagaagcaauugugagcaaaccugggagacagggacagcugcucucuagccuagacuguaagccagggccccucuuccuugccuacuuccaucuuacuccggccuuucucuggcuuccccauacccaagcccagcugggcauccaugaacucuguggcuaaggaugagaaccagguucucugcuucuuaccaccacaaucaccauugucacccaggcacccuaacauuauagcgaagggcacaaaagauaaacagaaggugauaugcaaguauuccaagagcugauguccugaccccaguucagcaaagguucagcagaacuagaaggcagaggaggaagggggugaggugggauucugugggugaagaacggggggcagaggaggaagggggugaggugggacucugcgggugaagaacuggggguguugaaccaccaucugcaaggguaaggggagaaccagagcagacucaguaugguucucugaacaggcugacccccccuggggcaaggggguccacauugcgagggaacuguccagcaucgguggccugaaaacccuggaauguugacuaagacagguguggcugcaucagggcuaguucucucucucuucccccucccccuauucuguggugguggugguggugguggugugugugugugugugugugugugugagagagagagagagagagugcaugggagagugggugagagagcaagaaugagaguaagagagaguggguaggagagagcgugcaugaaaguaagagagugggaggaggugggcagacccuuagggaaaacaaaaggaaacagaguagagguuagccuaagagaucggauguaccaaggaguggagcacugaggccucacgggagaggauggcuacuacucugagggaugcucuuagaacacaaggaagcuuugguggguggguugggcucuggaaaagcggcggagacuucugaaguugugcugguugaagaaagggauggacagaguuggccauguggccuggcucugcaauccuagcacuauggaggcugagacaggaaaagcucaaguucaaggccagguuacauuuacauaacacuuuccagaccuggaucauggaguaagacacugugagaaacacccagaaguaaguaaguaaguguguguguguguguguguguguguguguguguguguacacacacacacacacacacacacacacacggagaggguggugguggauguggaggaaggggaggaauggaagacacgggcugggccauuccuguaauaagucucugccugucuuguguaggcagccgggaggcagcguucgucuaugcuaucucgucagcaggagugguccacgcuaucacucgggccugcagccagggugagcugagcgugugcagcugugacccauauacccgcggucggcaccaugaucaacgaggggacuuugacugggguggcuguagugacaacauccauuacgguguucgcuuugccaaggcuuuuguggaugccaaagagaagaggcuuaaggaugcccgggcccucaugaacuuacacaacaaccgcuguggucgcacggucaguacucacaucugggaauauacguucacauuuucugguguaaaccaguuagugugaccacaggcugaauucaaugguagaggagucaauggcuucugguucacuuccacgaucccuaaccuucugccacagacugcauggagcuugggaaugcagggggcauuaggaauacauagccacaaucaaguuuucaugagacagagaaauaacuuccuuuuucuuccuuuucuuuuuuuuuuuuuuuuuuaaucuucccuuucucuucucuuucuuucccaguuuccuuccuuuugguuuugguuuaguuuuucugcauggaauagggaacugggugaagugggggcuuaaacuccagguuuguuucuuucagggucugugaaaucuuggcuaucuuggaauuugauauauagaccaggcuggucuugaacucacacagauccgccuacuucugccugcuuaguguggcaguucaaggcauguaccaccauguccugccaaugaugcuuuauuuguuuguuuugucuuguggacagggucucacucugccgauauccuaggcugaucucacaauugaugccaugcucuuguggcagccuccagaguagugagauuauuugugugugacaccaugccugacuaaaacgcaaauuuuaaauauuuaaaaaucggaucuguuaugguuguguguacacauguggauaucuaugccugggcuuugucacagaggucagaggaggaugucaggugucuuguuccgcuacccccgccauauucucucgagacaaggacucuuacugaaccuggggcucaaucccagcaaucuuccugucuccaauccuccuguuucugugccccagugcccaccaccgggauucuaugucaugugcuaccacgccuagcuuuuuacacggguucuaaagacuuaaacucagguccucacagggacuguaagugcucuuaagucccuggcugucuccuaagccccaaaguagcuuuuaauuuauuaaguuuuaauuuauuauuguuguggauauaugcaugauauauaugggcaggcaugcauggcauggugcauguguggaagucagaggacaacucuguggaacugguucucuucuucuacuuauagugagugucuagggaugaaacccagguggccagggcugcauggcaauuaccuuucauugauaucaguaucacugacccaaaaguagcuuuguuuuguucugcuuuuaagaagaaaacauuccuucauaacaacuaagaguuucagguaucacuuuaggcuauucacucguguuugagcaucugcuguguaccaugcugagaaauggugugcuauagaagcagaagacaugguaccuagcgcuuuaaaagauacacaggcuguaaucaggagcagacuccuguggguugacaauccagcaggcagucaugcagagcaaaggacuguugguccaggaagacuuccuagaagagauucugugauggguucaggaagauugggugggaucugauguggcagagaaucaccgugggcucaaccgcaggccuggaucagcauagcucagagcacgacugcuugaccccagggaugccuguacaguguccugagcucucuccucucuccucuaggcuguucggagauuccugaagcuggagugcaagugucacggugugaguggcuccuguacucugcgcaccugcuggagagcacucucagacuuccgacgcacaggugacuaccugaggaggcgauaugauggggcugugcaggugacggccacacaggauggggccaauuucacagcagcgcgccagggcuaucgccacgccacccggacugaucuugucuacuuugacaacuccccugacuacugugucuuggacaaggcugcaggugagaaagaagcaggcagagacaucauggagcuugcuuauuagcacaggcacuucugcuuuaucaagggcugucuagcuugcaggaguuaaagaagggaaaggagucagucacuuccuuacaugaaaaccuugucuugagauagguaugucucaggcuggcaggucauauguuacuauguuacucacuauaucccuggugucugggauacaguagguacaacucagagaacauuuaaaugauccaccuguuuucaaguucugggcaagaggugagcuacacacacacacacacacacacacacacacacacacacacacacacacaugaacauggggaaucaaaacugcuucuugauaugccaccacuacaaaagaagugaggggaacaggagaucucugccaaggcugguaaagcagcaaacacuugauuacaagcagaaaauggcugcuucucgggcugcucuaaguaugcguggcaguggggcgggugucuugggaacgcugcaaggugauaaggugcuccugugagagaauggaagcucacaucuugguccagguaaguuaacccagggacaauguguagcucaauggagcugcuucucuuuugguuccugucaugaccaccaccugagagacuggaccaaguggaggauggcaugacugagagaggcguagucaggauagagguucacguagaaggugucucaggcucuuuucccaggcagauucgauagucgagacuugguagaguagagcccugcaccauggcuggcuuccauccuguuuguuugcacuucccauuauuucuagaguugaguggcccaaagugcuucagcccaaaggaagcagguagcaucccaccuggauaaugaaggccauaugaacucuagggagugcuagaagucaaaaagguuggggaggcccucugaucuccuggugguuuacugccaugagguagcuuuuccauguggucuaaugcagaggauucauaucuaaaugcccaggaauaauuuccacauaucuguauaggcuauucuacuaccccuaaaaugugucuuuggagaaggaucuuuggaguuuggagggaggaugagucauacacuuauuaauuuuucucagaggcauaaacuuagguccccuaagccccaagagaucccaaugauauaagccuccccccaccucccgaguauggaaccaaggauccccuccacgguaguacugcccaacuaaacuuccuacguugauugaauccucauugcuacuguuuccagugcuccaaggucaagggaugccucaaaguacagguaguacuaaaccuucuauguacucugcuucuuaacauacauaucuaugaugaaguuuaauuuuuaauugauaaguaagagaguagauucacucuuuuaaugcuacuguugaucuaacccaggaccuuacaauaugcugggcucuccuacugagucacaaagaggaugauuuuuuuuuuuuuucucuuuucgagacaggguuucucuguauagcccuggcuguccuggaacucacucuguagaccaggcugaccaggcuggccucgaacuaagaaagcugccugccucugccuccugagugcugggauuaaaggccugcaccaccacgcccggcuaagaggaugauuugaauaauagacauuuacaaguuuuagucauuuaucuuuggauuguccauuuaauacuuuuagcaugacaguugauguugggcagcaaaugacacugaauaaaaccacaaacaagugugacagacuuguuaauccaauucaaaaccaaaaccuuuuaguuuagcuaauaauuuaaauucucugaauuuaagagaucuaacacaguuaguagcuagucugcuuguacagcuccagauuguagaagaggacuuugguauugaggacccagcucucggcguuagaauaacauauguagaccuagucagcccauacucuauagaguaguaguuugcuaacauuuuggauuauauauuccgguuguuaaaaaagaaaauagagggggcuggagagauggcucagugguuaaguguucuugcugcuccucuagaggaccugaguucaguuuccagcaucuacauuagguugcucagagcugaauccaggagacugauguccucuuccggacugugagggcacccacacgcaagugugcacacacacauacaaagauacacacacacauacacacacacacacacacacacaagaaaauaaauaaaaucaaucuuaaagaguaaaaucgagagcuggaaaaguggcucagcaggcaaaggugcuucugcaaacccuauuaaucucaguuuggcccccauuguacuauacgguaggagagaaccaaccuccacagguuguucuccgacuucugaaugcaugcuguggucccccauguguguguguguguguguguguguguguguauaaugugugugcauguauuuauauauauacauauacacauacaaaaauuuuuuaagaaagaaaauugagcacaugugcacuuaaagacgucugcuuauguuguugcuauaccauguaauuauuagauauucaugucuucuacaugguugucauugucacuauaacagugcugggauccaauccagggucuugcacaugcuaggcaaguaugucaccacugaacuacacuccuagcccuaaaucagagauuuuaaaccaauaagcuaaaaaacaaagaauuucugcuuuuguccuccccauauccuaguggguugguggggggcauugcuguugagcucuuucuugaagucucaggccaggggucccuguuaguaggaaaaggguugauggggucuuuuugugcugacaucuuuugaauuagcauucccuguacaaggagaaagcuacccuacuuuucaagaaucccuucugaaagggguguaacacagaaacuucuugcaguaagcuuccagccugucaugccaaucagcucaucucuguuggacggaaauaauaaauguacgcuaacaaucuauuacauuagauuuugaguuguuuuguuuccucgagacagcaucuuacuaugcauucuaaucugaccucaaacucacuacacagcccaggcuagccuagaaccaaaguggcuuuucuugccucaguauuuugcaucauggcuacaagcaggugcuaccacaccuggauagccauuauuuuauauacauuugcauauaugaaaacugaggcccagauacaaucauuaacuugcuaaauagcuacagcuaugaaauaguacaacuagaauuuaaauccagauaaugugccaucauauucccuacaaaauagagaaccucaccugaccuacaguucuucuauuuucaagcuagauucugaagaggacauggcagugugggggcugcaggaaagggacggugcugggacuggugccucuggggagcuuugauaguggcaacaagggaaccugggucagagggcaacgagugaccguuuugguuauauuuucaggaacagagguucuuuauggcuucuuaagaguguaaggguggacuggagagaugccucagugauuaagagcacugacugcucuuuugaagguccugaguucaaaucccagcaaccacaugguggcucacaaccaucuguaaugagauuagauguccucuucuggugugucugaaaacagcaacaguguacuuacauauaauaaauaaauaaaucuuaagaaaaaaauaaggggguguaaggguacccagaguggcauaaacaaaagugacuuguuucucaccucucuucccugacucagguucccuagguaccgcaggccgcgucugcagcaagacuucuaaaggaacagaugggugugaaaucauguguuguggccgaggguaugacacaacucgggucacccgcgucacccagugugagugcaaauuccacuggugcugugcugugcggugcaaggagugcagaaacacuguggauguccacacaugcaaggccccuaagaaggcagaguggcuggaccagaccugaacacacagaaaccucauucuucccuccacuucaagccucugacucaaaagcacaagacccuugcaugcgcaccuuccucuacccucaauccugggcugcuauggcuucugucacggaccuggagagugauccggagggaccccaaugucccggccgccugguuccuuagcccuagggacguguugauaggggauggauuuaggaggcugagugacucccugaugguccaucuggagguuugaagggagaguaggagaggucugucuucagagugauuugaguugcacuaagucaaggcucauccuccccuuugcuugcacugacuucugauccucuuuggguaugcaacaggaagggaaccuggagguagcuuccguguuugaugcuacucugccugaggauaggacagagauaaaacugccugucccuuugcuggagacaguacgggcagacaaucuuaggccauaguauucugcugagacccugagauagcuagauggguuagccacauugaacaaggcuccacaucaugcuucuacgcagcuuauaaaguagugguuuggugaggaggaaaaucacaaugcucuacagauacacauucucugugccucccuuuccaccuacaucacacagcagcagccugcucacuggcugccuguucagagugaggcagcuugcagugggucaaauucuuaccaggccauuagaggcccggaacaggauugugagagaaugacauagaaagccuggcuaggccuugggacuucccccacauccacuauuccggagauucgguaggaagggagguaacucaugggaagggugagcgcaccugaucucagggguuccaugaggaucaguguauacuaggaaggcagagaucucgcauuuugcuaguucuugaggaucuucagcuuugaaguaggaacaaaaggcagcagcuauagagagagagcuggugcuggagccgagguggcaaacauccuauaaggccuuucucauuuacccagcaaaucuuuauuuugugauucaccagguccaacuguuaacuacugcacguuccacgaucgacuuaaacagggaagguucucucugugcuacugaccguugccuaacgaggguacacaggaguggagccuucaaagagagcaggcacagugacauggggguuccaaaccuugauggucuaguuuuaugugaccucgacaauggucaucuucuucccuauugauaaacagaaauaguauagaaauccacaguuagacuuaggucuaaucccagcuauuuacucucuauuuuuuauuuucagcagggucuuuaaauucuccucucccauuuucuuaucuguaaagugagggugaaacugagaucuaacugugccccaaacucuagccgacugauagacgucaucaacacucucacuggucaaguacuuccugcuucucugggaccuucugauuuagggcugucugggcagacaacagacuagauucaaaggcuuucacaaggaauucuggauauagcuccucucucucuucucagguuccucuucauccaaucguacucucagauguuuguggagcaaccucuuucugcccaggcagcaggaggcuggggugggguggggugggggggcacagcucuggccacagaggcagauuuauuuggaugauaggacuaauauuuguguaaccugcugagaccugugugggagaguuuaguaugguuuuucuuuuggugaggggauuugcuccgguuucacauccauuaacacaaaacaugagcuagucagggcccuuguggucuguggugaggggaugacuggagaaacgggacugagugagucaggcggagggaaugucuuccucgcagaguagagucaacgggauaacugaugagccagugguggggucacggaggggggcggaggggaagagggacuucucuuggaagagaggaguuuuggggcaggggcgagaacauccaaguuacgguaucagugauggcauuggccuucacuggggagccagccugagguaaaucuacuugugcuguauucucuuugaguuuggguucuuagcuguggcagacaucugugacaucucauauuacuccaugccuuugccugggcuccaaauucuagcugauaaagauauacaaccacuuauaaauggcucagagagaaauagcuguccagggagugagaaguuuguaaagugagguguuuaugugagagaaaagauauccgaguccugcuacggaagcuguguggccccaagaaggaaugguggccaagcaauuaguuuuuccuccgaacuuagcuugucucugcauuccaacuggcuuuagacaacuggcgcucauucugcgcuauacaaacaaacugauuuauuuggaacaagcaacaaaacaagaacuuuauuccgugccgggacucca

SEQ ID NO: 1640 - RNA, 934 nt, Mus musculus
ggagucguacaguuuuauuucuaaucaagcgugcugggggaaucaacucuuaggccagucuuggauguauagugagacgcagaaacaaaacaaacccaccaaccacaaaagccccuuguguuugaauugagguggcuuccuucauccugguuucuccucaaguauccuucaccgaguaggcuuuccaucaauguuucugaacccauaauguugagauuucccugacucacacucugugguaucaucuuguucguuuguuguuguuuuuaagagagcaacucauuauguaugcaucccuggcugcccuggaauucuauacagaccaggcuggcuucaaauucagagaucugccuguuucugccuucugaaugcugggaucauauaugaaccaccacugccagcuaugucuugauuuuuuuuuuuuuucagaaugaucugagaccuguguacuaugcaaagaagagauuugggggggggggagcuaacagucuucucugcauuuuaaguccaguuuuuguugaguugaaacacuuauacuaaugaguagacacaaaaggaaucagauaggccagguguaguggcucaugucuuuaaucccaguacuuggaaggcagaggcaggcaggacucuguagagaguuggaggccagccuggucuacaaagugaguacagaacccacguuggugguauaguggugagcauagcugccuuccaaagugaguacaggauagccagggcuuuuacacagagaaaccuugucucaacaaaaaagaaaacgaaacaaaacaacaagcaaacaaaacaauaaaacaaacacaaacaaaccaacaaaagguagugggagaucccugauucuauuuaaaaagauagaaacauaaagcuucuacaaaagaacaggcaguguugacaggaaucaggcuaacuggauagaaug

SEQ ID NO: 1641 - RNA, 23733 nt, Mus musculus
cuuauuugagucuuccguuuauuccagugucauucauaguugagacgugaugcaaaguagauguuacuuugugacauaggggacacaacacacuugugggguaacccaggaagaacuugcuugaaauaaccucaccccucacagugcucugcagcgacuucucuucugguuuugaggcagggaggaagccgaaaaaaacccaggauuacugucugcuaugcagacuccuagcugcccagacuccgcaguuagggccuaaccggaagcucguuccugauaaguucugagugucagccuccuccucuuccucacuguggacgagcuucucggcucugagaaaguuggaugcuacuguuuaaucucuaugaaaggaaauggagaugauagugucgccuagcagaagaggaauaugugcugggcaugguugguggugaauccuguaugcagagcacgcaggagaccaaggugagagggucucaguucuagaccagccauauaccagaccugucuuaagcaaacagagaagagagauuguuaggauuagguuggugggaugaaaacucagcacacugcuuucagguaaaaagcauuuggauguuagcaucccuguuucugcugcugcuguuaaaauugauuuggggacccagcaaaauggcucagugaguaaaggugcuugucaucuccaucccggugaccccaguucaguucuuggggcccacaugguaaaaagauccagaaaacuggcucccgcagguuguccucugaccuccauacaugcucuguguggcauauaaaugguuauucacacaugugcgugugaucacacucuuucucauauauacauagcaaaauggagaggugcuaaauucaguagguaccagucaggacaaugagacccugcugcagcugcugcugaaauacagccugaccacagcagaugcugggaagggugagaccugaacgcuuccaagcugcugauaagcaguaguguaguagacccacucugggaacugauggagcaguucucaugauuagacaagcuaacgagcuguaauuacaaaagaagcaucugcaagcagcucuuacucuguugcuaauacagcuuuguucauagaagaauccaacuuaguagacucaaacaucagucaagagaguaaauaaaugcaguauauucauauaguagcauacagugcagcaguagaggacagauuacagacaugccaccuaugagcaugaacuucauuauacugagaacagggccagguacaaaagcgugcagcaugugcgacuguuuagaugacuaaguuagugaaaacaaaagaacucagaacgggguuggcccugcggggagacuucugguggggaggggcacgcaguaacuuccuguugagauuuagaaugcucugugcuuuaacugggauauagguaacgggauguguauguuuguauggugucugcacaguggggacagggcagaagaagaucacucuccacucgucacuuuauuccccaggacaggaucucucccuaaaccuaggguuagcuggcagucagccucugucuccacacgcgcgcacacacacacacgcacacgcacacguacaugcacacgcacacauacauacccaguggugggcuuacaggcccaugagaggccacucccagcuuuuuuacaugacuauugggaauuuggacccaggacuucaugcuugcacggaaagaacuauuuacccacugagcugucucuccagcccuaaacugaacucuaauguauaauucuuggccauuuggauuuucucuuuucauuuauggucagugucuggcuuuuguuuuguuuugguuuaguuuguuuguuuuuacuuucgcuuuuuuaguugguugguuguuugguuggcugguugguuguuugguuggcuggcugguugguuggcugguuggcugguugguugguugguugauuggcugguugguugguuaguucauugguuuucguuuuucaagacaguuucucuuuguggcccuggcugucuuggaauucauucuguucaccauacuggccccaaacucaaagauccaccugccuucugccucccaagugcugggauuaaaugugugcacaaccacacccagcuucagugucuguuuuuauuugugaucauugggcaggaagaugaagaacuggaguuguagccuggcugcuuaccuaggagguccuggguuccaugacccauucuaaugagaggugguugucagggcagaguccuaagcauuugccaguggggauagcuaggaaaucucuuaacucacucacuucuguuauaaaccuaaaacugcugggaaagggaaaggauuuuuuuguuuuuguuuuuaugugcauugaaauccuuaauuuauguucaggaauacuugcccuuuaucuguucuuucuucccuguucaauucccguacacauuuuuguuccccacaucaaaaagguaagcauauggauccaggccagaaaguaccauagcccccauagccucauuccuggagggaagggauccgacagaaggacagacauacuccacauuccuuugguuucaucaaaaccugugacagacuuuggaauuaggguguugauaccgcuccuuguggccacacucacagcuacuuaagauuaaacccacucucaguccugaauagaauuuaggacacuuuguccaaauaaugauaaauaauugucuaaucuuauguaaauaauugccuuuauaaauaucugugcuugaagauuacuuugaagaguguuugaaguucauccuacuucaaaggcaguugaaauaaucaccucauucuuguagaaguuagagggcaaccuauaggaguuggcccucccacaguacaggucuugaagaucaaauugaggucauuaagcuuggcaacaaguaccuuuaccaucuaagccaucuuaugugccaaguuauuaguuugcuuugcuuugccucaagacaggaucucauguagcccaggcuggccccaaacuuaauauuuagcuggaaaugaccuugaacuucugaucugcccaccuccuucaccuccuaaacacugaaacugcagacaugcaccagcacacccaguuuugugcuaugcuguggaugaaacacagggcuccaugcaugcgaggcaagcccucuaccaacugagccauccuagacuaacucuuuaccuuuagauucagagccacuuuucauccaaagaauauaguggcugguauccugcccaggaguggauuaugcacacuccuguuguuacacacuucacacuaggaaggcagaaaaggaaacugcuuuauuucuuugugggggaagggugacgacuugaaacaaaaucuuccuguguggcucauguggcucaggcuggcuugaaccucucaguucugccaccauagccugagugcccaccucuuccuuuaugaggcagugagagcgccacaggagcuuggggacuaaacauggcggcuccaaggcuagucugugaugucauuuuaagcuuucucuagugauguguuuccuccagccugugaagugaagaugaaggcauaauagguggcugguguucuggcuguugauaggaccucuguugucagucugucuagcaagccaguauuuuucuuuucuuugaaauuaaagaccaacauguuuucuggcacuguagaaauuucucuucagcugaaguuuauauugucccugaagcaaaaaugcugaaauacgaaauugauugguuuaagcuuuggccccucauguacauuuuuaauagguacaaaucauuaaaauauuaaugcuauuuuacccuguaauauaauguuaguggcagcauaucucauuccuugacuguggccagucucagugagcuguguggucgcaucuggaguguucuaagguugggcugcacaccugagauguuggucuugauaaccugaacacugcaugcugugggaagccagcacauaagccguggugauuagaauagacccucaugagaucccaaucuagaacuacccagcuaaccccucauccuagauuccugaccaucaggugccacaugagauaaaauaaggauuauuuaagcugcuggcguugcugcuuguuaugcagcaagagguagccagcacauacccccacaacaguuauucucauuacauuuuagcauuugguuuugcuuaucacuguuauuuacaguuaaacauguagcccauaaauugguugaaaaaugaauuucucccguuuuucugguguuuaguaucauaaguacagccuucgagcugaccuugucugugcuuggcccugugguggaacugcugugugaccagagccuuuuagucugcccacagcucccuuucaucugcggugaagccguguauugguguggauuguaauuaaccaugcaggugacuaugggaucacucugaaguaucagaagacagccuaacaacuguuuucgggcuaaggcuacucuugcuugggacucugauacuaacugucacaaaagauaaucaccauguggguuuuuaaagucaaguuuuaggacugguuaacucuacacucaaacccgacaggcagcuucuuggcaaaacuaacauccgagucaccaguuguuccguggccagagucaucgucccagcuucugcucgaaaucccaacuccccaguguuuugaaaagaaaagaucauuaacacuaauuuaaaaagacucuagcuuaaucucucucuuuugggcuacagaaccaaucuuggugauaguagcauuuacuacacuagugguacaggguuggcuuuaucagaagagcaagggcuguaaggagacuccaggaaagaggccaaguaugguggcucaugucugucaguccagccagaauccaagaccagccuccuccccagccaagggccuccuccauacuccaguacacauagggauuuuuaaaaagaaagaagaauauuugcacuuacagugucugugucuacuguguaaauagccucaaacuguuccagucaucuggugauaagaugacuguaggccaaaccagaaaucaaacggaaagcguguuuguuuugaggaagggucucacugcauagcccacacugaccuaaauuuaggaucuccucaucucagccucuccugcaggacuugugggcuuguaccaccauggccagcauuggggcuuucaucauuguuaguuguuuugagauagggucucagaauguugcucaggcuugccucagacucacagagauccagcugccucugccuccugaguacuggagcauaaaagcauaugcccccaugccuagccuguguagaaacugcucaugccccucuguuuauagacaugaaguacuuguugcucauaucaugucauuccuaaagcuuuccugagcagagguaagacaagaaggaaacugaaguaucuuuccaaacauuuguugauccuuagauaccugguugccaggggaaacagaaaagacuauggaacggagagggugaucagagauugagaaggaggggcagggguugaauuuggcgggggguagaagggguuuuuguguguggcuggcauuauauguaccuacccacucuuaacccaucagcugugaacucgaguucucucuguacagaucacaaggaguccugaauucuccucugucggcacuugcuggcaccugguuuguuguuaaguauauaaacugauaaagucaucaagcuuaacacuuuaggaaugcaaaugccacacaggagaaagauaagauaaaccugcagguaacacagacauacaaguggaggcacuggguuugcugcuuuaagacuugggacuuccaagcccgggaguggugcuacaugccuuuaaucccagcacuugggaggcagaggcagguggauuucugaguucaaggccagccuggucuacagagugagcuccaggacagccagggcuacacagagaaacccgucuugaaaaacaaacaaacaaacaaacaagucaugggacuuccagagccaugcuagcuggguuaaguaccuguucugacagucggcuagcugaguaguuagccucuuuuuaaugauuuuuccauuugcaaaggagaugauuagugcuacuuuauaaggcuauaaaaucacccacguuaauauggccaaaccugcuguggaucacgucuaauacugggucaguguucauauuacugcaaggcaccaccuccugguaucuccugauuuguagucagguuuacacuaaugcuaccaccuuugguauuguaacacauuccucucuuuaaugguuugggguuuuguuugucuuuucuuauucucaggcccaacacagagauacuuucauugaagaacgcuauggaaaauauaacaucagugacccucuaauggcucuucagagagauuuugaaacacugaaggagaaaaaugauagugagaagcagccagugugcacaaacccccucucuguccucaaggcggugaugaagcagugcaagaacaugcaggagcgcaugcugucccagcuggccgcagccgagagcaggcaccgcaagguaggcuugcccagagccaggcugggcuucggaaauccgcaggagacuugccucagccaccaguguucacgggcauuggagagggcuggggagcucauggguaucggacucuucaguuacacaggaguccaggcacaaagggaaacgggucauugcacagguccagacguuacuaaagaugacauucaucugugaugagucacuccaaaauacuuggugccauuuuuuuccccaaaaucucagucuuccaaacuuuaguggcaagcugguguuuaaccaugcuugaagcugaacagagcauucucuguuugcuuauuuaagugauaaauaaaaagauuaacagguauuuagggaagagagggaguauaaauccaccugguacuaaccaugcaagcaugagauuguuuccacucaucugguuccugguuucauuacaagguguaaggcuguaaacagcuccugccauggcuggccuuuaagucuucucuacacuggagugcagggcaaaccugugcucccugcaguuucagguuugagaacuccaauguguguaguaccucuccagcuuguuccugccuauaggcaggguuugacaagcaucugcauuuuaaaaagcuagcuauuuagauuuggcccuacaaggggcaggcaucgaccauggcuuguaggagacauuuuaaugagggagauggugucagcaaauucaguagacauuaguuuguucucaugguuaucuccacgggagcucucugcuaaagccacaucugguaaguugccccugagcugggucuucuugccugucagccuuuguuucucuucacugaguccagaggauaaguccuuaaccauggguaggucacgcaugacccacaaggccccugaaauauauaacauaucagaaguguaugcauuuuuauggaaaguguauuuuuuuauacuuucagucaaaaucuaaaaguugccuguggccaaaaagagucuaacccaaauguuucauuuguggcaaugugucugauccaggcuaugucgucuagaacacacauggcagugugucugacccaggcugcguugucuagaacauacaugguagcgugucuaacugcaguaccuagcugcucuuggguguuuuacccaagcugggcacuaaauuugccaguaaucaguuaguacuuagaggucuguauauagaguaggcuuauaguccaaguucgcugaagauuccgugucuacccuuugcugugcuguggcuauuaucuguaagcccucguccucccagaaagaguaggaucugcacaguagacagucuggucacugugcuugcaguagaaggaggguuccucaggcacuuccucccugucccagugcccccagcacucaaggguagcuuuaucucuguuguuucgaaacauggauuugucacacacacacacacacacacacacacacaccaccgcaucugcccuccucaugcuuuaaaucacuggguagcuaaagaugaccuuuugacuuuacuucucaagcccugggguugcagauacugcuccucauacccaguuuaaggaagagucucuucuucaucuagucuuugaaaauccagacucugaaccagacucccuacagcaccugcuuuccaagguuccagcucuuuggagccugcaggugaggugagaugguucacuccugcuaccgaagcacugccucuccccaagcuuguuuuccauuucagacuguucuuaaaccuuccugucuggggccuggagagauggcuuagcagggaugagcacuaauugcucuuccaaaggaccgaguuuaguugcuaacacacucacaucaggcagcucacaaccaccuguaacucuagcuccauagaauucagugccucuggccuccaugggcaacaacgcucaugugcgcacauacucacgcauaaauaaauacaauaaauucuugaaaaaacuuucuccccuacuaaagucucucaucucugagacucuauaguauauuucuuucuguaauuuuaaagggcucucaaacuagauaauacauuuaaccagaaggcauucuauuacauuuaaaaucuagauuuuuuuuagcucaacaggaaguacacuaauacaucuuaauuuuaguuuuauuuauauuuaauuauuuuuugagacuagaucucccuguaucuguauagcucuggcuggcuucgaacucauuguguagacaaggcuaacuucacggucauggcaauccuccugccucugccuucuguauacuuagaggacaggcaugugucaccauguuuguuuguuuucauuuuaaacuuuaaagugggguuccguguuauagaaaauguucuuucuucauuccuaaaauuauuaguaggcaacaucuugagaauugaccaucaacauaacugacagcccaagaggucuaggcugagccacucugaaacagaagcuacugaacgauacauucacaugucaaaugcugugugguuugggcagaaugcaugagaaauguccauuucugcuuuuguuuuccuggaaacugauuuagagcauucagcaccaggauaaguggacuaggauaaaugggcaaguuguuaaauucuuguggaaaaucacaggucagaucccaguaaccgagccuucugcacauaggauggaguaggagucuuucccagaugaucuggguguuaguuaagcaaggcacuggauguucuguuugauuugaucuuuaguuucaagcuggagcuuuggugccuccugugauagcauugagaggaacaccucagccuuguguggugccgcccaccacaacagggcucgccccagcaggucccuagucagaacaaaccgccugugauuucccagaauucugcugguucucaaaccuucccaacccccacagcuaauucguuucucucuugucucuguuugcauucuucugcacauacuucaacaaaaguaaacaucuuguuuucuagcacauagcucacaugucuuucauccugcugcgacagcgugcgccucgacagcccuggcuggauuucauguguuugcucauuuaaucuggaacccucaagucuugaguaguguaaguguugagucgauguuuggaaguuaaugcuuuaaaauccuuuacaggugauccucgaccuugaagaagaaagacagaggcaugcacaggacacugcugaaggagaugaugucaccuacaugcuggagaaggagagggagagacugacgcagcagguaacucgggaaggaggagcaggaugaccuugucuagagaguugcugcuuaggcuuacggcagugugcagaauuacguuagaaguccuuauugagaagauagaauggccauguuuaucacggcuauucccaaaaugucuguuuuuucaaacaaacaaacaaacaaacaaacaaaaaacauagguaacuugggauuggggagauaguccagggggcaagcacugcucuugcagagggcccacguuugguuccucacauccacaucaggugucucacaccuuccuggaacuccagcucagaggaucugacacccuccuccugucuacaguaagaccuguacucaugcacagaguccucacccacacacaaguauacauaacuuuaaaaauaaaacaaacaaagaucacucaguggaacugucauucauagcacauccuuuagagaucucugaguuucaggcuuuuuuguugucccacgaccuacaguaacagcauggccuaucccaagccaguacgccugaaguagaguguugagguguggucuugcuuguccuuuaaugcuaauauugggcccccaagaucugguugucccagagaugacacagucuacauguagacccaagugacacugugugaucuugccccgaguuauuuuugauuggugaauaaaaaugccaauagccaauagcuaggcaggauuuggggugagaggagaaacacaagaaagagaaggugaaaaguauggaggaggagccaccauggguuaggugagccgugaaaauauggcccugagggcuggccaauuagaguuuaagagcagcccagaugaaacaugguaaguaauaaguuggaguuaucaauaggaaaguagauucuaauagcauagaaaguagauaucugccuagguuuuguccugguuaagccuuauuguaaauauaaaggcugugugugucuuuuauccggaaacuaaaugauaaaggcaagguagaaaccucaguuugggauuaaauaauuuccacaucacagagaucacaggacauaaaccaucuguuuauucuuguacuauacagugguggugugcucacauuguagaucagggcagccuugacucacacucaugaauucuuuuuguuuuuaaguaugaucaugguuuacugaacuggcuuccccaucuaucaauguaucucgaauuggaaauuccugauuagaagguucauccacccguucccucucagagucuguauaauaauguuagacaauaaaacagacuacauuuguguagauccaaggauggugguucaugccucucguccuaccaguuggaaggaggauuucaaauucaaagcgagucucagaguaagacuuugucuaaugaaaacaacaaaagcagggucucagugcagcuauuuauguucguuacucuuuguaaagaucagacagaaugauugcugcaucuucaaguuugauuuucaacagcauccaugcccagaugcaucuuacauuguauucuguuauuuguuuuggcugauucuauggccucuccgcauaccuaaaacacaacggugcaucauaucccugcuguucacccugaggcaguuaggaacucaaaugccucccaagucaucaagaaagauuaaaucauagugugugggguguucucauacuucaaaaauacuaauuaaccuaagcaccgugcuguacaaacuaauaccgcgcaccagagagcagccagugaggacacccugagugaucguaauuguuaguacauccuucuguuuuccuucucuaaucaagaggugugguggcauuuuucuuuucuaguuggaauuugaaaagucccaagugaaaaaguuugaaaaagaacaaaagaagcuguccagucaguuggaggaggagcgcacccgccacaagcagcucucuuccaugcuggugcucgagugcaggaaggccacuagcaaggcagccgaggaagggcagaaggccggagagcugagccugaaacuggacaaggagaagagccgggcgagcaagcuagaggaagaguuggcagccgagaggaagcggggccugcagacggaggcccagguggagaagcagcugucugaguucgauaucgaaagggagcagcugagagccaaacugaaccgagaggagaaccggacccgugcccugaaggaggagguggagagccugaagaagcuugugaaagaccuagaggcugcccagcagcaccgcagcaccagugagcagggcagggagccagugaccauguccagaggcacagccacggagccucccaugcgagugucugcguuuugucaaacagagaguguucagacagaaagaagccacgggagugucauaaccaagcugacagacacuggucuuccaggucccaccacggcugcuuacucauaugcuaaagcuaauggccacugugacccagagauacagacuaccagggaguugaccucagacagcagcacagaaaaccaagggccuccacgggagaaaucugcaguagcggcucaggagaaaccaguggagaaugguggguguccuguaggaacugagacuccagucacgaugccuagucaccucccuuccaguggcagcucccugucucccagcagcacagccucuuccucucugacaucaucuccuugcuccuccccaguucuaaccaagcgucucuuggggucagcagccagcagcccgggcuaccagucuuccuaccaagucgggaucaaccagcgcuuccaugccgcucggcacaaauuucagucccaggcggaucaggaucagcaagccagcggucuccagagcccuccauccagggaccuguccccuacccuguuagacaacucugcugccaagcagcuggcccgaaacacagucacucaggugcucuccagauucacuaaccaagggccaauuaagcccgucucucccaacaguucucccuuugggacagacuaccgaaaucuggccagcacugccagcccaagaggugacaccagccauucacccacuccagggaaaguguccagcccucugagcccccucucuccaggaaucaaguccccaaccauccccagagcugagagaggaaacccuccaccaaucccgcccaaaaagccuggccucaccccuucgcagucugccaccacuccaguaaccaagacucauucccaggcauccucccuggccgccacagaagaccucgccagcagcugcucccccagugccgugguggccaauggcaaagauguugagauacuuuugccuaccagcagcuagucccuagggcugagucuccacauuugacauuccaucagacucgggccaagagcucagcguuaaacccuggagucaaaucauguuauuuauuugauaguagcuacagccaucuguauaauacauucaguguauuuaccuuuuuguauuuuuuuaaguagaaauugaauacuuuggauuuuuaugacucaccucuuuguacuaagcuagaaggggaccucauagacauagcgcaucucaagcucugcacuugccagcgugcugcgacgaggcggcugacuggggaccaggcggugcugcugccagucggggagcuagaauucauuacucagcacucauuucaaauuaugcagaagcgguucgugcagauuuuuauuccagaugaacauguuuuaaaagugccugaaaucgccugccacgggaaugugauucugcggcagaaacaaaagacagagcauuucuugcagcaaaugagauccucugugaaucugaaugucaaaaaaccaacacugcuuuuaauccucucugacuguuuaaugccagcuuuguguucugaaccgagguuugcauaaguagaguggaaauccuucugaagggcgggaacucugucaggcugagcucuguaaagcccucaagaaacccuccagaacacuuagcaguuggggugcugauuuucuugugcuuuugaaaacuuaagucauucuccguuuccugcaucacuucuugaguagugaagucacgucuccauucaaauccacccucaagcaucggccaugggaacuucugauucugguugcuuuuacuugaauaggaaaugacauaaugaacucuuuauucugugaucaaaaagcaauaacuuaaaagucagucuuuguaauacuguaagucagaauuauacagauuuuaccaaauuguuacauucacucuccaugcugccagcacuucuaucuauggaaccaaaugggcguauaucuguaucuguauaguacacaccccuuuuacauguucagcauucucacacucaagcacauaaguauuagugcaauuguaucucuggagcuugcaguguagcauaaaggacaaaguagaaucaaucgcauguuaagauuaccuaccaaagcaauuagaugugacuuggagccagucagucaacaaagaaauccauuugacaaggaaguggacaaucccaaacuaagcucacaucaucagcaucauaggaaagcccauuaaaucguccuagugccacagaacucagcuagccaugugagugagugagacagcacagccccucaagugcuauccacucagccauagcauccuagccccguguaauggggccaccccuuugagccccagcuccugucaugcaaaaauugcagauggagguuaccaauucucuaaacguucauggaauugagauucccacaagaagauucucauucugauuuuaaauguuuuuuaaaugcugcugauuagacaaacauggcugcaaaugacuuuagcuugcaggcuaccaagcugcagccucucccucccuagaaccugugcuguuucccuuguagugaguuuguacagacagaaacccccaggcuucuccacugugucagcuacaucugaccaaguccacagagcaggacagccuugcucuuggcaagcagaacccccgacacaccagcucaggacacugguuacacaguuuuuuauccagaguaagagagaggaaggccuuggugucuuuacauaaauuguucuggccagcaucuacccagaagccccuggccuacuguaaccguuuauugggaaggagaaugggugaucauuggaaacaccugaucauguuugcaaaaccaaaggauucagugggcccauucagaugagucacaaggaauuagaaauugauuuucuucuugaaccacagagcugaaaacaaaaagucucccuaauaauuuagcuaauagcucuuaguuauauuuuuauuaacccuuugagucagugggcaagaggcaggugauuaaaaucuuggugggcaagucaacaacaggguauacuguugacucuccagcuuacaguuuaaaugguuaagguaaaugcaugacacaugaaaguguggcuggugucugcugaaaugauggagacaugugaaacugucccgagcgauccugcauggaauuuacuccuauugcggagccaaaauagaccagugaugaucaaacgcugaaccuucuccucaggagagacugcagggccucaguguucuuaccucucuugcuuuaaaugguaaucuuaaaagcuguguugugcucuuccucuguuuggagacagauauauauagagaaagagaaaugcuauaggggaguuuauuucuugggggggaugcacugaacaauauuucuuuuacaguauaauacaggggugggauaugcaaaagaaauguguauuuuugcuaguuccuaucuucugagauaauaagcacaauccugaaauggauccaauaauucagcuagauauuauagauuaguauuucaguuugcaguagauugugagugugugcgcuaaguaaaaguuccaugauucacaauuuggguauuaaccauaucaaagaagcuguuacuggucagcagaaucuaaugaugugcucgguguaacacaagcguuaacuaagucauuaacauuuguaaggccaagugcagaagucuucauuuuuauaguagacuacauuaaaacaaguuaaaucauaacugucugggggaaaagucuugucuugggcuuguuuuauuagaaaggggagugugugauauacggagcacuugauugaguuuuugagaaacucggccucgauggcagcauccagguuagaacucccaaaaacuuaggacauuggcuuucuugugaagcauagagcuggggguagggguuccaauaaucuaguauuuaauaacuugcauuuuuacucacugggaaucucacaugcaugcagacacagggacaucgacuggagcuuggucugccugucaggcuacaaagcugucaccacuuccucucuaguagccgucagcugccauuaacacucagcuaggagcaggaacuugggaggccacgcugcaguguggcuggcuugaucuugugcaggcagccacagcuacugagaguucaugaguacauugguccagaagacagcccuguccccguccuuccuaaccucuggcucguagaaucguuccuccuguguuguccccugagccuugggaggagggcuguaauacagaugccccacugagcagucccuuggauguauuugcaguccucucaccgguugucaguuccugugauaaccacugacccccacacaaagaagcuuuugugagaagggcuggaagcugcauugcucuacacguauagaauaauacauguagcacguuagcacuagguccucagcaaaucaccccuagggccuacgagcucuccagccaugaguucuuggccagauguacauacaguaccuugcauggaauuuucuccugggaagaccgguccuaaauccaaucagaaagcaguaguuaccacuauaacauuuuuaccacugauguaccaugaacauaucuugcuggaccagcuacuaauaacuuuacaacccuuucaggguucuggaccuuuugaaaaucuuagaagagcuauauauuguaguuccagaaaaguggaugugucuauaugcaaaagucaguugaugguuuugcuggaacucgaccagaagccaccagugacucauggguuccaguuuuaaugccucaucuugccuugcccuuucauuccacaaaugacuaaugcuucccuuaaaguuuacuaguccaugccuucgcugcuaccccaugcuugcaauuguaaguuguagccagacgaaaguacuugaaaacccuuugaaguacaaaagauguucaaacauuguggauguuuauguaucuuaaguaagcucauuaacaauccauucagcaaacaccagcuauauccaguuucccaugacagccucuggcagcugcugcgcacgcgcgugcguucucucucucucucucucucucucucucucucucucucucucucucucucucccucucccccucuccuccucucccccucucccccucucucucucucccucucccuccugcuccuucccucaccaccaccccucucuuucugugucugggucugggggagagaauuuaggguuuuucuaagggcuaggugguccuugaaaccacuuucagugucuugaaaugcugguuuuggauuaguggguauggagcuggggcuagcccuguggugacaugcuaagcccuggguaccacccacagcucuggggugggaugagacccauuuucaaaccugaaucaggcaggcaaugagcaauauuccaugggagucauuuuuaagguuuaacuaauguuuaaacuauuugagaaaauugagaguccaucuaucuguuugccuaucaauggacgcaucauuacuaggaggaggagacaaaguggguugggcuccgcaaacccgcugugcuugugcauaaccuguguauaaccugggaagccugcuaaaauugauggcuggugaggucuaaggacaacauuugguaagccaugcuucauaucccucccuuguucuuuggugacuuucuugcccacguguaaggagaugucuuagcuucuggaaaucuugccagaacgucaguugcguugagagaaguaccugcguggggaccaagccccauagcaaugaguugacaugaauguaacgauacugauccuccuguggccuguuaucacuagugagcugauaaaaguggcuguggacaagagaucuguacaaaaacuccaggugaagugacaagcaggauugcacaccuguugcugaaaaucucuggugcuccaaaugcaaugaccaagugcaagaccgugggcagggaggagggucaguuaaucuaaaccaugagcuguggcuggagaaauagcucgugacuagcagcauuuggugcucuugcagaggacucagguucaguuccaagcacacaguguggcuaacaagccuguaacuccauuuccaaagguuccagggccuucuccuaaccuguacagguacugcaugcauaugauauacuugcguaugugagggcaaaacucucauacacauagaaaauagacuuaaaacccucuacagacugaaaacagggucucccuauagauuugacugaauguagacuaggcuguccucaaacccucuuuugugucuuugaagguguguuaaagucucauggcucacuagcagggugauaacaccccauuuuacauacacguuuagaacuauuaaguacagucaguccagaaccaacaguuucaccuauggacugccuuccaacaaaaccuguuucuuauaaucuguucccccuuaauagccacacaguuucaguggaaacacuguucauaaaagcacucuuuacucuuacaaauaggcacacaucuucaaucuuguaacuugggagguggaaauagaaggauccaaacaucuaggucacuucagcuacuuaaagaguuugaggcuagccugggcuuuuugaaaccugucuagaaaagagaugguuaaaagugcuugcugccccuacagagguccagaucuucuuguaacuccagcuccaaaggaucuggugaggccucugaggacacccaugcacacuugggagcucacacagacacacacacacaaacacaaagaaaccuagucccuccucccccugcacaacaugauaauggauaagcauacucuuuaaggaccgccucagcccugggucucguggucacuuuucucucugcccuaacguggguucguucuuuuucugccagcaucuguaaucgcacccuaaaccugcuuacuguagaccuugaaucaauccugggaguuuggguuuaacucccucaaagagccugggcgggucuauauagugaguuccaggucaaccagagcuacacagagcuuuuuuuuuaaaggugggggagagaggugggacgcuggagagauggcucagcaguuaagagcacuggcugcucuuccagaguuccuggguucaauuuccaguacccacauggcagcuugcagcuuaucuguaaccucauuucaagggaccugacaaccuucacacagacuuacuugcaggcaaaaugccagugcaucucaagaaagccuuuuuuuaaggcagcaugcuuagcaugcaugagcucuuaaauacaauucccagcaccacaccccccaaaacuucaaaguuaaaacaauuuaaagaucuccacuggcccuauuugucgguguagaaucaagcauguguuagaauaaguuauuagaauacauuaggcaaagacuuuguggggguuacaaagcugaaaggaacagaaaaugguuuggucauuucgaaguuacuuguaaggugggaacuaagacaaaacagaaccagaucagcguaaagccgaaaggagccacacuggaagauucagacagccggggaauguggccguucucucggcuucucugagugcgaucagguuaacucggugagggggcuucugugggagugguuuugauuuuuaaucuggucucuugggaaccucguccaaaacagccacuugcaaucuuuaucaaaauguuucgcucccaaaguaucuguguuucccaaauucguggugugguggccuacuauccuagcagaggcaggaggauugccacaaacucaaagccugccuagacuacauaacagauucugucucggacaaacaaagccaucaccgccaccucagaggaaacagucccacugcugauuuauucggccaagacgggccucucucuaaccaagugauugagauugaaggaggucagaaaacccucucaggcuccacucaagugccuuaucagaccuaagcagggccuguagacuccagauaaaggaagcaaaaacaaaggccuuaauuaauuccccucaaacaacagguuuccuaaggauccaaggaaagccagaaaccaaaguagcuauuaaagacacaaguuuagaccuguuacgagcccucaagguacucucaguuuagcuggaaaaaaacccacauacacacaaauuuacuugauucuaggaugaucuugaguccuaggccaguucagucgacagggagaucaucgaacuuuucaaaggaaagagaaaaggcaucuaguuacugugcaugcuuuagaagaauacccccucguacuucccuguagcgcagugcuucuuguaaaagcucuccaggucuucggaugagaaggcacgggaaacguucacuaggaggccaguaaagucuccugucuccaaagcaguugucugggguucugccucaucuccccaugauugauuuagauucagaaaacccagucucgcuugaggaagaguaacaagcaccuauguguaauuucugcaaggguugagaucagcuaaagagacucaaauccacagcacagucccguggcaggguaagaaagggcuguuuuacaacaugcauuacccagaaguguucucucuugcccauuccccuccuuacagacuaaaucuccaagcaaaagaguagugaaaagugguugucaaggaucaaaugcacucuccuggagccuuguaaguggcucagucagaggauagaaaagcaaagucugccuuuugggaccaugguccuuguugcugagccuagaaggacuccuccuccacaucccugagacaugucugauacgaagaaguuacugaauuuuuuguuuuguuuuguuuucuucaagguaggauuucucuguguagcccuggcuggucuggaacucuguagaccaggcuggccuggaacucaccugccucugcugaaauuaaaggcacccagcagcagcagcaagcaaaauggacauuuuuuuaaaaauuuguguuugauguguaugccacagcuauggagugcccauagaggccauugaauccccuggagcuggagauacaaguuauggugagccaccuggugugaugcugaacucagguccucugaaagagcugcaaguguucuuaacugcugagccaucucggcagcccccugaaauuuuaggauaggccuuaucauggagagccaccuacuuagucauacaggcugggcuuagaguucagugggggagauuguucaugcuagcacagacaaggcuacgggcuuaaucccccggcacggcaaaauaaaaacuucuacucgcucaauaugauagauaacuagaauauccuuguagguacagggaauguuagguuaggcuguugcccucauauaggagcuacauuuacuagagaggggggaaaaaacuucuccaaggucauuucugcagcguucagcucauaccaaggaccuauugguguaugugcgcuaagcacauucguacuguauaucaugcaugcucuguucucaaaacuagcaauuuccugucuucagccuccuagaugcugggaucacaacucugcugacuccaguuuacuguuugucuccuugucccaacuaaggaaaacucagaagggucaucccagcuugaaaaccacgcgagggcuggggcuauagcuuagugggaagugcuuagucuagcaugcaugaagugcuggauuuggaccucagcgcacauucaaaagccaguaaauagugaaacuaucaaaaaugcacgaggguuggccauggccuuccugaugcauagcaacucgguuucucccucuauccaucaggcuccacgucccuuucugcuuccugggugugguuagcuuccaagcagcuaaccuguagccccagcuaaucucuagccaagcccaaggucuuccuuuugguucugauuaagcucuguaaaggagggaauauagucuugagaauguuugucaguuagccaacucggguuacuuccuuuaauucugcauagcuacugaauaugaucauccuaccuaacaaauacggugacuuaagaaacaauaaauuaauugcccaaagauccagagccaggcugagauguaaagucacagcuacaagucaaggucguggggaggacugcuccugauugagaaaugcugcuaaccauugcuuggugugugcugaguuguguugugauguguuuggguggugcuaaggaccaacauaaacuaggugguuauuccaccccugaacuacauccccaguccuacagcugggauuugaacccacagccaguugguuucaaucccuuccacuggccacacuaccauuucgaacaggucagagggcagcagcagcucagagaucgagcacacccaguuuccagaaagcccugggaucaccuguaguggcgcacaccuuuaacccccagcacucgggaggcagaggcaggugcaucucugaguuggaggcaaaaguacucuacauauugaguuccaggacagccaaggcuacacaaagaagcucugucuugaaaacaagcaaauaagaaagucucaggauauuaaauccccagcaccaagaacaagcaauacaugaugggaauuaggacauuaacugauugucagccagauucccaagugaguccacugguuguuuauuauuauuauuauuauuauuauuauuauuauuauuuugaguucuucagcugacacagggagaaacaaaaacaaaaaaccugggucuugaggaaaggacaauuugucuacucacauggaaucaaaugagagacacuucggaaaccucugggucggucuccuguauuaaaaaugagaacaaguccuagaaaggucaagugacuauccaaguucaggccauggcagagcccacacaauaaacuguaguccccgcccaccacuucugccuaggcuucuccugagcugaccugggaccagcagucagccugguccuggcuacucccuuaaggccuucccuguccucuccccugcuuccccacaaagcuuggcuuugaucuugcuugcccgggcugccuaagccucaggcugcccaccagccugauugccacacaaaaauccuguccugucucugaacagguuugacagccaggugaggggaggaaugagaagcaugggagggcuuuugcucccaggcugggccccuccgucuggccucagcccugggaaguacucacaggcaagcuugcuccucagguagagccaggcagacacagaagcuguaagcaucuguccccucccugcucagacucugacuugccacaccugccugugaggaagggccaccaggaugccuccuggccccucucuccaucagaacucagaugcuacgcugucccuuaaacccccgccuuuugcauucucaaaacuccccaucucuuaucgcucccugcuguguguuccaucuccucuccccugccugucccaccuaaaucacagccuuccaggacucuuuguaccucggggcagcugguguccucaggaagccccugaccaaagcaaucugggguggcagggcgguuuggaggugguggcagggcauaaacaggccccuucuucaucccuagcauguuuucgcucuccucagccuggugagucagcagcacagggccacacacaaggcucccau

SEQ ID NO: 1642 - RNA, 51586 nt, Mus musculus
cccaaguuccugcuccuagcugaguguuaauggcagcugacggcuacuagagaggaaguggugacagcuuuguagccugacaggcagaccaagcuccagucgaugucccugugucugcaugcaugugagauucccagugaguaaaaaugcaaguuauuaaauacuagauuauuggaaccccuacccccagcucuaugcuucacaagaaagccaauguccuaaguuuuugggaguucuaaccuggaugcugccaucgaggccgaguuucucaaaaacucaaucaagugcuccguauaucacacacuccccuuucuaauaaaacaagcccaagacaagacuuuucccccagacaguuaugauuuaacuuguuuuaauguagucuacuauaaaaaugaagacuucugcacuuggccuuacaaauguuaaugacuuaguuaacgcuuguguuacaccgagcacaucauuagauucugcugaccaguaacagcuucuuugauaugguuaauacccaaauugugaaucauggaacuuuuacuuagcgcacacacucacaaucuacugcaaacugaaauacuaaucuauaauaucuagcugaauuauuggauccauuucaggauugugcuuauuaucucagaagauaggaacuagcaaaaauacacauuucuuuugcauaucccaccccuguauuauacuguaaaagaaauauuguucagugcaucccccccaagaaauaaacuccccuauagcauuucucuuucucuauauauaucugucuccaaacagaggaagagcacaacacagcuuuuaagauuaccauuuaaagcaagagagguaagaacacugaggcccugcagucucuccugaggagaagguucagcguuugaucaucacuggucuauuuuggcuccgcaauaggaguaaauuccaugcaggaucgcucgggacaguuucacaugucuccaucauuucagcagacaccagccacacuuucaugugucaugcauuuaccuuaaccauuuaaacuguaagcuggagagucaacaguauacccuguuguugacuugcccaccaagauuuuaaucaccugccucuugcccacugacucaaaggguuaauaaaaauauaacuaagagcuauuagcuaaauuauuagggagacuuuuuguuuucagcucugugguucaagaagaaaaucaauuucuaauuccuugugacucaucugaaugggcccacugaauccuuugguuuugcaaacaugaucagguguuuccaaugaucacccauucuccuucccaauaaacgguuacaguaggccaggggcuucuggguagaugcuggccagaacaauuuauguaaagacaccaaggccuuccucucucuuacucuggauaaaaaacuguguaaccaguguccugagcuggugugucggggguucugcuugccaagagcaaggcuguccugcucuguggacuuggucagauguagcugacacaguggagaagccuggggguuucugucuguacaaacucacuacaagggaaacagcacagguucuagggagggagaggcugcagcuugguagccugcaagcuaaagucauuugcagccauguuugucuaaucagcagcauuuaaaaaacauuuaaaaucagaaugagaaucuucuugugggaaucucaauuccaugaacguuuagagaauugguaaccuccaucugcaauuuuugcaugacaggagcuggggcucaaagggguggccccauuacacggggcuaggaugcuauggcugaguggauagcacuugaggggcugugcugucucacucacucacauggcuagcugaguucuguggcacuaggacgauuuaaugggcuuuccuaugaugcugaugaugugagcuuaguuugggauuguccacuuccuugucaaauggauuucuuuguugacugacuggcuccaagucacaucuaauugcuuugguagguaaucuuaacaugcgauugauucuacuuuguccuuuaugcuacacugcaagcuccagagauacaauugcacuaauacuuaugugcuugagugugagaaugcugaacauguaaaagggguguguacuauacagauacagauauacgcccauuugguuccauagauagaagugcuggcagcauggagagugaauguaacaauuugguaaaaucuguauaauucugacuuacaguauuacaaagacugacuuuuaaguuauugcuuuuugaucacagaauaaagaguucauuaugucauuuccuauucaaguaaaagcaaccagaaucagaaguucccauggccgaugcuugaggguggauuugaauggagacgugacuucacuacucaagaagugaugcaggaaacggagaaugacuuaaguuuucaaaagcacaagaaaaucagcaccccaacugcuaaguguucuggaggguuucuugagggcuuuacagagcucagccugacagaguucccgcccuucagaaggauuuccacucuacuuaugcaaaccucgguucagaacacaaagcuggcauuaaacagucagagaggauuaaaagcaguguugguuuuuugacauucagauucacagaggaucucauuugcugcaagaaaugcucugucuuuuguuucugccgcagaaucacauucccguggcaggcgauuucaggcacuuuuaaaacauguucaucuggaauaaaaaucugcacgaaccgcuucugcauaauuugaaaugagugcugaguaaugaauucuagcuccccgacuggcagcagcaccgccugguccccagucagccgccucgucgcagcacgcuggcaagugcagagcuugagaugcgcuaugucuaugagguccccuucuagcuuaguacaaagaggugagucauaaaaauccaaaguauucaauuucuacuuaaaaaaauacaaaaagguaaauacacugaauguauuauacagauggcuguagcuacuaucaaauaaauaacaugauuugacuccaggguuuaacgcugagcucuuggcccgagucugauggaaugucaaauguggagacucagcccuagggacuagcugcugguaggcaaaaguaucucaacaucuuugccauuggccaccacggcacugggggagcagcugcuggcgaggucuucuguggcggccagggaggaugccugggaaugagucuugguuacuggagugguggcagacugcgaaggggugaggccaggcuuuuugggcgggauugguggaggguuuccucucucagcucuggggaugguuggggacuugauuccuggagagagggggcucagagggcuggacacuuucccuggagugggugaauggcuggugucaccucuugggcuggcagugcuggccagauuucgguagucugucccaaagggagaacuguugggagagacgggcuuaauuggcccuugguuagugaaucuggagagcaccugagugacuguguuucgggccagcugcuuggcagcagaguugucuaacaggguaggggacaggucccuggauggagggcucuggagaccgcuggcuugcugauccugauccgccugggacugaaauuugugccgagcggcauggaagcgcugguugaucccgacuugguaggaagacugguagcccgggcugcuggcugcugaccccaagagacgcuugguuagaacuggggaggagcaaggagaugaugucagagaggaagaggcugugcugcugggagacagggagcugccacuggaagggaggugacuaggcaucgugacuggagucucaguuccuacaggacacccaccauucuccacugguuucuccugagccgcuacugcagauuucucccguggaggcccuugguuuucugugcugcugucugaggucaacucccugguagucuguaucucugggucacaguggccauuagcuuuagcauaugaguaagcagccguggugggaccuggaagaccagugucugucagcuugguuaugacacucccguggcuucuuucugucugaacacucucuguuugacaaaacgcagacacucgcaugggaggcuccguggcugugccucuggacauggucacuggcucccugcccugcucacuggugcugcggugcugcugggcagccucuaggucuuucacaagcuucuucaggcucuccaccuccuccuucagggcacggguccgguucuccucucgguucaguuuggcucucagcugcucccuuucgauaucgaacucagacagcugcuucuccaccugggccuccgucugcaggccccgcuuccucucggcugccaacucuuccucuagcuugcucgcccggcucuucuccuuguccaguuucaggcucagcucuccggccuucugcccuuccucggcugccuugcuaguggccuuccugcacucgagcaccagcauggaagagagcugcuuguggcgggugcgcuccuccuccaacugacuggacagcuucuuuuguucuuuuucaaacuuuuucacuugggacuuuucaaauuccaacuagaaaagaaaaaugccaccacaccucuugauuagagaaggaaaacagaaggauguacuaacaauuacgaucacucaggguguccucacuggcugcucucuggugcgcgguauuaguuuguacagcacggugcuuagguuaauuaguauuuuugaaguaugagaacaccccacacacuaugauuuaaucuuucuugaugacuugggaggcauuugaguuccuaacugccucagggugaacagcagggauaugaugcaccguuguguuuuagguaugcggagaggccauagaaucagccaaaacaaauaacagaauacaauguaagaugcaucugggcauggaugcuguugaaaaucaaacuugaagaugcagcaaucauucugucugaucuuuacaaagaguaacgaacauaaauagcugcacugagacccugcuuuuguuguuuucauuagacaaagucuuacucugagacucgcuuugaauuugaaauccuccuuccaacugguaggacgagaggcaugaaccaccauccuuggaucuacacaaauguagucuguuuuauugucuaacauuauuauacagacucugagagggaacggguggaugaaccuucuaaucaggaauuuccaauucgagauacauugauagauggggaagccaguucaguaaaccaugaucauacuuaaaaacaaaaagaauucaugagugugagucaaggcugcccugaucuacaaugugagcacaccaccacuguauaguacaagaauaaacagaugguuuauguccugugaucucugugauguggaaauuauuuaaucccaaacugagguuucuaccuugccuuuaucauuuaguuuccggauaaaagacacacacagccuuuauauuuacaauaaggcuuaaccaggacaaaaccuaggcagauaucuacuuucuaugcuauuagaaucuacuuuccuauugauaacuccaacuuauuacuuaccauguuucaucugggcugcucuuaaacucuaauuggccagcccucagggccauauuuucacggcucaccuaacccaugguggcuccuccuccauacuuuucaccuucucuuucuuguguuucuccucucaccccaaauccugccuagcuauuggcuauuggcauuuuuauucaccaaucaaaaauaacucggggcaagaucacacagugucacuugggucuacauguagacugugucaucucugggacaaccagaucuugggggcccaauauuagcauuaaaggacaagcaagaccacaccucaacacucuacuucaggcguacuggcuugggauaggccaugcuguuacuguaggucgugggacaacaaaaaagccugaaacucagagaucucuaaaggaugugcuaugaaugacaguuccacugagugaucuuuguuuguuuuauuuuuaaaguuauguauacuugugugugggugaggacucugugcaugaguacaggucuuacuguagacaggaggagggugucagauccucugagcuggaguuccaggaaggugugagacaccugauguggaugugaggaaccaaacgugggcccucugcaagagcagugcuugcccccuggacuaucuccccaaucccaaguuaccuauguuuuuuguuuguuuguuuguuuguuuguuugaaaaaacagacauuuugggaauagccgugauaaacauggccauucuaucuucucaauaaggacuucuaacguaauucugcacacugccguaagccuaagcagcaacucucuagacaaggucauccugcuccuccuucccgaguuaccugcugcgucagucucucccucuccuucuccagcauguaggugacaucaucuccuucagcaguguccugugcaugccucugucuuucuucuucaaggucgaggaucaccuguaaaggauuuuaaagcauuaacuuccaaacaucgacucaacacuuacacuacucaagacuugaggguuccagauuaaaugagcaaacacaugaaauccagccagggcugucgaggcgcacgcugucgcagcaggaugaaagacaugugagcuaugugcuagaaaacaagauguuuacuuuuguugaaguaugugcagaagaaugcaaacagagacaagagagaaacgaauuagcuguggggguugggaagguuugagaaccagcagaauucugggaaaucacaggcgguuuguucugacuagggaccugcuggggcgagcccuguuguggugggcggcaccacacaaggcugagguguuccucucaaugcuaucacaggaggcaccaaagcuccagcuugaaacuaaagaucaaaucaaacagaacauccagugccuugcuuaacuaacacccagaucaucugggaaagacuccuacuccauccuaugugcagaaggcucgguuacugggaucugaccugugauuuuccacaagaauuuaacaacuugcccauuuauccuaguccacuuauccuggugcugaaugcucuaaaucaguuuccaggaaaacaaaagcagaaauggacauuucucaugcauucugcccaaaccacacagcauuugacaugugaauguaucguucaguagcuucuguuucagaguggcucagccuagaccucuugggcugucaguuauguugauggucaauucucaagauguugccuacuaauaauuuuaggaaugaagaaagaacauuuucuauaacacggaaccccacuuuaaaguuuaaaaugaaaacaaacaaacauggugacacaugccuguccucuaaguauacagaaggcagaggcaggaggauugccaugaccgugaaguuagccuugucuacacaaugaguucgaagccagccagagcuauacagauacagggagaucuagucucaaaaaauaauuaaauauaaauaaaacuaaaauuaagauguauuaguguacuuccuguugagcuaaaaaaaaucuagauuuuaaauguaauagaaugccuucugguuaaauguauuaucuaguuugagagcccuuuaaaauuacagaaagaaauauacuauagagucucagagaugagagacuuuaguaggggagaaaguuuuuucaagaauuuauuguauuuauuuaugcgugaguaugugcgcacaugagcguuguugcccauggaggccagaggcacugaauucuauggagcuagaguuacaggugguugugagcugccugaugugaguguguuagcaacuaaacucgguccuuuggaagagcaauuagugcucaucccugcuaagccaucucuccaggccccagacaggaagguuuaagaacagucugaaauggaaaacaagcuuggggagaggcagugcuucgguagcaggagugaaccaucucaccucaccugcaggcuccaaagagcuggaaccuuggaaagcaggugcuguagggagucugguucagagucuggauuuucaaagacuagaugaagaagagacucuuccuuaaacuggguaugaggagcaguaucugcaaccccagggcuugagaaguaaagucaaaaggucaucuuuagcuacccagugauuuaaagcaugaggagggcagaugcgguggugugugugugugugugugugugugugugugacaaauccauguuucgaaacaacagagauaaagcuacccuugagugcugggggcacugggacagggaggaagugccugaggaacccuccuucuacugcaagcacagugaccagacugucuacugugcagauccuacucuuucugggaggacgagggcuuacagauaauagccacagcacagcaaaggguagacacggaaucuucagcgaacuuggacuauaagccuacucuauauacagaccucuaaguacuaacugauuacuggcaaauuuagugcccagcuuggguaaaacacccaagagcagcuagguacugcaguuagacacgcuaccauguauguucuagacaacgcagccugggucagacacacugccauguguguucuagacgacauagccuggaucagacacauugccacaaaugaaacauuuggguuagacucuuuuuggccacaggcaacuuuuagauuuugacugaaaguauaaaaaaauacacuuuccauaaaaaugcauacacuucugauauguuauauauuucaggggccuugugggucaugcgugaccuacccaugguuaaggacuuauccucuggacucagugaagagaaacaaaggcugacaggcaagaagacccagcucaggggcaacuuaccagauguggcuuuagcagagagcucccguggagauaaccaugagaacaaacuaaugucuacugaauuugcugacaccaucucccucauuaaaaugucuccuacaagccauggucgaugccugccccuuguagggccaaaucuaaauagcuagcuuuuuaaaaugcagaugcuugucaaacccugccuauaggcaggaacaagcuggagagguacuacacacauuggaguucucaaaccugaaacugcagggagcacagguuugcccugcacuccaguguagagaagacuuaaaggccagccauggcaggagcuguuuacagccuuacaccuuguaaugaaaccaggaaccagaugaguggaaacaaucucaugcuugcaugguuaguaccagguggauuuauacucccucucuucccuaaauaccuguuaaucuuuuuauuuaucacuuaaauaagcaaacagagaaugcucuguucagcuucaagcaugguuaaacaccagcuugccacuaaaguuuggaagacugagauuuuggggaaaaaaauggcaccaaguauuuuggagugacucaucacagaugaaugucaucuuuaguaacgucuggaccugugcaaugacccguuucccuuugugccuggacuccuguguaacugaagaguccgauacccaugagcuccccagcccucuccaaugcccgugaacacugguggcugaggcaagucuccugcggauuuccgaagcccagccuggcucugggcaagccuaccuugcggugccugcucucggcugcggccagcugggacagcaugcgcuccugcauguucuugcacugcuucaucaccgccuugaggacagagaggggguuugugcacacuggcugcuucucacuaucauuuuucuccuucaguguuucaaaaucucucugaagagccauuagagggucacugauguuauauuuuccauagcguucuucaaugaaaguaucucuguguugggccugagaauaagaaaagacaaacaaaaccccaaaccauuaaagagaggaauguguuacaauaccaaaggugguagcauuaguguaaaccugacuacaaaucaggagauaccaggagguggugccuugcaguaauaugaacacugacccaguauuagacgugauccacagcagguuuggccauauuaacgugggugauuuuauagccuuauaaaguagcacuaaucaucuccuuugcaaauggaaaaaucauuaaaaagaggcuaacuacucagcuagccgacugucagaacagguacuuaacccagcuagcauggcucuggaagucccaugacuuguuuguuuguuuguuuguuuuucaagacggguuucucuguguagcccuggcuguccuggagcucacucuguagaccaggcuggccuugaacucagaaauccaccugccucugccucccaagugcugggauuaaaggcauguagcaccacucccgggcuuggaagucccaagucuuaaagcagcaaacccagugccuccacuuguaugucuguguuaccugcagguuuaucuuaucuuucuccuguguggcauuugcauuccuaaaguguuaagcuugaugacuuuaucaguuuauauacuuaacaacaaaccaggugccagcaagugccgacagaggagaauucaggacuccuugugaucuguacagagagaacucgaguucacagcugauggguuaagaguggguagguacauauaaugccagccacacacaaaaaccccuucuaccccccgccaaauucaaccccugccccuccuucucaaucucugaucacccucuccguuccauagucuuuucuguuuccccuggcaaccagguaucuaaggaucaacaaauguuuggaaagauacuucaguuuccuucuugucuuaccucugcucaggaaagcuuuaggaaugacaugauaugagcaacaaguacuucaugucuauaaacagaggggcaugagcaguuucuacacaggcuaggcaugggggcauaugcuuuuaugcuccaguacucaggaggcagaggcagcuggaucucugugagucugaggcaagccugagcaacauucugagacccuaucucaaaacaacuaacaaugaugaaagccccaaugcuggccauggugguacaagcccacaaguccugcaggagaggcugagaugaggagauccuaaauuuaggucagugugggcuaugcagugagacccuuccucaaaacaaacacgcuuuccguuugauuucugguuuggccuacagucaucuuaucaccagaugacuggaacaguuugaggcuauuuacacaguagacacagacacuguaagugcaaauauucuucuuucuuuuuaaaaaucccuauguguacuggaguauggaggaggcccuuggcuggggaggaggcuggucuuggauucuggcuggacugacagacaugagccaccauacuuggccucuuuccuggagucuccuuacagcccuugcucuucugauaaagccaacccuguaccacuaguguaguaaaugcuacuaucaccaagauugguucuguagcccaaaagagagagauuaagcuagagucuuuuuaaauuaguguuaaugaucuuuucuuuucaaaacacuggggaguugggauuucgagcagaagcugggacgaugacucuggccacggaacaacuggugacucggauguuaguuuugccaagaagcugccugucggguuugaguguagaguuaaccaguccuaaaacuugacuuuaaaaacccacauggugauuaucuuuugugacaguuaguaucagagucccaagcaagaguagccuuagcccgaaaacaguuguuaggcugucuucugauacuucagagugaucccauagucaccugcaugguuaauuacaauccacaccaauacacggcuucaccgcagaugaaagggagcugugggcagacuaaaaggcucuggucacacagcaguuccaccacagggccaagcacagacaaggucagcucgaaggcuguacuuaugauacuaaacaccagaaaaacgggagaaauucauuuuucaaccaauuuaugggcuacauguuuaacuguaaauaacagugauaagcaaaaccaaaugcuaaaauguaaugagaauaacuguuguggggguaugugcuggcuaccucuugcugcauaacaagcagcaacgccagcagcuuaaauaauccuuauuuuaucucauguggcaccugauggucaggaaucuaggaugagggguuagcuggguaguucuagauugggaucucaugagggucuauucuaaucaccacggcuuaugugcuggcuucccacagcaugcaguguucagguuaucaagaccaacaucucaggugugcagcccaaccuuagaacacuccagaugcgaccacacagcucacugagacuggccacagucaaggaaugagauaugcugccacuaacauuauauuacaggguaaaauagcauuaauauuuuaaugauuuguaccuauuaaaaauguacaugaggggccaaagcuuaaaccaaucaauuucguauuucagcauuuuugcuucagggacaauauaaacuucagcugaagagaaauuucuacagugccagaaaacauguuggucuuuaauuucaaagaaaagaaaaauacuggcuugcuagacagacugacaacagagguccuaucaacagccagaacaccagccaccuauuaugccuucaucuucacuucacaggcuggaggaaacacaucacuagagaaagcuuaaaaugacaucacagacuagccuuggagccgccauguuuaguccccaagcuccuguggcgcucucacugccucauaaaggaagaggugggcacucaggcuaugguggcagaacugagagguucaagccagccugagccacaugagccacacaggaagauuuuguuucaagucgucacccuucccccacaaagaaauaaagcaguuuccuuuucugccuuccuagugugaaguguguaacaacaggagugugcauaauccacuccugggcaggauaccagccacuauauucuuuggaugaaaaguggcucugaaucuaaagguaaagaguuagucuaggauggcucaguugguagagggcuugccucgcaugcauggagcccuguguuucauccacagcauagcacaaaacugggugugcuggugcaugucugcaguuucaguguuuaggaggugaaggaggugggcagaucagaaguucaaggucauuuccagcuaaauauuaaguuuggggccagccugggcuacaugagauccugucuugaggcaaagcaaagcaaacuaauaacuuggcacauaagauggcuuagaugguaaagguacuuguugccaagcuuaaugaccucaauuugaucuucaagaccuguacugugggagggccaacuccuauagguugcccucuaacuucuacaagaaugaggugauuauuucaacugccuuugaaguaggaugaacuucaaacacucuucaaaguaaucuucaagcacagauauuuauaaaggcaauuauuuacauaagauuagacaauuauuuaucauuauuuggacaaaguguccuaaauucuauucaggacugagaguggguuuaaucuuaaguagcugugaguguggccacaaggagcgguaucaacacccuaauuccaaagucugucacagguuuugaugaaaccaaaggaauguggaguaugucuguccuucugucggaucccuucccuccaggaaugaggcuaugggggcuaugguacuuucuggccuggauccauaugcuuaccuuuuugauguggggaacaaaaauguguacgggaauugaacagggaagaaagaacagauaaagggcaaguauuccugaacauaaauuaaggauuucaaugcacauaaaaacaaaaacaaaaaaauccuuucccuuucccagcaguuuuagguuuauaacagaagugagugaguuaagagauuuccuagcuauccccacuggcaaaugcuuaggacucugcccugacaaccaccucucauuagaaugggucauggaacccaggaccuccuagguaagcagccaggcuacaacuccaguucuucaucuuccugcccaaugaucacaaauaaaaacagacacugaagcugggugugguugugcacacauuuaaucccagcacuugggaggcagaaggcagguggaucuuugaguuuggggccaguauggugaacagaaugaauuccaagacagccagggccacaaagagaaacugucuugaaaaacgaaaaccaaugaacuaaccaaccaaccagccaaucaaccaaccaaccaaccagccaaccagccaaccaaccagccagccaaccaaacaaccaaccagccaaccaaacaaccaaccaacuaaaaaagcgaaaguaaaaacaaacaaacuaaaccaaaacaaaacaaaagccagacacugaccauaaaugaaaagagaaaauccaaauggccaagaauuauacauuagaguucaguuuagggcuggagagacagcucaguggguaaauaguucuuuccgugcaagcaugaaguccuggguccaaauucccaauagucauguaaaaaagcugggaguggccucucaugggccuguaagcccaccacuggguauguaugugugcgugugcauguacgugugcgugugcgugugugugugugcgcgcguguggagacagaggcugacugccagcuaacccuagguuuagggagagauccuguccuggggaauaaagugacgaguggagagugaucuucuucugcccuguccccacugugcagacaccauacaaacauacacaucccguuaccuauaucccaguuaaagcacagagcauucuaaaucucaacaggaaguuacugcgugccccuccccaccagaagucuccccgcagggccaaccccguucugaguucuuuuguuuucacuaacuuagucaucuaaacagucgcacaugcugcacgcuuuuguaccuggcccuguucucaguauaaugaaguucaugcucauagguggcaugucuguaaucuguccucuacugcugcacuguaugcuacuauaugaauauacugcauuuauuuacucucuugacugauguuugagucuacuaaguuggauucuucuaugaacaaagcuguauuagcaacagaguaagagcugcuugcagaugcuucuuuuguaauuacagcucguuagcuugucuaaucaugagaacugcuccaucaguucccagagugggucuacuacacuacugcuuaucagcagcuuggaagcguucaggucucacccuucccagcaucugcuguggucaggcuguauuucagcagcagcugcagcagggucucauuguccugacugguaccuacugaauuuagcaccucuccauuuugcuauguauauaugagaaagagugugaucacacgcacaugugugaauaaccauuuauaugccacacagagcauguauggaggucagaggacaaccugcgggagccaguuuucuggaucuuuuuaccaugugggccccaagaacugaacuggggucaccgggauggagaugacaagcaccuuuacucacugagccauuuugcuggguccccaaaucaauuuuaacagcagcagcagaaacagggaugcuaacauccaaaugcuuuuuaccugaaagcagugugcugaguuuucaucccaccaaccuaauccuaacaaucucucuucucuguuugcuuaagacaggucugguauauggcuggucuagaacugagacccucucaccuuggucuccugcgugcucugcauacaggauucaccaccaaccaugcccagcacauauuccucuucugcuaggcgacacuaucaucuccauuuccuuucauagagauuaaacaguagcauccaacuuucucagagccgagaagcucguccacagugaggaagaggaggaggcugacacucagaacuuaucaggaacgagcuuccgguuaggcccuaacugcggagucugggcagcuaggagucugcauagcagacaguaauccuggguuuuuuucggcuuccucccugccucaaaaccagaagagaagucgcugcagagcacugugaggggugagguuauuucaagcaaguucuuccuggguuaccccacaaguguguuguguccccuaugucacaaaguaacaucuacuuugcaucacgucucaacuaugaaugacacuggaauaaacggaagacucaaauaagucugacuguugacucugcuuuucuauuuaagguaaaagaaauauauaaacgcuaaucuaaaaagguauuaguaggacuaucuuauuuuaaacuagcaaguguuacuagaagagauuugguuauagaacaaguauauaauauacaaaagaaacgaaaagccgcauaacugaaauauccagaauacacaaacuuugcaugcauuuauuuaguacuuuauguuugcugggcagugcauaugcugugaugugggcggugacagaggaaggcagauuugaacaugugaggcaaaguucucagucuucaagaagauaaaaaucugcuacauuuuuaaggacaaacaacaggagcgagggugggcagccucugcuuguuuaaugguuucugaacugcaucacacauguuuagaagaacaccaaguggaguuuauuugauuggaguuuucuaagacacacagacuuuaaccuccuaaggaauaggaaggaaacggccaacccuggaaguggguggguucuggcagauaaacgguacaaucagugacuuaaugaaucacaggaaauagguacagcgguggugaugguggggagacacuugaccccaaacuucuggaguaccacacaaugggacuaacccacaggccgugggacacgguagguuaauccuaugaaccuggagaccucucuacuagagaugaacugaggcucuuguauucacuguauugaaaaggcccagggcucagugaguauagguauuugcagccaagacggacacugacaaccuggguuugaucccugggaccuacacaccagaggaaaagaacugacucccaaaaguuguccucugaccugucugcgccaucccggccaaguugugugagcccuugugcaaaguuuaggaguccauucagacaaauuacaguuacagcaggugugcuggcacgcaccuuaauccccacacuagagagccagaggcaggugggcuuuaugaguuccauaccagccaacaacacauacugagacucugacucaaaacaaagagacaaacaaauagagaaagucuagucaggagccacuucacagcugcacagcuuccaucgucccuccucagagucacucuacaaggcggcuccuccuccucagucacaucucaugagcuccguuuccagcgcuacugcugacuaaguguguccugugcaccccaccacugagcaacagucccacgugagccccaucugaaacuaaggaguuuuuaaaaauuacuuuuauuuuuauuauguguacgugucuuuguauguacucaugagggcaugcuccaggaggcauaugaaaccuuggaaguggaguuccaggcaguugugcucugccugacguggguguugggaaaugaaccugaguccucugaaaggccagccuguguacauucuuaacuguugagcuaucucucuagucugaaguuaguuuguacuuucuguuuuagauuuauuuauguguauguauacacauaaauuuaaaauaaauuuaaaaaaaauuuaaaauaguguuaauuuggaaaauagagaaaacagaugaugauaaacauuaucuaaaagauacaaaaacaaacaacaacaacaacaaacccaaaacaaaaaaacccaaacccugaaaaacaaauucccaguuaggcguggugacccaaaccuuugaucccaguauuggggaggcagagguagaaggaucucugugagcuuagggauagccuggucuacaaagaggguuccaggacagagagcuacaaagagagccugucucaaacuaacucccacccaucagaaaaagagagagcgagagagagagagagagagggagagagagagagagagaggaaggaaagaaaagaaaaaaggaaagaaaaagaaaagaaagaaaaaaggauggaaggaaggagagaagagaagagaagagaagagaagagaagagaagagaagagaagagaagagaagagaagagaagagaagagaaggaagagaaggaagaagaaccaguugcaguaagcacaagucccacagaacuagggugagugcgugcauucugaacgucaguaucucuaagucagacagaugcucuaaagcccucagcuggacaguggggaaauagauuuucuaaguagcuagaagggaaggaaaaagaacacugcaccacucaauacagugcggcuggagcagccucagugggaguggucuugccuagcauuauaagguccaggguuuggggaugaggcuaggauugggaggagcucgcggguguuugcuuuucugcugauacaaagcucccauuauuacccaauggggggagagggcagugcagacgacuacaccucaccucagcaagaaaggaugcuaagacaaaauguucacugaaaguuaaaaugggggaggggcuggaagggcaccggcugcucuuccagaggaccugaacuguacuuucaggauucacgugacagcuuacaacugcuuguaacuccaguucccgagaagcugacaccuucuucuggccuccacugcuacugcaagcauguggugcacagacauauauguagggaaaacacccauauacauagcauaaaaauaauuuuuaguuuaaaaaguuaaagugagaaaacuuguuucaugacaggaauuuacccguggacggagaggggcagagcagacaucugcauccuucacagauaugaaagccaacgucaagcccugacuuccugucugaagaacaagcuguucccagacauguaaauaacgugaguggaugggaaucaucaacaguggaaguuaugaaacuacuuuauuagaguuaugccucucuucuaaaaagcacuaauaaaugcuauccauuuugagaacugaaauauucacauaagacuuaaaagggucccagcucauucuucaugugacacauauagcggugaguacgacagaggcucuggauacugggcuuccagagucagaggagauuaaggaccugugugcgccucauggaauuacacucgauggagguagggaaccacggauuugcacacaaaauagaaagauccuuguaauguccaaugcuuaucagaauuaacagguuacacauuacuguaauccccagugaggacagccagaaaagagaaagcauauuaagugaacacagguuuauaaaacaugcaauggggcgcucaguagauaagaugcuuccugucagcucccagcacauagaccaggcaauguacuuguaacuucagcuccaagacaaacacagacaggacagacagacagacaggcagacagauggauagauagguagguagauaaauguaauuuuauaaaacaaaacaaaagcuccaaacacaaccaaccaacaaacccaaaucagccccgaagucuaaaagccugauacagcacuaucacaguacagucacgaagugugccagacagagagcuucugaacguauaccaugggaaccacagaggauuauaaacagccauggggggcauuccauuuaaagguauguggaagaaaaaaaugaugagaaauaucaagacaagaaagcuaagaaaaccaaagaaagaaaguguaaaaguaagaugaggggcuggagagauggcucagugguuaagagcacuggcugcucuuccaaaggacccagguucaauucccaguacccacauggagguucacaacugucuauuacuucaguuccaggggaauccaaugcucucuuuuagccuucacuggcacuaggaaugcauguaagugguauacagacauauaugcaggugaaaaacguauacacauuuaaagaaaguaugauggccugaggugucuguuugaugccugucagcuacccagcaacacccugucuuaaggacugacacaccucccgucccugucccccccccccccccccagaugcuuuaguaauuuaauuagaagacgccauuagggccugggacucagagguggaauguuugccuuauguguuggcuagguucuggguccaauccagcacagagggcgguaggcauuagaaguuauauuugcuuucagcaggcagauuuaagucgagacagagguaaaaacuaaacgagagaugcaggcacagaaggcagaagaagacaagcaacacugaaauacugaguguaccaaggagacgaguugucucgcagguggcucauaauuaagagacugguccaaaugggccuuacagcaggggcaagaaguaauguaagggaagaaaucggagggcaagagacgaccaagaacuuccgaguacacaaggaagcaagggaaagaaggcuggggagaugcucaguuggggaggcugaggcagggaggugcuacaagcuggaggucagacaacuuacccagaacacauguaacccugagcucaagccacagccccauacaacugggcguggcagugcacaccuauaccccagcacucaccaaacuuauuguuuagcuaacugaaguccuucuugacugcaaccccaccuauuucugagucugugaguucuccugagccacuucaucuaucuuuccucucggaaagucuuccugaauucuguucgugggccacuucuaggcaaacgcauauguuuaggugcauuguauaaaacccaaccacacagcuaaacugcagggcucugcugugucuuuccaaucaaucuuagacaucuaagucacugcauagcaguuuucuucuuaaaaauacaaccaguugggcauaugggcacaugccuaagacagcuuccuggggagaccgaggcagaaagaugcuacaagcuggagaucagccuggguaugggcugcacaguugauucaaggccagcuuggcaugcacagugaaaacccuacauccaggaacaucccacagugagaugcaccaggaugcagcuuuacugacaggagauuuacgauuucccgguguuaaacaacagcacacgaacaucccugucaguguaacaacagcuuuacagaagagguauuucuuuccuuccuuccuuccuuuaaaaaaugucauacuucuauucauguguacauaugugugccugccaugaguauaugccacucauauaugugugucauuaguguccagaggagggggcuggaucucuggagcuggaguuacaaguguagcuaccuaauguggguccugggaacuguucucagguccacuggaauugcagcagguacucugaaccacugagcugucucucaagccccugggagaaaaguauagcguuuccuuuuaagaauauuuacuuacuacugggugagagugaccaugccacgcuguguguguggaggccaggacaauuuuggagcuggcuuauuccuucugccuugacaugggaucugagaacugaacucaggucggcagccuuucgucagugggcagugggcaguaugcaccauuaccugcagacugucaucagugggcagugagcaucauuaccugccgagagccaucagcuuuggcagcccuauguuucucauuuaauaaaacucccaauacauucucuaaaugccuccuuuccacacagacugucagcaagcugacaagauggccuccucuaguccuauuauuucuacaacuggcucaauauacugacagaccacagauuuuguuuucaacuaaaacuuucauaguuucccuugcuucuuucuauaggagcugcuagaaauaaccucugauuuaaccuaaaucacgaggccaacacaugcaaggagacacaaugacaggaagucagaauaacaggaauaagcugcuuccuuuuucuaucugucuuaguuucaggcugagugacugcuguaagcuugucccaacugccugugcuggaagggacugccacuucacaagcagaaccccgucucuuccuccaagacauaacaccccacccccacccacucggacacacaccacacagaucccagaguucacaggaagaugccagucaaaugagaaauucacuggcaccuguaaucccucacacaauucacagcaagaaugacacgucacagaaagcggucuagacagcugacaccacacuauugcguuaugagccagcugauagaugaggguccauguuuucaggaaugaaaaucagaugcuuuaucacuuaggaacacaagcuucuuguucuaaauauccgguuuacgaacaaucaucgguaccaauggccuugcccuucucguggcucuuuccugccagggcaccccaccugcagguucuucccucucacuagugccccacugcggguuccccccacccccguagaugguguuaggagguccuacuaucuucagggaacaagcugagggggagaauggagagacuuugagagguuuccccuacuagacuacaacuuaguauuuuuccauguuaugguuuuauguuuccacauaucacauuguggacaguauucccuaggacacacaaagaccauuccuuaccagucuggagguacuccacucugauuccaucauaacuguuguaaaauuuuuuaaucccaauccgggguuucuacccaccuucaaucauucaguucccagauaaaagacacacaacuuuuuuuuguuuuucuuuuuuuuuuguuuuuuaaagacaggguuucucuauauagcccuggcuguccuggaacucacucuguagcgcugaccuugaacucagaaauccgccugccucugccucccgagugcugggauuaaaggcgugcaccaccacgccugccuagcacacaacuuuuauuauuuacaauauugcuuaagccgcacaagagcugggcagauauucacugucuaugcuauuagaaucuaccuuccuaucaguaacccugaguuaguacuuacuauguuucaucugggcugcuuuuaaugugggaccacguuuucgugacucaccuaaccuauggcggcuuucucuuccuccucaccuuuucuucccuggccccgcagaagguucuaggcucuagaaccuaaacccugccuaugucucuucugugcuuacggcccacugacgaaaggcugccgaccugaguucaguuuucagaucccaugucaagguggaaggaauaagcuagcucacaaaguuguccuggccuccacacacagcguggcauggucacucucacccaguaauaaguaaauauucuuaaaaggaaacacuauacauuucucccaggggcuagagacggcucagugguucagaguaccugcugcucuguuggcaucuuuauucaccaaucaaaacuaacuuaggggcaagggcacacagggucacuugggucuaugugaggacucucuuguccucggggcaaccaggucuugcuccccccaccucccacuuagcauuacaauauauagcaaaagaucaaaccucaagagugauuuucuugagcagacccuacugugagaugcuaggcuuucucuagcacuugugcugcuaugacgucugcugcuaguaacagucuuuuuuuuuuuuuuuuaaauauuuuuauuagguauuuuccucauuuacauuuccaaugcuaucccaaaaauccccuauaccuucccccaacuucccuacccacccacucccacauuuuggcccuggcauuccccuguacuggggcauauaaaguuugcaaguccaaugggccucucuuuccagugauggcugacuaggccaucuuuugauacauacacagcuagacucaggagcucagggguacugguuaguucauaauguuguuccaccuauaggguugcagaucccuuuagcuccuuggguacuuucucuagcuccuccauugggggcccugugauccauccaauagcugacugugagcaucgacauauguguuugcuaggccccggcauagucucacaagagagagcucuaucuggguucuuucagcaaaaucuugcuagugugugcaauggugucagcguuuggaagcugauuaugggguggauccacagauauggcagucucuagaugguccgcuagcaacagucuuacaugcagcuuuagucaggagguugagggaguuggagggcaaaugucagacaauuugggcuacauagugagacugucucaaaaacuaaggaaguaaauauugaugacauuuaaauaccuaauuucauuacucaauaagaaaugaaaaauuaauauuaaaaugagaagcugguugguagugguguaugccuuuaaucccagcauccaaguggcagaagcaggcagaucucugaguuuggggccagccugacagugagaucuuauuucaaaaaacaacaacaacaacaacaaauuaaacaaaccaaaauccccaaaccaaaucaaaccaaaaaaaaaaaaaaaaaaacagaaaaagaaagaaagaagugagaagacugguguugggcauauauaaaauucucaaacaauaaaaacagucauguagagcugaagaaguccaccuucccagaacuaagagaauauguuuuguaugauuccauaaagucauagaaaacaugucuggggacagaaagcagaccagggauucaugaacacaggaugggggguggggguugggggcugaggagaggggauggggauguaggcagaguggauuaaaacggcacaaagaagaucuuagcggugauggacacguguccuugugacuggaaauggucccauaggauccauacaucacaacaguccagagcacacugugaccccagcacucuggcagagacaauggauccugagcucaaggccagcuugguuugaauggcaagacugucucaaaaacaaaauauauggagggguuugggugggggagcuauaacagaccaucuguucuaagccagagucaaccuuaauguuugccagcuguuucaaaagucacacauuugguuaucaggguaggaaugaagaaauuccaagccagcacugcuggugacaagagagugguacucagaaguaagaguuguaucuuccuugcagugugcacaguuugcuuuaugaacauaauucuguccuaaaccaaugagcuuuguaaugacagaagagauuguaaugguugguaaagccguaagaaacccugucuaguaucucauccagccaagagccauacauaacacuuguguuugugugcguaugugcuuguguggccgggugcacaugcaugcuaaugauggcggcagaugucuuccuugauuauccuccaucuugugucgagaaagauucuaagcugacacagcuaagugugguucuguaccagcagaggacacgcggugggauguagaacaugcuagcaccaagagaaaagcaaagcaggugcucuaaaguugacugguagucaacacugcucccagagguuuuaaauggcugcguuuccaguccuucagccucgucugcagcaggcucagagcacccagcaagccauuuucuagaucugcguggaauugcuuaacuggggcuuuccugcuggauugugagcuccacccugggcuucugagcaaugugauuuuccuuuucuguugaggggaguuuuauagugcccuccaucaggaaaauaaguuuacuuuugacuuucaugaagacuguuuuaccuuggcacaugcuucuaacaucaaaaaucacguuuauguaagguuuaauuaggaccaaauacaguauauauauucucuuuaacaacuuaaguucacauacaggaaggcugaauauuacauuauagaaacacugccuuuuauagccuuauugcaaacaugcuuugguugcaacggaacagggcagggcggcuugcaugggcaggaaaaguacccuaccugggacaacaggagguguggugcaaucuggcaccaauuucagagaaggaauaaagcucuuuuacaaucccagcuguacagucagaucuacuuuacaaacuauaggacauuuacaaucuuucccuaaagaaacaaaaccugccaguguggccugacagucacugagaagcaacagguagccauaugguuuuguucagagaacaaaaaguuaaauggaagcagaaaaagagauuuuucuuucucuuugaaagcaaacagaaaagaccguucaaaguuauuuaaggcaaagacugaacugggcacaucugaaauacaacuauacucucaguacuuaggagacagaagcagaaagaucucuuggaggccugagguccaggacagccagugagacccugugucaaaaagcagggguggaagggaacggccuggagagauaaagagagggcucagagguuagcugggcacacggaucuugcagaggaccugagucugguugccagcauccacuuuagagggcucacaacaacuguauuccagcugagagggagccagugcuucuggccucccagaaaaccaccacucauuucuaugugcucaugcacacaagcacauaauuaaaaauaaacaaaucuuaagaaaaacaaagcagcaacaacaacaacaaaaaaaaccaccaaggaccaaagcuuuucaacucacuuaaguaugaaauaugaacuagcacaaagaaaaucauugcuaguacaaaaauuccaacagguauuuguuguuaagaaaaagugcuguaaaggcaguaacaucuugguauugcuauagaaccagccaaccaaccagccaaccagccaaccagccaaccaaccaaccaaccaaccaaccagccaaccagccaaccagccaaccaaccagccaaccaaccaaccaaccaaccaaccaaccaaccaaccagccaaccagccaaccaaccagccaaccaaccaaccaaccaaccaaccaaccagccaaccagccaaccaaccagccaaccaaccaaccaaccaaccaaccaaccagccaaccagccaaccaaccagccaaccagccaaccagccaaccaaccagccaaccaaccaaccaaccaaccaaccaaccaaccaaccagccagccaaccagccaaccaaccaaccagccaaccaaccagccaaccaaccagccaaccaaccagccaaccaaccaaccagccaaccaaccagccaaccaaccagccaaccagccaaccagccagccaaccaaccaaccaaccaaccaaccagccaaccagccaaccaaccaaccaaccagccaaccagccaaccagccaaccaaccaaccagccaaccagccaaccaaccagccaaccagccaaccaaccaaccaaccaaccaaccaaccagccaaccagccaaccaaccaaccagccaaccaaccagccaaccagccaaccaaccaaccaaccaaccaaccaaccaaccagccaaccagccaaccaaccaaccagccaaccaaccagccaaccaaccagccaaccaaccagccaaccaaccagccaaccaaccagccaaccaaccagccaaccaaccaaccaaccaaccaaccaaccaaccagccaaccagccaaccaaccaaccagccaaccaaccaaccaaccaaccaaccaaccaaccaaccagccaaccaaccaaccaaccagccaaccaaccaaccagccaaccagccaaccaaccaaccagccaaccaaccagccaaccagccaaccaaccagccaaccaaccaaccaaccagccaaccaaccaaccagccaaccagccaaccaaccaaccagccaaccagccaaccaaccaaccaaccaaccaaccaaccagccaaccaaccagccaaccagccaaccaaccagccaaccaaccaaccaaccaaccagccaaccagccaaccagccagccaaccaaccaaccaaccaaccaaccaaccaaccaaccaaccagccaaccaaccaaccagccaaccaaccagccaaccaaccagccaaccaaccaaccaaccagccaaccagccaaccaaccaaccaaccaaccaaccaaccaaccaaccagccagccaaccagccaaccaaccaaccaaccaaccagccaaccaaccagccaaccagccaaccaaccagccaaccaaccagccaaccaaccagccaaccagccaaccagccagccaaccaaccaaccaaccaaccaaccaaccaaccaaccagccaaccaaccaaccagccaaccaaccagccaaccaaccagccaaccaaccagccaaccagccaaccaaccaaccaaccaaccaaccaaccaaccaaccagccagccaaccagccaaccaaccagccaaccaaccagccaaccagccaaccaaccaaccaaccaaccaaccaaccagccaaccaaccagccaaccaaccaaccaaccaaccaaccaaccaaccaaccaaccaaccagccaaccaaccaaccaaccaaccagccaaccaaccaaccaaccaaccaaccagccaaccaaccagccaaccagccaaccaaccaaccaaccaaccaaccaaccacuaccccacaaauuaaaggagauuuccuuauaacguaaauaaccugguaaggggcuggagagauggcuuaguuauaagagcaagguggcucagcagggcaguaguggcccacaccuuuaaucucagugcucaggaggcagaggcagaggcagaggcagaggggcagaggcagagaggcagagaggcagagaggcagagaggcagagaggcagagaggcagagaggcagagaggcagagaggcagagaggcagaggcagaggcaggcagaucucugugaguuagaggcuagccugguguauauagauuugaguuccaggacauccacggcuacacagaaaaacccugucuggaggggaaaaaagcauggucuguaacuaguuucagggaaccugguucuuuccucuggcuucacaggcaccaaguauacacagugcacauacaaacaugaagggaacacucauacacauaaacacaaauaaacccaaaagcacaacaacaacgagucuugaugccgccuaggucaauucuagccacagcugugaacaacugucccagcagauguuuaaagauggugucuguggcagaacuaaacuagcuggagugagcucaguucuaucacccauaggccacacacaggcccagucuaacacuggcccaaugcugaacgucacuggcuagcaaaacagaacccuuagagcuccugcuucucugaauccguucaacuucucagaccauaaugaagagaaguagcugcaugcagaaacccacuaggaaacaaaacaacaagcagccgaggcugccugcgagagcagagaacaguccuuacucacuccacacacuuggccugaaggacugcggcagucuuagggcaacacaucaccgcagucauuuuauuuguucgacaaauauuuggugcuagggauguggcuuagugacugaacauguauucagcguggucacagcccugaguuaaucuucaacaacaaaaauuacuacaacaaauauuuaccaaguaucuacaucaagcucugucaagcuuuaugggagaguaaauggcagagugacacaugcagcaggugccggucugugaccuucggucugugaccuuaggcuagggaaacuugucagagcacgacucagggcaugcucugcuucuuuucaucccaggugucaucuccccaccaguucugaggggaugaaggcagaugaggaggggaggaagacccagcaacagcagguaccaggaggguucgggaugggcucaaaccuugguacuucuguucuccucauuaucagaugaggacaagaaaugggaagguguccugaggcaaaucaagucggccuuucaagucagcggaauaaauaaauaaacuaauaagcauaauagggcuggagaaauggcucagugguuaagagugccgacugcucuuccgaaggucaugaguucaaaccccagcaaccacaugauggcucacaaccauccgaaaugagauuugaugcccucuucugggugagaagaaaaagugucugaagacagcuacaguguacuuacauauaauaaauaaauauaucuaaaaaaaaagcauaauaaagaaauaaaucagcauuacucuaaacuuaucaacuauagauguagguuucaauguuuuguuuuacuuaauugcacuuuacagggauccauuugucuuuggcagacucaaaucuuaccuucuuugguuacuguccuuugccucuggggacuaucaucuguacagauucaacgauacucugaaaagucuuuucucauccuaucuaaguaugcgaagacagaaagggaaccuccccauacacgcgaaaagagcuccuaccugggcgggcuugaucugcuuggccuucguaggcucugcaguguuuccacagacugccuguccuacuaacacgucucucucauccuuuguauuuuaacagguuacaaauuaaguaacaacagauuuuuguuuuugagacaggguuucucuguguagccuuggcugucuuggaacuguguagaccaggcuggccuugaauucugagauccaucuaccucugggauuaaaggugugugccaccaccuggcugaacaaaagguuuuuuaauuguguugguagcacagguaguuuuauggaaacuuuaacauccuggauauuagacccugaacuuugguauaugaaaaaaaauauuuugaauuuugagggcagaaaggcgucaucauuccuuucccuuuugguuuacuuaagacagggucuauacagccuugguugacauguaaauugcucuauagacgaagauggucucaaacucagagaucugccugccucugccucucaagcaccagaaguaaaggugugugcuaccauauuaagccuaaaauucuuaacacaaauuacaccaauauccacauaaaauagagaaauggcucacaacauaggauaaauacucucucucucucucucucucuccauaccuuuaaagcuucuauaacaaggucucuugcuucaaguucuccuucaaggauacugaacagugucaggaguucaggcuugcugaguuuuuccagauucauccugaaagucuuaaacaaaggcaaaaaucagucucccgaagaggauccugcucagagugaaggacaaagacaagacacagagcaaaccacacagcauaugauacccuucagacccgcaauucaaaacaacaccaaaguuuccugauguuaaucauaaacugaacaggaagagaaaaauaaauccacuauaaauuauugauuccaucaccaggaucaauuauucaucaccuuuuacaaggcugguuugcaaccuggguuucagaaaggaucaggcgcuaauucugccugcuagaaacugacguaguuucccacugggcaucaucucgcuggagaaucacugggucccacaaggaugcccuagguuuagauaaccacugagaccugcaggcaggacacgcuagcaucucucuucacuuggcugaguaaaguucaagcaaagguaaugcuugcucaaaguguaggagucgcugagaguguagcagaaacuuuaaauaguuuccgacagaaaguagggaucacaauguuuacacagccuucagcaacacagacuuaaacauaaguguaugcaaauaaacgucuaucuucaucuuuuuaaaagguuuuuuaaaagugaucuuucugugugcagguuugugcaugaggacugagcccauggaagccugacgguacuggaaucaucugggcuggaguuauaguaggcugugaaccaucauauacaggcgcagagaacugaauuugggcacccugcaaagagcaucaagugcuuuuaaccaccaagccaucuccagucccacagucuccuaugugguacaggcuggccuaaaacucaccgaggaguuuugguucaccuugacuucucaacccugcuaccucaggcuccagagugccaggugugagucaguaugcccaguuauaaauaugcuucaaaguaauauguuaaacuccguuguuuaaauaucucaauuaacuaggcuccugcgaauuuaacuucuuaugaccaucauuuuguuuuccugagauauggucuggccuaaccuccuguguagaugaagcuggccuuaagcuucuagugagcaucagccuuuacuucccgaggccaggguuaagacacgcacuccuugcacacagcgaugguuuucuuaaagacaucuucauucaauucuaucacauacucugaccacauucaccuccucauucauucuccuuucucucccaacaccagucccuuccucucccaaucuagauucuauucccaugccacauguguguguggucuuagguaucuauggaaaaaucuacaagugagaaaacauuguaacuuuuauuuauucacagugcuugauaugaugaucucuaguugcauccauuuauucuccaagugggauaaauuuauucuucuuuauggauggauaaaaugccauugugcagauacacauuuucuucauccucucagauguuaguagaaagauuucagcucauuauuuggcuacuaugaaugaacuugaguccucuggguguuuaucuaggagugguguaccagggaccuaauuuuaguuuucagagaaaauguuaauauugacuuccauaccugcagaguagaucucagugcccuggcccaccugaagguauaacucuuuuccgcaaucuuucucagguuugccuccuuuccccugcccacccucuuucuucugugucuccauaguuauggcaggccuugaauuugcccaaucuuccugcuucugcuccucgaguucuggaaccauagguauguaccgucaucacacccaauuacugucuuaaaaaccagcugacaggcgaggcgaaaucucagugcauugaucugucagcuaaggaugucaacuuucuuuuccauguuuacuggccaucugcacgucuucauuugaaaagugucuguuucauagcucauuuauugaugagguuguuuacuuuuuugccauuuuuacuuauuuuacauguuuauuuuugugugcuguauaugugcacacaccugugugccauggcauauguauggaggucagagaacaaccugugugggggggguugguucucauuucaacaucuggguuacacuaaccccguucaggaugccaggcuugaaaggaagcucucuuuuuugacuuucugagguauccuggccgcccagguuuuuguaguaaaacacucuacggucauguguaacugauaaaguuuccaucuggcuccguagcugucucuuuccucgacuguuuccuuugcugugcaaacuuucgaauuucaugacaucccaucugccaguuauuuccugagcuaacucguccuuuucagcaacauccauaucuugaaaugucccccuaaugguuucaggucuuacacugaggucuuugauuucuguacaggaauguccagugugccuagcaccauuuguugaggaggauauguuuucuccaauguggcauuaaguggccauagccauguggcauuauauccaggcccucuauucuguuccacugagccacaucuggagcuagcggcaagcuacuuuuguuuuguuacugugucucuacaguauaacgucagacguguaguauggguacacagugcaaguguagcuucacuggaggcacuaggacaccuccagcauuccucuucucacucaggguugcuugggcuguucugggucuucugugauucuuuguuuuaggcuuauuuuucauauuuauacagugaggaauguuacuggaguuuugauggggauuguacugagacuguagauugcuuuugaugggugucauuuggguuguuucaauucugcugacccacgaacacagaagaucuuuccaucuucuacugucuuccucaauuauuuuucagaguucuaaaguucucacugggaaaguguuuacuuccugguuagggucacuccucuacguuuuagcucuuaccuauuucugaggcuguugugaacagggcugcucucccgaguccucucucacagugccuggcugcuggcacacaggaaagggacggauuucuaugcugauuuuguauucggcugcuuugcucgguguuuaucaguucuaagagcuguuuucagucagucuaacaaguucacauuucuacaaggaucugucuguuaaagaagugugucaccuacucagucuccugucucagaacgcacacaggcagagagaccgaucaagggucucuggcagggaacacagcaccagaguuuauagcuuccaagggaguacaaauauuauuugccucccacuuuuucuucccaaacuguaacugucacaguuuuucuucagaaugaaggcaacaugaugcguucacguacucucagcacucaaaguagccguugacuccuccagagccccugcacugaagcgaggagaacauacacagaugcgcacuuccaugugucaucacaguguguucuagcauggaaccuggacauccuuuaccacacagaaaacggucuaauguauguaacuuuggcucuaacugcuaacuuccuccugagggaauuccagccucuaaugggucucagaguaguauuaaagauuaugugcuauaaguaguugugaaaagaaaacaaucccaauuagaagcccccaacaaacuuaauaaagcugccugucacucaaagcuguacugggcacaacaaagaccuccgccuuggcagccacaggaagucagaauccuccuggcugaguggcugggagacuuccucuuccagacgcguuucaggaagacagggcuuuagaaaucuuuacuuagauauccagugcuguguaaggccuaaccuccuuccuuccuuguuuggcuguguguuugcuuuucugagacagggucuuacucugugguccacacuagacuagacaugagcuuccagcacucucccugccucagccucucgggugcugacaucacaugcauacccaccgcccccggcucaguaacuuuagaauuuguuuuacuucuccacucgcugcucuggcaggcgugggcaugaggagugugugccauggugugccuguggagguuagaugacagcucuuuuagcuuggcucccgggaaucaccgggccuggacaacaaguuguuuuauccaacgagccuucuaucucacggguccugguuuacucauccguauacaguuuaagauucuaucauuuacuuauguguguguguacuucugugaggaucugugcacaugaauacaggcacucacagaggccagaagacagugauggucccugaagaagagagugaugaucccugaagaagagagugauggucccugacgcuggaggugcagggagcuaagagccacccuacauggauguugggaaccaaacucagguuccauaaaagagcaacuagaacucucucucucucuuucucuuuuucuuuuucuuuuucuuuuucuuuuuugggcagagcagggggugguucaagacaggguuucucuauguagcccuggcuguccuggaauuaguucuauacaccaggcuguccuccaacucacagagaccaccugccucugccuccugaguguugggauuaaaggcgugcgccaccacaacaggcuguggaacaagcaagcacucuuaaucacugagcuaucucccagcucucugcuuuaguaauuacuaacuacuauuuuauuuccuccaaggaaggcauuagaaagcugccccucugcagucaggaccacacccaaaagcccggggaggaauuaaccccuggugcgcugugcugguuucuuacuuuuucuuuccccaccaagaccacagguagaggggaugucccaugaugcucuuccucucucuucccaugaugcuaagcaggaucaugagcagaugggaaaggcacuccccaaauuccaacggagcagaguaaagcaacuggauguauaagcaccgaggcaagauggcagaaacaaugcuaaaaacugcuauccaauuacuuccuuuucuccaauauuuuuagagucauuuuuguuuggagguucgaaaguaugacuaaaagccgcagugucauuucaguaaagcacagagcguuccugagaaguacagacagaaugccaguccucgacuggacaggaacagcgagauggccuugaggaacacacacuuaguugcuguggcccuuuguuuccuaacagguaaaaugaaacacauuaggugcucuuaguuccacucuaaauaagcauaaagacuggaggugaagucagucgacugccagccuagaagggcuggguuuuacccuuacuauacaaauuugauuauauccaaaucaagucucugaccuguuaagaaaaauagucgucuccaucaaagaauagaauuaguaucaccuucagagucacuuacauuagaaagcaguagccuacacaagaaaaaaauucacucuuuaucaaugaaacgaagaacaauacucuugggcuggaaagacagcuugcuggguagacugcuugcugugcaagcaugagcacccaaggucagauucucagcacucacauaaaaaaguggggcucggcagcaugcaccugcagccccagucaggauuggagagggaagagacaggcagacagaucccagagcccacugaucagcuaaucuauccaacuagugaggacuagguucagggagacaccaugucucaagaaauacagugaagaacaauagagaaagacauccuuuggccucucugaacaugcaugcacagggauauguaucauacauaucacacacauaaacacacacauacacacaucuuaccuguaccuguaaaaaucacuucuacacacauauuuuaauaccugggacauuuuauuaauaauaacgcauuuuuacuuauuguuuauaaugcuauauaaacaguauacaggcaggggaaaaccacaguuguguaacucaagaccaacauguucuaguaaucuuucuucauagauauuaaaacuuagcaauucuuugcuauucuauacauuugaagguacuccugaugcccacuguaauacuucuuacauaagacauauccaaacuccauuaugauucagcauggcagugguggucuuccugugagugguguagaggugacacugaccugauaauugguggcugcacuuugguccucagguacgaagucuuagagguuuccuucaguuaaacuuuuagaaagcugacagauauuuaaacuguugucggcauggugggaaaguguccaacacugcaacacaagagaaauucauuguccauguguccauacuaugaggaacguggcaagucccacuggugucaccuagggccacagcugcuaaagccugauaacuguaggcugcuauugacaaggggaaaccaccuaguccucgggcugaagcugaaucuauacaugaaguacagggcucugacuucccuucugcaagggguaauuagugagcgugagagcuacugaaaauuuuuuuucauuuucuuuuaagacagagacuagaaugaccuuaaacucaaauggugauccuccugccuuagugucugauauacagaaaucucuuaagauguccaaugccauuucaacuugucaagggcacuaggcacaaacuuucccucaauugccaaaagccugucugcaggagacaugacucacacacaaugccacaacgccacaaugcaccucugagcaucaucagaacgaaagcguucuaccugccaaaucuggguaaggaaacgucugcucuuacuccccaguaacugcaaggaaacaaaucaacaugcgcucauuuccacuauuuagaagauggccaaacacugccaacuucuauuuuucccaucacgucuacacauuaaguguuggcuuauaaacaaauguuuuugcuuauauuuuuccaauaguauuaagcuacuauaaaaaagaaaagaaagacagacacacauacaacccacaacaugaaagaugugaaacugacgagagaaaaaaaggaggcauggggaaagaaguagguagaggaaagggagagaggagggccugggguguggaggauggguggugugugugugggucaugcucagaacacaugugugagaacugggaaggaugaaauaacaaaaacaaaaggaaaaagcaaguagggggcuuuaacuuuauuucaauucauuuaucaagucaacaguuaaacucugaaucucccaauuuaggggaggaaguguggguccaucacagagucaagaguaaacgaccaacagcaugcaggccaaccacgaaauaagcagguccggcaauucugccagcgcucgggcagaauuauacagcucaagguuuucaggaaaaggcugcucuuaacccacacucauuaucagagccaucacugccagguuucaggcacgccaccacacacagcaggcugucgacuccuguuuucugagugagcuguuacuacugacagcauccauuaagugacuuugaaagacgggaucauuccaaccagaugcccagcuugcuccucccaguagagcccuccaagacccugcuuggcccacaguuuacacccagacacuucuguguaaggaaugcuacagucuauaaaucugaaagaaaaaccacuuguggacaagcugucuggguauguucucacugccggcuggcagugcuuuaaacuuuagagguuucuuucuuucccccuuuuuguguagcccuggcacucacucagaagaccaggcuggcauagaacucacagagaucuaccugccucugccucccaagugcugggauuaaaggugugcccuacuucugccuguucaguuuucuuuaaaaaaaaaaaaaaguacacacacacacacacacacacacacacacaaaaugucacauguacugcaaugcccugaaaaacuaaggccacauaaaggguaaguauaagaggagacuuucccauacgguaugcaacuccagccaaauucgugcuaagcaugccauuuagucagucccagccuccucaccccauuucuccaccugacagcgggagacugagaguccuucuucacuaaacacacaucucccgcuuccaccuccuucucccucuguccugucugucuuuugaggcaguuuuacuauguagucucugcuggccugguauaguccugaacucagagaaaucccccugccucugccuuaugagugcaugaaguccucuuucuucuuuuugagacagaguuuugcuacguagcccagguuggcuuuuaauuuaucucuuugcuucagucccucaaguacugauccuuauagguguaaucuaccaugcuuggccuacccaugacaacaaucagaaguucuggguaucaagccgggaugcacacgcaggccacaccccucgccuuaugcacacacccacacagcgccuccuuaacuacuuugaugauuuugccugggaaauguguugcugugcccugcuccgucucugacuaacaccccagcucugcuccuucuggcccgcacuacacugugcagcuugcuucuccacaaagcccgugcucuggagcugaagugauccuguagggcaacaggcauagcuguguuuucaccacagagacaagguggcaagaaaagaaaacaccccaaacugcuucuccagccauguaagcaauagggcagggcagggcagggcagggcagggcagggcagggcagggcagggcggagcgcagguaguguuugggucuaguaucugggugugaguaucugggugcaagugaagguuuacuaaguagucaguaauaaggaacauguaggaaaaaaaaaaaaucaacauuuuagaugagucuuaguuccugacaggguagccucaaaaacaaaaacaaaaaucccacuuaaaaagucaagucaauuaaaaaaaauucagucauuuuacuaugagaucauuuuauuacacacucagauauugaacuuaaguaacucauacuuggccuaaaacugccucacaggccacugagugaggucuuagaaucaguaauuagauaugaccagaaagagaaacugaaguugcuccaaucauguagccugacauaaaucuguauaagaccaauaugggucauaacuuaaaacucagagauaaugcacaaaauagguauuuugacaucuguucacagaacagugcauuauccuaaaaacccagucuauaccugggcaugguagugcacaccgacuaucccagcucugggagguaugaggcaggaggauaaaaagcucaaagccagccuggacauaaauaccugguggauucaaggccugccuggguuauaugagaccuuuacuaaaaacagaaacaaagcccagagccagaccaagccaaaccaaagaaagccaguaugugugagauaaauagggaccacugugcuuaaagccaccaaggcuaaauaaauauggagacacgugcacuguuucuagugaauccaggggccccuucuuagguggaaaguacuagacuaucagaagauuaaacacucuccacccuggcaccccugggcucagaagggcuacuugccugucugugcuaagacagugucagcguuccacaugguccuaccacucuugguuuuguuuuguuauuuuguuuuuuguuuggaucaggccagggaagaaaaccaugcuaacaugcugucacaaaaugauuuucugauuuuaaaaaguaguuuuuagccaagugugcuggugcacaccugcgacccagcuuuugggagacuaaggcuaggggaguugagaggccagcuucacagcacgguaguacucagggggaaucgcuucuuacuacuaguuccuuaaaaaauccuaaugucaagguacaaaacacaauuucauuugauggaauuuuaaaauauuaaguaauauaaacguaauuagcgauacuuuaaaccaagcuuuucucagcugacgauacuacaagacuauugacauuucuauaauguaugucaaugggcuguaugaccccuuaccccgagcucauguggaaucuuaauuccuagaauuucagaaugugacugacucugaagacagacacacagcccccugccucgccuucuuuuuuggcaguacuggugauugaacccagggccuugaacuuguuaggcaagugcucuaccccugagcuaacucccagcaccagagacuuuucagaggcaauuaaguuaaaaugaggucauugcacacugugcauacagugagagauguuggaggacuuacucaugaaugagauaucuaucaaacuucuccccucaaggcucagggaucuacgugagagaggaggugggaaggcuggaggugguaaggaaacagggucaucuggauccagcagcccugauaagaacugucagacaugagagcacccucaaaaccugcacggguucaaacaaggcaagaguccaucauggagaaagggagcaagcacaggagugagaggucacacuccuccgcaaggacucauccuaaccuucccagcuauuagcaacggacacgggugggacaagggaaaccgggcuccuguaaccaagugucccuggcuacaugacaggguaggcccagugccuagaagucaccaaugcaaaauggacuccaugguguuuuuguuauuuuucuuauugaguuuauuuuuguucugcuuuucaagguuuugauucuuaucuuccugagagacaagagaaugaaccagaagguggaugguggugguggugggggcgcgggaaagggaaacaguaugaucaaaauacauguaugaaaaaucuuaauaaaaaaauuggucacuacaauccuuaauccaauaagacugguauccuauaagagaaaauuagaauacagaccagucagggaaagugcaaggcgagaauccacucugaucagaacagugcucuaagcuuuuagccaaugauaacaauauuugaaaaaauacauucuuuuuauucaaaccacccagacugugguggcaaaauaaaacaauauacuagcuacuuacuuuucuuuucuuuguuuguuuccuaugucugcuuggccuggaccuuacuguguaaaguaggcugacuucaaacucgcaaccuuccuguucagcucccaagugcuacuguguccccagacccugcguucuauucuuuuggggaggggguguuauuuauauauuuuauguauacagacgcugcugugucugcauuaugucggcacaccagaagagggcaccagauugugggcugccauguggggcucuuaaaugcugagccaucucuccaguuccacuuucuacucuuaaagugcaucugaacaacuaggucugagcuuuccccuccaugugaggacugacuguaacgcccccuuccucacacagcuugcccuacuaugugaggacugacuguaacacacucuuccucacacagcuugcccuacuaugugaggacugacuguaacacacucuuccucacacagcuugcccuaccauccaugugaggacugacuguaacacacacagcuugcccuuuucuccuagccaugcaauaaacagcauuacaauaaaaacaaugcuuuggaaauacaucuuagagauugugcauuucaggacucggaauuauccugaaaggcgaucugaauaaugcaguuagggagacaugcugagcgaucaaggcauuuauuuaccuagcacugagggugccucuagggaucagcuuugcaguuaugcuaaaacuguucagggucagcacugaaacacuggagcacucaaugcagggcagacgcaaggaccccagacccucaaggcuuaugcuuaggauaaaaaugccuacuguggacacggaaaacauuaaccaguagcacaccagcauucuacagcauaacuuucuaagaauucaaacaaguaaugaaaagagauaaacauuuauugagcuaaacaugacagacauuucuaagugcgcuugacauacauuaucacaaucuagggugagagaucaauaccauccagguuaaaaacggcaaagcugaggcacaguggcugaacagcuugcuuaaagucguguagcuagaaucuggaagaaaccaaauuugaacccaguaaauuugacuccagaggcuuccuuggaaaccgcugcucgugggccuuacuuuaccagccuuaggcgauggaauagccucagagauaaucuacuuuggccucuuuuacagaugaggguuauuagagagcaguuagcgagauccaggucuagcacugaccacugaaaauuuggauuccuucuuuccacccaccuaccuauuuguguguguguggaugugugugcacgugugugugugugugugugcacguguacacacgugccauggcuuuuguauagcuucagaagacaacuggcuaacaagagacaagagcuggcucucuuaucaagugugcccaggacugagcacaggucaccaggcuuggcauaugucccuaacugccaagccauuccgcuggcuccaccucugauuuauuucuaaagucuaggcuaacuugcucuuugggagaccacagcaagcucugguuuggcuugguccuuagggucuucugugcaugaauuuguucaucugucucucucauucucucucuuauaugcggccagcaagcuuuacauguauacugaagaacaagggaagcagccucaugcccauaaacaagcaaauaucucacccucuguauaaggguaccaggacaaugcuacugaaaaucaacucuguuacccaggcacggugaugcacaucucuaaucccugcacucaggaggcugaggcaagaggauucccacgagaucaaggcaagccaggacuacgcaauaagacccagcuucaaaaacaaaccaaaaagagaaccauaucugacuaccugaguaucugaccacacccucucacuacucuuacugacaugagaccacaccagaagaacuauacagugugaaugaaaauuaagcaauaguuuuuuaaaaaacauuuuucauugaaauuuuaagaaaugauauauaucuuuaaacaacagauaaucagaaaguuugagcuaauuuaguacuugcuaauuaguuuaaaugaaauuagauuucagccuaucacauucgucugucucucaauuuuacccaucgaguccuagaaaauucugcuuuucugaaacaaaaccggagcaagggaacaaagguuguguagguugguuuuaucuucagaaaaacacuucacgggucaccauucuugaggccgccugaauggaaaaacccuucaacugcuacacuggaugaagucacuggcuccacggggacugcagagacgaaaucccaggcugcagcauuaaccacaacagucaagauaaucugggucuucacuaugcucacggccuuuuuccugagcugcaaaaaccuucacacgagccucugaggcagugggucuccgccuuccuccuacuguggcccuuuaauacaacucuucacgaugugguggcccccagccacagaauuauuucguugcuaccucauaacuguaauuuugguaguguuaugaauuuuaauuuaaguaucuguguuuuuuggucuuaggcaaccccguggaaggguaguuugacccccaaaugguugagacccacagacugaccagacucacugcucugcaucucugagaagcauccacuugagcccaccuccaaggacaggacguuauuuguuguuuauuuucuuuucaauggagcauaauggucuuucauucacaugucuaauuuacaagucaaaaauaaauguauuccuuacagaccccaacccaguagguugaccugaucugagggggagauggcauugccaguucccccaaaagucacuuuagagguauguucaacacacgucuaagccagugauagcuaugcacuccuuagggacagaaaaggacacucuucugcccgggucagcccucugugccuucugcaacaaaaaugaaagguagucucugcuucuagugaaaaaaguuuuacagcuuuucaucaaguuacaacuuuuaucuuguaauaggguugcuaaaaauaucacagcugaugcugacauuagacaugcaacagaagugaacgcagcucgggaacccaggagccgcuaccccauucuaaucuaucaguuuguccauuuacacaucugcuuaguguuucacaagauucggaacucuguggacagcuauucugucugguagaaagaggaggaggaagugggagagauuuacuuacaguaacuuggagacugacuccauuuaggggguuaaauaggggaaauaauccaaacucagcagagguuuggagacucugugacgaacgacaauguggucaacagaaacagggaugucagaacaggaacuggcuuuaguggggaaaugaugacuuggagaugagacaggcugaggaagaacuaaguacccucuaagaggaaccuaagggagggaggcagcugguacgcugcggugcaggggcuuaggacauggaaucuuuaaaaacauuauuuuggugucuucaaucuaaagacaugggguaaggcugaugauauacaggaccagaucuguacccucaaauacuaagccaguuaaaaacacagacuauagccuggccugguagcacagacucaugaucccuaccugggagucugaggcaggaggaugucaauuucaaggcuugucuggacuacagaaugaguccaagcuugggcaauuauuuaguaagacccagucucaauuuaaaaaaaaaaaaggaagaaaaaaagcauaccgucccccaacacucuccucccacuuucccgucguuuuucuuauauccuccuuuccuuaguaucugcaaucccuaucacuuuucccccccuuuucuggugugugugagcaaacgugcgugcauguggaggccacaggucagcagcagguaucuccuaaaucgcucuucaccucauuuucugcgacagucugucacugacucuggaacuuccuggcuggcacgggcuagccggucacaugccccagggauccucuggcugcccaauguugaacccacaggccugcagcugcacuggcuguuugugagggugcugcagagcaaaacucuggucuucacacuuaugcaaccaagcccggacuaacugagccaacuccccagccccuugugccuuguuaaagcaauauauccuugcuucucuuucuaccccuuucccccgucuccuggacuccacacaaggucccacacauuucagugcucacuaggcucagaggcaggaguuuuugugcuaauuuuccuuucuaguuuacuaacaauuauggguuauaaucuuuguugcugaaacagaauucuuuuaacagcaaagacacauugagauggaaugugucaaugcacuugauacacugaguuuggauagacuuugcauucuuuacuucaaagcuaccgugaaguccugucuucagcccccaaacccuugccauccuccaccuccauucucaauuucccaccccuauuucuuucccauccauuuuugauuggccgucaacuuauuccuuuuagaucaacaaggaagguaguuuucaaaugcuuuaaaugaaaauuaucauugaaaauuucuuaaaucuuauaagcauaccacacacaaacccauucagaaaaguugcagaguggcaggcaucuggaacaacuggugguaaccugucucuugccuuuguuuuacacacacacacacacacacacacacacacacacacacacacgaucugaaugcacagcuauaugcucucaaaaaaaaaaucauuggcucagauguguuacauuaugaccuguacaacucuguuuuccucaacccagggaccucagcuauuuagaucuuauuuuauuaaguguaugaguguuuugucuacagcguccauaagugcugguagacaucagaagaagauguuggauccucuggaacuggagugaaggaugguucugaguuuccgugugugugcugggauugaagcuggguccucuguaagagcacuaagugcucuuaaccacugagugucucucuagcccaaaccguagcuauuuacagacaaauuuaaaacaaaaccaaccaacaaacacuacuucacuuuugcuaaaguagaccuuuuaguaucuuuucucuucuuccucucuuucacuuggacuaguagguagucucaaaggagagccucuugccuccccuccagagagcagaaagggguguguacauuaauuuccauaacucacgcgccaagugcuaauaacaacaauguucauaauaguaucucucaaugaccauuuccuaagaggcaccuugcuuaguagaccuauacaaacaugcuggcaguagguucacacaaucuuuaaaaccagaaaacucuucuguuucuagcucacaacugaagggcucugaacuagaaacagccucucuucaccucaugccacucaacaucaguccaauggcagucucugagaaacaccacagaaaagcugagaauucaaacucuuguaagaaaaccaaccgggagccccaucagugugauucugauuuggcacagaccuguaacaaaucagggauauggcacucaccaagagaaucugaaugacuacuguuaaggacccaugaaguccuguguacuguuaauacaacugggaguaaauaaaagcacaaaaauugggauugucgguauggcucagguggaagguuugaaguucaagccccauccagcacaggauuaagagaaaagcacgaaacaacccccccccccccaaacccuuaaaggagagcagcugucuuaguuugguuucuaucgcuauacuaaaacaccacucagcuauuaaaaagaaugaauuuaugaaauuccuaggcaaauggauggaccuggagggcaucauccugagugagguaacacauucacaaaggaacucacacaauauguacucacugauaaguggauacuagcccagaaacuuaggauacccaagauauaagauacaauuugcuaaaugcaugaaacugaagaagaacgaagaccaaaguguggacacuuugccccuucuuagaauugaaaacaccacaaucaaaagcaaccugggaaggaaaggguuuacuuccucuuacaacucucagcucacacucuaucacugauggaauucgaggcggcaggaacuuaacguggaaaucuggacugagaaaaugaggcagaagccaucgaggauuaggaacacaauuuacccacuugcucagccaguuuauaacacucaggccccaagccuagggagagcaccgcccagggugggcugggcacucucaacaacaaucaucaaucaagaacaugcccuacaggcuugcccacaggccaauccggugagggcauuuuucucaacugaguuucccucuuuccagauaacucuagcuugugugaaguugacauaaacuagccagcacacuagggucaaaccaaauacccagaaacuaaaauaaaaauuaaccaauaguuccuaacauguucuucagaacucacuccauccccauuaggucagauucuuguacauauauaucuuuaaaaugacuacaauugaucauguuuauaaguauggcucagaauucaugacaguaaaaaagaaauuauauacagcaccuaaccagagguauuuucucauaggaaagucaauauuuuagccacuucagauauugcaauuuccuauuaugucagauauggaaaaaucaaauuacacaaagacaagaaggcagaugguuuaaacuaacaagaugugccauacuuuauuagauguuaucugucuuaguuugacucuuaggugagaacuuuagacuaaauucaguguucguauugggcacuguggaagcuacaaagacuucaugcagucuaagaauaauuuaacgaaaugcacuaaacacgcacauacacgcacacgcacacgcacacgcgcacacacacacacacugucugcacacaaugcuuuucuucaucuaacaugaccaaaaaugacacugaaaugguuagaggaacgaauucucccagaguugaacaucggaguacacgcuguaaucccaacaggaacgggaaagccacccugggcuacauaaucuucagaaacauagcgagacacagugcuccacucuugauuaaauaaaacaaacccuccagauccaaagguauaucaaacaggucuuguuuauugugccaaaacaucaaugagauuacucugcuucuccuguuuguccaggcccuggaaaucacugcucccugggucuccugacgucuccuaccuuaguuuauuucccuucucuacucagguaaugagacacaucuuuuagggcuuuccuguuuuacuucuaggguuuuuuuuuuuuuaaaccccugcugcuauuucugggauaauguaucucucccuccuauggcaauaaacuuuguguuugugggagagacccugcauacaguuucuucuuugugcuuccucucacuacauaucuggaaacaaucauggaacagaucugcagcccccuagaguggcucugaaaccuaggaaccugacuacucaaaacuaauuaccuucaggaagucuacucaggaaggcugcagacaacagccacuacaaucacccucucugauugcaacuccgcaccucgccucuaucagcuauaaauaaccaacaggaaaaugaacuugagauaaaaacuuaaaaugcuaaaaauauggaaaaauuaauaggugguacugcuggccacagaugaugacuggagauucaaugacauuaaugucaggacaaaaucauuuguacuuugcaacugcuaaaaugccaaagacuuuaguagaucuuuacagggacucuacagagacgugaaaauugaauucccaaggcuuuuaucugcccuucucucugaaacugaaaaguaccuuuuauuuuaaugcuuuaaauuuugguugaugaugauggugugcuagacaccaccacauuacauguauauucguuuccuuugaggguaaaaucccacuauaaaagaggggugagacaguacucagaggccacaggaccagauuaauuauaaaccuagccaacugaaccugaauuuuguucaaauacuuccugucuuuuguuucaaccugccauacaccuucaagguuaacugcaguuucccugagcaacggaccagcccacuccaaauugggagauggggacuccuucugcaaaggcauuuacugacuccucggcaccauuucauuugaaaauaugguauuauucagugacugucaaacaauacacacugcauuccuacccacacaaggccagcucugcugaaagcuaacacacccaccuugcuaugaaauaugcggaugcuucccuacuaaguucucaagagaagaaaccggguagaaagcaaaaucgaaaggcaacucaaaccuaaaaagccccuaaaagcugguuucucccaaaagaaacagaaagggcaagaaagguacaaagggcgaugggaagaagauaauguauaauuuaagccggggagcuuucaacacucagaaagagaauacaggaucuggggaggcuguaggagcaaucacaggcugggggaugggaagagcuaaaagagggggaaaggccgcuuuggcuguuggaggugucugucuggguuucgucuuuuuuucucccccucgcccaucccucauaaggaaaacgcugguuuguguguguguguuuaaaucuuauacagaacccuaguucuggacccacgcuugccagcagggacagaugugggaaaggaugucugaauucgcagggauccaauauaggggugggggcugcagccuagaaaacgguacccaccaguaccacucugaggcuagggcugggcaaaaggcgaccuagagugagacaggucaggaggagaccccugcugaggggcggaggcuagcgagagacaaugaacaaucguaaagaccccggaggaugccgcgacgccuccuuggggaaucccgggaucuggaggcggcggccccgcccccuagggggaccaucccuaccccgacagggacuucugcugaaagccacucacgcuccgggccaggaggcucucucggagacccggcucccccggcaccgcagagccccgagcccacgcuccguaccuggccucggcgcuccgggauccuuccccgccgccgccuccgccgcccgcuccccauccccagccucccaggacccgccccuuacccgccggcggcagugacaggcagauacccucgccaaucauagcuuuacccuugcggcucugaaaccaauccucgccgccugaaggcggggcuucuccaaagucaucccggcuccuccuggggccgcaagaucccuuuuguuugggagagccaggcugggauug

SEQ ID NO: 1643 - RNA, 51586 nt, Mus musculus
caaucccagccuggcucucccaaacaaaagggaucuugcggccccaggaggagccgggaugacuuuggagaagccccgccuucaggcggcgaggauugguuucagagccgcaaggguaaagcuaugauuggcgaggguaucugccugucacugccgccggcggguaaggggcggguccugggaggcuggggauggggagcgggcggcggaggcggcggcggggaaggaucccggagcgccgaggccagguacggagcgugggcucggggcucugcggugccgggggagccgggucuccgagagagccuccuggcccggagcgugaguggcuuucagcagaagucccugucgggguagggauggucccccuagggggcggggccgccgccuccagaucccgggauuccccaaggaggcgucgcggcauccuccggggucuuuacgauuguucauugucucucgcuagccuccgccccucagcaggggucuccuccugaccugucucacucuaggucgccuuuugcccagcccuagccucagagugguacugguggguaccguuuucuaggcugcagcccccaccccuauauuggaucccugcgaauucagacauccuuucccacaucugucccugcuggcaagcguggguccagaacuaggguucuguauaagauuuaaacacacacacacaaaccagcguuuuccuuaugagggaugggcgagggggagaaaaaaagacgaaacccagacagacaccuccaacagccaaagcggccuuucccccucuuuuagcucuucccaucccccagccugugauugcuccuacagccuccccagauccuguauucucuuucugaguguugaaagcuccccggcuuaaauuauacauuaucuucuucccaucgcccuuuguaccuuucuugcccuuucuguuucuuuugggagaaaccagcuuuuaggggcuuuuuagguuugaguugccuuucgauuuugcuuucuacccgguuucuucucuugagaacuuaguagggaagcauccgcauauuucauagcaagguggguguguuagcuuucagcagagcuggccuuguguggguaggaaugcaguguguauuguuugacagucacugaauaauaccauauuuucaaaugaaauggugccgaggagucaguaaaugccuuugcagaaggaguccccaucucccaauuuggagugggcugguccguugcucagggaaacugcaguuaaccuugaagguguauggcagguugaaacaaaagacaggaaguauuugaacaaaauucagguucaguuggcuagguuuauaauuaaucugguccuguggccucugaguacugucucaccccucuuuuauagugggauuuuacccucaaaggaaacgaauauacauguaaugugguggugucuagcacaccaucaucaucaaccaaaauuuaaagcauuaaaauaaaagguacuuuucaguuucagagagaagggcagauaaaagccuugggaauucaauuuucacgucucuguagagucccuguaaagaucuacuaaagucuuuggcauuuuagcaguugcaaaguacaaaugauuuuguccugacauuaaugucauugaaucuccagucaucaucuguggccagcaguaccaccuauuaauuuuuccauauuuuuagcauuuuaaguuuuuaucucaaguucauuuuccuguugguuauuuauagcugauagaggcgaggugcggaguugcaaucagagagggugauuguaguggcuguugucugcagccuuccugaguagacuuccugaagguaauuaguuuugaguagucagguuccuagguuucagagccacucuagggggcugcagaucuguuccaugauuguuuccagauauguagugagaggaagcacaaagaagaaacuguaugcagggucucucccacaaacacaaaguuuauugccauaggagggagagauacauuaucccagaaauagcagcagggguuuaaaaaaaaaaaaacccuagaaguaaaacaggaaagcccuaaaagaugugucucauuaccugaguagagaagggaaauaaacuaagguaggagacgucaggagacccagggagcagugauuuccagggccuggacaaacaggagaagcagaguaaucucauugauguuuuggcacaauaaacaagaccuguuugauauaccuuuggaucuggaggguuuguuuuauuuaaucaagaguggagcacugugucucgcuauguuucugaagauuauguagcccaggguggcuuucccguuccuguugggauuacagcguguacuccgauguucaacucugggagaauucguuccucuaaccauuucagugucauuuuuggucauguuagaugaagaaaagcauugugugcagacagugugugugugugugcgcgugugcgugugcgugugcguguaugugcguguuuagugcauuucguuaaauuauucuuagacugcaugaagucuuuguagcuuccacagugcccaauacgaacacugaauuuagucuaaaguucucaccuaagagucaaacuaagacagauaacaucuaauaaaguauggcacaucuuguuaguuuaaaccaucugccuucuugucuuuguguaauuugauuuuuccauaucugacauaauaggaaauugcaauaucugaaguggcuaaaauauugacuuuccuaugagaaaauaccucugguuaggugcuguauauaauuucuuuuuuacugucaugaauucugagccauacuuauaaacaugaucaauuguagucauuuuaaagauauauauguacaagaaucugaccuaauggggauggagugaguucugaagaacauguuaggaacuauugguuaauuuuuauuuuaguuucuggguauuugguuugacccuagugugcuggcuaguuuaugucaacuucacacaagcuagaguuaucuggaaagagggaaacucaguugagaaaaaugcccucaccggauuggccugugggcaagccuguagggcauguucuugauugaugauuguuguugagagugcccagcccacccugggcggugcucucccuaggcuuggggccugaguguuauaaacuggcugagcaaguggguaaauuguguuccuaauccucgauggcuucugccucauuuucucaguccagauuuccacguuaaguuccugccgccucgaauuccaucagugauagagugugagcugagaguuguaagaggaaguaaacccuuuccuucccagguugcuuuugauugugguguuuucaauucuaagaaggggcaaaguguccacacuuuggucuucguucuucuucaguuucaugcauuuagcaaauuguaucuuauaucuuggguauccuaaguuucugggcuaguauccacuuaucagugaguacauauugugugaguuccuuugugaauguguuaccucacucaggaugaugcccuccagguccauccauuugccuaggaauuucauaaauucauucuuuuuaauagcugagugguguuuuaguauagcgauagaaaccaaacuaagacagcugcucuccuuuaaggguuuggggggggggggguuguuucgugcuuuucucuuaauccugugcuggauggggcuugaacuucaaaccuuccaccugagccauaccgacaaucccaauuuuugugcuuuuauuuacucccaguuguauuaacaguacacaggacuucauggguccuuaacaguagucauucagauucucuuggugagugccauaucccugauuuguuacaggucugugccaaaucagaaucacacugauggggcucccgguugguuuucuuacaagaguuugaauucucagcuuuucugugguguuucucagagacugccauuggacugauguugaguggcaugaggugaagagaggcuguuucuaguucagagcccuucaguugugagcuagaaacagaagaguuuucugguuuuaaagauugugugaaccuacugccagcauguuuguauaggucuacuaagcaaggugccucuuaggaaauggucauugagagauacuauuaugaacauuguuguuauuagcacuuggcgcgugaguuauggaaauuaauguacacaccccuuucugcucucuggaggggaggcaagaggcucuccuuugagacuaccuacuaguccaagugaaagagaggaagaagagaaaagauacuaaaaggucuacuuuagcaaaagugaaguaguguuuguugguugguuuuguuuuaaauuugucuguaaauagcuacgguuugggcuagagagacacucagugguuaagagcacuuagugcucuuacagaggacccagcuucaaucccagcacacacacggaaacucagaaccauccuucacuccaguuccagaggauccaacaucuucuucugaugucuaccagcacuuauggacgcuguagacaaaacacucauacacuuaauaaaauaagaucuaaauagcugaggucccuggguugaggaaaacagaguuguacaggucauaauguaacacaucugagccaaugauuuuuuuuuugagagcauauagcugugcauucagaucguguguguguguguguguguguguguguguguguguguguguaaaacaaaggcaagagacagguuaccaccaguuguuccagaugccugccacucugcaacuuuucugaauggguuugugugugguaugcuuauaagauuuaagaaauuuucaaugauaauuuucauuuaaagcauuugaaaacuaccuuccuuguugaucuaaaaggaauaaguugacggccaaucaaaaauggaugggaaagaaauaggggugggaaauugagaauggagguggaggauggcaaggguuugggggcugaagacaggacuucacgguagcuuugaaguaaagaaugcaaagucuauccaaacucaguguaucaagugcauugacacauuccaucucaaugugucuuugcuguuaaaagaauucuguuucagcaacaaagauuauaacccauaauuguuaguaaacuagaaaggaaaauuagcacaaaaacuccugccucugagccuagugagcacugaaaugugugggaccuuguguggaguccaggagacgggggaaagggguagaaagagaagcaaggauauauugcuuuaacaaggcacaaggggcuggggaguuggcucaguuaguccgggcuugguugcauaagugugaagaccagaguuuugcucugcagcacccucacaaacagccagugcagcugcaggccuguggguucaacauugggcagccagaggaucccuggggcaugugaccggcuagcccgugccagccaggaaguuccagagucagugacagacugucgcagaaaaugaggugaagagcgauuuaggagauaccugcugcugaccuguggccuccacaugcacgcacguuugcucacacacaccagaaaagggggggaaaagugauagggauugcagauacuaaggaaaggaggauauaagaaaaacgacgggaaagugggaggagaguguugggggacgguaugcuuuuuuucuuccuuuuuuuuuuuuaaauugagacugggucuuacuaaauaauugcccaagcuuggacucauucuguaguccagacaagccuugaaauugacauccuccugccucagacucccagguagggaucaugagucugugcuaccaggccaggcuauagucuguguuuuuaacuggcuuaguauuugaggguacagaucugguccuguauaucaucagccuuaccccaugucuuuagauugaagacaccaaaauaauguuuuuaaagauuccauguccuaagccccugcaccgcagcguaccagcugccucccucccuuagguuccucuuagaggguacuuaguucuuccucagccugucucaucuccaagucaucauuuccccacuaaagccaguuccuguucugacaucccuguuucuguugaccacauugucguucgucacagagucuccaaaccucugcugaguuuggauuauuuccccuauuuaacccccuaaauggagucagucuccaaguuacuguaaguaaaucucucccacuuccuccuccucuuucuaccagacagaauagcuguccacagaguuccgaaucuugugaaacacuaagcagauguguaaauggacaaacugauagauuagaaugggguagcggcuccuggguucccgagcugcguucacuucuguugcaugucuaaugucagcaucagcugugauauuuuuagcaacccuauuacaagauaaaaguuguaacuugaugaaaagcuguaaaacuuuuuucacuagaagcagagacuaccuuucauuuuuguugcagaaggcacagagggcugacccgggcagaagaguguccuuuucugucccuaaggagugcauagcuaucacuggcuuagacguguguugaacauaccucuaaagugacuuuugggggaacuggcaaugccaucucccccucagaucaggucaaccuacuggguuggggucuguaaggaauacauuuauuuuugacuuguaaauuagacaugugaaugaaagaccauuaugcuccauugaaaagaaaauaaacaacaaauaacguccuguccuuggaggugggcucaaguggaugcuucucagagaugcagagcagugagucuggucagucugugggucucaaccauuugggggucaaacuacccuuccacgggguugccuaagaccaaaaaacacagauacuuaaauuaaaauucauaacacuaccaaaauuacaguuaugagguagcaacgaaauaauucuguggcugggggccaccacaucgugaagaguuguauuaaagggccacaguaggaggaaggcggagacccacugccucagaggcucgugugaagguuuuugcagcucaggaaaaaggccgugagcauagugaagacccagauuaucuugacuguugugguuaaugcugcagccugggauuucgucucugcaguccccguggagccagugacuucauccaguguagcaguugaaggguuuuuccauucaggcggccucaagaauggugacccgugaaguguuuuucugaagauaaaaccaaccuacacaaccuuuguucccuugcuccgguuuuguuucagaaaagcagaauuuucuaggacucgauggguaaaauugagagacagacgaaugugauaggcugaaaucuaauuucauuuaaacuaauuagcaaguacuaaauuagcucaaacuuucugauuaucuguuguuuaaagauauauaucauuucuuaaaauuucaaugaaaaauguuuuuuaaaaaacuauugcuuaauuuucauucacacuguauaguucuucugguguggucucaugucaguaagaguagugagaggguguggucagauacucagguagucagauaugguucucuuuuugguuuguuuuugaagcugggucuuauugcguaguccuggcuugccuugaucucgugggaauccucuugccucagccuccugagugcagggauuagagaugugcaucaccgugccuggguaacagaguugauuuucaguagcauuguccugguacccuuauacagagggugagauauuugcuuguuuaugggcaugaggcugcuucccuuguucuucaguauacauguaaagcuugcuggccgcauauaagagagagaaugagagagacagaugaacaaauucaugcacagaagacccuaaggaccaagccaaaccagagcuugcuguggucucccaaagagcaaguuagccuagacuuuagaaauaaaucagagguggagccagcggaauggcuuggcaguuagggacauaugccaagccuggugaccugugcucaguccugggcacacuugauaagagagccagcucuugucucuuguuagccaguugucuucugaagcuauacaaaagccauggcacguguguacacgugcacacacacacacacacacgugcacacacauccacacacacacaaauagguagguggguggaaagaaggaauccaaauuuucaguggucagugcuagaccuggaucucgcuaacugcucucuaauaacccucaucuguaaaagaggccaaaguagauuaucucugaggcuauuccaucgccuaaggcugguaaaguaaggcccacgagcagcgguuuccaaggaagccucuggagucaaauuuacuggguucaaauuugguuucuuccagauucuagcuacacgacuuuaagcaagcuguucagccacugugccucagcuuugccguuuuuaaccuggaugguauugaucucucacccuagauugugauaauguaugucaagcgcacuuagaaaugucugucauguuuagcucaauaaauguuuaucucuuuucauuacuuguuugaauucuuagaaaguuaugcuguagaaugcuggugugcuacugguuaauguuuuccguguccacaguaggcauuuuuauccuaagcauaagccuugagggucugggguccuugcgucugcccugcauugagugcuccaguguuucagugcugacccugaacaguuuuagcauaacugcaaagcugaucccuagaggcacccucagugcuagguaaauaaaugccuugaucgcucagcaugucucccuaacugcauuauucagaucgccuuucaggauaauuccgaguccugaaaugcacaaucucuaagauguauuuccaaagcauuguuuuuauuguaaugcuguuuauugcauggcuaggagaaaagggcaagcuguguguguuacagucaguccucacauggaugguagggcaagcugugugaggaagaguguguuacagucaguccucacauaguagggcaagcugugugaggaagaguguguuacagucaguccucacauaguagggcaagcugugugaggaagggggcguuacagucaguccucacauggaggggaaagcucagaccuaguuguucagaugcacuuuaagaguagaaaguggaacuggagagauggcucagcauuuaagagccccacauggcagcccacaaucuggugcccucuucuggugugccgacauaaugcagacacagcagcgucuguauacauaaaauauauaaauaacacccccuccccaaaagaauagaacgcagggucuggggacacaguagcacuugggagcugaacaggaagguugcgaguuugaagucagccuacuuuacacaguaagguccaggccaagcagacauaggaaacaaacaaagaaaagaaaaguaaguagcuaguauauuguuuuauuuugccaccacagucugggugguuugaauaaaaagaauguauuuuuucaaauauuguuaucauuggcuaaaagcuuagagcacuguucugaucagaguggauucucgccuugcacuuucccugacuggucuguauucuaauuuucucuuauaggauaccagucuuauuggauuaaggauuguagugaccaauuuuuuuauuaagauuuuucauacauguauuuugaucauacuguuucccuuucccgcgcccccaccaccaccaccauccaccuucugguucauucucuugucucucaggaagauaagaaucaaaaccuugaaaagcagaacaaaaauaaacucaauaagaaaaauaacaaaaacaccauggaguccauuuugcauuggugacuucuaggcacugggccuacccugucauguagccagggacacuugguuacaggagcccgguuucccuugucccacccguguccguugcuaauagcugggaagguuaggaugaguccuugcggaggagugugaccucucacuccugugcuugcucccuuucuccaugauggacucuugccuuguuugaacccgugcagguuuugagggugcucucaugucugacaguucuuaucagggcugcuggauccagaugacccuguuuccuuaccaccuccagccuucccaccuccucucucacguagaucccugagccuugaggggagaaguuugauagauaucucauucaugaguaaguccuccaacaucucucacuguaugcacagugugcaaugaccucauuuuaacuuaauugccucugaaaagucucuggugcugggaguuagcucagggguagagcacuugccuaacaaguucaaggcccuggguucaaucaccaguacugccaaaaaagaaggcgaggcagggggcugugugucugucuucagagucagucacauucugaaauucuaggaauuaagauuccacaugagcucgggguaaggggucauacagcccauugacauacauuauagaaaugucaauagucuuguaguaucgucagcugagaaaagcuugguuuaaaguaucgcuaauuacguuuauauuacuuaauauuuuaaaauuccaucaaaugaaauuguguuuuguaccuugacauuaggauuuuuuaaggaacuaguaguaagaagcgauucccccugaguacuaccgugcugugaagcuggccucucaacuccccuagccuuagucucccaaaagcugggucgcaggugugcaccagcacacuuggcuaaaaacuacuuuuuaaaaucagaaaaucauuuugugacagcauguuagcaugguuuucuucccuggccugauccaaacaaaaaacaaaauaacaaaacaaaaccaagagugguaggaccauguggaacgcugacacugucuuagcacagacaggcaaguagcccuucugagcccaggggugccaggguggagaguguuuaaucuucugauagucuaguacuuuccaccuaagaaggggccccuggauucacuagaaacagugcacgugucuccauauuuauuuagccuugguggcuuuaagcacaguggucccuauuuaucucacacauacuggcuuucuuugguuuggcuuggucuggcucugggcuuuguuucuguuuuuaguaaaggucucauauaacccaggcaggccuugaauccaccagguauuuauguccaggcuggcuuugagcuuuuuauccuccugccucauaccucccagagcugggauagucggugugcacuaccaugcccagguauagacuggguuuuuaggauaaugcacuguucugugaacagaugucaaaauaccuauuuugugcauuaucucugaguuuuaaguuaugacccauauuggucuuauacagauuuaugucaggcuacaugauuggagcaacuucaguuucucuuucuggucauaucuaauuacugauucuaagaccucacucaguggccugugaggcaguuuuaggccaaguaugaguuacuuaaguucaauaucugaguguguaauaaaaugaucucauaguaaaaugacugaauuuuuuuuaauugacuugacuuuuuaagugggauuuuuguuuuuguuuuugaggcuacccugucaggaacuaagacucaucuaaaauguugauuuuuuuuuuuuccuacauguuccuuauuacugacuacuuaguaaaccuucacuugcacccagauacucacacccagauacuagacccaaacacuaccugcgcuccgcccugcccugcccugcccugcccugcccugcccugcccugcccugcccuauugcuuacauggcuggagaagcaguuugggguguuuucuuuucuugccaccuugucucuguggugaaaacacagcuaugccuguugcccuacaggaucacuucagcuccagagcacgggcuuuguggagaagcaagcugcacaguguagugcgggccagaaggagcagagcugggguguuagucagagacggagcagggcacagcaacacauuucccaggcaaaaucaucaaaguaguuaaggaggcgcugugugggugugugcauaaggcgagggguguggccugcgugugcaucccggcuugauacccagaacuucugauuguugucauggguaggccaagcaugguagauuacaccuauaaggaucaguacuugagggacugaagcaaagagauaaauuaaaagccaaccugggcuacguagcaaaacucugucucaaaaagaagaaagaggacuucaugcacucauaaggcagaggcagggggauuucucugaguucaggacuauaccaggccagcagagacuacauaguaaaacugccucaaaagacagacaggacagagggagaaggagguggaagcgggagauguguguuuagugaagaaggacucucagucucccgcugucagguggagaaauggggugaggaggcugggacugacuaaauggcaugcuuagcacgaauuuggcuggaguugcauaccguaugggaaagucuccucuuauacuuacccuuuauguggccuuaguuuuucagggcauugcaguacaugugacauuuuguguguguguguguguguguguguguguguacuuuuuuuuuuuuuuaaagaaaacugaacaggcagaaguagggcacaccuuuaaucccagcacuugggaggcagaggcagguagaucucugugaguucuaugccagccuggucuucugagugagugccagggcuacacaaaaagggggaaagaaagaaaccucuaaaguuuaaagcacugccagccggcagugagaacauacccagacagcuuguccacaagugguuuuucuuucagauuuauagacuguagcauuccuuacacagaagugucuggguguaaacugugggccaagcagggucuuggagggcucuacugggaggagcaagcugggcaucugguuggaaugaucccgucuuucaaagucacuuaauggaugcugucaguaguaacagcucacucagaaaacaggagucgacagccugcugugugugguggcgugccugaaaccuggcagugauggcucugauaaugaguguggguuaagagcagccuuuuccugaaaaccuugagcuguauaauucugcccgagcgcuggcagaauugccggaccugcuuauuucgugguuggccugcaugcuguuggucguuuacucuugacucugugauggacccacacuuccuccccuaaauugggagauucagaguuuaacuguugacuugauaaaugaauugaaauaaaguuaaagcccccuacuugcuuuuuccuuuuguuuuuguuauuucauccuucccaguucucacacauguguucugagcaugacccacacacacaccacccauccuccacaccccaggcccuccucucucccuuuccucuaccuacuucuuuccccaugccuccuuuuuuucucucgucaguuucacaucuuucauguuguggguuguaugugugucugucuuucuuuucuuuuuuauaguagcuuaauacuauuggaaaaauauaagcaaaaacauuuguuuauaagccaacacuuaauguguagacgugaugggaaaaauagaaguuggcaguguuuggccaucuucuaaauaguggaaaugagcgcauguugauuuguuuccuugcaguuacuggggaguaagagcagacguuuccuuacccagauuuggcagguagaacgcuuucguucugaugaugcucagaggugcauuguggcguuguggcauugugugugagucaugucuccugcagacaggcuuuuggcaauugagggaaaguuugugccuagugcccuugacaaguugaaauggcauuggacaucuuaagagauuucuguauaucagacacuaaggcaggaggaucaccauuugaguuuaaggucauucuagucucugucuuaaaagaaaaugaaaaaaaauuuucaguagcucucacgcucacuaauuaccccuugcagaagggaagucagagcccuguacuucauguauagauucagcuucagcccgaggacuaggugguuuccccuugucaauagcagccuacaguuaucaggcuuuagcagcuguggcccuaggugacaccagugggacuugccacguuccucauaguauggacacauggacaaugaauuucucuuguguugcaguguuggacacuuucccaccaugccgacaacaguuuaaauaucugucagcuuucuaaaaguuuaacugaaggaaaccucuaagacuucguaccugaggaccaaagugcagccaccaauuaucaggucagugucaccucuacaccacucacaggaagaccaccacugccaugcugaaucauaauggaguuuggauaugucuuauguaagaaguauuacagugggcaucaggaguaccuucaaauguauagaauagcaaagaauugcuaaguuuuaauaucuaugaagaaagauuacuagaacauguuggucuugaguuacacaacugugguuuuccccugccuguauacuguuuauauagcauuauaaacaauaaguaaaaaugcguuauuauuaauaaaaugucccagguauuaaaauauguguguagaagugauuuuuacagguacagguaagauguguguauguguguguuuaugugugugauauguaugauacauaucccugugcaugcauguucagagaggccaaaggaugucuuucucuauuguucuucacuguauuucuugagacauggugucucccugaaccuaguccucacuaguuggauagauuagcugaucagugggcucugggaucugucugccugucucuucccucuccaauccugacuggggcugcaggugcaugcugccgagccccacuuuuuuaugugagugcugagaaucugaccuugggugcucaugcuugcacagcaagcagucuacccagcaagcugucuuuccagcccaagaguauuguucuucguuucauugauaaagagugaauuuuuuucuuguguaggcuacugcuuucuaauguaagugacucugaaggugauacuaauucuauucuuugauggagacgacuauuuuucuuaacaggucagagacuugauuuggauauaaucaaauuuguauaguaaggguaaaacccagcccuucuaggcuggcagucgacugacuucaccuccagucuuuaugcuuauuuagaguggaacuaagagcaccuaauguguuucauuuuaccuguuaggaaacaaagggccacagcaacuaaguguguguuccucaaggccaucucgcuguuccuguccagucgaggacuggcauucugucuguacuucucaggaacgcucugugcuuuacugaaaugacacugcggcuuuuagucauacuuucgaaccuccaaacaaaaaugacucuaaaaauauuggagaaaaggaaguaauuggauagcaguuuuuagcauuguuucugccaucuugccucggugcuuauacauccaguugcuuuacucugcuccguuggaauuuggggagugccuuucccaucugcucaugauccugcuuagcaucaugggaagagagaggaagagcaucaugggacauccccucuaccuguggucuugguggggaaagaaaaaguaagaaaccagcacagcgcaccagggguuaauuccuccccgggcuuuugggugugguccugacugcagaggggcagcuuucuaaugccuuccuuggaggaaauaaaauaguaguuaguaauuacuaaagcagagagcugggagauagcucagugauuaagagugcuugcuuguuccacagccuguugugguggcgcacgccuuuaaucccaacacucaggaggcagaggcagguggucucugugaguuggaggacagccugguguauagaacuaauuccaggacagccagggcuacauagagaaacccugucuugaaccacccccugcucugcccaaaaaagaaaaagaaaaagaaaaagaaaaagagaaagagagagagagaguucuaguugcucuuuuauggaaccugaguuugguucccaacauccauguaggguggcucuuagcucccugcaccuccagcgucagggaccaucacucucuucuucagggaucaucacucucuucuucagggaccaucacugucuucuggccucugugagugccuguauucaugugcacagauccucacagaaguacacacacacauaaguaaaugauagaaucuuaaacuguauacggaugaguaaaccaggacccgugagauagaaggcucguuggauaaaacaacuuguuguccaggcccggugauucccgggagccaagcuaaaagagcugucaucuaaccuccacaggcacaccauggcacacacuccucaugcccacgccugccagagcagcgaguggagaaguaaaacaaauucuaaaguuacugagccgggggcgguggguaugcaugugaugucagcacccgagaggcugaggcagggagagugcuggaagcucaugucuagucuaguguggaccacagaguaagacccugucucagaaaagcaaacacacagccaaacaaggaaggaaggagguuaggccuuacacagcacuggauaucuaaguaaagauuucuaaagcccugucuuccugaaacgcgucuggaagaggaagucucccagccacucagccaggaggauucugacuuccuguggcugccaaggcggaggucuuuguugugcccaguacagcuuugagugacaggcagcuuuauuaaguuuguugggggcuucuaauugggauuguuuucuuuucacaacuacuuauagcacauaaucuuuaauacuacucugagacccauuagaggcuggaauucccucaggaggaaguuagcaguuagagccaaaguuacauacauuagaccguuuucugugugguaaaggauguccagguuccaugcuagaacacacugugaugacacauggaagugcgcaucuguguauguucuccucgcuucagugcaggggcucuggaggagucaacggcuacuuugagugcugagaguacgugaacgcaucauguugccuucauucugaagaaaaacugugacaguuacaguuugggaagaaaaagugggaggcaaauaauauuuguacucccuuggaagcuauaaacucuggugcuguguucccugccagagacccuugaucggucucucugccugugugcguucugagacaggagacugaguaggugacacacuucuuuaacagacagauccuuguagaaaugugaacuuguuagacugacugaaaacagcucuuagaacugauaaacaccgagcaaagcagccgaauacaaaaucagcauagaaauccgucccuuuccugugugccagcagccaggcacugugagagaggacucgggagagcagcccuguucacaacagccucagaaauagguaagagcuaaaacguagaggagugacccuaaccaggaaguaaacacuuucccagugagaacuuuagaacucugaaaaauaauugaggaagacaguagaagauggaaagaucuucuguguucgugggucagcagaauugaaacaacccaaaugacacccaucaaaagcaaucuacagucucaguacaauccccaucaaaacuccaguaacauuccucacuguauaaauaugaaaaauaagccuaaaacaaagaaucacagaagacccagaacagcccaagcaacccugagugagaagaggaaugcuggagguguccuagugccuccagugaagcuacacuugcacuguguacccauacuacacgucugacguuauacuguagagacacaguaacaaaacaaaaguagcuugccgcuagcuccagauguggcucaguggaacagaauagagggccuggauauaaugccacauggcuauggccacuuaaugccacauuggagaaaacauauccuccucaacaaauggugcuaggcacacuggacauuccuguacagaaaucaaagaccucaguguaagaccugaaaccauuagggggacauuucaagauauggauguugcugaaaaggacgaguuagcucaggaaauaacuggcagaugggaugucaugaaauucgaaaguuugcacagcaaaggaaacagucgaggaaagagacagcuacggagccagauggaaacuuuaucaguuacacaugaccguagaguguuuuacuacaaaaaccugggcggccaggauaccucagaaagucaaaaaagagagcuuccuuucaagccuggcauccugaacgggguuaguguaacccagauguugaaaugagaaccaaccccccccacacagguuguucucugaccuccauacauaugccauggcacacaggugugugcacauauacagcacacaaaaauaaacauguaaaauaaguaaaaauggcaaaaaaguaaacaaccucaucaauaaaugagcuaugaaacagacacuuuucaaaugaagacgugcagauggccaguaaacauggaaaagaaaguugacauccuuagcugacagaucaaugcacugagauuucgccucgccugucagcugguuuuuaagacaguaauugggugugaugacgguacauaccuaugguuccagaacucgaggagcagaagcaggaagauugggcaaauucaaggccugccauaacuauggagacacagaagaaagagggugggcaggggaaaggaggcaaaccugagaaagauugcggaaaagaguuauaccuucaggugggccagggcacugagaucuacucugcagguauggaagucaauauuaacauuuucucugaaaacuaaaauuaggucccugguacaccacuccuagauaaacacccagaggacucaaguucauucauaguagccaaauaaugagcugaaaucuuucuacuaacaucugagaggaugaagaaaauguguaucugcacaauggcauuuuauccauccauaaagaagaauaaauuuaucccacuuggagaauaaauggaugcaacuagagaucaucauaucaagcacugugaauaaauaaaaguuacaauguuuucucacuuguagauuuuuccauagauaccuaagaccacacacacauguggcaugggaauagaaucuagauugggagaggaagggacugguguugggagagaaaggagaaugaaugaggaggugaauguggucagaguaugugauagaauugaaugaagaugucuuuaagaaaaccaucgcugugugcaaggagugcgugucuuaacccuggccucgggaaguaaaggcugaugcucacuagaagcuuaaggccagcuucaucuacacaggagguuaggccagaccauaucucaggaaaacaaaaugauggucauaagaaguuaaauucgcaggagccuaguuaauugagauauuuaaacaacggaguuuaacauauuacuuugaagcauauuuauaacugggcauacugacucacaccuggcacucuggagccugagguagcaggguugagaagucaaggugaaccaaaacuccucggugaguuuuaggccagccuguaccacauaggagacugugggacuggagauggcuuggugguuaaaagcacuugaugcucuuugcagggugcccaaauucaguucucugcgccuguauaugaugguucacagccuacuauaacuccagcccagaugauuccaguaccgucaggcuuccaugggcucaguccucaugcacaaaccugcacacagaaagaucacuuuuaaaaaaccuuuuaaaaagaugaagauagacguuuauuugcauacacuuauguuuaagucuguguugcugaaggcuguguaaacauugugaucccuacuuucugucggaaacuauuuaaaguuucugcuacacucucagcgacuccuacacuuugagcaagcauuaccuuugcuugaacuuuacucagccaagugaagagagaugcuagcguguccugccugcaggucucagugguuaucuaaaccuagggcauccuugugggacccagugauucuccagcgagaugaugcccagugggaaacuacgucaguuucuagcaggcagaauuagcgccugauccuuucugaaacccagguugcaaaccagccuuguaaaaggugaugaauaauugauccuggugauggaaucaauaauuuauaguggauuuauuuuucucuuccuguucaguuuaugauuaacaucaggaaacuuugguguuguuuugaauugcgggucugaaggguaucauaugcugugugguuugcucugugucuugucuuuguccuucacucugagcaggauccucuucgggagacugauuuuugccuuuguuuaagacuuucaggaugaaucuggaaaaacucagcaagccugaacuccugacacuguucaguauccuugaaggagaacuugaagcaagagaccuuguuauagaagcuuuaaagguauggagagagagagagagagagagaguauuuauccuauguugugagccauuucucuauuuuauguggauauugguguaauuuguguuaagaauuuuaggcuuaauaugguagcacacaccuuuacuucuggugcuugagaggcagaggcaggcagaucucugaguuugagaccaucuucgucuauagagcaauuuacaugucaaccaaggcuguauagacccugucuuaaguaaaccaaaagggaaaggaaugaugacgccuuucugcccucaaaauucaaaauauuuuuuuucauauaccaaaguucagggucuaauauccaggauguuaaaguuuccauaaaacuaccugugcuaccaacacaauuaaaaaaccuuuuguucagccaggugguggcacacaccuuuaaucccagagguagauggaucucagaauucaaggccagccuggucuacacaguuccaagacagccaaggcuacacagagaaacccugucucaaaaacaaaaaucuguuguuacuuaauuuguaaccuguuaaaauacaaaggaugagagagacguguuaguaggacaggcagucuguggaaacacugcagagccuacgaaggccaagcagaucaagcccgcccagguaggagcucuuuucgcguguauggggagguucccuuucugucuucgcauacuuagauaggaugagaaaagacuuuucagaguaucguugaaucuguacagaugauaguccccagaggcaaaggacaguaaccaaagaagguaagauuugagucugccaaagacaaauggaucccuguaaagugcaauuaaguaaaacaaaacauugaaaccuacaucuauaguugauaaguuuagaguaaugcugauuuauuucuuuauuaugcuuuuuuuuuagauauauuuauuuauuauauguaaguacacuguagcugucuucagacacuuuuucuucucacccagaagagggcaucaaaucucauuucggaugguugugagccaucaugugguugcugggguuugaacucaugaccuucggaagagcagucggcacucuuaaccacugagccauuucuccagcccuauuaugcuuauuaguuuauuuauuuauuccgcugacuugaaaggccgacuugauuugccucaggacaccuucccauuucuuguccucaucugauaaugaggagaacagaaguaccaagguuugagcccaucccgaacccuccugguaccugcuguugcugggucuuccuccccuccucaucugccuucauccccucagaacugguggggagaugacaccugggaugaaaagaagcagagcaugcccugagucgugcucugacaaguuucccuagccuaaggucacagaccgaaggucacagaccggcaccugcugcaugugucacucugccauuuacucucccauaaagcuugacagagcuugauguagauacuugguaaauauuuguuguaguaauuuuuguuguugaagauuaacucagggcugugaccacgcugaauacauguucagucacuaagccacaucccuagcaccaaauauuugucgaacaaauaaaaugacugcggugauguguugcccuaagacugccgcaguccuucaggccaaguguguggagugaguaaggacuguucucugcucucgcaggcagccucggcugcuuguuguuuuguuuccuaguggguuucugcaugcagcuacuucucuucauuauggucugagaaguugaacggauucagagaagcaggagcucuaaggguucuguuuugcuagccagugacguucagcauugggccaguguuagacugggccuguguguggccuaugggugauagaacugagcucacuccagcuaguuuaguucugccacagacaccaucuuuaaacaucugcugggacaguuguucacagcuguggcuagaauugaccuaggcggcaucaagacucguuguuguugugcuuuuggguuuauuuguguuuauguguaugaguguucccuucauguuuguaugugcacuguguauacuuggugccugugaagccagaggaaagaaccagguucccugaaacuaguuacagaccaugcuuuuuuccccuccagacaggguuuuucuguguagccguggauguccuggaacucaaaucuauauacaccaggcuagccucuaacucacagagaucugccugccucugccucugccucucugccucucugccucucugccucucugccucucugccucucugccucucugccucucugccucucugccucucugccucugccccucugccucugccucugccucugccuccugagcacugagauuaaaggugugggccacuacugcccugcugagccaccuugcucuuauaacuaagccaucucuccagccccuuaccagguuauuuacguuauaaggaaaucuccuuuaauuugugggguagugguugguugguugguugguugguugguuggcugguuggcugguugguuggcugguugguugguugguugguugguuggcugguugguugguugguugguuggcugguugguugguugguugguugguugguugguugguugguugguuggcugguugguuggcugguugguugguugguugguugguugguuggcugguuggcugguugguuggcugguugguuggcugguuggcuggcugguugguugguugguugguugguugguugguugguuggcugguuggcugguugguuggcugguugguuggcugguugguuggcugguugguugguuggcugguugguugguugguugguugguugguugguugguuggcuggcugguuggcugguuggcugguugguuggcugguugguuggcugguugguuggcugguuggcugguugguuggcugguugguugguugguugguuggcugguuggcuggcugguugguugguugguugguugguugguugguugguuggcugguuggcugguugguugguugguuggcugguugguuggcugguugguuggcugguugguugguuggcugguugguugguugguugguugguugguugguugguugguuggcuggcugguuggcugguuggcugguugguugguugguugguuggcugguugguuggcugguuggcugguugguuggcugguugguugguugguugguugguugguuggcugguuggcugguugguugguuggcugguuggcugguugguugguuggcugguugguugguugguuggcugguugguuggcugguuggcugguugguuggcugguugguugguuggcugguuggcugguugguugguuggcugguugguugguugguuggcugguugguugguugguugguugguugguugguugguuggcugguugguugguuggcugguuggcugguugguugguugguugguugguugguugguuggcugguugguuggcugguugguuggcugguugguuggcugguugguuggcugguugguuggcugguugguuggcugguugguugguuggcugguuggcugguugguugguugguugguugguugguugguuggcugguuggcugguugguuggcugguugguugguuggcugguuggcugguugguugguugguugguugguugguuggcugguuggcugguugguuggcugguuggcugguugguugguuggcugguuggcugguuggcugguugguugguugguuggcugguuggcugguugguugguugguugguugguuggcuggcugguuggcugguuggcugguugguuggcugguugguuggcugguugguugguuggcugguugguuggcugguugguuggcugguugguuggcugguugguugguuggcugguuggcuggcugguugguugguugguugguugguugguugguugguuggcugguugguuggcugguuggcugguuggcugguugguuggcugguuggcugguugguugguugguugguugguugguuggcugguugguuggcugguuggcugguugguugguugguugguugguugguuggcugguugguuggcugguuggcugguugguugguugguugguugguugguugguugguuggcugguugguuggcugguuggcugguuggcugguugguugguugguugguugguuggcugguuggcugguuggcugguugguuggcugguucuauagcaauaccaagauguuacugccuuuacagcacuuuuucuuaacaacaaauaccuguuggaauuuuuguacuagcaaugauuuucuuugugcuaguucauauuucauacuuaagugaguugaaaagcuuugguccuuggugguuuuuuuuguuguuguuguugcugcuuuguuuuucuuaagauuuguuuauuuuuaauuaugugcuugugugcaugagcacauagaaaugaguggugguuuucugggaggccagaagcacuggcucccucucagcuggaauacaguuguugugagcccucuaaaguggaugcuggcaaccagacucagguccucugcaagauccgugugcccagcuaaccucugagcccucucuuuaucucuccaggccguucccuuccaccccugcuuuuugacacagggucucacuggcuguccuggaccucaggccuccaagagaucuuucugcuucugucuccuaaguacugagaguauaguuguauuucagaugugcccaguucagucuuugccuuaaauaacuuugaacggucuuuucuguuugcuuucaaagagaaagaaaaaucucuuuuucugcuuccauuuaacuuuuuguucucugaacaaaaccauauggcuaccuguugcuucucagugacugucaggccacacuggcagguuuuguuucuuuagggaaagauuguaaauguccuauaguuuguaaaguagaucugacuguacagcugggauuguaaaagagcuuuauuccuucucugaaauuggugccagauugcaccacaccuccuguugucccagguaggguacuuuuccugcccaugcaagccgcccugcccuguuccguugcaaccaaagcauguuugcaauaaggcuauaaaaggcaguguuucuauaauguaauauucagccuuccuguaugugaacuuaaguuguuaaagagaauauauauacuguauuugguccuaauuaaaccuuacauaaacgugauuuuugauguuagaagcaugugccaagguaaaacagucuucaugaaagucaaaaguaaacuuauuuuccugauggagggcacuauaaaacuccccucaacagaaaaggaaaaucacauugcucagaagcccaggguggagcucacaauccagcaggaaagccccaguuaagcaauuccacgcagaucuagaaaauggcuugcugggugcucugagccugcugcagacgaggcugaaggacuggaaacgcagccauuuaaaaccucugggagcaguguugacuaccagucaacuuuagagcaccugcuuugcuuuucucuuggugcuagcauguucuacaucccaccgcguguccucugcugguacagaaccacacuuagcugugucagcuuagaaucuuucucgacacaagauggaggauaaucaaggaagacaucugccgccaucauuagcaugcaugugcacccggccacacaagcacauacgcacacaaacacaaguguuauguauggcucuuggcuggaugagauacuagacaggguuucuuacggcuuuaccaaccauuacaaucucuucugucauuacaaagcucauugguuuaggacagaauuauguucauaaagcaaacugugcacacugcaaggaagauacaacucuuacuucugaguaccacucucuugucaccagcagugcuggcuuggaauuucuucauuccuacccugauaaccaaaugugugacuuuugaaacagcuggcaaacauuaagguugacucuggcuuagaacagauggucuguuauagcucccccacccaaaccccuccauauauuuuguuuuugagacagucuugccauucaaaccaagcuggccuugagcucaggauccauugucucugccagagugcuggggucacagugugcucuggacuguugugauguauggauccuaugggaccauuuccagucacaaggacacguguccaucaccgcuaagaucuucuuugugccguuuuaauccacucugccuacauccccauccccucuccucagcccccaacccccaccccccauccuguguucaugaaucccuggucugcuuucuguccccagacauguuuucuaugacuuuauggaaucauacaaaacauauucucuuaguucugggaagguggacuucuucagcucuacaugacuguuuuuauuguuugagaauuuuauauaugcccaacaccagucuucucacuucuuucuuucuuuuucuguuuuuuuuuuuuuuuuuuugguuugauuugguuuggggauuuugguuuguuuaauuuguuguuguuguuguuguuuuuugaaauaagaucucacugucaggcuggccccaaacucagagaucugccugcuucugccacuuggaugcugggauuaaaggcauacaccacuaccaaccagcuucucauuuuaauauuaauuuuucauuucuuauugaguaaugaaauuagguauuuaaaugucaucaauauuuacuuccuuaguuuuugagacagucucacuauguagcccaaauugucugacauuugcccuccaacucccucaaccuccugacuaaagcugcauguaagacuguugcuagcggaccaucuagagacugccauaucuguggauccaccccauaaucagcuuccaaacgcugacaccauugcacacacuagcaagauuuugcugaaagaacccagauagagcucucucuugugagacuaugccggggccuagcaaacacauaugucgaugcucacagucagcuauuggauggaucacagggcccccaauggaggagcuagagaaaguacccaaggagcuaaagggaucugcaacccuauagguggaacaacauuaugaacuaaccaguaccccugagcuccugagucuagcuguguauguaucaaaagauggccuagucagccaucacuggaaagagaggcccauuggacuugcaaacuuuauaugccccaguacaggggaaugccagggccaaaaugugggaguggguggguagggaaguugggggaagguauaggggauuuuugggauagcauuggaaauguaaaugaggaaaauaccuaauaaaaauauuuaaaaaaaaaaaaaaaagacuguuacuagcagcagacgucauagcagcacaagugcuagagaaagccuagcaucucacaguagggucugcucaagaaaaucacucuugagguuugaucuuuugcuauauauuguaaugcuaagugggagguggggggagcaagaccugguugccccgaggacaagagaguccucacauagacccaagugacccugugugcccuugccccuaaguuaguuuugauuggugaauaaagaugccaacagagcagcagguacucugaaccacugagccgucucuagccccugggagaaauguauaguguuuccuuuuaagaauauuuacuuauuacugggugagagugaccaugccacgcuguguguggaggccaggacaacuuugugagcuagcuuauuccuuccaccuugacaugggaucugaaaacugaacucaggucggcagccuuucgucagugggccguaagcacagaagagacauaggcaggguuuagguucuagagccuagaaccuucugcggggccagggaagaaaaggugaggaggaagagaaagccgccauagguuaggugagucacgaaaacguggucccacauuaaaagcagcccagaugaaacauaguaaguacuaacucaggguuacugauaggaagguagauucuaauagcauagacagugaauaucugcccagcucuugugcggcuuaagcaauauuguaaauaauaaaaguugugugcuaggcaggcgugguggugcacgccuuuaaucccagcacucgggaggcagaggcaggcggauuucugaguucaaggucagcgcuacagagugaguuccaggacagccagggcuauauagagaaacccugucuuuaaaaaacaaaaaaaaaagaaaaacaaaaaaaaguugugugucuuuuaucugggaacugaaugauugaagguggguagaaaccccggauugggauuaaaaaauuuuacaacaguuaugauggaaucagaguggaguaccuccagacugguaaggaauggucuuuguguguccuagggaauacuguccacaaugugauauguggaaacauaaaaccauaacauggaaaaauacuaaguuguagucuaguaggggaaaccucucaaagucucuccauucucccccucagcuuguucccugaagauaguaggaccuccuaacaccaucuacggggguggggggaacccgcaguggggcacuagugagagggaagaaccugcagguggggugcccuggcaggaaagagccacgagaagggcaaggccauugguaccgaugauuguucguaaaccggauauuuagaacaagaagcuuguguuccuaagugauaaagcaucugauuuucauuccugaaaacauggacccucaucuaucagcuggcucauaacgcaauaguguggugucagcugucuagaccgcuuucugugacgugucauucuugcugugaauugugugagggauuacaggugccagugaauuucucauuugacuggcaucuuccugugaacucugggaucugugugguguguguccgagugggugggggugggguguuaugucuuggaggaagagacgggguucugcuugugaaguggcagucccuuccagcacaggcaguugggacaagcuuacagcagucacucagccugaaacuaagacagauagaaaaaggaagcagcuuauuccuguuauucugacuuccugucauugugucuccuugcauguguuggccucgugauuuagguuaaaucagagguuauuucuagcagcuccuauagaaagaagcaagggaaacuaugaaaguuuuaguugaaaacaaaaucuguggucugucaguauauugagccaguuguagaaauaauaggacuagaggaggccaucuugucagcuugcugacagucuguguggaaaggaggcauuuagagaauguauugggaguuuuauuaaaugagaaacauagggcugccaaagcugauggcucucggcagguaaugaugcucacugcccacugaugacagucugcagguaauggugcauacugcccacugcccacugacgaaaggcugccgaccugaguucaguucucagaucccaugucaaggcagaaggaauaagccagcuccaaaauuguccuggccuccacacacacagcguggcauggucacucucacccaguaguaaguaaauauucuuaaaaggaaacgcuauacuuuucucccaggggcuugagagacagcucagugguucagaguaccugcugcaauuccaguggaccugagaacaguucccaggacccacauuagguagcuacacuuguaacuccagcuccagagauccagcccccuccucuggacacuaaugacacacauauaugaguggcauauacucauggcaggcacacauauguacacaugaauagaaguaugacauuuuuuaaaggaaggaaggaaggaaagaaauaccucuucuguaaagcuguuguuacacugacagggauguucgugugcuguuguuuaacaccgggaaaucguaaaucuccugucaguaaagcugcauccuggugcaucucacugugggauguuccuggauguaggguuuucacugugcaugccaagcuggccuugaaucaacugugcagcccauacccaggcugaucuccagcuuguagcaucuuucugccucggucuccccaggaagcugucuuaggcaugugcccauaugcccaacugguuguauuuuuaagaagaaaacugcuaugcagugacuuagaugucuaagauugauuggaaagacacagcagagcccugcaguuuagcugugugguuggguuuuauacaaugcaccuaaacauaugcguuugccuagaaguggcccacgaacagaauucaggaagacuuuccgagaggaaagauagaugaaguggcucaggagaacucacagacucagaaauaggugggguugcagucaagaaggacuucaguuagcuaaacaauaaguuuggugagugcugggguauaggugugcacugccacgcccaguuguauggggcuguggcuugagcucaggguuacauguguucuggguaaguugucugaccuccagcuuguagcaccucccugccucagccuccccaacugagcaucuccccagccuucuuucccuugcuuccuuguguacucggaaguucuuggucgucucuugcccuccgauuucuucccuuacauuacuucuugccccugcuguaaggcccauuuggaccagucucuuaauuaugagccaccugcgagacaacucgucuccuugguacacucaguauuucaguguugcuugucuucuucugccuucugugccugcaucucucguuuaguuuuuaccucugucucgacuuaaaucugccugcugaaagcaaauauaacuucuaaugccuaccgcccucugugcuggauuggacccagaaccuagccaacacauaaggcaaacauuccaccucugagucccaggcccuaauggcgucuucuaauuaaauuacuaaagcaucugggggggggggggggggacagggacgggaggugugucaguccuuaagacaggguguugcuggguagcugacaggcaucaaacagacaccucaggccaucauacuuucuuuaaauguguauacguuuuucaccugcauauaugucuguauaccacuuacaugcauuccuagugccagugaaggcuaaaagagagcauuggauuccccuggaacugaaguaauagacaguugugaaccuccauguggguacugggaauugaaccuggguccuuuggaagagcagccagugcucuuaaccacugagccaucucuccagccccucaucuuacuuuuacacuuucuuucuuugguuuucuuagcuuucuugucuugauauuucucaucauuuuuuucuuccacauaccuuuaaauggaaugccccccauggcuguuuauaauccucugugguucccaugguauacguucagaagcucucugucuggcacacuucgugacuguacugugauagugcuguaucaggcuuuuagacuucggggcugauuuggguuuguugguugguuguguuuggagcuuuuguuuuguuuuauaaaauuacauuuaucuaccuaccuaucuauccaucugucugccugucugucugucuguccugucuguguuugucuuggagcugaaguuacaaguacauugccuggucuaugugcugggagcugacaggaagcaucuuaucuacugagcgccccauugcauguuuuauaaaccuguguucacuuaauaugcuuucucuuuucuggcuguccucacuggggauuacaguaauguguaaccuguuaauucugauaagcauuggacauuacaaggaucuuucuauuuugugugcaaauccgugguucccuaccuccaucgaguguaauuccaugaggcgcacacagguccuuaaucuccucugacucuggaagcccaguauccagagccucugucguacucaccgcuauaugugucacaugaagaaugagcugggacccuuuuaagucuuaugugaauauuucaguucucaaaauggauagcauuuauuagugcuuuuuagaagagaggcauaacucuaauaaaguaguuucauaacuuccacuguugaugauucccauccacucacguuauuuacaugucugggaacagcuuguucuucagacaggaagucagggcuugacguuggcuuucauaucugugaaggaugcagaugucugcucugccccucuccguccacggguaaauuccugucaugaaacaaguuuucucacuuuaacuuuuuaaacuaaaaauuauuuuuaugcuauguauauggguguuuucccuacauauaugucugugcaccacaugcuugcaguagcaguggaggccagaagaaggugucagcuucucgggaacuggaguuacaagcaguuguaagcugucacgugaauccugaaaguacaguucagguccucuggaagagcagccggugcccuuccagccccucccccauuuuaacuuucagugaacauuuugucuuagcauccuuucuugcugaggugagguguagucgucugcacugcccucuccccccauuggguaauaaugggagcuuuguaucagcagaaaagcaaacacccgcgagcuccucccaauccuagccucauccccaaacccuggaccuuauaaugcuaggcaagaccacucccacugaggcugcuccagccgcacuguauugaguggugcaguguucuuuuuccuucccuucuagcuacuuagaaaaucuauuuccccacuguccagcugagggcuuuagagcaucugucugacuuagagauacugacguucagaaugcacgcacucacccuaguucugugggacuugugcuuacugcaacugguucuucuuccuucucuuccuucucuucucuucucuucucuucucuucucuucucuucucuucucuucucuucucuucucuucucuucucuucucuccuuccuuccauccuuuuuucuuucuuuucuuuuucuuuccuuuuuucuuuucuuuccuuccucucucucucucucucucccucucucucucucucucucgcucucucuuuuucugaugggugggaguuaguuugagacaggcucucuuuguagcucucuguccuggaacccucuuuguagaccaggcuaucccuaagcucacagagauccuucuaccucugccuccccaauacugggaucaaagguuugggucaccacgccuaacugggaauuuguuuuucaggguuuggguuuuuuuguuuuggguuuguuguuguuguuguuuguuuuuguaucuuuuagauaauguuuaucaucaucuguuuucucuauuuuccaaauuaacacuauuuuaaauuuuuuuuaaauuuauuuuaaauuuauguguauacauacacauaaauaaaucuaaaacagaaaguacaaacuaacuucagacuagagagauagcucaacaguuaagaauguacacaggcuggccuuucagaggacucagguucauuucccaacacccacgucaggcagagcacaacugccuggaacuccacuuccaagguuucauaugccuccuggagcaugcccucaugaguacauacaaagacacguacacauaauaaaaauaaaaguaauuuuuaaaaacuccuuaguuucagauggggcucacgugggacuguugcucagugguggggugcacaggacacacuuagucagcaguagcgcuggaaacggagcucaugagaugugacugaggaggaggagccgccuuguagagugacucugaggagggacgauggaagcugugcagcugugaaguggcuccugacuagacuuucucuauuuguuugucucuuuguuuugagucagagucucaguauguguuguuggcugguauggaacucauaaagcccaccugccucuggcucucuaguguggggauuaaggugcgugccagcacaccugcuguaacuguaauuugucugaauggacuccuaaacuuugcacaagggcucacacaacuuggccgggauggcgcagacaggucagaggacaacuuuugggagucaguucuuuuccucugguguguaggucccagggaucaaacccagguugucaguguccgucuuggcugcaaauaccuauacucacugagcccugggccuuuucaauacagugaauacaagagccucaguucaucucuaguagagaggucuccagguucauaggauuaaccuaccgugucccacggccuguggguuagucccauugugugguacuccagaaguuuggggucaagugucuccccaccaucaccaccgcuguaccuauuuccugugauucauuaagucacugauuguaccguuuaucugccagaacccacccacuuccaggguuggccguuuccuuccuauuccuuaggagguuaaagucugugugucuuagaaaacuccaaucaaauaaacuccacuugguguucuucuaaacaugugugaugcaguucagaaaccauuaaacaagcagaggcugcccacccucgcuccuguuguuuguccuuaaaaauguagcagauuuuuaucuucuugaagacugagaacuuugccucacauguucaaaucugccuuccucugucaccgcccacaucacagcauaugcacugcccagcaaacauaaaguacuaaauaaaugcaugcaaaguuuguguauucuggauauuucaguuaugcggcuuuucguuucuuuuguauauuauauacuuguucuauaaccaaaucucuucuaguaacacuugcuaguuuaaaauaagauaguccuacuaauaccuuuuuagauuagcguuuauauauuucuuuuaccuuaaauagaaaagcagagucaacagucagacuuauuugagucuuccguuuauuccagugucauucauaguugagacgugaugcaaaguagauguuacuuugugacauaggggacacaacacacuugugggguaacccaggaagaacuugcuugaaauaaccucaccccucacagugcucugcagcgacuucucuucugguuuugaggcagggaggaagccgaaaaaaacccaggauuacugucugcuaugcagacuccuagcugcccagacuccgcaguuagggccuaaccggaagcucguuccugauaaguucugagugucagccuccuccucuuccucacuguggacgagcuucucggcucugagaaaguuggaugcuacuguuuaaucucuaugaaaggaaauggagaugauagugucgccuagcagaagaggaauaugugcugggcaugguugguggugaauccuguaugcagagcacgcaggagaccaaggugagagggucucaguucuagaccagccauauaccagaccugucuuaagcaaacagagaagagagauuguuaggauuagguuggugggaugaaaacucagcacacugcuuucagguaaaaagcauuuggauguuagcaucccuguuucugcugcugcuguuaaaauugauuuggggacccagcaaaauggcucagugaguaaaggugcuugucaucuccaucccggugaccccaguucaguucuuggggcccacaugguaaaaagauccagaaaacuggcucccgcagguuguccucugaccuccauacaugcucuguguggcauauaaaugguuauucacacaugugcgugugaucacacucuuucucauauauacauagcaaaauggagaggugcuaaauucaguagguaccagucaggacaaugagacccugcugcagcugcugcugaaauacagccugaccacagcagaugcugggaagggugagaccugaacgcuuccaagcugcugauaagcaguaguguaguagacccacucugggaacugauggagcaguucucaugauuagacaagcuaacgagcuguaauuacaaaagaagcaucugcaagcagcucuuacucuguugcuaauacagcuuuguucauagaagaauccaacuuaguagacucaaacaucagucaagagaguaaauaaaugcaguauauucauauaguagcauacagugcagcaguagaggacagauuacagacaugccaccuaugagcaugaacuucauuauacugagaacagggccagguacaaaagcgugcagcaugugcgacuguuuagaugacuaaguuagugaaaacaaaagaacucagaacgggguuggcccugcggggagacuucugguggggaggggcacgcaguaacuuccuguugagauuuagaaugcucugugcuuuaacugggauauagguaacgggauguguauguuuguauggugucugcacaguggggacagggcagaagaagaucacucuccacucgucacuuuauuccccaggacaggaucucucccuaaaccuaggguuagcuggcagucagccucugucuccacacgcgcgcacacacacacacgcacacgcacacguacaugcacacgcacacauacauacccaguggugggcuuacaggcccaugagaggccacucccagcuuuuuuacaugacuauugggaauuuggacccaggacuucaugcuugcacggaaagaacuauuuacccacugagcugucucuccagcccuaaacugaacucuaauguauaauucuuggccauuuggauuuucucuuuucauuuauggucagugucuggcuuuuguuuuguuuugguuuaguuuguuuguuuuuacuuucgcuuuuuuaguugguugguuguuugguuggcugguugguuguuugguuggcuggcugguugguuggcugguuggcugguugguugguugguugauuggcugguugguugguuaguucauugguuuucguuuuucaagacaguuucucuuuguggcccuggcugucuuggaauucauucuguucaccauacuggccccaaacucaaagauccaccugccuucugccucccaagugcugggauuaaaugugugcacaaccacacccagcuucagugucuguuuuuauuugugaucauugggcaggaagaugaagaacuggaguuguagccuggcugcuuaccuaggagguccuggguuccaugacccauucuaaugagaggugguugucagggcagaguccuaagcauuugccaguggggauagcuaggaaaucucuuaacucacucacuucuguuauaaaccuaaaacugcugggaaagggaaaggauuuuuuuguuuuuguuuuuaugugcauugaaauccuuaauuuauguucaggaauacuugcccuuuaucuguucuuucuucccuguucaauucccguacacauuuuuguuccccacaucaaaaagguaagcauauggauccaggccagaaaguaccauagcccccauagccucauuccuggagggaagggauccgacagaaggacagacauacuccacauuccuuugguuucaucaaaaccugugacagacuuuggaauuaggguguugauaccgcuccuuguggccacacucacagcuacuuaagauuaaacccacucucaguccugaauagaauuuaggacacuuuguccaaauaaugauaaauaauugucuaaucuuauguaaauaauugccuuuauaaauaucugugcuugaagauuacuuugaagaguguuugaaguucauccuacuucaaaggcaguugaaauaaucaccucauucuuguagaaguuagagggcaaccuauaggaguuggcccucccacaguacaggucuugaagaucaaauugaggucauuaagcuuggcaacaaguaccuuuaccaucuaagccaucuuaugugccaaguuauuaguuugcuuugcuuugccucaagacaggaucucauguagcccaggcuggccccaaacuuaauauuuagcuggaaaugaccuugaacuucugaucugcccaccuccuucaccuccuaaacacugaaacugcagacaugcaccagcacacccaguuuugugcuaugcuguggaugaaacacagggcuccaugcaugcgaggcaagcccucuaccaacugagccauccuagacuaacucuuuaccuuuagauucagagccacuuuucauccaaagaauauaguggcugguauccugcccaggaguggauuaugcacacuccuguuguuacacacuucacacuaggaaggcagaaaaggaaacugcuuuauuucuuugugggggaagggugacgacuugaaacaaaaucuuccuguguggcucauguggcucaggcuggcuugaaccucucaguucugccaccauagccugagugcccaccucuuccuuuaugaggcagugagagcgccacaggagcuuggggacuaaacauggcggcuccaaggcuagucugugaugucauuuuaagcuuucucuagugauguguuuccuccagccugugaagugaagaugaaggcauaauagguggcugguguucuggcuguugauaggaccucuguugucagucugucuagcaagccaguauuuuucuuuucuuugaaauuaaagaccaacauguuuucuggcacuguagaaauuucucuucagcugaaguuuauauugucccugaagcaaaaaugcugaaauacgaaauugauugguuuaagcuuuggccccucauguacauuuuuaauagguacaaaucauuaaaauauuaaugcuauuuuacccuguaauauaauguuaguggcagcauaucucauuccuugacuguggccagucucagugagcuguguggucgcaucuggaguguucuaagguugggcugcacaccugagauguuggucuugauaaccugaacacugcaugcugugggaagccagcacauaagccguggugauuagaauagacccucaugagaucccaaucuagaacuacccagcuaaccccucauccuagauuccugaccaucaggugccacaugagauaaaauaaggauuauuuaagcugcuggcguugcugcuuguuaugcagcaagagguagccagcacauacccccacaacaguuauucucauuacauuuuagcauuugguuuugcuuaucacuguuauuuacaguuaaacauguagcccauaaauugguugaaaaaugaauuucucccguuuuucugguguuuaguaucauaaguacagccuucgagcugaccuugucugugcuuggcccugugguggaacugcugugugaccagagccuuuuagucugcccacagcucccuuucaucugcggugaagccguguauugguguggauuguaauuaaccaugcaggugacuaugggaucacucugaaguaucagaagacagccuaacaacuguuuucgggcuaaggcuacucuugcuugggacucugauacuaacugucacaaaagauaaucaccauguggguuuuuaaagucaaguuuuaggacugguuaacucuacacucaaacccgacaggcagcuucuuggcaaaacuaacauccgagucaccaguuguuccguggccagagucaucgucccagcuucugcucgaaaucccaacuccccaguguuuugaaaagaaaagaucauuaacacuaauuuaaaaagacucuagcuuaaucucucucuuuugggcuacagaaccaaucuuggugauaguagcauuuacuacacuagugguacaggguuggcuuuaucagaagagcaagggcuguaaggagacuccaggaaagaggccaaguaugguggcucaugucugucaguccagccagaauccaagaccagccuccuccccagccaagggccuccuccauacuccaguacacauagggauuuuuaaaaagaaagaagaauauuugcacuuacagugucugugucuacuguguaaauagccucaaacuguuccagucaucuggugauaagaugacuguaggccaaaccagaaaucaaacggaaagcguguuuguuuugaggaagggucucacugcauagcccacacugaccuaaauuuaggaucuccucaucucagccucuccugcaggacuugugggcuuguaccaccauggccagcauuggggcuuucaucauuguuaguuguuuugagauagggucucagaauguugcucaggcuugccucagacucacagagauccagcugccucugccuccugaguacuggagcauaaaagcauaugcccccaugccuagccuguguagaaacugcucaugccccucuguuuauagacaugaaguacuuguugcucauaucaugucauuccuaaagcuuuccugagcagagguaagacaagaaggaaacugaaguaucuuuccaaacauuuguugauccuuagauaccugguugccaggggaaacagaaaagacuauggaacggagagggugaucagagauugagaaggaggggcagggguugaauuuggcgggggguagaagggguuuuuguguguggcuggcauuauauguaccuacccacucuuaacccaucagcugugaacucgaguucucucuguacagaucacaaggaguccugaauucuccucugucggcacuugcuggcaccugguuuguuguuaaguauauaaacugauaaagucaucaagcuuaacacuuuaggaaugcaaaugccacacaggagaaagauaagauaaaccugcagguaacacagacauacaaguggaggcacuggguuugcugcuuuaagacuugggacuuccaagcccgggaguggugcuacaugccuuuaaucccagcacuugggaggcagaggcagguggauuucugaguucaaggccagccuggucuacagagugagcuccaggacagccagggcuacacagagaaacccgucuugaaaaacaaacaaacaaacaaacaagucaugggacuuccagagccaugcuagcuggguuaaguaccuguucugacagucggcuagcugaguaguuagccucuuuuuaaugauuuuuccauuugcaaaggagaugauuagugcuacuuuauaaggcuauaaaaucacccacguuaauauggccaaaccugcuguggaucacgucuaauacugggucaguguucauauuacugcaaggcaccaccuccugguaucuccugauuuguagucagguuuacacuaaugcuaccaccuuugguauuguaacacauuccucucuuuaaugguuugggguuuuguuugucuuuucuuauucucaggcccaacacagagauacuuucauugaagaacgcuauggaaaauauaacaucagugacccucuaauggcucuucagagagauuuugaaacacugaaggagaaaaaugauagugagaagcagccagugugcacaaacccccucucuguccucaaggcggugaugaagcagugcaagaacaugcaggagcgcaugcugucccagcuggccgcagccgagagcaggcaccgcaagguaggcuugcccagagccaggcugggcuucggaaauccgcaggagacuugccucagccaccaguguucacgggcauuggagagggcuggggagcucauggguaucggacucuucaguuacacaggaguccaggcacaaagggaaacgggucauugcacagguccagacguuacuaaagaugacauucaucugugaugagucacuccaaaauacuuggugccauuuuuuuccccaaaaucucagucuuccaaacuuuaguggcaagcugguguuuaaccaugcuugaagcugaacagagcauucucuguuugcuuauuuaagugauaaauaaaaagauuaacagguauuuagggaagagagggaguauaaauccaccugguacuaaccaugcaagcaugagauuguuuccacucaucugguuccugguuucauuacaagguguaaggcuguaaacagcuccugccauggcuggccuuuaagucuucucuacacuggagugcagggcaaaccugugcucccugcaguuucagguuugagaacuccaauguguguaguaccucuccagcuuguuccugccuauaggcaggguuugacaagcaucugcauuuuaaaaagcuagcuauuuagauuuggcccuacaaggggcaggcaucgaccauggcuuguaggagacauuuuaaugagggagauggugucagcaaauucaguagacauuaguuuguucucaugguuaucuccacgggagcucucugcuaaagccacaucugguaaguugccccugagcugggucuucuugccugucagccuuuguuucucuucacugaguccagaggauaaguccuuaaccauggguaggucacgcaugacccacaaggccccugaaauauauaacauaucagaaguguaugcauuuuuauggaaaguguauuuuuuuauacuuucagucaaaaucuaaaaguugccuguggccaaaaagagucuaacccaaauguuucauuuguggcaaugugucugauccaggcuaugucgucuagaacacacauggcagugugucugacccaggcugcguugucuagaacauacaugguagcgugucuaacugcaguaccuagcugcucuuggguguuuuacccaagcugggcacuaaauuugccaguaaucaguuaguacuuagaggucuguauauagaguaggcuuauaguccaaguucgcugaagauuccgugucuacccuuugcugugcuguggcuauuaucuguaagcccucguccucccagaaagaguaggaucugcacaguagacagucuggucacugugcuugcaguagaaggaggguuccucaggcacuuccucccugucccagugcccccagcacucaaggguagcuuuaucucuguuguuucgaaacauggauuugucacacacacacacacacacacacacacacaccaccgcaucugcccuccucaugcuuuaaaucacuggguagcuaaagaugaccuuuugacuuuacuucucaagcccugggguugcagauacugcuccucauacccaguuuaaggaagagucucuucuucaucuagucuuugaaaauccagacucugaaccagacucccuacagcaccugcuuuccaagguuccagcucuuuggagccugcaggugaggugagaugguucacuccugcuaccgaagcacugccucuccccaagcuuguuuuccauuucagacuguucuuaaaccuuccugucuggggccuggagagauggcuuagcagggaugagcacuaauugcucuuccaaaggaccgaguuuaguugcuaacacacucacaucaggcagcucacaaccaccuguaacucuagcuccauagaauucagugccucuggccuccaugggcaacaacgcucaugugcgcacauacucacgcauaaauaaauacaauaaauucuugaaaaaacuuucuccccuacuaaagucucucaucucugagacucuauaguauauuucuuucuguaauuuuaaagggcucucaaacuagauaauacauuuaaccagaaggcauucuauuacauuuaaaaucuagauuuuuuuuagcucaacaggaaguacacuaauacaucuuaauuuuaguuuuauuuauauuuaauuauuuuuugagacuagaucucccuguaucuguauagcucuggcuggcuucgaacucauuguguagacaaggcuaacuucacggucauggcaauccuccugccucugccuucuguauacuuagaggacaggcaugugucaccauguuuguuuguuuucauuuuaaacuuuaaagugggguuccguguuauagaaaauguucuuucuucauuccuaaaauuauuaguaggcaacaucuugagaauugaccaucaacauaacugacagcccaagaggucuaggcugagccacucugaaacagaagcuacugaacgauacauucacaugucaaaugcugugugguuugggcagaaugcaugagaaauguccauuucugcuuuuguuuuccuggaaacugauuuagagcauucagcaccaggauaaguggacuaggauaaaugggcaaguuguuaaauucuuguggaaaaucacaggucagaucccaguaaccgagccuucugcacauaggauggaguaggagucuuucccagaugaucuggguguuaguuaagcaaggcacuggauguucuguuugauuugaucuuuaguuucaagcuggagcuuuggugccuccugugauagcauugagaggaacaccucagccuuguguggugccgcccaccacaacagggcucgccccagcaggucccuagucagaacaaaccgccugugauuucccagaauucugcugguucucaaaccuucccaacccccacagcuaauucguuucucucuugucucuguuugcauucuucugcacauacuucaacaaaaguaaacaucuuguuuucuagcacauagcucacaugucuuucauccugcugcgacagcgugcgccucgacagcccuggcuggauuucauguguuugcucauuuaaucuggaacccucaagucuugaguaguguaaguguugagucgauguuuggaaguuaaugcuuuaaaauccuuuacaggugauccucgaccuugaagaagaaagacagaggcaugcacaggacacugcugaaggagaugaugucaccuacaugcuggagaaggagagggagagacugacgcagcagguaacucgggaaggaggagcaggaugaccuugucuagagaguugcugcuuaggcuuacggcagugugcagaauuacguuagaaguccuuauugagaagauagaauggccauguuuaucacggcuauucccaaaaugucuguuuuuucaaacaaacaaacaaacaaacaaacaaaaaacauagguaacuugggauuggggagauaguccagggggcaagcacugcucuugcagagggcccacguuugguuccucacauccacaucaggugucucacaccuuccuggaacuccagcucagaggaucugacacccuccuccugucuacaguaagaccuguacucaugcacagaguccucacccacacacaaguauacauaacuuuaaaaauaaaacaaacaaagaucacucaguggaacugucauucauagcacauccuuuagagaucucugaguuucaggcuuuuuuguugucccacgaccuacaguaacagcauggccuaucccaagccaguacgccugaaguagaguguugagguguggucuugcuuguccuuuaaugcuaauauugggcccccaagaucugguugucccagagaugacacagucuacauguagacccaagugacacugugugaucuugccccgaguuauuuuugauuggugaauaaaaaugccaauagccaauagcuaggcaggauuuggggugagaggagaaacacaagaaagagaaggugaaaaguauggaggaggagccaccauggguuaggugagccgugaaaauauggcccugagggcuggccaauuagaguuuaagagcagcccagaugaaacaugguaaguaauaaguuggaguuaucaauaggaaaguagauucuaauagcauagaaaguagauaucugccuagguuuuguccugguuaagccuuauuguaaauauaaaggcugugugugucuuuuauccggaaacuaaaugauaaaggcaagguagaaaccucaguuugggauuaaauaauuuccacaucacagagaucacaggacauaaaccaucuguuuauucuuguacuauacagugguggugugcucacauuguagaucagggcagccuugacucacacucaugaauucuuuuuguuuuuaaguaugaucaugguuuacugaacuggcuuccccaucuaucaauguaucucgaauuggaaauuccugauuagaagguucauccacccguucccucucagagucuguauaauaauguuagacaauaaaacagacuacauuuguguagauccaaggauggugguucaugccucucguccuaccaguuggaaggaggauuucaaauucaaagcgagucucagaguaagacuuugucuaaugaaaacaacaaaagcagggucucagugcagcuauuuauguucguuacucuuuguaaagaucagacagaaugauugcugcaucuucaaguuugauuuucaacagcauccaugcccagaugcaucuuacauuguauucuguuauuuguuuuggcugauucuauggccucuccgcauaccuaaaacacaacggugcaucauaucccugcuguucacccugaggcaguuaggaacucaaaugccucccaagucaucaagaaagauuaaaucauagugugugggguguucucauacuucaaaaauacuaauuaaccuaagcaccgugcuguacaaacuaauaccgcgcaccagagagcagccagugaggacacccugagugaucguaauuguuaguacauccuucuguuuuccuucucuaaucaagaggugugguggcauuuuucuuuucuaguuggaauuugaaaagucccaagugaaaaaguuugaaaaagaacaaaagaagcuguccagucaguuggaggaggagcgcacccgccacaagcagcucucuuccaugcuggugcucgagugcaggaaggccacuagcaaggcagccgaggaagggcagaaggccggagagcugagccugaaacuggacaaggagaagagccgggcgagcaagcuagaggaagaguuggcagccgagaggaagcggggccugcagacggaggcccagguggagaagcagcugucugaguucgauaucgaaagggagcagcugagagccaaacugaaccgagaggagaaccggacccgugcccugaaggaggagguggagagccugaagaagcuugugaaagaccuagaggcugcccagcagcaccgcagcaccagugagcagggcagggagccagugaccauguccagaggcacagccacggagccucccaugcgagugucugcguuuugucaaacagagaguguucagacagaaagaagccacgggagugucauaaccaagcugacagacacuggucuuccaggucccaccacggcugcuuacucauaugcuaaagcuaauggccacugugacccagagauacagacuaccagggaguugaccucagacagcagcacagaaaaccaagggccuccacgggagaaaucugcaguagcggcucaggagaaaccaguggagaaugguggguguccuguaggaacugagacuccagucacgaugccuagucaccucccuuccaguggcagcucccugucucccagcagcacagccucuuccucucugacaucaucuccuugcuccuccccaguucuaaccaagcgucucuuggggucagcagccagcagcccgggcuaccagucuuccuaccaagucgggaucaaccagcgcuuccaugccgcucggcacaaauuucagucccaggcggaucaggaucagcaagccagcggucuccagagcccuccauccagggaccuguccccuacccuguuagacaacucugcugccaagcagcuggcccgaaacacagucacucaggugcucuccagauucacuaaccaagggccaauuaagcccgucucucccaacaguucucccuuugggacagacuaccgaaaucuggccagcacugccagcccaagaggugacaccagccauucacccacuccagggaaaguguccagcccucugagcccccucucuccaggaaucaaguccccaaccauccccagagcugagagaggaaacccuccaccaaucccgcccaaaaagccuggccucaccccuucgcagucugccaccacuccaguaaccaagacucauucccaggcauccucccuggccgccacagaagaccucgccagcagcugcucccccagugccgugguggccaauggcaaagauguugagauacuuuugccuaccagcagcuagucccuagggcugagucuccacauuugacauuccaucagacucgggccaagagcucagcguuaaacccuggagucaaaucauguuauuuauuugauaguagcuacagccaucuguauaauacauucaguguauuuaccuuuuuguauuuuuuuaaguagaaauugaauacuuuggauuuuuaugacucaccucuuuguacuaagcuagaaggggaccucauagacauagcgcaucucaagcucugcacuugccagcgugcugcgacgaggcggcugacuggggaccaggcggugcugcugccagucggggagcuagaauucauuacucagcacucauuucaaauuaugcagaagcgguucgugcagauuuuuauuccagaugaacauguuuuaaaagugccugaaaucgccugccacgggaaugugauucugcggcagaaacaaaagacagagcauuucuugcagcaaaugagauccucugugaaucugaaugucaaaaaaccaacacugcuuuuaauccucucugacuguuuaaugccagcuuuguguucugaaccgagguuugcauaaguagaguggaaauccuucugaagggcgggaacucugucaggcugagcucuguaaagcccucaagaaacccuccagaacacuuagcaguuggggugcugauuuucuugugcuuuugaaaacuuaagucauucuccguuuccugcaucacuucuugaguagugaagucacgucuccauucaaauccacccucaagcaucggccaugggaacuucugauucugguugcuuuuacuugaauaggaaaugacauaaugaacucuuuauucugugaucaaaaagcaauaacuuaaaagucagucuuuguaauacuguaagucagaauuauacagauuuuaccaaauuguuacauucacucuccaugcugccagcacuucuaucuauggaaccaaaugggcguauaucuguaucuguauaguacacaccccuuuuacauguucagcauucucacacucaagcacauaaguauuagugcaauuguaucucuggagcuugcaguguagcauaaaggacaaaguagaaucaaucgcauguuaagauuaccuaccaaagcaauuagaugugacuuggagccagucagucaacaaagaaauccauuugacaaggaaguggacaaucccaaacuaagcucacaucaucagcaucauaggaaagcccauuaaaucguccuagugccacagaacucagcuagccaugugagugagugagacagcacagccccucaagugcuauccacucagccauagcauccuagccccguguaauggggccaccccuuugagccccagcuccugucaugcaaaaauugcagauggagguuaccaauucucuaaacguucauggaauugagauucccacaagaagauucucauucugauuuuaaauguuuuuuaaaugcugcugauuagacaaacauggcugcaaaugacuuuagcuugcaggcuaccaagcugcagccucucccucccuagaaccugugcuguuucccuuguagugaguuuguacagacagaaacccccaggcuucuccacugugucagcuacaucugaccaaguccacagagcaggacagccuugcucuuggcaagcagaacccccgacacaccagcucaggacacugguuacacaguuuuuuauccagaguaagagagaggaaggccuuggugucuuuacauaaauuguucuggccagcaucuacccagaagccccuggccuacuguaaccguuuauugggaaggagaaugggugaucauuggaaacaccugaucauguuugcaaaaccaaaggauucagugggcccauucagaugagucacaaggaauuagaaauugauuuucuucuugaaccacagagcugaaaacaaaaagucucccuaauaauuuagcuaauagcucuuaguuauauuuuuauuaacccuuugagucagugggcaagaggcaggugauuaaaaucuuggugggcaagucaacaacaggguauacuguugacucuccagcuuacaguuuaaaugguuaagguaaaugcaugacacaugaaaguguggcuggugucugcugaaaugauggagacaugugaaacugucccgagcgauccugcauggaauuuacuccuauugcggagccaaaauagaccagugaugaucaaacgcugaaccuucuccucaggagagacugcagggccucaguguucuuaccucucuugcuuuaaaugguaaucuuaaaagcuguguugugcucuuccucuguuuggagacagauauauauagagaaagagaaaugcuauaggggaguuuauuucuugggggggaugcacugaacaauauuucuuuuacaguauaauacaggggugggauaugcaaaagaaauguguauuuuugcuaguuccuaucuucugagauaauaagcacaauccugaaauggauccaauaauucagcuagauauuauagauuaguauuucaguuugcaguagauugugagugugugcgcuaaguaaaaguuccaugauucacaauuuggguauuaaccauaucaaagaagcuguuacuggucagcagaaucuaaugaugugcucgguguaacacaagcguuaacuaagucauuaacauuuguaaggccaagugcagaagucuucauuuuuauaguagacuacauuaaaacaaguuaaaucauaacugucugggggaaaagucuugucuugggcuuguuuuauuagaaaggggagugugugauauacggagcacuugauugaguuuuugagaaacucggccucgauggcagcauccagguuagaacucccaaaaacuuaggacauuggcuuucuugugaagcauagagcuggggguagggguuccaauaaucuaguauuuaauaacuugcauuuuuacucacugggaaucucacaugcaugcagacacagggacaucgacuggagcuuggucugccugucaggcuacaaagcugucaccacuuccucucuaguagccgucagcugccauuaacacucagcuaggagcaggaacuuggg

SEQ ID NO: 1644 - RNA, 9489 nt, Mus musculus
gagccccgccgcgcggccaggcacucagagccgcgggaggccggcagcgggcggcgcccaccaagggcacgcggcgcccucugcaggccgcaggcggcaacacaccgguagccucaucuucccucgcucuucccgccucuuucucaggcuacauuuuuuuuuuuuuucugcucccuccuagagugacagccuccgacuuccguucuuccccuccgcuuccaggcguguccgugucuucuccgggaggcugccaauaaaguuuuucuccuucucgcucccaggagccccgccucaagucuaaauaucgcgagaucuggaggcgcggcuaccauggcggcggcggcguuugaagucccggcggccuugacaaccuccgaguccacuauggcugcggagcgugcggccgcgccggugcaggcuguggagccgacuccggcauccccguggacccagcggaccgcacacgacaucggcgggccgcgcacacguaccggggacguggugcuggcggagcccgcggacuucgagucgcugcugcugucgcgaccggugcuggagggucugcgggcggccggcuucgagagacccucuccggugcagcucaaggccaucccguuggggcgcugcgggcucggugaggaccggggccggccggcgguggggggaaggaggggacggcguggcccccggagagcuccggcuccgcgccaucgcggggcuaagccaggcucuaaggcgcgcaguugaauuugaggguaggacuuucuuccagcauggaguccaaguuggagaaggugagcggcagagauucggggcgcaaagggcuggggagguagcucggugguuaagagauuggggcaucaagcacaccuccugcgcguuugagagucaaccaaaaauacagguggcaacuagguccucauggcagagaaccucuucauucuccuuucucguauuugguaucugguggcaucaguaaaucuagguaauaauauguaauauauauaauuuuuuucuuccucagauuuaauuguccaagcuaagucgggcacuggaaaaacuuguguauucuccaccauugcucuggacucucugauucuugaaaacuauaguacucaggugagucuaacucaggauccggaaggggguguguagcacgugacucuauugagagucgugacaaacuaguaacucuuccagauggugaguuugaagaggccggaccaaagcguaugcaaguuagggaaguaaacuagauggucacgucggugaguuguggccaaggcuacguccaguauuuuaaaguuggaauuuucuguuauaaguacaucucgaccauuugucaguuggaaucguacaauuaaaaauucauuuacuuucugacuagagugggauuagacauagaagguagaaguucuggauuaguaaguacugugcuauggcagaaauuucaggugguucuuaaagccuuguguauguguuguauugaucucucauuuucuagguugccucgggauaugguuuuaagauuguccuacucagcuuuggguuugggggaucauucuuuaaaaagcuuuguuuagccauuguuacauauaaauacuauaguaggcacuagggauuaaacagugaauaagaugugauccugacacugucgucuggaguguguagugauggcugacuucaaaagggggcuuuugagauggucgaucuucaaugugauuccuuuaaacccaggauucuuguauuuguugucuagaaucuuugaguucuauauccacgaaaccgugggagauaaugaauauacuuuuuaaaguacauuggcuaauuuauuugagauuuaggauguguugagaguuuuggcuuuguaauacuuggcaacagacaaaaucccaaacuugaguaaaaaucauauuuuuaagguauauuauuaaaauaauuagugccuguguauuauguaguaucaaaguaauacuacauaauaauuuauaguugggaaaaucagaaagagagagagagagagagagagagagaaugagaauaaaguacccaaaucugugaugugugcccagaguuaagggauuuuuaaaaagucuuauuuccuagucuuuuuuuuuuuaaaaccaguauguucauuuccaguaguuacauugcaguuuguacuguguggugcuuggggccuuugguaccuaaccuuugcaguuagcuuugagauauaguccucucacaaaccuuuaaucccagcacuugggaggcagagacaggcggaucuacagagagaguucacgaacagcuagagcuacacagagaaacugucucgaaacaacaacagagaguaugugggucuuucugcuguucuucauguauaucuuacuacuuuugaauuuguguuuucucuuccuaaagcauuagugugucccacagcuagcucugugcuauacauuuagguuucuucucaaauguuaccuccuuauggggcuccuaacacguuuguuugaggcaggcacacuuggaauaguccuagcuggccugaaaccuagacuagucuucaacugaggcaaucgauuucuguuucuaggguaguagaaccuucugugugugccgacacucucgauguaaaagggcuuucugauuaucucauuuaaaaccacucccgggcuggugagauggcucaguggguaagagcaaccgacugcucuuccgaaggucaggaguucaaaucccagcaaccacaugguggcucacaaccauccguaacgagaucugacucccucuucuggagugucugaagacagcuacaguguacuuacauauaauaauaaauaaauauuuaaaaaaaaaaaaaaaaaaaaaaaaaaacccacuccccuugucagggcuuucucuuuucucuauuugauauauauauuaaaaaaaaaaucuuacaauuuauuacuugcuauuacauguauauauauguuauguauguauauauucauuauguauguauaaaaaaaaugacaacaaaaacccuguuuuuuuugggggggcgggggagggaguuugaggcaggguuucuguccuggaacccaacuuugucgaccagccuggccagggacuaacagagauccaaagugccucugcuucucaaguccagggauaaagucgugcaccaccacacccggucuaguauguucuuaauuguuagcugaauuuuucucuugucuuaaaacucaucucuuaaaauguaguguauugcaacaaauggauguaccacucaaauguauuccucugacuuguuagaauguuuugcaauuuauuuuagauuuugauauuggcucccacaagagaaauugcuguucagauacacucgguuaucacagccauuggaauaaaaauggaaggauuagaaugucaugucuuuauuggagggacuccauuaucacaagacaaaaccagacuuaaaaagugucauauugcuguuggaucuccugguaagucauuaagaccucuugguagcugaaguucuugaagacuagaacagugagcaugccaaucaaaugggaguuuugaugguggugauaauugcuuucagcauaaauggaagaguauuagaccagagagacacauggcuggguuuucaacagaaucuguuccucuccauucugaagaguguuggagaauacccaugggaucagcuucugagaccugaagugacuuuaggaagccuguuuaagccguggauugagguuucuuuuguucucucugguuauuugcucacaaaucacucagaaucagaaccuaggauucagugccauagcauucaaguuuuguuuuuguuuuuguuuucgagacaagguuucucuguauagcccuggcuguccuggaacucacucuguagaccaggcuggccuugaacucagaaauccaccugccucugccucaggagugcugggauuaaaggcgugugccaucacgcccagcuagcauucaaguauuuugguagcaguaauguuuguuuauuagcaguaauguuuguuuaccaaaguuacuggugaugaaaagggaggggacaaagaauggauucagacuuuaagauuacuuagaccguuaggugguauguaacgguacacuguaaggaaauuaagcagucuaaccuguggauaaauacuguaaagcauuccugagguuuguacagauuugauaugucauaaguauuucagguuuuguuguuuuccugccauacagguagaauuaaacagcucauagaacuugacuaccugaauccgggcaguauccgucucuuuauucuugaugaagcagauaagcuuuuagaagaaggcaguuuccaggagcaaauaaaguaagaaaacuagccugaauacaaaaauguugcaccaaagcauuucucuauagcuuucccgguagugugugcugucugcaugguguguguucauggugugugcuuuccuguauuuuacaguuggauuuacuccucuuuaccugcgaguaagcagauguuggcaguaucugcuacuuacccugaaguuuuggcuaaugcuuugacaagguauaugagagaucccacuuuuguaagauugaaucccagcgauccaagucucauagguguguauagauuuuacauuauuaguuugugauguccuggggcuuucccucgucugauuggcuauuuccaugucauaguugcuauuggaauuuaccacacuuguuuguuuuaacugggacucuugacuucuuuauagguuugaagcaguacuaccaaguugucaauucuuacccuuuggcucauaagauuuuugaggaaaagacucagcacuuacaggaacuuuuuaguaaagucccauuuaaucaagccuugguguuuucuaauuugcacagcagguaauagaacuuaaucuagggaacuuaaaaaaccuaaagacuagggcauggggcaguaguugaagguuguaaaucuuuuucuuuuuuuguagagcucaacauuuggcugauauccuuucuucuaaagguuuuccuacugaaugcauuucaggcaaguucagcacucuguuuuuguuuaauguauugcuuugaagccuuccaugucaugagagaaaaauaucacuucucaaauugucucaagagugugaugucaaucuccuguuuuuuuuuuuuuuucuuuuuuuuguguauguuuuguuuugaaggaguaacuugguguauaguaauaauuuagaaaaucagugaucagaaauacuuaaauuuuuaauuaaaaucucugaguuauacuugcaaagaacuuaauacuacaaaauaaacucuaucuucauugucuugagauauauuuuguucaauauaaucaagucauuauuaaaaugcuuaaaaauuaaacaagguaugguguugcauguccucuagagacagaggcaggaagaucaugggcuuaaggccauauuugcauaugcuacauuuuaggucguuauaggcugcauagaaagcaaacaugcuaagacuagcugaguuuugaucuaucgucucugcuccccuaccaucagacuugaccuuuuauauauauguguaagugcucuccuacugagcuauaccucccacccaugaaucgacuuaauguucauccacagaguuuguuaauugcuggauuaauagaaaagauuuaaaggaauuuuuggucagugagcuccuuuguuuuauaugcuguaguguaauuuuucacuuguuagcuggaacaugcucaguauuaggaagacuguuucuuuuuuuuuuaaagauuuauuuauguauuauauguaaguugucuucagacacuccagaagagggagucaaaucucauuauggaugguugugagccaccaugugguugcugggauuugaacucgggaccuucggaagaacagucggcacucuuaaccacugagccaucucgccagcccaggaagacuguuucuuaauggucugcuagcuuaacucuggaucacauuucaaacccagauaagugggcuauugaagggauucaguguuaaaagccuuuccugugcaaucgugugcacaggaauuuggaucucagcacccacgugacaagccaaguaguauucuugccccuggggaucuaaugucucuccuggccucagugugcauaggcacauucaccuguauacacagacacagagacaagcacacagacccgcagaucuuaaaaacaagauucauaaagagcuaggaagaacauucacugucagacacauagcuacaagcauugcagacucacaaaucuuaaaaaagaguuggaaagaacauuuuuucuuuaaguauuuauuguuagacuuuguaauguugccauuuaaaauugauuuuugauuuucaaauugauagccuaaauuauacuuugaaaaauacugacuuuagauuuuagcacucauauuugcacagaacagaauuaacuaacugguugguauauuucuuuaaaacuuuaagacugggaguuaggauucuugcuuauuguggaugugauaaauauaucuuagcuuaaguuuuuguugauguuuuugagauggaauccuacagucuaggcuggccuugaacucuggaauuuucuaccucaaccucuugaguguuaggaugacagauagcaagugugugccaccauuccuggcuugcuuagguguuuuaaagugacuuuuugggguuggggucuuuuuagguaacaugaaucagaaucagcgccuugaugcuauggcuaaacugaagcaguuucauugcagaguccucauuucuacagacuugguaaagcuccugcuugguuugggugacuguuggucuuggcauguauuguuaucagauugcuguccuguuucauguagguaccuaacagguaccagagauaaaaguuaucuuucuaguucugggaaaagugcuuucuuaaaaauauguuuaauguuuaacauuugcuuugaaauagguuuaguccuaguuacucacuagaaauagauuucuuuuuccuuugaauccuaaauauuugaucauuuuaaauuuggcuuuuguuuauaucagaauugcauagugugcauugguagucaugcuguaauuaauacaaacaauugucuucaagacgucccgugggauugacgcagagaaggugaaucuaguuguaaaucucgaugugccguuagacugggagacuuacaugcaucggauuggcagagcuggccguuuugguaaggaacaggaaguuuagugcuuuaauaagaacacuaaugugaaggguacuuggaguguuguuucuguggaaaugaguuacuaugucauuccuuacucuuagguacauugggacugacagugaccuacuguuguagaggagaagaagaaaauaugaugaugaaaauugcucagaaauguaauaucaaccuucuuccuuuaccagguauguguuuguuucuuuugacauucuuuuacuauuauauuuauuauugcuuauuuauuuauuuugaggcagucucuguguagcucugacuguccuagaacccauuauguagagcagguuggccuugaacucacagagaucugcgucugucuccugaguacugggauuaaaggucccauuaccaugcccauuagucagaaguuuugacauucuuauaguuguagugaugauauaggcauaauaaaaauaauaguacauagugcuauuauauguucauucauuaauacuuaacacaagcuugugagguacacaguauugcuaaucugugucuugucgauuaggagaguuggguauaccuuaacauguagguuaaguaaaaguguuaacaacugauaauagauauuuccaacuaacuacuugacacaugaaaaaauuuuucuacuguauaguuguaggcuuugcaguuuuacuuuugagacagucucacuauguagccuugccuggccugguacaugauacguagaccagauuggcuucuaacucacaaagauucaccugccucuagugcugggauuaaaggugugcaccacuaugccuaggcugaguauuucuuauucuuccuuuuauauagauccuauuccuccuggccugauggaagaaugcuugaauugggauguggaaguuaaagcugccaugcauacuuacagcucaccaacuguagcuacucagucccccaaaaagcaaguucaaaaacuagagagagccuuccagucucaaagaacgccugggaaccaaacgccuuccccuagaaauacuucugcaucugcacugucagccaggccaaagcacagcaaaccaaagcuuccugugaaaagccacucagaguguggaguccuagaaaaggcagcuccaccacaagagucgggcugucccgcacagcuggaagagcaaguuaagaauucuguucagaccucuguugaggauuccuccaguaacagccagcaucaggccaaagauagcucaccugggucacucccuaaaaucccuugucugucuucuuuuaaaguccaucagccgucuacuuugacuuuugcagaacugguagacgauuaugagcacuauauuaaagagggguuagagaaaccuguggaaauuauccggcacuacacagggccugaggcccagaccgggaauccucagaauggcuuugugagaaauagaguuucugaagauagagcacagauguuggugaguaguagccagucuggagacucagagagugacagcgauucuugcagcucaaggacuucuucccagagcaaagguaauaagucuuacuuggaaggcuccucagacacucaguugaaagacacugaauguacuccuguggguggcccucucucucuggaacaaguucagaauggaaaugauaccccgacucaaguggaguaucaagaagccccugaaacccagguaaaggcaaggcauaaagaaggcgcuaaccaaaggucuaagcaaagucggagaaacccagcacggcguucuucuuaccgaguacagucagaaccccaggaagagaguugguaugacugucacagggaaacaacugcaaguuuuucugauacuuaccaggauuaugaggaguacuggagagcguauuacagggcauggcaagaguauuaugcugcugcuucccauucauacuauuggaaugcucagagacauccaagcuggauggcugccuaucauaugaauacaguuuaucuacaagagaugaugcgugguaaccaaugagguuagcaugugcuucagacuagugacugucaacggauaauuggauaugcauucuucaccuagaacaagugggguuugguggcauuuuggaggaacuugagaggacuugaggcuuucuacugggacacaauuauuuuucagauuauuuuuagaacuuggaucuaaagacccccaaggugccacuucauguaggcuguucccaaaagaaaucuuuaagaaggugacuuaugccacuccuuacuuaaaaagcaaaauaaaaacaguuaaaauuugaaucuaau

SEQ ID NO: 1645 - RNA, 1261 nt, Mus musculus
cucuuugauugugguugucuuuuaagggaggucuuguuauaccacucaggcuggcuucaaacuucuggguucaggugaaucuccugccucagugucucaaguagcuaggauuacaggaauauaucacugugugaccaauuagggacauaccauauuuuaaggacuucugaagucauuaugcuuugaaauacuucucacacauuucuuuggacuuaaaaaucauggacagacagaccucucacaaaccagcuaaaauaucuaaauacguuauaucacguggguuguguagauauuuguuaaauuaaaauagucucaccaguaacacagacugauuuuaucaguuuccuuugacacaucuuacacuccucccuuggguuaaagguaaaacaaaaacaaaaacaaaaaaaaaaacaaaaaaacacccuuuugacauugaaggauauucaagccagagggaugcaguguuauccaagggaaauuuguacuugcugagcaacauguaaagguguccuguuaagagagagggcuauauuuuuauagugucuuuaugugaacuccuuggucuugggaagggcaacugaaggcaagauguauuuucauagccaagacauggagaguuucuaggguauuaauuugaaucucaugaugcauaucuaugaacaaauuacguaguaguguuuauggcuauuucaaguauaauagcuuugauuuugugaauaacaauuuaauuuaaaggaagcuugaugcuacaauugguagguuuuuaauuuucccaacuagaccacaagcaacuuuaaugacuugaugccuccaaucuaauuuuauaauuaacaguaaaugcaagugcaucaccuuacccuccaccagggggagcuucgguaucauaugaugcuucuaccagcauuuccuuacaaagacucauggaguuuacaacuuaauuaggcaaaaaauagacacaaaauuuugggaagguaugaauaccauuaacuuaaugcacuguagccacuuuaguauguauuuuucuuaauguuuggagaaacaguggcugcuagcaugugacugccaucuccccacagcucugaacucaccuuggucugccauccucaucugccaucaucagagaacuccuuuuacuccucaauaagaccgucuccuuuuccgaaguugugauguucuuuuuugucuacuugacuaaaacaagugauuuggagucauuuuucucuccuuaagaaucguaauaaaacauucugcaugccuugag

SEQ ID NO: 1646 - RNA, 3930 nt, Mus musculus
acagaaaguuuuuuuaaucccacucucugacauugagaaaucuuuauuuauggcagccagguagguauuauccuggcugguauuauguucaucuguggacuaacaaaaucgauuggaaggcagggucacuaccuucauccacuucuucagucccuuuucuggggugccuaaguagaaaagacaaaaaggucuggaaguagccagcgacucugaauaguuguaagagcaggcguggaggaguugguuagaagggcaugcggucugagaguucuacuccuccggauaguuuggaaacaccagggaggcgcaucuuccaguccuugcccuggagguaggggucucucucuuuaggcaccuaccagaguguuucagaaggugaaguuucacaaagggugacaaugagaugguaccgccccucccggauggacgcgcuggcgcccucuggcaccccgagccuagaggcgcagagggguagggugaggacccgagaagagcggccagcccaggugcgccagggguugggcaggagcccggaaggugcgcugccccgccccacccccuccuugcgccucccgcgugaaagugaaaguuccagggccccaagaaggucaaggauuuggggggcggggcuggcgcggacgugggagcaggcgcugggcacuggaggggccauggaugggcucggccgccgccuccgagccagccugagacugaaacgcggccagcgggguuagugcgggccacaacgcgcgggggaaagagggcguggggucccccgaacuauaggcucggugcggcacuggggucaggaacguggaucaguuugggcgggaucugugagggcugggcaggaggcaggugagcucaagggaacagguagaggucaacaaggggacagaucugcugggucaagggggaaccugguggccagaaaccuacaaagguuguggggccccaagggccacguguccuucuauccaggaagcuuguggugcagccacuuuguggcuaaagagcuuaggccgucaagcccuccgggaggcgcuucccuucccuacuuaacuggauuuuuuuuuucaguucccgaggagauccagcuugucccugccuugcagauaaccgugccacaaaaacuggucuccccaagcccuuagcacugaccucaguagagcagccagguagaucagcucagcuguuuccucaauccggaccuugaguucugaccuguaaaauuggaaucuuuucccuguccaggguggauuauagggaugaaauuagaugugccauccguuuccuuucuccuuaucuggagcacugggacuuggaagaagggcaauuaggauucauuaauguauccauucauucaacaaacaucuguugcuguuuaugucuggccagugcuauggcugagcugucacccucggguuuguucagacagagcccaugcuucuggaaaaaaaaaaaaaaaaaaaaaaaaccaguuuguaagagucauucccagagagcucgccucuuccugaauuugcaagugaagauaucaguggcccccucucauaagaggccucagagcugaggucgguacuuccuucucguaacuguagggacuugugacugcucugcucuuuguaccuucucgcuucuaccacacucuuccagccuggucguuauggcauaugccucuucuaccugcgugccagggagagggcagcaauggcuggagcaguauguugggaggagauaaguccucuuuuugcuacagaguucuggcuugguuuucuugggcuuccuggaccugaguaaucugcuacugaauggcuagggucugcuuccuagggcucagaggacacauuucaguuguucuccaccuuacccucacagcagcauauggcuagcaaugguaccuggaggaucuuccuugugguggaggaacaggaaggcaggcauucuauauguaccuggucacaacuuuagcaccugucaggucauaugggugugacucuuucaucuuucuuacuguccucuugcuuccugggggauuuccccuucugguucacuggcucaggcuguuuugucuuagagauguguguguguguguguguguguguguguguguguguguguaaaacacugguagggaagacuguuacggugauucuggguugcuagcaguucagcaaagaacacacaacagcuuuucagaucaagguucccuaaaguccccucucuuccuucaggugguugugggaggggcuuccuguuggaggaacaaguauaaccagacgccugacuucccuagaggaguggcuccucccucaauuaaaauugaggauaauaauccauuccagggcauccgggucaagugaggugccuucuacuauagaggaguuugaugcauauugauccuucucgugcuuuucugugagaaccccuuuugaaagggggagaaggagaaaacacucuguuggaucuugagccucagcccaaaggucuuaguuacuuuucauuggucugggauuucugacauugcuggucccuuguuucuccugauaaagcaggaggaaauggagugaaaagccagccccaaggacugaggaaaagacauuuccugagcuucugggaugaccaggaagaugacucuggccccccaagccauuugcucgccacccaucccacuccacccacuaccucuuccuaccgggagauguuuacuguguaauacaccagaaggccugagccuggauuuggaacuuuuuaugacguucacuuuguacagauccuguucauuuucaauugccuccgagugacuuaaugccucgguuuuccuuucuguacuaggcaugcucuugcuccguaaggcaaccaguaaagauuaugcaacaugucuauacaggcuacaaguaagacacaaguacuuucuguggugucuugcuuccccguucucaagaucccaacucucaucaucuguacuaugauugcugcuuccgccacaagucaauguuggguuucugaguccugcauuuuaccagugccacaguuucagugcucuuaggaguagggugacagccuuccuucuuaccauagcaacacacucccucccagagggcugcuaauucuuugcaggaguggcagacacaggcaccagauccuuuuacuucuucccuccccauuaaguuacuucugggcaaagucuccuuccucuuauccuguacauuuccuuauucaggacuuucuguuuaauaacccaggguaucagcgacuacuuuucuccucuuccucaaucucuagacauaguacugggccugcuguuuagcuuguccuggcccaaccagaggaaaggcugagcagggguaggggaggggugaagaugcucuguaccccuacagcugcugaugcaacuaggcuccuacucuaagcuggggacgauuucccgagucauugcuuccuuuuaguaaagauggugagagaaaggauucuuccggaacccuggaauagugagagagauuuaugccuuagaucaggaaagauugccagggaggagugggugaaguaaucaccuucacagcuauucuguauaucugggccucucagaggugggccucuccuguuacaaguuauuaguacauuuagagaaugagugggcaagucuacuuaucugaaucagggcaaucuggcaucuuggcugcaagaaguguucaguccuggguuccugaagauccuugauguuuuagauucgccaguuggccuggugggacuuugcagcucccgacgauugcuugaaaaggugaucgugagcaguggaggaugagggauguaaaauaccugugcugugccccacgaggcacuggaguccauagucugaucuucacaggcaucccucgcugccuggguuuguaaauaaacucaccacauggucugcaagcacuggaauug

SEQ ID NO: 1647 - RNA, 5236 nt, Mus musculus
ugaaccaaacuuuccucagaacagguuuauuggccauaaugaaguucuauauacaaagugaccuaaaccuuagugacaaaugcuuuaauuccaggauguauguguuuaaagcaggaagaccauacauuugaagucagccugggcuacauaguucuaggccaugaugggcugugauccuggacuacagugacugucaccaaagagcagagugacaaaagcccaaacaauugcuccucucuaacugaugucuugguaacuggcugucauauaaauaagggaguccacauuggacauuaacugaauggccuauuucuggaacuuuaauaguuuuacaaaugagcugagacaggcaugacugaaucccggugagaggccacuggagagcugacaucagaugucaagaggccauuuugugcacagccacugugaugccaucguguuucuggaucauaauguuccugaaaagccaaaaagaaaauauucagcaaacucuuaaugcaugugucucaguguaagauuaaauuuauuuaguuuaaauauauuuauguuuagaugacagcauauuuaucuauauucucauacaaaaccaaauaugaacagucccuguugacagguguccgucaccaaccccuagugccauagccucuccauacuucccacccagaaaggggacuacauucucaaaccaagagccaagucuuccgcuaagaaacaugaauaaauaaauagcacagaugggcaugaacaguugaggauugugggcaaaucuaauuauaacauaaagaaauuaauccuuuuaauuaaaaaaaauuuuuaaaaaguaauccuuaacccuacuacucaacaugauucugauuuuuauuuuuuccuggagguuuuggugguauuguuggaguuagaaucuagagccuugcacaugcuaucacuagccuagccuccuuccugguccuaauuuuuagauuagauuuuuaaaaaauauauguaugugucuguccgugugugucauuauacacacuggugccugagaaggccagcgagugguguugguuccucuggaguuggaguuauaagugguugugaacuuccaaaugugggugcugggaacugacacagguccucugggagagugccaugugcuuucaaccacugagccgccuccccagcucuuaauucuuauuuauguuacuuauuuugggggucuguaugugugccacugcuugcaugacaacgucaggguguuugucuccucagucauguggguuccagguauggaguuccagucaucagacuuggcagcaagcacgucuauuugcuuagccaucuugcuggcuccugguucuaauuuuaauuuguauauauuuauacauauaucgauauuaauaucuucuuuuucccuugccccaaacugaccaaaguaugcauuuuuaaagguucacauacucuaucucugugcaggugugcacauacaggugugugcauguacacacaccuauguauaggcacggaggucagaagaaggugcuggguguccucuauuacugugcaacuauccuuugauguguggucuuaucccugagccugagccucauuuucucugcuacacuggaggacagccagcuccaacaauccucccaucucugcccacccccucgccccugacugagggcugagguugcagguguuuguugugugggugcugggguacuaguauauaagcucucauccucgggacuguggcucuuaagcacuggcauuucuccagccccacaguuuuguuuucuuccuuuuaucacuuagcaucugaauaaagaucuuuaucuaggaauaucuuuaagaccuuacuuuagggaauucuaugcagcuaaucauuuuuuguguuuuuacuguuuuuccuuuauuggaguggcaaacugauaguucuuauuuuaaugaaguucuguucucaugaggccuggauguccaauggcucuguggugcauugacuaaugaacuaccacugaaugcaggggaaagcccaaucaaguuuuucagaacaaaaagaaaggggugugcugguauguacucacccauuaucugauucuaaacauaccacagggaugucgguggggucagagguuagccuagcugccugcugggcuagaacagauaugacuccagcgugcucauccgacaggguaccacggccuagagaauagugagaagugucuaaaaauuaauauaaaccuauaguuuaguaucuccuccagaauuauuugugaaaaagaaacuccgcucacggccuuuuugccuuuagguuaaguacugacaagaaaggaucucucucaccugguacucagcugaguccauuagugagaaagccuggcaauuguucuuaaaucagcaaagucguaaacgacauguaguuuucagaguuauuccccucacuaucucuaaacaccuucucaagcauauaaggaagcuguaauucaagucaucugaugguaguaacuauuuuauaggaaccuugcugaaaccaagaaauucaaaggcgagagugacaaaaagcauucaguauggauaaggggcuuguugaugcuaauuaauuccuuaugggaaaucugaguuucucuuccuaugcucaaucucaaagaagcagccauuacucagaaguccaguuguaagaucaccuugccagcauaugugaagaccugugagcaacuauuucugcuagcagaagcuagcugggcuccuuucaaaugucccccgagucuuuacuauuacuuugacuuguauuaacuaaaucaggcucuaggcacaaaagguaaccaccaagcuuauuauagaucccugaaauaaagggguuuacuuacaccuaaaacuaagguaguagacaauauaaccuggcagaaauucuggauugacuauuacuacauaaaaaauccguaggccaaagugcagcccggaaaucuauuggaaauagcaacuucgcaccuugaagguuuuacuuaguuuuuuuuuuuccuccacauuugcauuuaaagaguuuucauuaguaacuuggcaaaugcuucaaaaaaauuuaccuuuguuccaaauggcugcuuuuuguauaagacauaacuauauuacuuuugucagguaucauaccagcaaaagaucagagcucuaaaaaaccugcaucaguuauaaggauucuuggguuuacuaguuucugacauuaauuaacuuuagcuauuuaccuuucuggacuuaguuccuuaucuguaauugcuacaauuuauugaacaccacacaaacacaucuugguucuguacuggguguuuuaagcuuuggagccagcuuuaaaaacauccuaucucaaccauucauuagguguuugacccugggcaagguacuuuuaagcuugcuaaauuucuugaccauaaagggcuuuggugggggggggggggcaggaagggggguuauguacguuuuauaaugaaaacacuaagaauagugccuggcugggcauggugaugcacaccuuuguucccagcauucaagggauagaggcaggcagaucucugugaguuacaggccagcauggucuacaaaguuuguuccaggacagccagggccacguagaauaaguuuuuaaaaaaaaaugucuuaagacaacacacacauaauguauguaugaaauaaaauaacccaaugaagaaacugaagccccaagaggcuccuucuguucggcacucauguugcuagcagacagcaucggagaaugggguugaagucagacgugucuaacuaggaaaucccuauuuuuacugacaauaacuuacuguugagaguggcuggacuagcagccagcaucauccauuuucaggguuauugaggcaauuaaggaaauaguguagccugacugugccugcacagggaaugcauucaguaaagauguccuuaucuaaagcccuuuucuagaccacuuaaaauuuauucaaaaccauuuuaguaggaacaguuguagaacugggaggaacauuucugccuuuaaaaugcaacugaaaggcuucaaccaucuacucuuacuuggagauagucucuaugcccuaaagguaacaggaauaaaagcuagaaaauaguagcaguguaaguuaaggcucucagaacuucaaagggaggcugguaggagacacuuacagcccagauuaaguccuugugaaucugugcauaggacuccaacaauggauggauucuucauucuaauuuugggagcacaagaaagaugaaccagaugaugugaagaaaauauuucaaauuacuguaguaaaacagauuuucuaugcaccgaguauuaagcacuucaaaucagcccuuaaauuuuuucgcccccuuucagaggacaaacugugaguuguuuaaauaaacaaaacaaaacccaaaccauuuucucaggcaccucugcuucacaaagacacaaacaaggcaguuaucuuuagggcucuguccuugguauagaagcaugcucuaggacugcaacuccugaagacaacuguuaaaucucaguaacgggaauugcuccuggaggggauuaagaagcucaaggaggaggugucuucuuguaagccacuuuacaccucccaauuuuaaauuuuacagagauagcugaaaaacuuuacggauauauuuacuucacaagcgcugagcaacugacgggccacaaacgcgggaagaugugcgugaaagugcuuuggcacugcgggggcucgauuuagcacacccggggcauccuuccccaaacuuaauccguuucccaaacuucucaagagcuacucgauucugcgaacacgccuaacgaaacuuuacuacccaguaacgagcggcccggccguaggcagaagucacccgcucgccgccccgagugccccaaacgcuuccgcagacacucgcgguccaugccgcugucccauuccagcuccccuguccggagcccaggaccggccgcacgcacuacucacguguccuccaaaugcugcuccaaagucgccuccaucccgcaggcuguccgccccaggccaggaccccgcagcaaaacacuuccuccuucaccgcaaaccucgaucacgugacuugaccgaggcgggcgccuggacggcgucuccagagggacgaaauucagcgcggcgccgcguccgcgcucuuuacgaaaaggcauagcuacuaccacaggaccagugauggcuggcuuucgauugggggugcugggccuucaaag

SEQ ID NO: 1648 - RNA, 21015 nt, Mus musculus
ccucccucaggaaguaaaguccacaggcaggagcugcuaaaccucagcgcugcccccgcuugacuacagugccugguuguuuccaccaagcagcggaaugggaagccuuagaaagagaguaacguuuuagggaaaauaauuuuucaccugaaauuuucuugucucuagaggauucauuugcuuaaagguaaggugaaguggaauugaaauugggugauggguuggucuucucagggaccuggaaugacuagaaucucucugucuagaauuaucuaauagaaaucucucccccuacacacacacacacacacacacaucucacaacuggcaucuuucugucuaaucuaacagaccuuacuuuuuuagacacuaaacacacacacaugcgucgcauacacaccuggcugcuuucacaaggacagaugaggauaacauccauuccucagaacacguucuuucucaauauguggguauuuauuuacucaacucugucugaaguuagcacacuaugacauucuaaucuugaaugcuuagcaucucucuccuaagguggagacuagucuccugcagaaucauaaguucaccaccacaaccaaaauauuuaaccuauuuaguacccucuauuucaaaucacucauauuuccuaagugggcuucccaauuuguuuuucugaucuaguauccucuaaagagauaaguuacuuuguugggcuaucuaguucuuuaaaauaccuaagcuccauaaaaaggggcugucuaaacccaagagcccccucccauuuaacuuuucuuuagauucaagggcugguucacaggaauggauggguaacacauggcuuccucuaaaacuggcuuacagcugauggagauccugagcacaaguagaguggccauucccaucagggacucgagguuauuaacaucaggcagacuucacguaacuaagggggaacggaaaagugaaaaguuucauaccauggaacaaaauaaaauuuaauaguuuaacaugcacaccuauaaucgcagccuucaggaaguaaaggaaggacagccacaaguucuaggccagguggagccacaaagcaggucuuaaaaccaaccaaaaagacaaacaaaauaucccacuuacaguuagauuacuuucuugacuacugaaucaacuguuuugcaucuguuccagugaucuccgcauguagccuacaggaagcaucauggugaagaaggaaaaaacgcccuccccuuacaccaaaccccuugauggaggauggggguggauggucgugcuucauuuuuuccugguaaguguuucuuuccccuuuccaagugcugaacuguacgaagaaaagcucaaagcagucuaacaagaucgaugaaggaaucuugagauuugaguagacaggaagccaggaacuugcccaaacugcuaagaucagaggccaccuuggcugaacccagaagcugagcuguuuguuccccugagagaaaggagaagccuucccauccaggccucuccgcugccucuucaucaucucucaaucagagaaugcuccaggcauggcuggcaguucuacuuuggcagaauggcaacugggauuuggggacaucguauuuucgacuaaguaagagcuagcacaggucauuccuagaaaguacucagcucugccaggugugggagaugcuuagaacuccagcacugggcaggguugaagggaugcaagggaggcaagaugauugcugauaguucaagacuagccagucauacauguuaagauuuuaucuugaaacuaagugcccacccacucagccuaacauguacacaauacuucagaccacucaugcuguuuuuagcuacuugacacaaaccuguaugcaucuggaaagugggaaugucaacugagaaacugcuuccauugggcuggccuguaggcaaguuugugaggacauuuucuuggugaaugauagguuuggagagccuaguucacuggcaccccaggacaggugguccuguguuguuuaggaaaacaaacugagcaagucagggaaaacaagccaguaagcaguauuccuccauagcuucugcuucagaucuugcucugacuucguuauggucuauagccuguaagcugaaaggaacccuuuccuucccaaguauuucaucauagcaauagaaagccagccacggcaguccccuucauuaguagggguugaggauaguucagucugcugccccccccauaacuuaaacucgaauuauacucuguaucugacauguauuguaaggaaagacuucuuacccucgccuccgagacacuguuggaguugcuaucuaaaaaaaguagugauguacauuacccgcaugucuguucuagaacacugguggaucccaucauagcugcgccacaaauaacccugugcauaguggucccagcccuauaacucuuaagcaccccuagaucauuuucuuaauuuugagacacacucacaaagacacuucuuucuucuugacauuccugcccugcuuggauuuacaguaagcagcccacaugauaggaacacaaguccagaugagugacaacaucaguaugaaauugaaggugggaaaacauaaugcuuuacuccucccuaaugauagaaaagagggauggaggguagagguccuaagcuagaccuguguauuauaaaacuuaccaaauaaagcacaauuuguugaauucuggcuucauuacugaagaacagaauuucuucuccccuuccauagaaacauuaauaauagggaagcuaaagaugccuuaagcccgagagcccugccugguugggccuccucucaaaugguguaugcuguugguguuggagucugguucucccacccuuuuaugcauuauuuucaauggauaacaaguuauuugauuaguuacugcuaauuaaaaguagcuaauaaucagguuaauaauguuacuugggcaacaugaugaugguuauuggagcacauaaauauaccaaacuguuagcaaugaacucagcucacugcucauagggauaauauacauccuaacagggcaaugcauuuauuuccauguaaauuacaagugugcuuuuccguaagauuuaagcucccucaaaagugaaaaacuucucaguaugcuuugugagcuccuccacaaaagcaguuacacuguaacucaccauacuuuauauauauaacuguuucugggcuuaguaugugucuuaguuaggguuguauggcugagaacagacauuauaaucaaagcaacuuuuguaaggacaacauuuaauuggggcuggcuuacagguucagagguucacuccaguaucuucaaggcaggagcauagaaguguccaggcagguauggugcaggaagagcugagaguucuacaucuucaucugaaggcugcuaggaaaagacuggcauccagggagcuaggaugagggucuuaaagcccacacccauaaugacacacuuccuuaaacaacccacaccuacuccaacaaggccacacccccauucccugggccaugaauauucaaaccaucacaguauaucuuaccaaacuguucagugcgguuagggaaccacauuuauacuguucaucaguguugcguucacuauuguaugccuacucugaauauacagccugagacacaguagccacucauuaaauaccuucuuuuuuuuugacggggguggggaggacuaauuuauagacacauuuauaagcagcagccaagaggauggaugaagucagagguggagagaggcuacugaaaacauguuaagaaccacgugugcuggcacaguuacgugugauccaccuguaauugcagcaacugggaggugauggcaggaggaacucaaguucaaagucaguuggggcugcacugugaaauaaucucggaaagacaacagagagauuaagacaauugguuguucugagguuauguaguuuuagugaggcaagguaacuggaaaaguacuucaaauggaccuggacacuggguauccauuggacaagcugcaauacaggcaagaaaacgggcccuagauuuaacccaguauccagaaguaagugaaaaugcagaucugagcauuuugggaggacagaccacuaaggugugcagaggaauaugagagcagggaaucagaguccagaaucauuaguuuauguacuuugauaaguuuugaaugauggucacuagaguuaaaggaacagaaggaaaaauucugaacaguuugaaugguguaaucuuggacaaagucuaaggaacuuacaaccaagaacguguuugcuauagucuuugugcaccugaaguauauagcaaccugugucucuaauauacacaguuuaacuuuaaagcuaaagggauaggacaaaauugggggagaucauuguagggacgaauggaaucauccacagaggaaacaagagcagaggaguaggcagauguuuaggaauuaucaggaacaaugauguacggccacugcugaggccacaugauagaaauggcaacaaucugacuuagcaacaaggaagucuuugagaauuuuggucagagcacuuagguuuucaguggaauacuucaauuagaggaagaagacagagcagacuuugaagaaacuuaucuaugaaggucaggauaagcaaauaagcuaagauaaccuuacagaggacuggaaauaaaaagagcuguuauuaaauaaaauuaaccuugacaacaggcacucuaauuucaaaaugaguaucguggcugaucuagaucacacacacacacacacacacacacacacacacacacacacacgaauguggggguggggaaaggcgguccacuuuauccucuuauggguccaagaaaaugaacugcuuugccagguguuguggcccacgccuuuaauuccaggggcacuugggaagaggaggcagguggaucucugaguuugaagccagccugguuaaacauacacacaccacauggacacaggagauugggggggagggguuaguucaaggacauccaugacuauacagagaaacugucuugaaaaacaacaacaacaaaaaagcaacaaaaaacuaaaugcuuuuaaguuggaaauuagggguuggacuauuccuagguuuuuguuugauuuggaguuuaggcaauuacaaugucugaugaagcaggacugaguccuaccaaccuuaauccaaggcauugggaucaagacuuauguagucugccugguuaacuaagggaaaauacagauacugggaaaggucuuuaguaucuuuuuaagguagaaauagaaguuaauuaggaaguuaaaaauuagagagggcuggcugggcagaugcuagagcucugccuuuguguuccugauacucagugaacagacaacacaaccuguuauugagcacccauuucacagcucucagagacagacaucaggaagagaacaaggaaaaguuccaauugaagaccaacagccagccaaauucaaaagauuaacaauagagguacaccagaagugguggcauaugucauaugucuuuaaucccaguacuugggaggcagacacagacuucaaggccaucccuggucuucacagugaguucuagggcuucaaagacagauuguuucaaaaaaaaaaaaaaaaaaaguaaaagcauucucuacauacauagcucacgcacaggcuaaaggcuaaaggcuuacagaaugaccccuuacauuagugguucuuguucacaagaagguacacuguauuuugaccugaaauaagucuagaacauuugguaguuacauuuaaugguacaauuuauuauuuuuuuaaaaagauuuauuuuauaugaauacacuguagcugucuucagacccaccagaagagggcgucagaucucauuacagaugguugugagccaccauguggcugcuggaaauugaacucaggaccuucagaaaagcagucagugcucuuaaccgcugagccgucucuccagccccccaauuuuuuuuuaaagaaaguuauauugugggugcuagaucugaaccuggguauucuggaagugcaacaagugcuuguaacugcuaagcuaucuuuccagccccaaguuucauuucguacuugcuuucaagugagaaugagaaaaacauuuaggauucuuuuucuuaggaagccuccuaggcaguugccaauucucgaccucuugccuccagauaagaaauacuauucugaaauaagacuagaaaugacgauuaaagcaggguaggaguggcuagaauccuuuacaauuaggaguugaggaaugguuauauacaaacagguccgucccccccccacccccccuuaaggcaccuguaauaacugccagagacagaauguaaaaagagaguaguggggagucaagucagccuaggaucuaaaucucagugccuguaccaccacuggcaacuuuucucuuaaacuucaacucucacuauaaaacaacagugacauauccuuuucauaagcuugaaauggggacuaaaugagauuauuuccaugaaucuguccugacacuuuagagaggaaugaacugcuucucccacccccuacuauaaccagaaaccaccaguaagacaaaugagcaagcacugagaugcuggagcaauagaaccccugguaacacuucuagcccacuuugcaccuaacaaggacucuguauguuuugauuuagguaaauguguuugugaugggaaugaccaagacauuugcaauuuucuuugugguuuuucaagaagaguuugaaggcacuucagagcaaauugguuggauuggauccauuaugucaucacuccguuucucugcagguauggaguaggcaauaagcuugcugucuauggagaaugaccacaaagguccaugacaacaccaucacuccuuuagggcugaaguaauguacauucaaguucaccuauuaauaugcauuaauaucaauauguaauauugaaagagacaucaguguuuacgcucuauuuaacuugguaauuaaguugggaaaauuaagguuaaaaaggaauuaaggucagguguugguggugcucgccuuuaaucccagcacacgggaggcagacgguggaucucugaguuggaggccaaccuggccuacagagcaaguucuagaaugccaaggcuauacagaaaaacauccaucuugaaaaaagacagggaaaggaaaaaggaauuaagaauccaaguauuuaauuaaugauugauguuuuugcaugccuugugguuuuuuuguuuuaugucugguaaggcuuuaaacccagagagccaagacuucaaccugcaagugaaaccauucagcucuaacuaugugaucauauucaaaauaaacauuaaaccaauuucuccuuuaguucuaguugguguaauauggagauuagcgaugcaaauuuguacuaaacagaggccacuaguacaaacaugauuuuauuucaauuuugaauauacaauaucuuauaccaauugucuugcuuuccucugaucacucagucaaagaacacacagggccuaagggaugucugaggauauuaacuuagcacuuucccuuucuccucugaagguccccuggcugcuaucaucugugacguacuuggagagaaagcuaccuccauucuugggacguuccuugucucugguggcuaugucaucagcagcugggccacaggcauucccuuucuuugugugaccauggggcugcuaccuggugaguucacacucaauaguccauaaaggauguaacaggaaacuguccugcugcccacagaucuuaaauacauuaucucaucuacaucaucugaucugauaacuaaugaucuaauuucaaacuuuuuuuuuuuuuuaaagguuugggaucugcuuucuuguaccaaguagcugcugugguaauuaccaaauauuucaaaaaacgauugggccuuucuacagcaauugcccguucuggaauggggcugacauuuuuguuggcacccuuuacaaaauuccucauagaucuuuaugacuggacaggugagucagucuacauuucuaaacuuucaacacaaaaaacguaauguuuagcccuccuuuugaauacuagaagugaagcuuuaauaaauuccucuuccuagauccaaggucacuauguaugacacacuagcaggucuagaacucaugacaacgcugggauuacaggccaccaggcaccaccauguagcacugaagaugagagagggaaauaaacauauuuaaugggaacacaugccauuccuuauaaggaagaaaucuuccuauuugccagcccaacucaagaauucucuuuucagaauuccaugcaugaggugcaacuagaaaugcugugcaguaaaagcuuaggaaaacaauguuuucucuuuuuuuccaaucuuuucacuaaagcauccaaagaaaacaaaacaaacaaacaaacaaacaaaaaaacaaaacaaaacucugcauuuaaaaacaaaucuaagcauaaauggacuauuuguaaaaagauuauguuccuaccagacaauuuuuauauauauuaucaacuaggaauuuucacaaagccauuucauaauuuucuaucuuaaguauucuagugaaauguauuuaugucuauuucuaccuuuauaguaguuuugacuacucuucccuauguagaggacuauucaguaguuccacgguaaaugggaaccuccagcugauacgccucuagaaaagccgagacaagcuuguucucuccagaaacacuaagucauggcuuuguucuggacauccuaaaaccaaccaaguacucacaucaaaggcaagaaaggcaagacuagcaugucuucaagggggaaaaaaaguccgaauggcuuuuucuaacacguuuucccccaugauuccugacagcuaguucuauauucccuacaccaaaauccagucacaauauauuuaaaauaccuauuuaaaauguaaauuugugccaucagauuauuacccacuucccaauccccuaacuuguccuuuagcaaaaaauaaccucuuuucaauuuccugguuuuccaauaucuaaaguauuacauuuuugcaccauguauauugucaauagaccuaagugguuucaguuaaauuugggaggcagggaaggagagauggcuaagcaguuaaaggcauuuugcuguucuuccagaugacuagaauuccauucccagaauccuuaucagacauuucacaacugccugcaaucccagcucaggggaugugauucucuucuggcuucaguggacccccccccccccaaacacacacacacacguuuuuuaaguagcaugggaggcaaaguaguauuuuuuaauaauuauuugacuauggagauuggccuccucccagccuaugaauagacaguagcaugagcugaaagacuauucuuauguucuaauuucucucuuccauuuaggcgcucuuauuuuauuuggagcaauuauauugaacuuggugccuuccagcaugcucuuaagacccauccacagccaaucaaacaacaauucugacauugaaaacaaagguagcauuuugucugcaacugaaccagaggcaucauacaagacagagacaucgaagugcaaggagacacaggagccuuucaucaaagacaguacuaugaagaaaucugaacaaccuaccacaaccuuaacugucuuaggaaaucaaagcgaagaguucagcaauaggccucacaggaacaggccguuacuuaugagcaauggcaaaagucacaagaaaaaguuuguuucauggaacugcaaacaaaaacuuuuagauaucucgcucuuuagaaacccuuucuucuacauuuuuaccuggucuuuucuccugagccaauuagcauauuucauucccacuuuccaccuaguagccagagcaaaaacacuugggauugacguaauggaugccuccuaccuugugucuguagcugguaagaaaaaugaacuuagcuugauaaaaguuuauuaaauuuuauuuuaaaacagaagcaaggaaaagggaagaaagcaagagagugacugugaguuuucugggguuaaacagaguaguguguauuucucagcagauuuggcaacugcuaucuuucagguucuagcggacccuaacucaccuuacccaccuucaggugucucacacaguagacaucaauuguucccugggaagaaacuuaauuucaaaggcuggugcuaagugucaacagcuaaucugggaaggaaaagcucagcuagaaaacaugguauaauaacgugaaggauugauucugaagcuuaacuucccaggccaggcucuugcuguuuguuuuuuguuuuggcugugugaccuugggcaaggcauucuccuccaggucaggauuuccuuuuccuauaggauaggcauaauacacugcuuucccucccaacugucagauuaugaauguaauguauauguaauguaguguagugccaggcuagcauaauguucuacugguacuuaaugcuaagcaauuuuccuguugaguuagucacuaauccacaggcuuguguuuaaaauagaauguauguuaaaaacacaaaaacaauuauucuauguaaucacaaaauguuggauggucaaauacuuaaguuguagauucucucaacugaccagacaggaagucugaaacaaagaaugagauugaauuguuuugcuccaacuggacaauucucaacauucaacuuaacuuuucuucuacagauuucuuggggagaaagcccuuacaaagcugaagacaccuaguuucaaagguucucacugaagaaagcuuccgucaaaaaaugcuguuucauaagaguagcuuugguuaaccauuuucuuuuacuguccgauagaauccauuuggaucagauuaaggcuauacaaauuaggccaaauaguguaauacagucucagugugcauccuaggagacuaauggagcaguuuguuugaaccccuaaaauucaaaccaacuugagaucauacuggcuuucucauacuucacaccugugaaguaguacuggaccacuaagccuucuauccccagcauuacucaugguucuguuuuugagacuuggucucaucauguggcucaaucugucuuagaacuuaccaugcagaccgggguggccuggaugaaauucacaagauaucuaccuuugccucccaagugcuggaauuaaaggcacucaccaccccuggcuucaugauauugacuuuugguauuuuuaacugguauuaugccuuagaauaggguaaacaguaacaaugcugaauagaaaaaaaaaaagugcuucuuaaacuuuacucauuacaccauaccaaaugacauauauaaacgacuuauguauuuucaaauuaacuuuaacaaccauuggaggccuuaaauuccaaaguuucauagaagagucccagugucuauauuuuuaauauaagauuuuauuugauuucucucauuucaccauaugacuccucgggacacugagguuucauauccucacuuguuggaccucuucagaccauggucuugucaacagggaucccacauacaauuagagaacauacaugacaacuuaaugguuucauauucagcuggaagcagcauccugguauuuuacuagguguuuuaaaaaguaagguacauauccuauuucacuaugaaaccauuuuucccuccuauccucuggccucaggauggcauccuacuccuugggcaaagacacuuagacacugacauucuuacaaaacagauugagugacuuuguauucacuguuccagguaucacugagacagucagucagcucauuucuggauggauugcugaucaaaauuggaucaagaaguaucaauaccacaagucuuaccucauucuguguggugugacuaaccugcuugcuccuuuagccaccacauucccacuccuuauggccuauaccauccuuuuugccauuuuugcugguggcuaccuggcacuaauacugccaguauuggugaguagacucauuccuuaguaauaaaugacucaguacaguaacagccuuccuaagaauucaaauuuuauauuaacuuuaugauuuaaaaacuacacaagacuucagaaaucuugcaguuaguuauauacugucauuauucaucuaaccaugugaggaacagaagcuaagaggacuaaccacacagaacaggauaaagaggaacacagagaccagcaagacuccaacucuccuuguguuuacuccucuccaugaggcuccaggggucucuaggucuugcuaggauacaaguauauaagucugcuaauaaggauugcaucugugugcugccuugaauccuauguacuuuaaggacauuguuuuaacaagaucucuauauuaagcucaaacuuaaauccugaacucaaauggaauuaaaaugguuuuuaaguuguguaggaaagugcaugaggcuuaggcaaaaaucccagguucccaaagaugaaaucaguuccuguguuaccagauuucuuauaaacccaugguugguaauaagccacagguggauucaacauuaauauaagcacagauugcaaaauacuauuuccuaauugagaaggaagaucauuaagguuugggagguaaaaacacucuugaacuauauaaaagguuaaucuaucuagaccaaacaccaauguucccccacugauaaacuaaaaacacuuacucugccuugccaauccuagcucccuaguugacaucuauucccuucccuaacacuggggaugaaaagccaacuaagggcuggugagauggcucaguggguaagagcacccgacugcucuuccaaagguccggaguucaaaucccagcaaccacauggaggcucacaaccaucuguaacaagaucugacgcccucuucuggagugucugaacauagcuacaguguacuuacauauaauaaauaaauaaaucuuuaaaaaaaaaaaaaaagaaaagccaacuaaaucaucccaggagucaaacuguucaguuugagugugguuuucugguuugguuugcuuugcuuuuaaugauauuugucaccgcuuuguaaacauaagacacuggagaaguucauccuuaaaacggcucacacuaaauucucauucccuacagguugaccuaucuaagaauucuagaguacacaaguuuuugggauaugccaguuucuuugccgggauagcuguacuuucuggaccaccaauagcagguaacaacuaagucgcauucugagcaaauuucaaugaagaaauuagaaaucuaggaucaauggcaacaguacagguuuaaaugcuauuuuugacuuuaccauguucgcucuacccugaucaccauacaggaaaauacgaaguuaauucuauaaauauguuuuacuuuacuggaaauaaccaguuuuaccuaaaugguauuuuuugcuugcugauuuaguuaaaaauuugaccugcacagaaaaaaaauuauucacugguaaaggcuuaaauguuaagauucucacagauccgaguucucaucuauugaccuuacugacugcuauaguguuuccacuguccauaacuaggaacucaucuuaaaauuaacuuuucuauauuuaaaccauuuauuuuguuuuugaaacaaggucucauuugcccaaguaggcuucaaacuuccuccuauucaccggaggaaccugaagaacuuucugacucuucuguucccacugagacuacacgugugagaucauuaccugguauaugcagugguggggaagcaaaucaaacucagggcacucaugcuagacaaauaaucugccaacugaggccagcaucgcuuuugcuacuuucagaccauaacugaaaacagugauuuugcccuaucguuuaaaaaaacaaacaaacaaaauauguauagugaugguaaguuuguauucuuauuuguuuuugaggcagggucucauguagccuaaacuggccuuaaacucacuacccuagaagaugcucgcuugaacucuuuuguuuguuuguuuguuuuuguuuuucgagacaggguuucucuguguagcccuggcuguccuggaacucacuuuguagaccaggcugaccucgaacucagaaauccgccugccucugucucccaagugcuggaacuacaggcaugccccaccauucuugguuucuauuuccuuuccuuuccuuuuguuuuucuaaaugaaaaagaacagacuacaacagagcaaauuagaaaacagaaucauuuuauugugauacuuucauguacacaccuaaugcauuauaaauuugcuuucgauaaaucagaaaaaaaaaaucuuuauagauuuuucuuacccaaagucuagaauacuuagaacuauauguaaggauaaauggaccuccuguauccacuaauccuaagaauuuacuuggacagucauacauuuucuaacaagucaaagguagugguuaggcuagcauuaaggccuucacugauuuuuagucuaggagucuguuguucacagcaucccaaguaagauaaucauaauacacaauggaagcuaucucaccaagagugauguuauguggcuaagcaccuaguuaaagggagagguuucgcggaguucucugauuucucuaaaucauuccucuauggcaugauaaagacaacuuuauaaagaccauuagaucucuuuccaaguucugacuuuagcagcaacuaccaaagaaauacuacaaauguuggcuuucagauuaacucaguucuuuggaaugcagauguaacucauggguggaccacuuaccuaaugcacaugaagcccuugaaaaccuaaacuaaaaacagguaacuugauuauuaagagguaugggaaacuaugauuuuuaccuuuaaaucuaaauguguauugguaaucuucaaagcuguaagagauucucauuuuuacuuacccauaucuauuaacaaaugaaaagcugaaauuccuauaaaagaauauaggcauauuuaaguaggaaucuggcaaacaguaaauccucagucaaaauguuuguuuaaaaugguaccaaugaguaaauaaacaauauacuuuucuuuccuguaugggaaugaaaaagaaaagaaaaguuaguucuuuacaacauuuuaauaauucuaggaaagaaaaaaagcauaagaaaaccauagaaaucauguaauuuuuaacaaaacuacacaauuaaaaaaaucuauagcgaucacaugggcaauauaauuauauaauuuaucauuaugacuaugacaagaaauauagcagcagcaaaauuccuuaaggcaagaauucaaaggacaagaagccaaaagccucccacuccccacauguacuccuccccacaacauuaccuuuuuccucuccaaccagauucuuucuauccuucucuauaacuaguaugaaauccaauuuuauuuaauaauauggcucaaaucagacccagcuuccuagcugaggguguuuagcagacuaagaguagguuaaaagucacagugcauucaaaccugcuagguuuaugcugguagauaacauccagaauuccaccuuagcaccaagauuuuagcuuugaaaggcuguggggaaauaggaauuauuauuugaaaccuugcuauauuucuaguaaacucuggaaucugccuucuuuuacauccaauacugaacaucugaugaaauagauauaacccuaacucaucuauuuccuuaacuugaaauggguaugggacaauucaaauguuaaucagucauuucauaagacaaaccauuuuggacaaacgcuaagaaaaccuuuaaauucuuuuugguuuucuaagacaaggucucauuguauagugcaggcugccuagaacuugcuauguaguacagagugacccugacacaagauucuccuacuuuuuaagugcuaagauuauaagucaaagacgacagagaaacugguaaucuuuuacuagcucugaguauuacaggaaaagaaauccaaccaaggagagguuucagucccuuuaacaggaaagcuauguuauaaacuggcaggcuauuccuauuuccagucuagcuucaguucaaauacaauauugaacaaaacuucugaucccuugcucuaccauuuaccaaauuaacuucaaaaguuuuaucaguuaugcugacuuacagaauuucuuaggagaaaagauaacucaagcuucuggucuguuauaguuccagugaggagacuagaaggaauggaagacaagcgagauggcagagcaaaguucucugucuggacaaauaaaagggaauacacuaacgcuggagaauuuguaaacuguucauuaucaggugguuaauuucccuccaaccacaccacccagccagcuucacucugacucagcauuccuaagauugaugaauaucuaugaaaacaucaaaaauaaauuucaaauggcucuauugugguuuaaaagguuugcaaaagccaagacuagagugucaaaaugcuaauccucuaauaaaacagagcacaaagccaaugcuuaaguggcccuacuaaaucuuacuguaaauuucuaucuuggggccuucagugaguuccuaucuuaaaaaggccccaagauuuuaauuugcuaacacacauuucccaagauuuauucauuuaauggcauauacagaacacauaaauauuuuacaacacaaccaagagauaaaacugcuauacccaaccaguggcccugagagacaaaaagaugagggucuuaccaggcauagugguauacaccuuuaauuccaguacuugauaggcagagcuaauagaucucugugagacugaggucacccuggucuagacagcuagcucuaggccaccaacugggucuaucuggugagacccacaucucaaaauaaagaaauaaaaucacuguguccauacaccuuggaaguuugccacuaugccuccuacccaacagaggaagcucucauuaaacaggccagucucagaauuuucaguuucauaguugaaguaccaaggagcuuugggauaaggacuuccuggguauauuucaaguuguaacauguugauaaauggaaaccuaacagcaagccuaacaggauuccuuuuuucuucuuuguuucuuuacuuugugaguauaugugugugaacaugugugcugacagagagcagccuauggggagucaguucucuucuuccaucacaagucccagggauauaaaguucaggcugcuaggcucuguagcaagagccuaccuguaaagccaucucaucagcccccuaaaagaauuauuugcuuaaacaaauucugaaacacaugguaaugaauacuucugagcauauuaaauuccuuuuccacaacuuaacucauaaaaucuuaugcaaaguuuauugguugacuaucuuaaaauccaaaauaauaaaucuuuggugggggagugcuaugucauaguggcaaauuuuccuaccauaaguuugauucaugcacaaaaauauuaaaaauauuacauaaaauuaucuuuagugagagagaugauggcucagcaguuaagagcauuuguauauagcccuugcagaaggucaagaucaguucucagaauccauacagugcuucacaaccaucuguaacuccaguccacaggauccaauacccuuuucugaucucugaggcaccaagcauguaugugguacaccuacauacauacacacauuuuacaccugcaugcaugcaugcacacguguacacacacacacacacacaggcaaaauauacaaacauaaaaagaugaacacauuuuuaaaaauuaucuuuaggcuguguauaaaaaguacacaaaacauaaaugaauuuucuguucagacuugggucccauucacaccuuaucagcauguguuaaacacaauacuugcaauacuagguaucuucgauaacccuucuuagccauaacaaucaagcucagauuuaggggccuaaacuaggggccacuuaggcaaaaauuuuaggcaaaaauucaaucuugaauaguauuaaaacuuggaguagugaaccuuugucuaccauuaaaaauuaaagauuuggcucuggaucucaauuagaauuuuaaagauauuagcaucucaauuaacaaguauaaauagguagaauauucaaagcaaauuauuucauccaacuugaaauaugucaaaugacucccuuuucugauaaaaauauuaaaauauuuuaagcccuaauguuucagacauaacauucucuuuaaaagguguguguaaaagaaaagcuuagaaaugauuugcucugaacuaacugccaucugugcuccugucuacuagcacuaucaacaucacuagcaagaacccccaguucuuuccaauaaugcuaacaucugauaaccaucagaaagucacaggacauauacacauacagaggagguaguccugcuccaucuucccuccuuucuagaaaauucccuagcucagauuagucaccuguuucuuagggaguuauaggucauucauguucauagaacacaaagacuuaucauccuagcugaccucacuccacuccuucauuaguccccaagaaacuuaacugagaggucacuaaucaaaucaagaaucaguaaacaaauuccuaaaguuagcugaauuuaaagggcuauaauuuacaugccaauucauguauuacauaaaauauaggaaacauaaaaccaccauaaaaaggggcuggaguauagcuaaguaguaaagcauagguuugccaugucuguacaugaagcccuggguucaaucaauacccagagccaacuaauaaaaaaaucauagggcuggagagauggcucagcaguuaagagcacugacugcucuuccagagguccugaguucaauuccuagcauccacaugguggcucacaaccaucuguaaugggaucugaugcccccuucuggugugucugaagacagcaacaguauacucauaacuaauacauaaauuaaaacuuaaaaacaaaaacaaaacuucaaacccuggaagucagagcuaaacaagaaaaugaagaaauggcaauaaacaauuacacuaaaugggaguugggggugggaaaaaaaaaaaccaaaaaaaaauaaaaaaaaaccaaaacaaaaaaaaccaacaauaacaacaaaacauaaccaaacaaaaaaacccuguaagcagagaguguuuccaccccucucuucaccaguaauaucaucugcaaucccagaaccaaacaagcauacauaucauuaucuuuauaacacuaagauguuuucagaguacagacuuuuuguuuguuuguuuguuuuuugagacaggguuucucuguguagcccuggcuguccuggaacucacuuuguagaccaggcuggccuugaucucagaaauccacccgccucugccuccugagugcugggauuaaaggcguucaccaccaggccuggcgaguauagacuuuuuauauggacauuuaaauauugauuucuugcuaucgcacagugaaacaaacacuuuuaagaagauguuuuacuuaaguucuaauagaugccauugaccaaaagauuucaaggcuucucuuguucuuauuuuaaagagcauccaguuaggaauauagcucagaggcaguuuuucaggaagaacuccuuugcuuuuugguuuagcacauuuaucaagcaguucuuucucaugugaucacagcccccacuccuuuauagaauuuaccaaauagauauuuuaagugguuacuaucuacuuuccacuaaaacuauaaacuuugagggcucaguaaagguucagucucuuuuuuucuuugaaacaaaacgacuuauuuacgguuacuuuccuuauaagaaggaacagcagucucuaauaaucaccauaaagugaagugcugugucccuaauuuucuccaguuucuucuacccuaagacauguuuuuggagaccacaaugacuuuuguauuuaauaauguaaguuucuauucagauaaaaugauccaguuucaagacaggugagaagcccuauuuaaguccaauggcucacaauauggacugagaacaggagacauuuuccuucaaagucuuaagauuuguuugagaguaacaaaaguagggaucacuucauuaacagaaaucauuccuaccuugcaggcuggauauaugauuacacacagacuuacacaggcucuuucuauuucucuggcaccugcuauauccucucuucaguuucccuuuuuuuuguaccacuggcugaaagauggaaacgcaaacagucugaccuucugaggacuacaaucaaguaagagccuaacaaacaaaaaucuaaacaagcuacuguaagcaaaagcucagaagaaaagucuuuguuaagaaagcaagccauagaguuuuuaagauuccuuccuacuuucuuagcacugccaggaaugucaacugguggaaggaguaauaaaugaguaauaaaggagcaacaacuuaaauguaaucaaacaggcuacaaacugaauccauugaagcagcuccuuuacuauuaaaugaaaaucagaauguacuguaauaaaucaauccaauuuuucauuugugcuaugguaauucugucaccaaaauauguaacaauuauaaacuauuuuuuucuuuuauuuaaauauagucauugguuaacuagaucucuggaaucugaauaaagccuuauuuagugacaagaauaauacccucuccaaaaaaguuuauuguuguuuauucauuauaaguaaucuuguuuucuuauuacuuugucuuuuagauuucuauaguguacugcuaucuaauaaaaauaaaauuugcuaaaauaaucuuuauuugaucguuugaaugguauuacuguccaucuaaacaguauuaucuuuccaguacauuaaauuaucuaaaauauuuacauuaagcaccuacacgacucuucagagcuauaaguuucauaugg

SEQ ID NO: 1649 - RNA, 21015 nt, Mus musculus
ccauaugaaacuuauagcucugaagagucguguaggugcuuaauguaaauauuuuagauaauuuaauguacuggaaagauaauacuguuuagauggacaguaauaccauucaaacgaucaaauaaagauuauuuuagcaaauuuuauuuuuauuagauagcaguacacuauagaaaucuaaaagacaaaguaauaagaaaacaagauuacuuauaaugaauaaacaacaauaaacuuuuuuggagaggguauuauucuugucacuaaauaaggcuuuauucagauuccagagaucuaguuaaccaaugacuauauuuaaauaaaagaaaaaaauaguuuauaauuguuacauauuuuggugacagaauuaccauagcacaaaugaaaaauuggauugauuuauuacaguacauucugauuuucauuuaauaguaaaggagcugcuucaauggauucaguuuguagccuguuugauuacauuuaaguuguugcuccuuuauuacucauuuauuacuccuuccaccaguugacauuccuggcagugcuaagaaaguaggaaggaaucuuaaaaacucuauggcuugcuuucuuaacaaagacuuuucuucugagcuuuugcuuacaguagcuuguuuagauuuuuguuuguuaggcucuuacuugauuguaguccucagaaggucagacuguuugcguuuccaucuuucagccagugguacaaaaaaaagggaaacugaagagaggauauagcaggugccagagaaauagaaagagccuguguaagucuguguguaaucauauauccagccugcaagguaggaaugauuucuguuaaugaagugaucccuacuuuuguuacucucaaacaaaucuuaagacuuugaaggaaaaugucuccuguucucaguccauauugugagccauuggacuuaaauagggcuucucaccugucuugaaacuggaucauuuuaucugaauagaaacuuacauuauuaaauacaaaagucauuguggucuccaaaaacaugucuuaggguagaagaaacuggagaaaauuagggacacagcacuucacuuuauggugauuauuagagacugcuguuccuucuuauaaggaaaguaaccguaaauaagucguuuuguuucaaagaaaaaaagagacugaaccuuuacugagcccucaaaguuuauaguuuuaguggaaaguagauaguaaccacuuaaaauaucuauuugguaaauucuauaaaggagugggggcugugaucacaugagaaagaacugcuugauaaaugugcuaaaccaaaaagcaaaggaguucuuccugaaaaacugccucugagcuauauuccuaacuggaugcucuuuaaaauaagaacaagagaagccuugaaaucuuuuggucaauggcaucuauuagaacuuaaguaaaacaucuucuuaaaaguguuuguuucacugugcgauagcaagaaaucaauauuuaaauguccauauaaaaagucuauacucgccaggccugguggugaacgccuuuaaucccagcacucaggaggcagaggcggguggauuucugagaucaaggccagccuggucuacaaagugaguuccaggacagccagggcuacacagagaaacccugucucaaaaaacaaacaaacaaacaaaaagucuguacucugaaaacaucuuaguguuauaaagauaaugauauguaugcuuguuugguucugggauugcagaugauauuacuggugaagagagggguggaaacacucucugcuuacaggguuuuuuuguuugguuauguuuuguuguuauuguugguuuuuuuuguuuugguuuuuuuuuauuuuuuuuugguuuuuuuuuuucccacccccaacucccauuuaguguaauuguuuauugccauuucuucauuuucuuguuuagcucugacuuccaggguuugaaguuuuguuuuuguuuuuaaguuuuaauuuauguauuaguuaugaguauacuguugcugucuucagacacaccagaagggggcaucagaucccauuacagaugguugugagccaccauguggaugcuaggaauugaacucaggaccucuggaagagcagucagugcucuuaacugcugagccaucucuccagcccuaugauuuuuuuauuaguuggcucuggguauugauugaacccagggcuucauguacagacauggcaaaccuaugcuuuacuacuuagcuauacuccagccccuuuuuauggugguuuuauguuuccuauauuuuauguaauacaugaauuggcauguaaauuauagcccuuuaaauucagcuaacuuuaggaauuuguuuacugauucuugauuugauuagugaccucucaguuaaguuucuuggggacuaaugaaggaguggagugaggucagcuaggaugauaagucuuuguguucuaugaacaugaaugaccuauaacucccuaagaaacaggugacuaaucugagcuagggaauuuucuagaaaggagggaagauggagcaggacuaccuccucuguauguguauauguccugugacuuucugaugguuaucagauguuagcauuauuggaaagaacuggggguucuugcuagugauguugauagugcuaguagacaggagcacagauggcaguuaguucagagcaaaucauuucuaagcuuuucuuuuacacacaccuuuuaaagagaauguuaugucugaaacauuagggcuuaaaauauuuuaauauuuuuaucagaaaagggagucauuugacauauuucaaguuggaugaaauaauuugcuuugaauauucuaccuauuuauacuuguuaauugagaugcuaauaucuuuaaaauucuaauugagauccagagccaaaucuuuaauuuuuaaugguagacaaagguucacuacuccaaguuuuaauacuauucaagauugaauuuuugccuaaaauuuuugccuaaguggccccuaguuuaggccccuaaaucugagcuugauuguuauggcuaagaaggguuaucgaagauaccuaguauugcaaguauuguguuuaacacaugcugauaaggugugaaugggacccaagucugaacagaaaauucauuuauguuuuguguacuuuuuauacacagccuaaagauaauuuuuaaaaauguguucaucuuuuuauguuuguauauuuugccuguguguguguguguguguacacgugugcaugcaugcaugcagguguaaaauguguguauguauguagguguaccacauacaugcuuggugccucagagaucagaaaaggguauuggauccuguggacuggaguuacagaugguugugaagcacuguauggauucugagaacugaucuugaccuucugcaagggcuauauacaaaugcucuuaacugcugagccaucaucucucucacuaaagauaauuuuauguaauauuuuuaauauuuuugugcaugaaucaaacuuaugguaggaaaauuugccacuaugacauagcacucccccaccaaagauuuauuauuuuggauuuuaagauagucaaccaauaaacuuugcauaagauuuuaugaguuaaguuguggaaaaggaauuuaauaugcucagaaguauucauuaccauguguuucagaauuuguuuaagcaaauaauucuuuuagggggcugaugagauggcuuuacagguaggcucuugcuacagagccuagcagccugaacuuuauaucccugggacuugugauggaagaagagaacugacuccccauaggcugcucucugucagcacacauguucacacacauauacucacaaaguaaagaaacaaagaagaaaaaaggaauccuguuaggcuugcuguuagguuuccauuuaucaacauguuacaacuugaaauauacccaggaaguccuuaucccaaagcuccuugguacuucaacuaugaaacugaaaauucugagacuggccuguuuaaugagagcuuccucuguuggguaggaggcauaguggcaaacuuccaagguguauggacacagugauuuuauuucuuuauuuugagaugugggucucaccagauagacccaguugguggccuagagcuagcugucuagaccagggugaccucagucucacagagaucuauuagcucugccuaucaaguacuggaauuaaagguguauaccacuaugccugguaagacccucaucuuuuugucucucagggccacugguuggguauagcaguuuuaucucuugguuguguuguaaaauauuuauguguucuguauaugccauuaaaugaauaaaucuugggaaauguguguuagcaaauuaaaaucuuggggccuuuuuaagauaggaacucacugaaggccccaagauagaaauuuacaguaagauuuaguagggccacuuaagcauuggcuuugugcucuguuuuauuagaggauuagcauuuugacacucuagucuuggcuuuugcaaaccuuuuaaaccacaauagagccauuugaaauuuauuuuugauguuuucauagauauucaucaaucuuaggaaugcugagucagagugaagcuggcuggguggugugguuggagggaaauuaaccaccugauaaugaacaguuuacaaauucuccagcguuaguguauucccuuuuauuuguccagacagagaacuuugcucugccaucucgcuugucuuccauuccuucuagucuccucacuggaacuauaacagaccagaagcuugaguuaucuuuucuccuaagaaauucuguaagucagcauaacugauaaaacuuuugaaguuaauuugguaaaugguagagcaagggaucagaaguuuuguucaauauuguauuugaacugaagcuagacuggaaauaggaauagccugccaguuuauaacauagcuuuccuguuaaagggacugaaaccucuccuugguuggauuucuuuuccuguaauacucagagcuaguaaaagauuaccaguuucucugucgucuuugacuuauaaucuuagcacuuaaaaaguaggagaaucuugugucagggucacucuguacuacauagcaaguucuaggcagccugcacuauacaaugagaccuugucuuagaaaaccaaaaagaauuuaaagguuuucuuagcguuuguccaaaaugguuugucuuaugaaaugacugauuaacauuugaauugucccauacccauuucaaguuaaggaaauagaugaguuaggguuauaucuauuucaucagauguucaguauuggauguaaaagaaggcagauuccagaguuuacuagaaauauagcaagguuucaaauaauaauuccuauuuccccacagccuuucaaagcuaaaaucuuggugcuaagguggaauucuggauguuaucuaccagcauaaaccuagcagguuugaaugcacugugacuuuuaaccuacucuuagucugcuaaacacccucagcuaggaagcugggucugauuugagccauauuauuaaauaaaauuggauuucauacuaguuauagagaaggauagaaagaaucugguuggagaggaaaaagguaauguuguggggaggaguacauguggggagugggaggcuuuuggcuucuuguccuuugaauucuugccuuaaggaauuuugcugcugcuauauuucuugucauagucauaaugauaaauuauauaauuauauugcccaugugaucgcuauagauuuuuuuaauuguguaguuuuguuaaaaauuacaugauuucuaugguuuucuuaugcuuuuuuucuuuccuagaauuauuaaaauguuguaaagaacuaacuuuucuuuucuuuuucauucccauacaggaaagaaaaguauauuguuuauuuacucauugguaccauuuuaaacaaacauuuugacugaggauuuacuguuugccagauuccuacuuaaauaugccuauauucuuuuauaggaauuucagcuuuucauuuguuaauagauauggguaaguaaaaaugagaaucucuuacagcuuugaagauuaccaauacacauuuagauuuaaagguaaaaaucauaguuucccauaccucuuaauaaucaaguuaccuguuuuuaguuuagguuuucaagggcuucaugugcauuagguaagugguccacccaugaguuacaucugcauuccaaagaacugaguuaaucugaaagccaacauuuguaguauuucuuugguaguugcugcuaaagucagaacuuggaaagagaucuaauggucuuuauaaaguugucuuuaucaugccauagaggaaugauuuagagaaaucagagaacuccgcgaaaccucucccuuuaacuaggugcuuagccacauaacaucacucuuggugagauagcuuccauuguguauuaugauuaucuuacuugggaugcugugaacaacagacuccuagacuaaaaaucagugaaggccuuaaugcuagccuaaccacuaccuuugacuuguuagaaaauguaugacuguccaaguaaauucuuaggauuaguggauacaggagguccauuuauccuuacauauaguucuaaguauucuagacuuuggguaagaaaaaucuauaaagauuuuuuuuuucugauuuaucgaaagcaaauuuauaaugcauuagguguguacaugaaaguaucacaauaaaaugauucuguuuucuaauuugcucuguuguagucuguucuuuuucauuuagaaaaacaaaaggaaaggaaaggaaauagaaaccaagaaugguggggcaugccuguaguuccagcacuugggagacagaggcaggcggauuucugaguucgaggucagccuggucuacaaagugaguuccaggacagccagggcuacacagagaaacccugucucgaaaaacaaaaacaaacaaacaaacaaaagaguucaagcgagcaucuucuaggguagugaguuuaaggccaguuuaggcuacaugagacccugccucaaaaacaaauaagaauacaaacuuaccaucacuauacauauuuuguuuguuuguuuuuuuaaacgauagggcaaaaucacuguuuucaguuauggucugaaaguagcaaaagcgaugcuggccucaguuggcagauuauuugucuagcaugagugcccugaguuugauuugcuuccccaccacugcauauaccagguaaugaucucacacguguagucucagugggaacagaagagucagaaaguucuucagguuccuccggugaauaggaggaaguuugaagccuacuugggcaaaugagaccuuguuucaaaaacaaaauaaaugguuuaaauauagaaaaguuaauuuuaagaugaguuccuaguuauggacaguggaaacacuauagcagucaguaaggucaauagaugagaacucggaucugugagaaucuuaacauuuaagccuuuaccagugaauaauuuuuuuucugugcaggucaaauuuuuaacuaaaucagcaagcaaaaaauaccauuuagguaaaacugguuauuuccaguaaaguaaaacauauuuauagaauuaacuucguauuuuccuguauggugaucaggguagagcgaacaugguaaagucaaaaauagcauuuaaaccuguacuguugccauugauccuagauuucuaauuucuucauugaaauuugcucagaaugcgacuuaguuguuaccugcuauuggugguccagaaaguacagcuaucccggcaaagaaacuggcauaucccaaaaacuuguguacucuagaauucuuagauaggucaaccuguagggaaugagaauuuagugugagccguuuuaaggaugaacuucuccagugucuuauguuuacaaagcggugacaaauaucauuaaaagcaaagcaaaccaaaccagaaaaccacacucaaacugaacaguuugacuccugggaugauuuaguuggcuuuucuuuuuuuuuuuuuuuaaagauuuauuuauuuauuauauguaaguacacuguagcuauguucagacacuccagaagagggcgucagaucuuguuacagaugguugugagccuccaugugguugcugggauuugaacuccggaccuuuggaagagcagucgggugcucuuacccacugagccaucucaccagcccuuaguuggcuuuucauccccaguguuagggaagggaauagaugucaacuagggagcuaggauuggcaaggcagaguaaguguuuuuaguuuaucagugggggaacauugguguuuggucuagauagauuaaccuuuuauauaguucaagaguguuuuuaccucccaaaccuuaaugaucuuccuucucaauuaggaaauaguauuuugcaaucugugcuuauauuaauguugaauccaccuguggcuuauuaccaaccauggguuuauaagaaaucugguaacacaggaacugauuucaucuuugggaaccugggauuuuugccuaagccucaugcacuuuccuacacaacuuaaaaaccauuuuaauuccauuugaguucaggauuuaaguuugagcuuaauauagagaucuuguuaaaacaauguccuuaaaguacauaggauucaaggcagcacacagaugcaauccuuauuagcagacuuauauacuuguauccuagcaagaccuagagaccccuggagccucauggagaggaguaaacacaaggagaguuggagucuugcuggucucuguguuccucuuuauccuguucugugugguuaguccucuuagcuucuguuccucacaugguuagaugaauaaugacaguauauaacuaacugcaagauuucugaagucuuguguaguuuuuaaaucauaaaguuaauauaaaauuugaauucuuaggaaggcuguuacuguacugagucauuuauuacuaaggaaugagucuacucaccaauacuggcaguauuagugccagguagccaccagcaaaaauggcaaaaaggaugguauaggccauaaggagugggaaugugguggcuaaaggagcaagcagguuagucacaccacacagaaugagguaagacuugugguauugauacuucuugauccaauuuugaucagcaauccauccagaaaugagcugacugacugucucagugauaccuggaacagugaauacaaagucacucaaucuguuuuguaagaaugucagugucuaagugucuuugcccaaggaguaggaugccauccugaggccagaggauaggagggaaaaaugguuucauagugaaauaggauauguaccuuacuuuuuaaaacaccuaguaaaauaccaggaugcugcuuccagcugaauaugaaaccauuaaguugucauguauguucucuaauuguaugugggaucccuguugacaagaccauggucugaagagguccaacaagugaggauaugaaaccucagugucccgaggagucauauggugaaaugagagaaaucaaauaaaaucuuauauuaaaaauauagacacugggacucuucuaugaaacuuuggaauuuaaggccuccaaugguuguuaaaguuaauuugaaaauacauaagucguuuauauaugucauuugguaugguguaaugaguaaaguuuaagaagcacuuuuuuuuuuucuauucagcauuguuacuguuuacccuauucuaaggcauaauaccaguuaaaaauaccaaaagucaauaucaugaagccagggguggugagugccuuuaauuccagcacuugggaggcaaagguagauaucuugugaauuucauccaggccaccccggucugcaugguaaguucuaagacagauugagccacaugaugagaccaagucucaaaaacagaaccaugaguaaugcuggggauagaaggcuuagugguccaguacuacuucacaggugugaaguaugagaaagccaguaugaucucaaguugguuugaauuuuagggguucaaacaaacugcuccauuagucuccuaggaugcacacugagacuguauuacacuauuuggccuaauuuguauagccuuaaucugauccaaauggauucuaucggacaguaaaagaaaaugguuaaccaaagcuacucuuaugaaacagcauuuuuugacggaagcuuucuucagugagaaccuuugaaacuaggugucuucagcuuuguaagggcuuucuccccaagaaaucuguagaagaaaaguuaaguugaauguugagaauuguccaguuggagcaaaacaauucaaucucauucuuuguuucagacuuccugucuggucaguugagagaaucuacaacuuaaguauuugaccauccaacauuuugugauuacauagaauaauuguuuuuguguuuuuaacauacauucuauuuuaaacacaagccuguggauuagugacuaacucaacaggaaaauugcuuagcauuaaguaccaguagaacauuaugcuagccuggcacuacacuacauuacauauacauuacauucauaaucugacaguugggagggaaagcaguguauuaugccuauccuauaggaaaaggaaauccugaccuggaggagaaugccuugcccaaggucacacagccaaaacaaaaaacaaacagcaagagccuggccugggaaguuaagcuucagaaucaauccuucacguuauuauaccauguuuucuagcugagcuuuuccuucccagauuagcuguugacacuuagcaccagccuuugaaauuaaguuucuucccagggaacaauugaugucuacugugugagacaccugaagguggguaaggugaguuaggguccgcuagaaccugaaagauagcaguugccaaaucugcugagaaauacacacuacucuguuuaaccccagaaaacucacagucacucucuugcuuucuucccuuuuccuugcuucuguuuuaaaauaaaauuuaauaaacuuuuaucaagcuaaguucauuuuucuuaccagcuacagacacaagguaggaggcauccauuacgucaaucccaaguguuuuugcucuggcuacuagguggaaagugggaaugaaauaugcuaauuggcucaggagaaaagaccagguaaaaauguagaagaaaggguuucuaaagagcgagauaucuaaaaguuuuuguuugcaguuccaugaaacaaacuuuuucuugugacuuuugccauugcucauaaguaacggccuguuccugugaggccuauugcugaacucuucgcuuugauuuccuaagacaguuaagguugugguagguuguucagauuucuucauaguacugucuuugaugaaaggcuccugugucuccuugcacuucgaugucucugucuuguaugaugccucugguucaguugcagacaaaaugcuaccuuuguuuucaaugucagaauuguuguuugauuggcuguggaugggucuuaagagcaugcuggaaggcaccaaguucaauauaauugcuccaaauaaaauaagagcgccuaaauggaagagagaaauuagaacauaagaauagucuuucagcucaugcuacugucuauucauaggcugggaggaggccaaucuccauagucaaauaauuauuaaaaaauacuacuuugccucccaugcuacuuaaaaaacguguguguguguguuuggggggggggggguccacugaagccagaagagaaucacauccccugagcugggauugcaggcaguugugaaaugucugauaaggauucugggaauggaauucuagucaucuggaagaacagcaaaaugccuuuaacugcuuagccaucucuccuucccugccucccaaauuuaacugaaaccacuuaggucuauugacaauauacauggugcaaaaauguaauacuuuagauauuggaaaaccaggaaauugaaaagagguuauuuuuugcuaaaggacaaguuaggggauugggaaguggguaauaaucugauggcacaaauuuacauuuuaaauagguauuuuaaauauauugugacuggauuuugguguagggaauauagaacuagcugucaggaaucaugggggaaaacguguuagaaaaagccauucggacuuuuuuucccccuugaagacaugcuagucuugccuuucuugccuuugaugugaguacuugguugguuuuaggauguccagaacaaagccaugacuuaguguuucuggagagaacaagcuugucucggcuuuucuagaggcguaucagcuggagguucccauuuaccguggaacuacugaauaguccucuacauagggaagaguagucaaaacuacuauaaagguagaaauagacauaaauacauuucacuagaauacuuaagauagaaaauuaugaaauggcuuugugaaaauuccuaguugauaauauauauaaaaauugucugguaggaacauaaucuuuuuacaaauaguccauuuaugcuuagauuuguuuuuaaaugcagaguuuuguuuuguuuuuuuguuuguuuguuuguuuguuuuguuuucuuuggaugcuuuagugaaaagauuggaaaaaaagagaaaacauuguuuuccuaagcuuuuacugcacagcauuucuaguugcaccucaugcauggaauucugaaaagagaauucuugaguugggcuggcaaauaggaagauuucuuccuuauaaggaauggcauguguucccauuaaauauguuuauuucccucucucaucuucagugcuacaugguggugccugguggccuguaaucccagcguugucaugaguucuagaccugcuagugugucauacauagugaccuuggaucuaggaagaggaauuuauuaaagcuucacuucuaguauucaaaaggagggcuaaacauuacguuuuuuguguugaaaguuuagaaauguagacugacucaccuguccagucauaaagaucuaugaggaauuuuguaaagggugccaacaaaaaugucagccccauuccagaacgggcaauugcuguagaaaggcccaaucguuuuuugaaauauuugguaauuaccacagcagcuacuugguacaagaaagcagaucccaaaccuuuaaaaaaaaaaaaaaguuugaaauuagaucauuaguuaucagaucagaugauguagaugagauaauguauuuaagaucugugggcagcaggacaguuuccuguuacauccuuuauggacuauugagugugaacucaccagguagcagccccauggucacacaaagaaagggaaugccuguggcccagcugcugaugacauagccaccagagacaaggaacgucccaagaauggagguagcuuucucuccaaguacgucacagaugauagcagccaggggaccuucagaggagaaagggaaagugcuaaguuaauauccucagacaucccuuaggcccuguguguucuuugacugagugaucagaggaaagcaagacaauugguauaagauauuguauauucaaaauugaaauaaaaucauguuuguacuaguggccucuguuuaguacaaauuugcaucgcuaaucuccauauuacaccaacuagaacuaaaggagaaauugguuuaauguuuauuuugaauaugaucacauaguuagagcugaaugguuucacuugcagguugaagucuuggcucucuggguuuaaagccuuaccagacauaaaacaaaaaaaccacaaggcaugcaaaaacaucaaucauuaauuaaauacuuggauucuuaauuccuuuuuccuuucccugucuuuuuucaagauggauguuuuucuguauagccuuggcauucuagaacuugcucuguaggccagguuggccuccaacucagagauccaccgucugccucccgugugcugggauuaaaggcgagcaccaccaacaccugaccuuaauuccuuuuuaaccuuaauuuucccaacuuaauuaccaaguuaaauagagcguaaacacugaugucucuuucaauauuacauauugauauuaaugcauauuaauaggugaacuugaauguacauuacuucagcccuaaaggagugaugguguugucauggaccuuuguggucauucuccauagacagcaagcuuauugccuacuccauaccugcagagaaacggagugaugacauaauggauccaauccaaccaauuugcucugaagugccuucaaacucuucuugaaaaaccacaaagaaaauugcaaaugucuuggucauucccaucacaaacacauuuaccuaaaucaaaacauacagaguccuuguuaggugcaaagugggcuagaaguguuaccagggguucuauugcuccagcaucucagugcuugcucauuugucuuacuggugguuucugguuauaguagggggugggagaagcaguucauuccucucuaaagugucaggacagauucauggaaauaaucucauuuaguccccauuucaagcuuaugaaaaggauaugucacuguuguuuuauagugagaguugaaguuuaagagaaaaguugccaguggugguacaggcacugagauuuagauccuaggcugacuugacuccccacuacucucuuuuuacauucugucucuggcaguuauuacaggugccuuaagggggggugggggggggacggaccuguuuguauauaaccauuccucaacuccuaauuguaaaggauucuagccacuccuacccugcuuuaaucgucauuucuagucuuauuucagaauaguauuucuuaucuggaggcaagaggucgagaauuggcaacugccuaggaggcuuccuaagaaaaagaauccuaaauguuuuucucauucucacuugaaagcaaguacgaaaugaaacuuggggcuggaaagauagcuuagcaguuacaagcacuuguugcacuuccagaauacccagguucagaucuagcacccacaauauaacuuucuuuaaaaaaaaauuggggggcuggagagacggcucagcgguuaagagcacugacugcuuuucugaagguccugaguucaauuuccagcagccacaugguggcucacaaccaucuguaaugagaucugacgcccucuucuggugggucugaagacagcuacaguguauucauauaaaauaaaucuuuuuaaaaaaauaauaaauuguaccauuaaauguaacuaccaaauguucuagacuuauuucaggucaaaauacaguguaccuucuugugaacaagaaccacuaauguaaggggucauucuguaagccuuuagccuuuagccugugcgugagcuauguauguagagaaugcuuuuacuuuuuuuuuuuuuuuuuuugaaacaaucugucuuugaagcccuagaacucacugugaagaccagggauggccuugaagucugugucugccucccaaguacugggauuaaagacauaugacauaugccaccacuucugguguaccucuauuguuaaucuuuugaauuuggcuggcuguuggucuucaauuggaacuuuuccuuguucucuuccugaugucugucucugagagcugugaaaugggugcucaauaacagguuguguugucuguucacugaguaucaggaacacaaaggcagagcucuagcaucugcccagccagcccucucuaauuuuuaacuuccuaauuaacuucuauuucuaccuuaaaaagauacuaaagaccuuucccaguaucuguauuuucccuuaguuaaccaggcagacuacauaagucuugaucccaaugccuuggauuaagguugguaggacucaguccugcuucaucagacauuguaauugccuaaacuccaaaucaaacaaaaaccuaggaauaguccaaccccuaauuuccaacuuaaaagcauuuaguuuuuuguugcuuuuuuguuguuguuguuuuucaagacaguuucucuguauagucauggauguccuugaacuaaccccucccccccaaucuccuguguccaugugguguguguauguuuaaccaggcuggcuucaaacucagagauccaccugccuccucuucccaagugccccuggaauuaaaggcgugggccacaacaccuggcaaagcaguucauuuucuuggacccauaagaggauaaaguggaccgccuuuccccacccccacauucgugugugugugugugugugugugugugugugugugugugugugaucuagaucagccacgauacucauuuugaaauuagagugccuguugucaagguuaauuuuauuuaauaacagcucuuuuuauuuccaguccucuguaagguuaucuuagcuuauuugcuuauccugaccuucauagauaaguuucuucaaagucugcucugucuucuuccucuaauugaaguauuccacugaaaaccuaagugcucugaccaaaauucucaaagacuuccuuguugcuaagucagauuguugccauuucuaucauguggccucagcaguggccguacaucauuguuccugauaauuccuaaacaucugccuacuccucugcucuuguuuccucuguggaugauuccauucgucccuacaaugaucucccccaauuuuguccuaucccuuuagcuuuaaaguuaaacuguguauauuagagacacagguugcuauauacuucaggugcacaaagacuauagcaaacacguucuugguuguaaguuccuuagacuuuguccaagauuacaccauucaaacuguucagaauuuuuccuucuguuccuuuaacucuagugaccaucauucaaaacuuaucaaaguacauaaacuaaugauucuggacucugauucccugcucucauauuccucugcacaccuuaguggucuguccucccaaaaugcucagaucugcauuuucacuuacuucuggauacuggguuaaaucuagggcccguuuucuugccuguauugcagcuuguccaauggauacccaguguccagguccauuugaaguacuuuuccaguuaccuugccucacuaaaacuacauaaccucagaacaaccaauugucuuaaucucucuguugucuuuccgagauuauuucacagugcagccccaacugacuuugaacuugaguuccuccugccaucaccucccaguugcugcaauuacagguggaucacacguaacugugccagcacacgugguucuuaacauguuuucaguagccucucuccaccucugacuucauccauccucuuggcugcugcuuauaaaugugucuauaaauuaguccuccccacccccgucaaaaaaaaagaagguauuuaaugaguggcuacugugucucaggcuguauauucagaguaggcauacaauagugaacgcaacacugaugaacaguauaaaugugguucccuaaccgcacugaacaguuugguaagauauacugugaugguuugaauauucauggcccagggaauggggguguggccuuguuggaguagguguggguuguuuaaggaagugugucauuaugggugugggcuuuaagacccucauccuagcucccuggaugccagucuuuuccuagcagccuucagaugaagauguagaacucucagcucuuccugcaccauaccugccuggacacuucuaugcuccugccuugaagauacuggagugaaccucugaaccuguaagccagccccaauuaaauguuguccuuacaaaaguugcuuugauuauaaugucuguucucagccauacaacccuaacuaagacacauacuaagcccagaaacaguuauauauauaaaguauggugaguuacaguguaacugcuuuuguggaggagcucacaaagcauacugagaaguuuuucacuuuugagggagcuuaaaucuuacggaaaagcacacuuguaauuuacauggaaauaaaugcauugcccuguuaggauguauauuaucccuaugagcagugagcugaguucauugcuaacaguuugguauauuuaugugcuccaauaaccaucaucauguugcccaaguaacauuauuaaccugauuauuagcuacuuuuaauuagcaguaacuaaucaaauaacuuguuauccauugaaaauaaugcauaaaagggugggagaaccagacuccaacaccaacagcauacaccauuugagaggaggcccaaccaggcagggcucucgggcuuaaggcaucuuuagcuucccuauuauuaauguuucuauggaaggggagaagaaauucuguucuucaguaaugaagccagaauucaacaaauugugcuuuauuugguaaguuuuauaauacacaggucuagcuuaggaccucuacccuccaucccucuuuucuaucauuagggaggaguaaagcauuauguuuucccaccuucaauuucauacugauguugucacucaucuggacuuguguuccuaucaugugggcugcuuacuguaaauccaagcagggcaggaaugucaagaagaaagaagugucuuugugagugugucucaaaauuaagaaaaugaucuaggggugcuuaagaguuauagggcugggaccacuaugcacaggguuauuuguggcgcagcuaugaugggauccaccaguguucuagaacagacaugcggguaauguacaucacuacuuuuuuuagauagcaacuccaacagugucucggaggcgaggguaagaagucuuuccuuacaauacaugucagauacagaguauaauucgaguuuaaguuauggggggggcagcagacugaacuauccucaaccccuacuaaugaaggggacugccguggcuggcuuucuauugcuaugaugaaauacuugggaaggaaaggguuccuuucagcuuacaggcuauagaccauaacgaagucagagcaagaucugaagcagaagcuauggaggaauacugcuuacuggcuuguuuucccugacuugcucaguuuguuuuccuaaacaacacaggaccaccuguccuggggugccagugaacuaggcucuccaaaccuaucauucaccaagaaaauguccucacaaacuugccuacaggccagcccaauggaagcaguuucucaguugacauucccacuuuccagaugcauacagguuugugucaaguagcuaaaaacagcaugaguggucugaaguauuguguacauguuaggcugagugggugggcacuuaguuucaagauaaaaucuuaacauguaugacuggcuagucuugaacuaucagcaaucaucuugccucccuugcaucccuucaacccugcccagugcuggaguucuaagcaucucccacaccuggcagagcugaguacuuucuaggaaugaccugugcuagcucuuacuuagucgaaaauacgauguccccaaaucccaguugccauucugccaaaguagaacugccagccaugccuggagcauucucugauugagagaugaugaagaggcagcggagaggccuggaugggaaggcuucuccuuucucucaggggaacaaacagcucagcuucuggguucagccaagguggccucugaucuuagcaguuugggcaaguuccuggcuuccugucuacucaaaucucaagauuccuucaucgaucuuguuagacugcuuugagcuuuucuucguacaguucagcacuuggaaaggggaaagaaacacuuaccaggaaaaaaugaagcacgaccauccacccccauccuccaucaagggguuugguguaaggggagggcguuuuuuccuucuucaccaugaugcuuccuguaggcuacaugcggagaucacuggaacagaugcaaaacaguugauucaguagucaagaaaguaaucuaacuguaagugggauauuuuguuugucuuuuugguugguuuuaagaccugcuuuguggcuccaccuggccuagaacuuguggcuguccuuccuuuacuuccugaaggcugcgauuauaggugugcauguuaaacuauuaaauuuuauuuuguuccaugguaugaaacuuuucacuuuuccguucccccuuaguuacgugaagucugccugauguuaauaaccucgagucccugaugggaauggccacucuacuugugcucaggaucuccaucagcuguaagccaguuuuagaggaagccauguguuacccauccauuccugugaaccagcccuugaaucuaaagaaaaguuaaaugggagggggcucuuggguuuagacagccccuuuuuauggagcuuagguauuuuaaagaacuagauagcccaacaaaguaacuuaucucuuuagaggauacuagaucagaaaaacaaauugggaagcccacuuaggaaauaugagugauuugaaauagaggguacuaaauagguuaaauauuuugguugugguggugaacuuaugauucugcaggagacuagucuccaccuuaggagagagaugcuaagcauucaagauuagaaugucauagugugcuaacuucagacagaguugaguaaauaaauacccacauauugagaaagaacguguucugaggaauggauguuauccucaucuguccuugugaaagcagccagguguguaugcgacgcauguguguguguuuagugucuaaaaaaguaaggucuguuagauuagacagaaagaugccaguugugagauguguguguguguguguguguguagggggagagauuucuauuagauaauucuagacagagagauucuagucauuccaggucccugagaagaccaacccaucacccaauuucaauuccacuucaccuuaccuuuaagcaaaugaauccucuagagacaagaaaauuucaggugaaaaauuauuuucccuaaaacguuacucucuuucuaaggcuucccauuccgcugcuugguggaaacaaccaggcacuguagucaagcgggggcagcgcugagguuuagcagcuccugccuguggacuuuacuuccugagggagg

SEQ ID NO: 1650 - RNA, 4117 nt, Mus musculus
acuuuuuuggagaggguauuauucuugucacuaaauaaggcuuuauucagauuccagagaucuaguuaaccaaugacuauauuuaaauaaaagaaaaaaauaguuuauaauuguuacauauuuuggugacagaauuaccauagcacaaaugaaaaauuggauugauuuauuacaguacauucugauuuucauuuaauaguaaaggagcugcuucaauggauucaguuuguagccuguuugauuacauuuaaguuguugcuccuuuauuacucauuuauuacuccuuccaccaguugacauuccuggcagugcuaagaaaguaggaaggaaucuuaaaaacucuauggcuugcuuucuuaacaaagacuuuucuucugagcuuuugcuuacaguagcuuguuuagauuuuuguuuguuaggcucuuacuugauuguaguccucagaaggucagacuguuugcguuuccaucuuucagccagugguacaaaaaaaagggaaacugaagagaggauauagcaggugccagagaaauagaaagagccuguguaagucuguguguaaucauauauccagccugcaagguaggaaugauuucuguuaaugaagugaucccuacuuuuguuacucucaaacaaaucuuaagacuuugaaggaaaaugucuccuguucucaguccauauugugagccauuggacuuaaauagggcuucucaccugucuugaaacuggaucauuuuaucugaauagaaacuuacauuauuaaauacaaaagucauuguggucuccaaaaacaugucuuaggguagaagaaacuggagaaaauuagggacacagcacuucacuuuauggugauuauuagagacugcuguuccuucuuauaaggaaaguaaccguaaauaagucguuuuguuucaaagaaaaaaagagacugaaccuuuacugagcccucaaaguuuauaguuuuaguggaaaguagauaguaaccacuuaaaauaucuauuugguaaauucuauaaaggagugggggcugugaucacaugagaaagaacugcuugauaaaugugcuaaaccaaaaagcaaaggaguucuuccugaaaaacugccucugagcuauauuccuaacuggaugcucuuuaaaauaagaacaagagaagccuugaaaucuuuuggucaauggcaucuauuagaacuuaaguaaaacaucuucuuaaaaguguuuguuucacugugcgauagcaagaaaucaauauuuaaauguccauauaaaaagucuauacucgccaggccugguggugaacgccuuuaaucccagcacucaggaggcagaggcggguggauuucugagaucaaggccagccuggucuacaaagugaguuccaggacagccagggcuacacagagaaacccugucucaaaaaacaaacaaacaaacaaaaagucuguacucugaaaacaucuuaguguuauaaagauaaugauauguaugcuuguuugguucugggauugcagaugauauuacuggugaagagagggguggaaacacucucugcuuacaggguuuuuuuguuugguuauguuuuguuguuauuguugguuuuuuuuguuuugguuuuuuuuuauuuuuuuuugguuuuuuuuuuucccacccccaacucccauuuaguguaauuguuuauugccauuucuucauuuucuuguuuagcucugacuuccaggguuugaaguuuuguuuuuguuuuuaaguuuuaauuuauguauuaguuaugaguauacuguugcugucuucagacacaccagaagggggcaucagaucccauuacagaugguugugagccaccauguggaugcuaggaauugaacucaggaccucuggaagagcagucagugcucuuaacugcugagccaucucuccagcccuaugauuuuuuuauuaguuggcucuggguauugauugaacccagggcuucauguacagacauggcaaaccuaugcuuuacuacuuagcuauacuccagccccuuuuuauggugguuuuauguuuccuauauuuuauguaauacaugaauuggcauguaaauuauagcccuuuaaauucagcuaacuuuaggaauuuguuuacugauucuugauuugauuagugaccucucaguuaaguuucuuggggacuaaugaaggaguggagugaggucagcuaggaugauaagucuuuguguucuaugaacaugaaugaccuauaacucccuaagaaacaggugacuaaucugagcuagggaauuuucuagaaaggagggaagauggagcaggacuaccuccucuguauguguauauguccugugacuuucugaugguuaucagauguuagcauuauuggaaagaacuggggguucuugcuagugauguugauagugcuaguagacaggagcacagauggcaguuaguucagagcaaaucauuucuaagcuuuucuuuuacacacaccuuuuaaagagaauguuaugucugaaacauuagggcuuaaaauauuuuaauauuuuuaucagaaaagggagucauuugacauauuucaaguuggaugaaauaauuugcuuugaauauucuaccuauuuauacuuguuaauugagaugcuaauaucuuuaaaauucuaauugagauccagagccaaaucuuuaauuuuuaaugguagacaaagguucacuacuccaaguuuuaauacuauucaagauugaauuuuugccuaaaauuuuugccuaaguggccccuaguuuaggccccuaaaucugagcuugauuguuauggcuaagaaggguuaucgaagauaccuaguauugcaaguauuguguuuaacacaugcugauaaggugugaaugggacccaagucugaacagaaaauucauuuauguuuuguguacuuuuuauacacagccuaaagauaauuuuuaaaaauguguucaucuuuuuauguuuguauauuuugccuguguguguguguguguguacacgugugcaugcaugcaugcagguguaaaauguguguauguauguagguguaccacauacaugcuuggugccucagagaucagaaaaggguauuggauccuguggacuggaguuacagaugguugugaagcacuguauggauucugagaacugaucuugaccuucugcaagggcuauauacaaaugcucuuaacugcugagccaucaucucucucacuaaagauaauuuuauguaauauuuuuaauauuuuugugcaugaaucaaacuuaugguaggaaaauuugccacuaugacauagcacucccccaccaaagauuuauuauuuuggauuuuaagauagucaaccaauaaacuuugcauaagauuuuaugaguuaaguuguggaaaaggaauuuaauaugcucagaaguauucauuaccauguguuucagaauuuguuuaagcaaauaauucuuuuagggggcugaugagauggcuuuacagguaggcucuugcuacagagccuagcagccugaacuuuauaucccugggacuugugauggaagaagagaacugacuccccauaggcugcucucugucagcacacauguucacacacauauacucacaaaguaaagaaacaaagaagaaaaaaggaauccuguuaggcuugcuguuagguuuccauuuaucaacauguuacaacuugaaauauacccaggaaguccuuaucccaaagcuccuugguacuucaacuaugaaacugaaaauucugagacuggccuguuuaaugagagcuuccucuguuggguaggaggcauaguggcaaacuuccaagguguauggacacagugauuuuauuucuuuauuuugagaugugggucucaccagauagacccaguugguggccuagagcuagcugucuagaccagggugaccucagucucacagagaucuauuagcucugccuaucaaguacuggaauuaaagguguauaccacuaugccugguaagacccucaucuuuuugucucucagggccacugguuggguauagcaguuuuaucucuugguuguguuguaaaauauuuauguguucuguauaugccauuaaaugaauaaaucuugggaaaugugugu

SEQ ID NO: 1651 - RNA, 8940 nt, Mus musculus
cuaaaaaacccucuuaccuguuuacaaguuuaaacagcuguuuaccacuggaacaccaccuuguagaguauaaucguggcauccuugguugauaaucaccuguugccuaucaucccgcauggagacaagacagcacuagggcucuuccauccgagguuaaaauucaaaacaagcccaacaagccugcaugucaagguggucuucgucugcaacuauuaguuuuaaaacuggcaaacaaccauggugucugaagccaaaggugcagaauugcuggcuuccucuugaacuccagcguugucacugugcaccgaaguauccugcugcaaacaggggaguuuuucuccugcucugggaacaggcuuccaaagcucaagagccccuguacaggauaaugcaggaacuaaaggcaaacaaaauccuccuuaaggaugccuccauuuuuuuccucacaaucuguacuaccaaccgaagugacugggccugagugugcguucgaaccuaugaaaccgucacggugcaugcacauccaaggcauguggaaccacaggucaaauaaggcacagauaccaaguaacgguucuaauuacaaaugcuagcucucaggaacucuucauccauucagaacuaaacccaucacugcauaacucugguaagaagccccuggagacggaggagcuccucaaaugugucaggaaaggcuuuauuaacaucaucauuaacauuuaaaaggcaaccggagcauuucuccuucuuuuggcaauuuggugcaaauguuaaaagugcaagauaaugcaauuucaaacuuuucuucaaauuaaaaaaugaaacuaaagccaaacgugaugggugaacaaaauaaaucaaaacuuaaauuucaggaacuccggcucuucaaaccagcaaagcccccgacucgugcacuguguugaggcuuagagugcuugccccggcuucuugcaugccagcaaacagcacccucaucguguugaggaccgagaagcaaaggauccccuucacugcaaacaaagggggucacuguaacacuaugauccuucagaauugacacaccgugauagucaaaaggaaacugaugaucucccugcuucuugcucaagacauacaaaaucugagcagcagcaaguacccccuccgcugcaaacaaaggggucaagguuugccgucaauucacuuccaggcagaaaaacauuuuccucaaaagaaacaauuuauuuagaauaaaacaaaagcagcucaacugugagcccauguuugagugacagcuacuuuuaagcugugugagccauaaaaaggguuuuucuuuacuuuuccagaaaucuuguguacacagcacaaagcaaagaggucauuuuuccacuuaaaacaccggcauuggcaucacaauagcagauacacaauguuaagcugccauuuuaguaaaaugcacaaaauacuaaacagauuagcuuucuuccaucagaggcccauguaaacuccacauaagccacuucucuucaaaaagguccauuagagcuuugaauuccguaucuucauccgcuguucaccaguuuugcuugcgggagggggaaaaaaagguuauucaguacaaacguuuacaguauuaaaaauauauauauuuccccuaugccauuauagaugaacauaguauuaacaagaccuuccuggauaguccacuuuaacuucaaaaagcaccaauaauauccacuggcacaaaccuugaaauaaauuuacuauaugaacacacaaauaacaaauaaaacaauaggguuugacuuuuuaaaagacuguuaucaaggauuagaggacugaaaauauuguuuauccuaaaaaaaaaaaaaaaaaaaaaaaaaaaaaaaaaaccugacuaaugcauggccaaauguucaggaaaaugcagguuuauaauuaauaccuucuaaauauaacuaaaaaaguggaacagaaagauggaguuuagacaaacuuuuaaccccucuacgcuuauuuuuguuauuuauauggaguaauaaggacuacuccauuacuagguagucagggguuaaaacuacaaagccauuuacaaaccaccuuuaccuauguuaccauagacagcagguguuacuguuaagaaaacacacaauuugcuuaacagucagaaaauacuucaggacucauacuuuucaauucuguucaagguauacacauaagaacucuucaucaagcuuaaccacguacuguaguugccugaaaucauuucccacuguuaagggcaucaccccaaucagaaaauuaacaaggcuaacucugguucuuguucucauaccuuacuucuauuucaaaaccagacuuuguaacaaagacaagaggggaaaaaaguucagaaauugucucuauuuuuuuuuucacuuaagucauuaaggcccucuucaauagaagaucucauaauuccauuucaacagaaguuuugauaaaugguucuuauguggauacaaacugcaguucaagcugugccugcaaaaugggcaauuuuaucagcuaaaaagagcuaacuuaauaaaaaaaaaaaagauuaaagaaaaagucagugaacaucugcccauaacauaauuuuuaaauaaacuaugacucugaaaaacaccuuuuacugcuauguaucaaaugaucuaagugagucagucagucacaaaaagguuaccaccuucaagauauaacaaaagcuuauagaagccagaggauguacaauuuaauagguuaauucugaaaggaaaacuaccuuuaguuugaugguguacaaguacacauuaaaaauuuagguuucuguaugaaaaauucuuuacaggaaacacuaguccacaauuaaguagaaccauuugcuagaagcuaaaugauugcuuaacuuucaauaaacuuugaagcugugaucaugucuuaaucuuauuuuuaccaguauauuuaacgcauaaauagcauacuuaagaaauuuucuuucuauucauuuuaauugaguuucugaaaagauaaaaagcaguuacacuaaaguacuaaauuaaaaaaauuuuuaaaaagaagaaaaaaaagcggggggggggggggggggcuguuaaaaugaacauucagggaggccagcggaggauuuuggaucccaagggacuaggugcugggaaccaaaccuggguccucuggagagcagccagcauguuguaugcagacauacaugcaggcaaaacacccauaugcauaaaauaaaauuuuaacaauuuuaaaagaauauccaaugugggauucugauggcuaauaagauuggaaacauagacuuugcugucaaucaaauucugaagguuuaaguggcuaauugacaaauauuaugaaccugcacaagcguaggcaacacaaauaagauggcacuuuguugguaagcaccaaacuaauuuacauaauacauacauuugggaauggcaucaagccacuguuucaaaaauacugaagcacuaauugaucagaucuaauaaaauguagcagugucagauaaggguucaaauaaacauggagcaaaccaucacaacacauuugauuaacaguaaaauuagauuucacagaccauucucuaacagcaaaaucauuugcccaacuaucuuauuaaaaaaaauacuaaaaaguaauggcuagcgaaauuauuuaaacuggaaaaaucuaccuagauaacuaaaaacuguacuuaaacuccauguacacagacuacacuugcaucaguuucuaaauagaugucuuauuucaagccaaauguugcauuuuuggaggcaaaagacacccagucauaguuggaggauuucaguauuuuacaccuuugugcucagaaaccuauacauucuuuuucucaaaaaauuccaaauuaaaauaaaaaucauaaauacauagugaaaaacaaaaaguaugauguagugauaagguuuucauacugacaugcuuuauauacaguccuaaugaaaaacuaaaauuaugugacuuuuucuggguuauuacugaugcuauuucaaacgagcuuugauaacagaaagaaaacaguugggcucugcaaggcuuugaguaagucacauucacagaauagaaaaaugaccaugauccaaaaacucaaguuccuaaucguaacuaaauauugggcccuguugaaguccucaguacuuaaauugaggaagaaaaucauauuuaauaauggccuuagaaaucacaagugguagcagaagagcacauaaaacaaaacaaaaaacccauuauuauaaaauaacaaaagcccuuauuaaaaaccagaugucaaauccucagcucuuuauuuuuguggagagaggacuugggggacggggagggaaccugugcagguaaauuacaaauacaugaaaaaaucaaaauuaaaaaaaaaaaaguuuucuaacacugaaaucucaaaccucuacauccaggcaacagucaaaaauaucaaacauuaaauuucaaagauauucaaaacacugucaccaauguaaugccacuauucuuguuuaaacauaaacaaaaacaaaaaaaaaaccugaaggcauuuucuucaaauauacugagagcauuuuacaaucaccguuuaaaaacuucuguaauucagaugucugauuaaugucuacuaggggaaauaaaaggguuacuuauaagccugcaggcaacucuuacugaaaccagaaauuucuuaaguggauacagaaaccuucauuuuugguuuugaaguaugcacaauaaaacuguauuagcuacaccucucaagucaguaagaacacuaucgugcaccuaacuuaccaacaaauucucauuuuaaaagcauuuacucauuucuugcauaccaguuuaagauguaaaugguuuauaacacaagccucaacuuuuacccguuacugcuacaaacaugggauacaaaacucaaaaacuaauauguuaaagcaaacuuucugggaauaaacuguauauuuaaagaaauacucaaacaccugauuaaaguaauuggacuuugcaacaccugaucaaauuuuugucacacaaugcuucuaguuuaaauuuucuaugcaccaaucaaaucauuuucaguacagaguaaauauuaucagaagguacuuuucuccaaauuauaauuuuaaaaauuggggguuuuaucauuuugaggauuuaaaaaaaaagaaacccucaaaauugaaaaaggaaaaaaaaaaccuaaagaaaaauuaugaggguaagaacuccuaauuaaagcaaccuaucuucccgcuaccucagggcaucccuuucacuuaguaacuaacugcccuaauaucuauuuuaagguuuacaaaaauauauauauauaaaaaaaaaaucaacuaaacuaauugaaagaaauuuucaucugaugcuauaucccauuacacaucacaaaacaaggaaccaugucaaguaguaaauacaaguuacacauggacuuuaggacgcaccacggacaaugaucaugaccagguaaucuucuucagauuuggccagugccuuggcaggggaauccaggaacugcugagagaacucacaaggugggaaggcaugaagaaccccgguguuuuccuugucuuuauugccucccacagggaggcugaucaccccagcugccugcuuuugcuuuaaauaggacacaagguuccuaaguggccucugaguagaggcggcagugucugauguggcugaggaagaggaagaucggcugucagaacuuccagguacagccaggagaauggcauaaccauuaggcccugccacuuugaugcgucgaguuacuucauccaacuuggguugguccaaacggagccgcugagugaucuugaguugggccacuuugccuccaguugagcccuccacaaguagacugcuagcaacuuggaggucacccugcaacagaugcauguuggaagggaaguugcuguucuucaguagaagcaugcccugccaagccaaacagaguuugggagaggaugcugccacaggagcugucccuccauccuguuucugggaagguggcuucugcuuugaugaagaagugcuggcacugggugcauugccaucagaucggucuuccuuuuucagaggguuuuuucccucugugggagcagcuguccgaugcuuccuaucccguucagcugaugcagaguuuuuacggucucgcuugucgcucuggcucuucuccaaacugccccgucuaucucugacuggggaagaccuuuccaagaggagaagacgagaugaucgaucauugucacuguuguagcgaucucuguuacugcucaguucuggacuucggucaggagaaggagugcagugacgcuguuuucgaggccguucacucucaggugaucuaucaagaugccguccuccacuuuccucaggcagccuucgcuuccuuggcuggucccugcugcugggcaagucccgaucaccucugucccuguccagugaccagccaucccuccuucgauccaagcuaucuaguggcucauaagcagugacagcacuaguugcagcccgagcacugcguucucgaaccggugguggggguggcacccagucagaaucaguauaaaggucccuaucacgaucucuguauaguaagggugguguccugucccgagcacuccucaaagggucaggugcucuauguccaaaaguauccgucacuaguucauagugggucaagggcagaggcugaagauauugcugcugguaacgauguucugugucugcaaagucuacccugaggcgacgaucugggccaccaagugggaauccacgcauauggguccaggcagcaugagcugcauccaaacuuucauacuguauauaugcccaacugucaccuuuacgguagucuaugguucgaauggugccaaaucggucaaauucucgugccagggcagcaagaggcacccagggucccagaccacccacccaaagucggguaguggguguggcuuuaccauaaccaaucuugauuggauuccgaauuauaauuuugccagacauugcaaguuuggcccugugagacaugucuagauucucaaauuugagaaagccauagguacuggucuggccucgagaaggccucuuaauguccacuucugugaugacuccaaaacgaucaaaagcccuucugagaucauuuuccgucacagugauaucuaaguugcccaagaaaaguguccgguuggcacgcugaucguccucaggugauaucucauccacuucucggaaaggagccgcaccugcuccagcucccacccucggcuccaggcuguaggccgggcgcacccggucauagaacggauagucucguucucuuuccagcucucggggcaaugguggcggggguggaggaggcaggcggcccagggccaacugcugcaaccgguagucucuguaucccagagcagcaccuccaggggaaagcgaccucugaccucccccuccuccaggggcgugccgguggcuaccgacugaggucccgaccacgcuggaugacggggcguaagcaucuuugucuaacggggagcggcugcggcgccggcucacguacacggcuucuaucuucagaggccggucauagagcaccaggcggccucuggcaugcuuggccgcccucgcguccucuggccuccggaaguucacaaaggcuacccgcucauccccgcugccagaaccugagaggugacugauuuugacacuuacaucaccgaagcguuugaacucgugaaacagcccguccuccaccgccucgucgcucagcugggaccccagcucgcugaucuucagggucuuguacuccacgccguccccgccgccgggcgcggaggaggcggccccggaggaacgugacuccccgccuccaccccgggagcugcugcgcgacucgcccccgccugaggaauuuuuggugcucggggagcuguaacugugcaagcggcuacuggagcugcccccgccggucucguacucgcggcugccgccccggcugcuggacuuguccagaugaaggcuccgccgcgacccgccgcuguccgucuucccgcugcugcucccauugcugccgccggagcccccuaacuucuugcuccgcuccccacgagaacuggaguccucaccgccacgggagcgcuugggcuugaccggcgagcgcuccuuuccuuucauuguugagggucgccggaggucgucucugcggagcugacuaacccgccaccccgcgcucguuucacacagcggacucgcacgccgccaucuuggacuccgccgcggcaaaggcucccgccccgcagaccucauuggucaauuaauucacucuucagccuucucauuggaaaaacuauuuguccgucuuuacaucuccccgcgcuccgggaaggcgcccgccccgacgcuguuauuggguucccaacgcccuaaucccaguaccucauugguuauauucguugucuaucuuaacgguuccucgcgccaggcuguagcuccgccccucgcacuucauggucaccugacccaaagccuagaagcguugauuggacaaaaacucugcccuguaacgguacuucuagcacggcgaacgcagcgaucccaccuucucuucccuuucauugguuuguggccacgucuuuuaaaucacuaucgggaagucuggacaucaguucaggcguuuuuuccugagaauuuggcucucuccgaucucgcgagagacaaagagcucgcucgcucacucgcucacucgcucgcucucuuucgaccccagucuuccaacuucuccggcggcugaagaaaguuuaaaucugauuggauguugacgaggaacaugauuggauaaaagcgcuguccaucacucacuuaaaggaguaggcccauaaacugaggcgucugaaggugaaa

SEQ ID NO: 1652 - RNA, 1002 nt, Mus musculus
ucgcacuucauggucaccugacccaaagccuagaagcguugauuggacaaaaacucugcccuguaacgguacuucuagcacggcgaacgcagcgaucccaccuucucuucccuuucauugguuuguggccacgucuuuuaaaucacuaucgggaagucuggacaucaguucaggcguuuuuuccugagaauuuggcucucuccgaucucgcgagagacaaagagcucgcucgcucacucgcucacucgcucgcucucuuucgaccccagucuuccaacuucuccggcggcugaagaaaguuuaaaucugauuggauguugacgaggaacaugauuggauaaaagcgcuguccaucacucacuuaaaggaguaggcccauaaacugaggcgucugaaggugaaagacuaagaccacgcgcuugcugugcgacgucacuuugcugucgcgagauggugacagugagucaggcccgccuccccgcgcuuucggcguucucuuaaacauuuguuagguccuuacggcguacuugccugugcuucgguccuucgagucuggaacuugcgggcuccucacuguccugucugggcgggacaaugggcucggugguccuuccggcugcuggcccucacucgauccgccuaggcagcugucccggacaguccagccgacaccaucuuaguuagcugccugaaaaagccccacccccgugcgcgagaaaacgccugccccggucugugcggcccgcuggggcggugaguucaggguucacagagccucgggucacgcugacgcccugggcgguaccgagucacugcccgcccgcggacacagggaacagcgccgcggagcccuggccagucucaguggccgccuuagggcccgcaguguccugcaagcccacuuacugguccgaccugcaggaccacuugcagauuuuugcuuccugcuuuauguugugaaucccuguaagguuugcauuuauaaaagaugugugagacaua

SEQ ID NO: 1653 - RNA, 1002 nt, Mus musculus
uaugucucacacaucuuuuauaaaugcaaaccuuacagggauucacaacauaaagcaggaagcaaaaaucugcaagugguccugcaggucggaccaguaagugggcuugcaggacacugcgggcccuaaggcggccacugagacuggccagggcuccgcggcgcuguucccuguguccgcgggcgggcagugacucgguaccgcccagggcgucagcgugacccgaggcucugugaacccugaacucaccgccccagcgggccgcacagaccggggcaggcguuuucucgcgcacggggguggggcuuuuucaggcagcuaacuaagauggugucggcuggacuguccgggacagcugccuaggcggaucgagugagggccagcagccggaaggaccaccgagcccauugucccgcccagacaggacagugaggagcccgcaaguuccagacucgaaggaccgaagcacaggcaaguacgccguaaggaccuaacaaauguuuaagagaacgccgaaagcgcggggaggcgggccugacucacugucaccaucucgcgacagcaaagugacgucgcacagcaagcgcguggucuuagucuuucaccuucagacgccucaguuuaugggccuacuccuuuaagugagugauggacagcgcuuuuauccaaucauguuccucgucaacauccaaucagauuuaaacuuucuucagccgccggagaaguuggaagacuggggucgaaagagagcgagcgagugagcgagugagcgagcgagcucuuugucucucgcgagaucggagagagccaaauucucaggaaaaaacgccugaacugauguccagacuucccgauagugauuuaaaagacguggccacaaaccaaugaaagggaagagaaggugggaucgcugcguucgccgugcuagaaguaccguuacagggcagaguuuuuguccaaucaacgcuucuaggcuuugggucaggugaccaugaagugcga

SEQ ID NO: 1654 - RNA, 19276 nt, Mus musculus
ugcggcuuucgacacacgcagccacacugaauauggcgauuggggaaauuuccuggaggaaaucacgcgagaguugccugacgggaggccguccgcgaauugagccggggguguggagcagccaagauggagccggcagccgccggucccggcccucugauugugaacaacaagcagccgcagccgccaccuccuccgccgccugccaccgcgcagccuccuccuggggcgccgagggccgccggaggccuccugccggggggcaaagcccgcgaguucaaccgcaaccagcgcaaagacucggaggucagagcugcaggggggcgaggcuggcaccgggcgggugacagagggggucccgggagaccggggcggcauccgggcccagccgggcuucccgacggcuugacagggacccugggagcugucacuuuaccgggaaccgugcaguuagcuaggcuggcagccgccacagccccggggaggaaagcccggagcccugucaccaacucugcugcggccgggggaagaagguccccgagccggggauggccggucgcccccgggggcguggccugaggcacagcccuccuggggugcaaaaucgguggucugcuggcugguuagccccucauccuuuccggccucugaucuuagcaggguggugggccacgccaguuggcagcgaagggacccaggagaguuuagcgggcgcuuagaacagggcuucucucucuagugcugcuuggccggccccagguugugugaguagcagagagagcacauuguggcuucccuccgaauuuuagucagcgcuggaucaaaccgcggccagacauugccaaguauuuuugcaugcccagugagcccaguugcugagcugugaagggaucagaaguacacaaagggcgccggauucuccuccuugcuagugagcugcgauucccuuugcccgcgcugucuggagcuauucaccucgccccaaguuaaaauuccucccacugcuuccguuugcagaauucaugaaugaacacacacccgucucgucgcagcauuucagggcuuccucaucagcacauucauucccagagcgcuuacuacgcaaucuccuccaccugagacaacuuccagugugaugaacagccaggcacuuaccgagagggaauuccucaaauucaaauuugaugcuucagcuaguaccagauacuaaagauagugucuuuaagccuaagaaaucaguucccuccaaacauuuuguuguugucgcaggcucaaauucugauaacuuaugucacaaaggaacaagcccagaguugagaggaugaguuuagaguggcuuuuuugaaaaagauggaccuuuuaggagccuuuuguuguggaaugaugggugaucaguggcuacuucucagugaucucuuaaguacgaaggaguauggaaguuaaguuuguaagaccuuuaaugaccagacuuguccagguuuucugaagagaacccugagaauugaacuacaccuucaaauuucucuuuuuaaauguuugaguggacuggagagaugguucagugguuaagagaacuugcuguucucucagaggaucccagcacccaaguugggccgcucacaacugccuauuagcacacuagcuccuagggauccaguacuguccuuuuguccuccaugggcacauguauacacacacagauaaacacauaauacauuuaaaauaagugcuuuagggauggcgggauagcucagcagguaaaguaguuuuaaauuuuccugaaaagccacaaaauagucagauaaauacccuuuugugcauuuuauuuuauuuguuguuuguuugcuucuuuguuuuuuguuuuguuuuuguuuuugagacaggguuucucuguguagcuuuagcuguccuagaacucugcucugcagauggggcuggccucaaacucaacagagauucaucugccucuugagugcuaggauuaaaggugugcaccaccccuuauucguguuauuauguggugcugagaaucagauucagggccuugugcaagguaggcaaacacuauacugcugagguauguccucagccucuauuacauguuuuuauuucucuuccuaccuuuaauuucacuggauucaacaucuggaaggcccaucacaucgaucuguguccuuguguuggaggugcugaugcugcacacccuucuggugacagcugaagucaguaguuuggggaucugaucagugccuagagcacaaggaggcucaguaugugccagguaaacuuuauuaguccucaaaacuagccaaggcagucgagcaugcuuccagucacaacacuccggaagcugagcaaggagaaucagaguucaaggccagccugggcugcauaguaaaaccuugucucuauaaaaauacacuggggggggggggcuaagaaaugguaauggauuugggggugaauaagaccacaauauauuauauaaugggaaugaaacugucaaaaaaaaaaaaaaggucuuaagcuaaguuugaagcagaguuuugucauucccauuggguaaaugaaacucaaccucaguaauguauacaaauguugauuuuaguuguguuuuaaugggacugggacuugaacccaggacucuacacaugguagguaaucauuuuaccacuaaacucugucucuagccuagaagcucaguaguguauggaaguguccauuagugcccauuaauaaggaauagaguuauggcuugugggcauauuaugucaugucaggggucauuaucaguuagaagguuuucccugaccccacucuccaucucacucacccacccagcugcaugcugagaauuaagcccaggaucuagcaccuacuaggaaggugcucugugcugaacuguacccucuggucuugcaaguacauuagucagggcugggcuuagccuuuugaucuugaugcuucucucuucccaguacaaggcuuccaagauggcguguucucaggaaucaccuaucccuaacagauucucauugcacucucuccugugugugggaggcaggccaaucuguuccauuucugcuuucucucucaguucucacugaaaauugagauggggcaggguggcugaggguuucagugcucauuuuauccuuagcuguauauaguccacagcucagaaagaagugagacucccagauauucaguacuauauggaguggucaguuacugcacaacguagauagaaguuuuguguuuauuauugaacagguaugucacggagagcaauggucaguaaaacagaguuucuguuuugaggaacuugcugucuuacggagaggaagaugaaaaaagaaaaauucagugaauaauuguaguacagagugggugcuuugaaggugaaauacagggugcuggacagggcguaaaggggacuuccauuaguucaggagacaaaauauugugauaaaacaucaagaaaaaguagaggcauugacgucacgcagugcagucucugagacguguuuacccguaaagucucaggaggaucuuuaugugacgaucuuuucauucaccagggcuauuccgaaucuccagaccuggaguuugaguaugccgacacagacaagugggcugcagagcuugcagguaaagaacaggccuuuguguucuuugaugggaguuuuaacuggguuccuaagaagauuaagacuggcuguuuuccuacuuauuccuauuaaugauauuugaaacauaaauuagcuguuuaaguuggaccacguauguggacauuugggauugccuuuuauuuccacgaagacucagguuugaagucaacugaauugguuagcgcccagucccauguaaugucaauggugguacucauugacauaccaaaugaacagugaucucucacacaugagugagucacgggaaugcuagccacugugcuugcaucuuggcacaucuguugcugcuacugcuguugauggggagugugaggucagcaggagcugcuucuccuccagucuucacaagcauuccucgggacgugacacuaaaggcauagauucagggugauggccaccucugauacagcgcaguuugaugcacaucuuacuagaaaugccuggaucuaugauccacugacagugcaguggccccugugaucucuucgagcacaucagaacacugaggccuuccucacucagugauuagagagaguagucagagucacugugaaucagacaggaauggaguuggggcugggaaggaaagccugaauuucucugcugcaugggagaucugauguggauaggagacaacuuugcucuuugacagagcuuuacagcuacacagaaggaccagaauuccugaugaaucgaaaaugcuuugaggaggacuuccggauccaugguaagaccauuucccucacuucucgguucccuaucccaucaggacagcacaggacuucucuucauugucuaauugauguaggccaugcaggaguaugaacaguuguugugcugcuuguuuaaggccagacuugacauggagagugggccuucugggcacucugauggcaacaguagugugaccuuaucccuaugaaagaguaacuuguccuucugguccugugacuguccugauuugaaagguuaacacaguccauuccauugugaggaauggugugggcucaauuauaagugucucuugcccugcagugucagacaagaaguggacugagcuggauaccaaccagcaccggacccacgccaugaggcuucuggauggcuuggaggucacugcccgagagaagagacucaagguggcccgagccauucucuauguugcccaagguacugugaguaugacccggcaccucugccagugauagugccugguuauguauggaggggcucggcaagcucugcccuguguuuacagguaccuuuggagagugcagcucagaggcagaagugcaguucuggaugcgcuacaacauauuucugcuccuggaggugggcacguucaaugccuugguggagcuucugaacauggaaauagagugagcacuucuacugaggggcuuccauagggaagggagcagugggaagugagcccgagcuucuagaacuagcauuugagacagguaaauaggccauuuaaggugaaggagcuguuccaggcuguugggaauauacaggguugaacaguggagaaccuacuuaaugauuucuuggaaaauaauauaauaaagacaaagaugagaaaauaaaguuguagagaagggugugagguucccaugcugcuaggauguaaugagggguucuugugcuggcuccacacacucuguaaugcuggaccguugguaccugagcagauccuguucugcccaaaacacacccaaaagaaacuucucaucuugaacucuuugauauucccuucagcaugacaccaaacccaaaugugacauguagguacaacaaagcuugccgccucugguccuuuguccuaugggcaggucagcuacugcucguuuaaggauaacagccaucauaaauaaggaagauggcuacaagucagaggccagccugauuuacauagugaguuucaggguagccagagcuacuuagugagaccauauccaaaagcaaacaacaaaauuaaaacaaaauaaauucaguagaaggugaaaacacucacugaguacugcgucuucaggcaguguucaguaauguucuugggucauuacguaucaugauucacguugguggcgcaagugcuguuaucacccugauuuuguagaugaggcagcuagacagagggaaguuggcuuuacuuugcccacauaacuuguaaauguuagagccagaacucacacugugagacuugauagucugguucagggcuugaguucuuaaccacagugguguccuaaggucucguguagagcccagaugcacacagcaccguguugccugauggguaguacugcccagggcaucgcuggccucccucgcccugucaagcugauucagaucucuccugcaguaacagugccgcaugcagcagugcagugaggaagccugccaucucccuggcugacagcaccgaccugaggugagaugagcugcaagccagagagugagcucagggucaggcugagcauuucuuagcugugugugcauugcuuuugcacucauuagucggcucaagugauaggcucgcugggagucauuaguaggccuugaugagaucuuaggggacgggggcagccuggaaaauccaaaugaaaucugggaucgagccucuuaauagaucugcuaagaagcuggcuguagaguaccuuauuuguggagaaagcccaggggcuugcucuugggcucccaccauccacugggcacagugugauccccaccuacauugguuauccugacagugcuucauggcugcacagggacagcagcugcuaaaccacagggccaucuuuccgugucuuaggguuaaaaucagguuuuggcauuggaacugugguucuccucccuguagucagggucucugcauuucaccuccuguuuuccacuccaccgggucggcucugcccuccuuccuguaauccugccaggccugcuuugaccucaguagcuuacucugaguaguguuguuuuccuuuccagggggcuuagggcaguggaaucuuuaggccauucugguucauauuugucagguuugaguaaacucuggggauacagaaugaguuauagucugggaagacagauucagacaccccucugcucuccagggucucaggggccauuucuccuauuacagccauccccuaccacaugcauggauguuuacaucuuagccaggaagggagaaaguccaagggcuccucccucacauuuuuguugguuugagauuuaggcuagccuagagcuuacugaaucuugagacccuccugccucagcuuucuaaggacugguauuacaaguaugcacugccacucguggcggagcgcgccccggcccccugucuuacucucuuaugagcugguucuugugcucaggguccugcucaacaucauguaccugauuguggagacuguucaccaggauugugauggggacaaggccgaguggagaaccaugcgacagaccuucagagcugagcuagguaggacccuggccauccucucuuaaggccuugcuugggaacugaaacuagagggcuuuggguggguucuguugcugccugggguccugauaucuuugagucacuuccagguuccccucuguacaacaacgagccauuugccaucaugcuauuugggauggugaccaaauuuugcaguggccaugccccccacuuccccaugaagaaaguucucuugcugcucuggaagacuguauuggugagcaccuucuugggggcacucguaugcuaggacacugggcaggaaggagacaucuuuguacaguuggccucuauaugcauccaaauucaggucauagaaugaaguuugcaucuguauugacuguacggaccuuguuguuauucucuaaccaguguaccaauaauuuauguaccauuagguauuagaaauagucuagggaugaucucaugcuugcagaagguugugcauagguaaccacaaguuccauuccauccacugagggaugugauagcuaccugugggagggggugaggggaaauucccagagccagucuccaguggauaaugacgaguaucuauauuucuauuugaauacugaauuaugugacuauguagcuacuuggguuuaaaaguauuuguuuagugguauuacagacugaaccuaggaccuugucgugcaugcuaggcaaacagauuucacugagcuacggugcuggagugcuucuucuucuucuuuuuuuaaauuuauuuauuuuaauuuuaugugcacugguguuuucugugugaagaugccagauccccuggaacuggaguuacagacgguugugagcugcuguugcugggaauugaacccagguccucuggaagagcagccaauguucuuaaccacugagccaucucuccagcucacccacuggcgcucuuuuuacauuuuauuuauuugcauauuuccugugcauguggguauguauuugguacacguguagucugugccuacacuuguguagcuguacacacuucagaggagacacgagagcccugcucugucauucuugguuguauuccauuaccacagggucucuauuggaaccugauccuaggcuggcauccggcaagcacuccuagaagucucacuguuucuacccagcucuguugggguuacaaucuuacaugcggcuuaucuggcuuuuugcaugaacacugggaauucaaacgcauacccucaucuuuucgaaacaagugcucuuacccauugagccauugucucagucauuuaccuuuuuuuuugacagaaggucugaccuuaaacuugagguauuccugccucagccuugucaguaucugcuacuaagcucagugagucugaggccagcaaaggcuacauggcaauaagaccuugucucaaaaaaggcuggggguuggaggcgggccuucaagauacuagauuggcucccuggcuuuuguuaaagcuguuuucucaaucgugcaacagcuucacccucagauaagaugccucuuuggagaccacuccuaaacuuguauuuguauagugguuuggggcaacaaaacuccacuaggcagaugacuuuugcuacuugaguugugauccuagccuugaacauuggagcucuuucuccaacccuaagaagaugacuuuuaaaggaagcaagagugagccuagguggucuguuuccugaggauguguugugaaauggacucuguuucugccuggggagagaaugguugcugggugucuggccaucauacuuaggauggggacauugucagaaaccaggccccgggcaagccuggagcccugucuccaggaggagcgcugugcucagcacccaguuagagccucauagggugugcaggcuuuaucuugaccagaccuacugguuccucaggaagccucacuccggcagagaggacagccgaguuacucgaguggaggcacugaguggccaaggacuccagccuagggccugggcuccuagugaggacguuagaccgcuuucuauuuuacuuugcuauauuauuucauuugagcuacacacaguaaguuuuagucuuauuggaagauugacguguaguuuugaggcacuagucugcugacguuugaaagaacuggcucuacuuuguuuguuuguuuguuugguugguuggugguugguuuaaaacauggucucucuauagccuuggcuugccuagaacuugcuauauaugcuaggccggacuuaaaauuauggugauccuccugcugggauuaccagucugugccaccaccccaugcuuaacuugcuucuuuuuaaaauuagagacuaugucacauccagagcuguguaucaugcgccagcucccaucagccaguauuucauucuuuccuucauccuuuugcucuugucccuuauagagaacucgggacucuccuuaaagacuuuaguuuuuauccaaguggcuguaugggucucuauaaaggcuuggguucucgugaugucaugcaugcuuuuuagaauaaugauaccaaaaaggacauggcgaccuaaguucugcaccccauuuuacgcagugcacgcugggcggcuuugaggagcugcagagcaugaaggcugagaagcgcacucuccugggccuucccccucugccugaggacagcaucaaggucauccggaacaugagggcugccuccccaccagccucugccucagaccugauugagcagcagcagaagcggggccgacgggagcacaaggugaggcaucucagaguacacacucagggaguggggucggggcacaugauuccugggccagcagguuaugagaagccagcuccgaucaagcugaucaggaggcgugccuccacagcagggacacuguccccagccucagccccaguguauagcggauacuuaacaucagggcagcuucugagguucucuucauucuaguccuaaauccuccguauucccugcuguugucagguccccaucugagaugggucuguuccauuugaacucuguuccucgucaccaucucauugguuggcugcuuuucucagcucuucucugugcuuucaggcucugauaaagcaggacaaucuagaugccuucaacgagcgggaucccuauaaggcugacgacucucgggaggaggaagaggagaaugaugacgacagcagccuggagggggaggcuuuuccccuggagcgagacgaggugaugccucccccacuacagcacccucagacugacagacucaccugcccaaaagggcucccuugggcucccaaaguuaggugagucucaguucuagaauauucuugaagugagagccuucauauccuaggucaguguuggccuggaguccucugcaaggcuaagaugaccuuaaguuaccaugugcuguccugggcacaucugugaggacggccuugcugaugucacacaggauagauaacccuugugugguuccugugucaguaauuugaacugguccaacuugauagugaacaaaggcaaggagaaaaaaaugaguauuuaggcaaaccuauccccauucaucuuggagcuguauguggccuuuuauuuaaaaaugauagauggagaauuuuuuaaaaacccaauguauuaaacaguaugcuugggggaguuaauagaugggaagguagcaggaacuguuaaaaugguauauuguagcugggcauaguggcacacgccuuuaauccuagcacuagagaggcagaggcagaggcagguggaugaugucugugaguuccaggccaguuggucuacaaagcaaguccaggacaaccagggcuacacagagaaaccuuguuuugaaaauaaaaccaucaaaaaagaaguauauuugguaggcagcaacuuaauaaagagauguguauaugaacugauauaaaagaggguauguccugagcuuucuauguugugugagaagaauguuucuguugagacaagaaaaugaccuguuuaaaguuaguagcuuaugucucuuacacuucaugguguuuaaauacuacuauuguuuaaauaaguguuaaauacuacuauuguuuaaauaaguugugcuuuaaguuuuauauaugucccuaauuuugagucaacuggccauauguauuauagaaauauaaacauacuuuaauuguaugaaccuaacaaaauuauguaaaaaaacaaaguagucaaaauucagguuuucccacuuacuguaagagaccuuuuccugucuuguaaacaccuggagaugcuuugucuguuugaacacaggccugugacuggcacaccuugaagcaguacuugauaaaaucugccccucuuucuugcuugguagagagaaagacauugagauguuccuugaauccagccgcagcaaguucauaggcuacacucuaggaaggugagugugaccugaggccucuuugaagugcccuugccuggccuuggggcagcggaccggugaguggcucucugggcucagcauaaggccuucuuuauucuccagugacaccaacacagugguggggcugccaaggccaauccacgaaagcaucaagacauugaaacaaguaaguggcacuaagggaacguuuggcuuuguuuggucccaggagaauaaagugagccugggccaagggagaagccuuucagggcuauugucugccagcaagagccugggaagcaucucuuccuacgucugacuucgguuacagauaugugugucccaggcuuuagaguucagggagcccacgagguauaaggcaauugagaggcacuggcggauggauauggugcugucagcuuugcugguuauagcauggcuggagagcaaggcuuaagagcaccauagugggugugcucuagcauacucuauaaaccaagcaagcucaguuucccaggcccagagagcuggaguggagggcagacaggacccaggcucucagcaggcaggcagguggagucccagaccauccuguuuuccucuugugcucacugcugagagggagcugagggagcugugggugugaggauuagcggagagacgaccccaggggucaggaggcuuuccagugugucuaaacuguaacauuuuaaaguccaguuuugaaauugguaguaccagguggucucugcacuaggcuuuuaagaauacaguuaguuuugccucugauaucuuucuccugucauuuuuuaaaaaagauuuuauuuauuauuauauguaaguauacuguagcugucuuuagacacaccagaggagagcaucagaucuuauuauggaugguugugagccaccaugugguugcugggauuugaacucaggaccucuggaagagcagucagugcucuuaaccacugagccaucucuccaggcccccuccugucguuuuugcuucugaaagcccuuuccacuuuauuuugcuuuuuugcuaaccucuaugggcgcuuuucacacaggcuuuuuugucagaaguagauugcagguuuaaguuaggaaucuuuguugugacuuagcccucucucagaaggccaaaauaaacucuugggucuuugccaggugaggggggagucuggccagagaagaggggugucuuuccucagcaccuucuuuccugccucucucuccagcacaaguauacaucaaucgcagagguccaggcacagauggaggaggaauaccuucgcucuccucucucaggggugaguuaagagaccacaaaguccccaacugcucucagucucugagccgggccuggccacaaggcugcuccaggagucggccucuccuugaauagauugccauccaugucuuccuuucagucugugaauggcaccuugaacauaaaacucaaucucucugugcuuuguuuccuaccuguaaaagaagaccagcgcuagacuaaggccgucucucucucuuaucuacuuauuaauuugagauaucaucuaucuguagcccagauggccucaaacaccuuucccaaccuuaccggugcuggguuacaaguguuugcuagcaugcaugacugugguaccucaugaagaauuaguuaaaugauuccgggugacauucuugggaugucauauguuucagagccuccugucaguaucaccaacaucacccuucacuuugauacuuagagauucuauuccagccagcuaguaaacugccucaggggacuguagccugagcauggguugugugacuuuuguguuaaagggagaagaggaaguugaacaaguuccugcagaaacccucuaucaaggcuugcuccccagccugccucaguauauggugaguucucugugucugagaccgcgaaggagcacgggcugcucuccuuccuucagccugcaaggcuccugccaccugaggacccucaggagucccacuucucagggcaucguugugguccuagguucugaugcucaccugaguggucuauuuuucccagauugcccuucugaagauccuacuggcagcagcucccacaucgaaagccaaaacagacuccaucaacauccuggcagauguucugcccgaggagaugccgugagugucagggccaugaguggaacagguugaagcaaggguggaaggguggggccaggaguuuucaggugaguugccuuccuugacccagcuuugcugcaggugaaguuuaggguauuucugauucagacaaaggaaucaauuggauaaguuucacuaguaagggagauggcuaggccugaugccaacacagauugucacugagugaauuucuaagugaauuagguaugcugguuuuucuuuguaaauagaugggcaguagacucucucagagcccuuauucuagagcugugugguuggcacaccuugcauaggaugguuagcuccuggucaguuugcuugccaccaccgagccugugccuuuguggaguuucucccacuggccagucaacuggcagguagaccccuggcaaaugucucagaggagaaagugaaacucuuagcuguuguucuuccucucuggcugaaaggucuuuucguggaagagaacagccugaggucauauucugcauugaggacagacucaggcccacaccugaucuguugcuugccagggcugccuuguucugagcugaucuccaggucugguggucauaguggugguauccaagugagggagaggcagggauuggcucauaccagagggagguucacagaacauuaggccaucuugauaaucccagaaauacuguguuucuucugaagauuugcagugagaaguccugaauuaagaaacagguauaauucagugcuuccuaaaucuaacuucagcacccccaccccgccacuguagaguggaauuuccccacauacugguguuccacagaauauacuuuggggaacucagguuaauagaguggccaaagcuuagggagaguuuggaaaagaaaagaaguucaguuuuggaggagaagcagagaaagggacugaguguguauuggcgagaugaaagaagcuguucccgcuggaucacuugggagauagaacccuaaggcuggccuccgaggugucuguggaucguaggccuuugccagaggguucugaagcccaucuccucuguggacaccugggaaggagguacugugugcugguaacucacccaggcgcuuguguuccuagcaccacaguacugcagagcaugaaguuggggguggaugugaaccgccacaaagaggucaucguuaaggccauuucugccgugcugcugcugcugcucaagcacuuuaaguugaaccacaucuaccagguaccugcaggaucugccuuccuuccugugcgcugggcggggccucuggcagugcagcuccccuagcccagagaguagggcuucacuuccgagcccacuugaccucugcacagcauucuaacacgagggccuccagccaaggcuuuuuaucucuagacaaaagagaaccagggcugugcuuauuuuucuucuguugguuucaguuugaauacauggcccagcaccugguauuugccaacugcaucccuuugauccugaaguucuucaaucaaaacaucauguccuacaucacugccaagaacaggugauaaggaccagagaccaagaaagggugguguagacagguggcaagacuuccagcugccucuccacugagacuauugaacagacuuuuucuuuaaacaucuaucuaccaggccucaaaaaagacauaaugaaugacagagugucaguuaugggauuagcuacgcuagugaccaggaggcucucacccuaggcucuguaauugccacuucuauccuuccucccuuucugcuuccaggucucuguacagagcuuggcuuuguguacuguaaagccuucucugaugauucucguggacucuucacagccuccuuguacccacuguacccgguagcaccugcuugucagugugagacaucacaagggaauccaguuagcuguggccucuaagagggcuuggcauaaaucauuugucucuaguccuaccucccagauucaugugaagggaaaagcugcaauagugucuccaccccucacaguuaguaauuacauuacaagcuuuuugagucacagagcaacuguacauaccaucuuauagcagguauuucuucaucuuauagucagggaaaccagguuagagcaagcgagguacauugcuccuucuucuucagcucaucacgucugcucuggcagacccagccuuugcucacagugagcaccuggucuuuuugcauucuguagcauuuccgucuuggauuacccucacugcguggugaacgaacuuccagagcuaacugcagagagucuggugaguggcccagaucucccugccuaccccuuugguaugagcauucccucccccaacacaaagaggugucuuccagaagaggucaccuuuggcuuuuaaaguaccagaaauggccauagagucagggagaggacgcugcggagcagaacgauuggggauuggcugugugguuagucagggcugcucaccuaggauuugcccacucaagcugccuacaucuucccacugaaguccggggcauucugugacagaaucauugaaaucagucaaggccuuuggacacugcugcugagcagccugcagucgugauaguuguguuugucucuggcuuuucccugcaggaagcuggugacaacaaccaguuuugcuggaggaaucucuuuucuugcaucaaucugcuucggaucuugaacaagcuaaccaaguggaaacacucgagaaccauggugaguuggugcugcagccagccugggccaugccgugcccgccucaccugggacgugguccucaggguggggcuucccaggcagcaucguccucguucaggucugcagacuucugguucucugaugaguacaaccagaagcuggaagagacucucaggcaugcccugaaacaaacccucaaccacagacacuuucugaucuuucugauccugggugggaagugaugggcaggagucaggagccaccuuagcccugcaaugcuuuggaacaaggaagguccaugaguucucagagauuagauuacagagugagccauaauuaggguugcaaccuuagugguuugcuauagcucugcuugucuuagugccuaacacuucaggugccagugaaccagugaguucaagagaaacugcauggcuugugguccugucugcuaccccagaagugcuaagugaccauguaguggcacucacacuuacugcuuucucaccauggccgccaccauggccgcccagaugcuggugguguucaagucggcacccauccugaagcgggcccuuaaggugaagcaggccaugaugcagcucuacgugcugaaguugcucaaggugcagaccaaguauuuggggcgacaguggcgcaagagcaacaugaagacgaugucugccaucuaccagaaggugcggcaccggcugaacgaugacugggcguacggcaauggugaggccacauaugacgccgcaagagugggagaggguaggacaagggaugacuugacuccuugccugugguaccuuaguuuucucugcccuuaggcacugagcagggccgggaucuaguuuuaguggcucugggcaagacuuugggaagcuacucaguaucuguguucaucuguuucucugucccuccacucuaaauccugucuuuuccagaaauugccauaagauuccauccccucuuuaucccuacugcagcuaccuaaaucuauagauccucaccggcucugccucuaguuucuccccacuguuggccucagauuuggcuccuguaaucuuuucaacacacccauccuaugcuguugccccugaguaagauuccuguuagcuuucuaguucccauaggaaugaaguuaaacauuaagacaggaggggcaaucauucacuugccugaucccagaguuugcagcuuucuuuucaagcccguugugugcugguacccagcuucugucacacccaagacuccaggacagaguaugaaaccucaguaccagcugaggauugcucucaggagcucugcagaucccagcagccacagaugcccaugcucuccagugugcccucugugccugagaauagacuguacagguacagagggaaacuacacuuggucccugagcgcuagccauguugccuccuguuccugggccucuguagacuguuggauaucuacauccucccagucuaacuguuguuuaccugguguugcuguguuacacugucgcagucacaucacucugugacuaugccuggcaucugggcucaagguggugcaugacauuuugucauggaggugagaggaggagcagaugauggagucucggaguuaucucugucaucuagaaccaaggggagacugugcuuuaaaaacgaguuuuccaggacucuccugucugucgacauguuuugggggaacaagucucuuucucagaguuaaggauuuucuccuuauauuugacuauccucuccugaggaugggcuuuggagaugaucuucugguuaaaaucacgcuccuacucaaggggagcugcuauagggcugacuccuaaccgaguuuucugcuuugccccagaucuugaugcccggccaugggacuuccaggcagaggagugugcucuccgugccaacauugaacgcuucaaugcccggcgcuaugaccggacccacagcaacccugacuucuugccaguggacaauugccugcagagcguauugggccagcggguagaucuuccugaggacuuccagaugaacuaugaccuauggcuagagagggaggucuucucuaagcccauuuccugggaagagcugcugcagugaagagggcuggaaaagaccaugaucugucugucucauaccugagggacuguccucaccauugcugcagugcuccuguuccccuccagguggcagcacagcuccauugaguccuccacagccugcccugggccugugagugaacccagguuagccucugguugauucccagcauccuacucaggagcugucaucuccaagcugggaucuacucucccuccacuugcccagcuucuacccuccucucuuggauaugaucgauugaaacucauuucacaguuagcccuaggcuggggaaagcugagccgggccuggcaucccuucucgacagcagcuguaucgugaggucccacagacuccugggcagcuuuggcaaugucagcuggucaggaaggaggguccgcuugagggccaagaacagagucagcaccuuggcugugcucugggacuaucucgugccaucccagcauccugcugaguucuguccagaagugauggacacacagccucugcacccugguuuuggauguggucaaagguggagugaggcuuccugaagccagaggugccgguuuccucucgguugccaugaccuguaaauauacaaaacucugugugaucucuggugucauggugggguuuuuauuguguuuguguauucuguuuacauuaaaagaaagcaaaacugucc

SEQ ID NO: 1655 - RNA, 2722 nt, Mus musculus
ucauucuugacuuugaguuaccaaggcccuauagaguaguaaugggccuuccuuuacagcaaaauacucaacugucaggauccaucuaggagagccuaaggcuagcaggugacuuuccuagauaugaccuaccauuuuugcauggccuaugaugggugagcucuuaagaggcaaggucccaauagacuuuauuucaggauugauugcuucuuacagcugguaugccuuuuucugucauuaguacauagucuaauggcuccugcauaauaaggaauacaaaagagaaauaggcuggggacaaauuugugaucgaggaaaaacacccuaugucagauccaaggaugaagccacaaguauguacuaugauaaagggagguuaugggaaacuguugcuuugaacuuauaaugagcuuauagacugaaacacugcuuugaacuaucaacauccugcaauucccccuuuaucauuuuucuaugagaacuuucuaaagaacuuuugucuaagaagguauaaggccagagaaaaggaauaaaguguggcaucuggggcuguguggcccauccaccaaauguauguauguauguauguauguaugucacuaugcaugaacacaugugaagucgaugagacaagugguccagucggaccucugguucacgaagaguuaaugaguuccaaaccucucuccuggccagcaaaagguccuuaagagagaaaagaaaccagugcuaaauaccacaaaauaguaagagaaaauuacagagaaagaagccagccuuuuuaaagcacaaauacuaagagaaaagaaaccagcacuuacuaaagcacaaacaguaagauuauacggccagggaucaucagucuuugaccuuuauuugaugcugugucccacccagucccggugcccuaaaggcuggggcaggcccauggcacccaacaguucucuucugugcugaggaucaccaauuacuuuugauauggauaacauaacaaaaaugcuaauuauagacauaaaaacauccuggccaaguuauuucagagaacucaguccugacuaaaacugcucauccaugugccuucucugaguaugaagagcuccugauuccuuaaaauagucuuugugagguguucuacaguuguuuuguuuauagaaaucuuaccagcuucugacacaugaggaauuucuacuuaguccugggaguuacaagccuguucaaaacuugaaggaggaucuaggugaaguuguucagcuguuagaaagguugcucuugaaaagguccugaguucaauucacaguaaccacaugguggcucacaaccaucuauauaauagaaucugaugcccucuucuggaaugcaagaguauaugcagacagagcacuugcauauaaaagaauacaugaacaaaacaaaacauggagguuuacccucuguucagcucuacucuaaauagaaggguaucccagcuugucgcucccacuauugugaaucucaaggguucauaggaaaacaaagauggcaaacuacucuaacugguccuacagcccuaggaaggcuucucuucaaaagggauuauagaagccaauuaucagcuaaguaauaugaguaaaggccucucugccuggagguuuucuuguuaauaguuuuucuuagcuagcuugucuguuacaggucauccuaacccacuucacccugaacuaaccucuuucuaaaucauguuaucccaauucucccuaacacacaaaugaugaaauaauacuggucacauccuccucaccugcuacaguuuggauuuuccucaugguccugaguguccgcacacuuggucuccagcugguaacucuguguugggagauugugaaaccuuuggggcauaagugaguucuagcuguugucugugggucacugcaggcaagccuccaggguaauaugcuaauagucacuucucuaucauggauucagacaagaugccaaugguguuggacugaagccauggguggaaauccuuacuuauguugcuucugccugguauuuugucacagaauggggagaagaguaaaugauaacaacagcaauaacaauaaugauaauaguaaugaugaugaugaugaugcuucccagaagccuuaggucuggcuaguugcugaauuugccaccaacguccauaucuggcucuuuuuacuugaaauuccugcaaacauaaaaguggucucuuuagacagauuuuucuuuuucaagcaaagccuacccacccuaauccuacagugcccuuagacagcuaaacaaacgaauuuuuguucauuucuauuccaaaucuauggucuggcuuacuagcagagucacagauauuaaaucagagaccacuuaugugagaggacucaugcuaugagaaugaccccaggagauccccagaccauuuucucagguacucagggauggaauuuuauuugcuauuauaaccaauccucugagaaaacaaacaaauaaauaaaaccagcguccuccaacucugcugcuuccuugguugugugcacccuccuguaacauuguucucuaccacauuugucaacugggugugauaucacaugcaucuauucccaggcagaggcuggcagaucucugaauucgaagccaguguggucuacaagugaguuccaggacaucuggggcuacacagagaaacccuaucugauuuauuuaaaaaaaaaaaaaaaaaaaaaag

SEQ ID NO: 1656 - RNA, 4895 nt, Mus musculus
uguaauuuuuuccaagauggggccuuacucucagguccugcuuaaccuagaacucacuagacaguccaggauggccuugugaacaacugucaauccuccugcuccuaacuucccaagcacugggauucuaggucugaccaucaugcccagcuucuaugaaacaaacacuuaacguguuuuuauuaguguaucugugcaugugauguguguguaugugguauguggaggucccaggcaaguuuguagaguuaucucucuucuuccauuucugugggaaucccugggaucaaacuccuguuaccagcugcagcgaagugcuuuugacaauugagccaucucacuagccccuuaugcauuguugguacccacucauucuuuaacauuguaagcauuucuucccucaugucacacaguauucuuugaaaacucuuaucagugaugacugcauaaaauuccaauguagugaugaaccagccuucuauaacacuucuuccagcaucagaaaguaagcuauuucuagcuggaaagauuuaaauauugugugugugugggggaguagacagccaguccuauauaccccagaccagaggacaaacaacaucugugaaauguucuuguaagaaaaaugaauauuuaaucugcuugucucuaaaucuaacuuacaaguaguaugauagggauaugggcagcagaaaacaugcuagagauguuaaggagcugcugacucuuggagacucuacaaaacaaauaaacuauuagggacaaagaaauggauaaaacuuuugaaugaacagaaguuuaagaggcuccagccaguuguagcauaugaauaauauuuggauccacacuugaacucuaaaaacaauguuuuccaggaaguaaaauacuuagaaauuugcuuauuauauuaauguaguguuaaucucuuuaaacgugauacaagcauugugaguaugcuuuuaaaaaugaguauguuuuaaggacagauaccaaaaaguuucaucugaauggauguauuuaggaucugauucaaaaauauaauuggugagacauagggccuugucauagaaaagggcucugucauugcagacauaaacugaagauaagugaugggagcgugaggguuuauucugcucucucugcucugcucuaggugugaugcuucccauaacugacauuagaaaaaggaugaaacaacuugcaagugagcauccugggggccagucacugaccugcucuguggggacagauccugaacaggacugaacuccgcauagccucagcucucacaguuaguuacuagugucccugggcugcuuaaucucugaaccagucuucacuucucucucucucucuuuuuuuuucugguguguguguguguguguggaguagccagaggaggguguugaauguccuucucuguuauucuuguuauucuuaccuuauucccuuaauacagggucucucacugacacuggaguuuacaguguuggcuagguugucugaucagcaaagcccagcugcccuucugucucugcuucccacagugcuaggauuuuaggcaaacagacaacuacaucaagcguuuuacauaggugcuggggaucugaacccaggucuucaugcuuguaugguaagcauucuuacccaccaagccaucuuccugcugccccaacauccucaugggauugcauugagaaggaaacaugauguuaucugggaaaguacuugggaaacugggggaacuuggguauuuucaguuauguguggaagaggacauaaggcaaagcaaaaguaugcaccucucucuccccuagugguuggggcuucucagcucuccaccccuacccccaccccaagauaggguuucuuuguguagcccuggcuauccuguaacuugcuuuguagacuggggucaguuugaacuagagagcugcccgccucugccuucugaauggagauuaaagguguacaccaccacgccugcuggcccucagcuuuuauggauugcuccagugacucugccauuucuuucauuuuguauuugaguaguuuaccuagugguuacucuugggucucaggagaucuguauauccagaacugagcucaaacuggacuauagaaggacuucuggcagguacuguuaucaccuuacaacaauccaguuucaguucgaauccauacccacuacgguuuucuaguauacaaaaacuuuguucacaaacagcucugcuucugcucccccacccaccaauucccauccccacucuuuuggugguggugcaagcauugggaacuccuuuccuuuccuuuccuuuccuuuccuuuccuuuccuuuccuuuccuaaguuaaauaggaaaauuguguaaugcauuuuauauuuaccccugucauuauccuuacugacuccuuuaucuuuucauaugguuuuaauuuacuauuuaguguacuuucauuugcuccuggaaaacucccuauguauuucuuaaaaauaaaauuggcuugguaauaaagucuguuuuuugcgacuaucuuaauuuguucaguuugaagacuaauuuugaugggcacagaguuguugguugacagucuuuuccucucagaauuccaaauaugccaucuuacuauauuccagccucucugagauaagaaaaucagcugcuaacuguaggaagccaacucuaagauggcgccgguuucgggugugccuuugucauaaacaacaccacugcgcaggcgccaaccccucccaagcggguacaugcuaauuaggugacagcaguucaaccuaucccaggaggacacgaagccuuucccugugcuggggugcauauaagcagaccucccugggugcccgggguccccguagcagcaucgaggcguuccugcaauaaaggcuguugagaagaauccaacaguguuuugucuuccuugccggcugaggugggcgcaacagcuaaccugacagaggaucuugguacugaaagagccuuuuucuucuguuaagucuguuuuucagaaguuaugaugaugguucuaggucuggauugcuuugagcuuaucauccuucgaguaugcugagcuuauauguauagacuaaaaucuuuauucacauuaagaaaguuuucaaauauuuuucuuaauuaauuaauuaauuuugaggcaggguuucucuguguagcccuggcuguccuggaauucacuuuguauaccaggcuggccucgaacucagaaaucugccugccucugccuccugaguacugggauuaaaggcgugcgccaccacaccuagcuucaaauauuuaaaaacuacuguuuucuguccuguccucuccuguccuuugaguccccucaugagccuguugaucucuguggcuguguucaauguuuuccccuuugcuauugauaauuccccuuuucagagcucagauggcuugcuuaccuucagguucacugauuuuucuagcuguucagcugcuguugagaccuuaggggagaauuuuaauuguugugcuccuuuuucaaucucauaauuuauuucuaccauuuaaaaagauucucauccuuauugauguucuuuauuuggcaagacacaaugcucauauuuuuucuuagucauuuagacaucuuuuccuuuagucuuugaacauauuugaagugcuagcuuaaaguuuuguuuagucaggcagugcccacacuucccuggggaaagacucaacuguuuacuuuugccccuguguguagacauacuucguuacauuuuuauaagucuugcaucuguuuuguuguugaaaacuagacuuuuucuuuuuuuuacauuuauuaugugugugcacccagguauucaugugccaaaaguguuaauauggaagucagagaacagagagcuucugcguguguucucuccuucuaccaugugaauauuccagaaaugaacuaagauugucaggccuggucaaaaggacuuuuacacacuaagcuuucucagcaacccucaaagcagacacuuaauguaauggagggaaaccaagauuugcuguuauuucugcuguguaaaauagucugagcauaacacaggacuugagcuaaaaggccuucaaagcccaaaguucuucagagaggacuuccuacuuguugguguggaacuaaucucaggaaagcccauggcuugagaccccaguguauuggguaaugaugcccuuuaaggguccccaaauaccauaguaagauccccuccuacccccaaggcccugcaaucuguagcuuugggcuuguuccucagaauuacuagagcaugugagcuucagaugucaaggucaaagauccuaguucaugccugggcaaucuucucuggagaacuagauggacaaauugaagccauuuucuagccuuuuaauccaugcucagaaccaaacaagaaugaugcccaaacugcuuuaagcuggaaugaucagugccucagacuguauuagccaggggugucagagcugucugcaguagguaaggucacaaaaauucaaaggaaggcaggaguaauggucaagagagaucuuuccugggaaauggcacaccuaggagggcuccuaauccuuuccuggugaauuugggguuggcaguaaggugaugagaccagaggucagucauaggugccucuggccauuuccagacuguacaguucaucugagaggagcacuaagacaacacuaaggcccuccaacccccagccccaccagcuguuccaaacuguccaucugugcaagaagcacccaugaaauggcuacuuggguacaguguugucacaagagugugcaauuugaauacugccaggccuggguuuaacugcaggcuuuggcauuuaaccacugugguaaguuggcugaguuguuaagauucu

SEQ ID NO: 1657 - RNA, 19557 nt, Mus musculus
cauuagaccgagaacaaucacacgagauugacaagaguggcgagcacagaaggaaaggcagugucuuguccagagcucgagaagggcgggggagggcgguggagcccggguuacuuugaggaggcugcacagccacagagcgacggggaagagagcuagcggggacgaccaggcggcccgcuugggggaagggagucggcggcucagugggccucugggguguaguaugugucagugccugugaguguguuuguguguguguaugucugugugugucuggcggagagccagggugauuucccauaaaccacaugccccgccagcccgcccgcuuaaaaggcugugccgagggcuggccagcgaagcucggccaggggaaagugaaaguuugccucggugcucucggugucgcugcggcucucugcaucccaggacagcggcguggcccucgaccggggcgcgggcucuucagccacuagcgagcaagggagcgagcgaaccagggcggccaacacgccgugccgggacccagcugcccguaugaccgcgcggggcgccgcggggcgcugcccuucuucgguaagcugcaaccguggcgcgcggggcccgggccgggcuggggcaggagcucugcagcaagcagcaggcggcucugcggggccacuuggagcggacagccccuucucgccagcugcccaggcuucucggcccuggguucuggcuuccuuacugcuucuaagcuacggcugaggcccgcgguauuucaauagcugcuccuggggcugcagcgcuuugcgagguaaagagaaggcugcucaucccauugcacggaggagaacacugagcuacccacaggcuggagagagagaugggggucugggggggggggguaucgcagggauuggcacaggcccaaugucugccagaauggucaaccaggucuccagguuccgagugacacaagauccgaguguggcaucauccccaguagauaucuuucuuugguuguugcacauguuuuaggccccaguugggagugggccuucaggguagggaaaauucaggcucacucagcuuuacaccaggaccugugcugagcaaccuguuggcagagagagagagagagagagagagagagagagagagaugggcaugcugcuacuuguucaauggauguguaggaacuauuagggacuuggguggcucuuugaggggagcuggacccgaaucuuuucuugaagaaaaugagauggggcuauucuagacucugcggcugacugaggaaagaaagugcaaggagaguucagagcugcagcugauaaugggcugcucagaagcugucuccaguaauggcagcagaugauagcauggcucuuacagagugaaggaugguacuuucaauccacagcaaguggguuugcuucagaagagaaugagagggaaaaccuggaggguaggaaccgaacuugugaugggcagcgcguugcaggugucugggaggagagaaaaguagaacagcagagagaggggcucagugagaggcagaaggugggguuaggaggaggggaagggaggaaguuaucccacaugcaacaagcauaaagagagaagagggaagaaaagaaagacuacaaggagacauaagaggaaagagaggaggccgagguucagccaggcagucaggccgggucucugucugcagacuguacugauuggaaaauggaacaugaugucuugaagugcucagagacugccgcaguuuccaggcugcucucauagucagaggcugaggcagugggugggaggaagaagcaagccaggaagagccuguccagccagaugcaggcuagaguauuaacccuuggguguccaucuguaucccugucuauggcagcauugggguuacagagccagauccaggaguggcuggucaucuuugaagccagcagcugugcauuauuucugugcaugcuugaaaugccaccaaaagccagguagcccugaaguaaugucuuuaucuugcuaucuccaaacaucaauggcuugaaauuccuggguugagauauuucugaacaucuccauucccggguccuuuccuucauaccauacacacauggacugacaggcugagugauaccagccugggccagagucaucuucugcagucauuuccuuuaacagguucugagacugggguucaggagacccgggcugccacucccacucaggacuaacuuuccaauugcccaaccaugcccaaugcaguuuaucaacccauagcuggcugcacccucucccccaccucuuucucccugucucucugugucugucacucugugucucugacugucugucucugacugucugucucugacucucugucucucucucucucuaaggucaggcaaggaaccuaacagguccugugcguaauggcauuaggcaacccugugccuuaacacccaucagcaucuuccacccuuuaaggccucacucuucccuccgcauggcccagccaaagcugccuuuccucccugguacucacuggcaaggcuuugggcuuuuagauguaacccaguguuguuauggacuguuucauagccucccuguguuuuuccaaugcgcuccuauuugcaacauuugucucaucaucuggacuauuggggcagagccagauccaagaaggugccagucaucacuccacccugccagcauuucccugaauugggggauaucagcagccagaaugcucagaauggcagcaucaggccagggaaagaaagcccaagagucccucugccccaggcuggcaucucccgggauacccuauuggagcccgaagggauggaaggauuuuagaguagaggaggaggaaggaagaaaggagaaaggaaggacccagucaggugucaggagccagaccuaggacucuagggaugagcagcugcagggccaggugggugcugacggaaaggagagaacuuucuugcuguggcaagaguuugcugacuagaugaagggccugaugggucucagauaaacagaugccagcagggaaacacagcauuguccuugauuagucagcuggacuccucuugaaaugcaaguccaaggcucuaggaggucucccacuggagcugaguucccaguguugcauccugguauuuuccccuguagaaccagaccuguguaaccaggugggaaggaaggaaugaaggaaggaaggaaggugccagggguaaugaguguuucuggcuugcaaucugaaagcuagugacugaccacaaguuugaaggcagcuuacaagguaucuauuugucucaguguuaaaaguuaaaaggauagaaaaucuuacccuugagucucucagucacuaaaacuuauacugguuggcacaccaccaguauuaucauuagacauucucuguaagauggaaagguggcucaucauuuaaaaacacuuguugcucuugcaguggauccagguucaaaucccagaaucuagaugaugguucacaaccauucauaccuccagguccaggagauuccaagaaggaagcacauagagugugugcaugcaagcaggcaaaauauucauaaacacaaaacaaaaacaguaagccuuuuaaaauugucuuuuaaaguacucuguauuguugagcugcucuggguuaaccucagaagaguucuuggagaagauggcauuugggcuauuaccaagggaagagugagguggugcccuggcugauaagaaucuaauggugcugcagcaugggaauggggcguuguuucuuugcccuuagugggacauggggguagcuagggagaggaagugcuggaaagacaugacucccuucuguuauagacauggcugggcucccggcugcugcuggucugucuccucaugagcaggaguauugccaaggaggugucagaacacuguagccacaugauugggaauggacaccugaagguccugcagcaguuggugaguaugagaccaugccuucuccucacugaggaaacugagguagcaagccagaaggcagagucaaagagaggcuuccagaaaacagucaaguggauaauggcucuccugguacuucucucauugaucuuuuuagguccucccaaccccuuagucugggucaccuguagugacuagggugggcuucuaacugcugccuggguuaaugguuguccaggaauguccacuauggauucuaaacugcuccuugacccugcucugacucagacaaugccuccuuugggaagucagcccagucugccugcuggguccagaugguucauccugcuccuggauagccagaucccugagcgccuggcaccagggccccacccaaauuuagaugggaggcucuagccuaacucugcgccuucugccuucauuccccugauccuugccccugagguuggaaugcccugcucaucugggccaggaaggaacccaggucccauucuaauaggcuuaaugcaaucuucaacaauucuaaaugucaucuagccaggcaggauccaguuguugucaugguuccugcuccucucacuaaagaauuuauuccacaagcccggcaggguggggcaccaguggguaaggccaugugcagagccugaacuugggcccccgagcugaccuucccaaucucccuucuuaacagcacccuaugcaugcagcuuccauggcaggcccaaggccaugagugcugucguggucucugcuccagggagaggcaagggcuagagacccagacuccccagagcucagccagccucucccugaggcuuuucaugauagagugcuuaccaccuuccagaaaagauuacauccuauauuuuccuagagauaauucuuccauauacagacuagauugugcaauuucauaggucaaaguagaagugucuguuguuggcuuuuaaguacucuggguauuuggaagauacagcuuuuccccagcuguggcucugucauuuuggcauuguuuuagggagguaaaauuaaaacaucauucaccccaaaaccuggguuccccauccugaagcugaguggaccuguagguacuauguaaccacuggccuguucuaucucacagaucgacagucaaauggagacuucaugccagauugccuuugaauuuguagaccaggaacagcuggugaguagcaagugucuguaaggugcuuaagugaauauucacggcccgcucuguguuggcauggaacaguaugaaggcagcagaaaaccuagagcagacaggaugagggucccugggugcucaagugucaaguuccagcuugcagggcuggguaggguccagagcuuaaguccuucuguuuccuuacuuugaccugguauaaaucagguacuugcuaaaugcuaggcacauuccccaauuaauccuaacaauacaauucugagguccacaaauauugcuuguuacccaugcagagauuaaggagcaugcuuagccaagugauagaggccuaauuugagcccaggaauguuauaccuuguaaaguaaaaaaugugcuuuauuuuuuagaucacaucuucuccaauccacuggccagagacaggaaggcagucuagccuggcuuucuaccccacaccuaacugaccagccacccaaugcagccaauacugccucucugcaccuuagggugcugucccucucuccuccccagucccuuggaaauuuucaggggcuucuugacuucccugauucuagggcacucuccaucuuaccacuagggggagcccucugaaaccccaaagccuucacuuauuucgccuuacuugucaggagccccauggcuccaggagaaagcacagucuaguuccaagucugcaguaccuaccacacccuacguucauuucccuccucugcuucauucugcuccccagcuuuugcaucagcucuuugugaugucuuuccauccuuuccaugugccccgcugaucccugugcuacacaccucccuaucuucaagccucaagagaacagucaggcuacccagaauuccuucuaucucugagcucucaugcacuagacccaugcaucucugugaacaugccauggccugcauagucucaggguuucuuccauccauucuauugcuccuucacuugcaccauggcaccuauuuauuggaucaggcacuagagauacagagauaaaaguaguuucugucuuugaaccaacuacuguauccuuggagacaaaacccaaggcuacacuuuugacaaugagguaguccucccucaguauuuuuauauuuuggagguuuugagggggccauauggcaaaaaaaaaaaaguggaaguaagcugaaaggagagaggagagagagagagagagagaaaaugcuaaggggcagcaaggcugaaacccacccuccccugugucuccugaauaaagcugcauugcagaaaagcucucuccaaccagaauccaccuuuccuucacgccagcccaacucuccaucaugguugauuuaaagaaagaaaacaaaacacaggccaaggguaucaccauccucaucaccaggguggugugucccuuccucagauuacagggugacaggcuacagcccucugucugccuagggugugaucgucucauauaaagccuggguuuccaggccaccauggccaggugcuaaccuccugguuccuguauuccaggaugauccuguuugcuaccuaaagaaggccuuuuuucugguacaagacauaauagaugagaccaugcgcuuuaaagacaacacccccaaugcuaacgccaccgagaggcuccaggaacucuccaauaaccugaacagcugcuucaccaaggacuaugaggagcagaacaagguaggguggauucuggggcuggagcaccagagaagggcagagggaggcuacagaggucccacccugccucauaugcucaccgagccugaaccuuacuaacuuacucccuugcccauucauuucuuaugccauccgccuuuaucaagcauucauuagacagaaggcacagugcuggacccugaggauauccuuggaacaagaaauuccccuucccacccuuacagggcuuauagccaagugagguagacagcuguuaaaugaugacaccuauaaauaugaucagaagggcucuucauucauucaguaaaaccuuacugagugaccaucaagggauguucugaacaccagaaaugagcugugauuuuaaaaagggggggggcaaaaauccccacaaucaugacgagaggaggggugcugaggcagcuaaaaugagcaaguaugugaauggacaaugaugcuaacagcauuggagaaguguagagcagcaggugaggggcgcccugggugacagugagaggaacaggaacccgagacucugagugugcggugaggagcuaauguaaugaggaugcagaggggaagaggcaaaggcagcuucuaagcaagaaaacuuuagccggcgcuccagcgugaggaagagcaguaagagccacagacagagaaacagaguggggagugcuaugcucaagcccuaggguaaccagaaagguuugcauucagaaauccaaagcggcucaccauggcccaggcaugggguguggacaggaggaagcaaagucaggaagcacugcauucaugcauggugucaaagaggugggcuuuuugucuaaauuugaaagaagccaccauaagcuagugaaugacacgaugucauauaugauggaagaccaucugguggugaggacgcuguggagagcaggaaugaagggcaggaggccagcaggagguucagccaagcugggcaugguggugaguugaauccgaggggagcaggggaaauggaggugagugggugugaucccuccagacagacaggacuccaugcuuccuggcagaaggggaagggugagugaggaugcucucauuuugagucccuggaguucucacugaugucaaaauaaggaugaccucaggcagaguagguuugagagaagagcucauuuuggugugaggcacaucugacagcugcaggcgcggcucaugacugugaaugcuggacauacagaugcuguuugcagagccacagaacugcacagcccugcccauccuucucacccuggugagaagagaaggggauccaggauccugaauccugaaugcaaugcagccugagguaggaggaaaaccuagagagggcagggcuuccaaauggaaggagccagaagcuuuaucaaaggaggcugagaagucaauuaagguaguguccauuggucugucucacuuggcagcauggagauugcuguuggaggcagguggggagaaaagaaagagaggaaacagagaccacaaaguagaggagcuucgcuccaaaggggacagagaagcagauguucugggguggcuuucugguggaggaaaggcugguucuuuaccaugcagagauucacccggagagcuuauuuaaaaugcagagucccagcaucacugcuacggacucuacuuuccugagcucauaggugagccugggaaucugcauuuugcgaagcugccccaucagugguugagauagaagccccucagucuuuccugggccggugaccauucacucagugcaugcugugggguggcucaggggaaagacaguguaagcccaaggagccaagucuagucacauggcucagaaaaggaguaugagcuccggaaccagcaggcuccacacugagaaagcuugggugucagguucuaggggaggaugccugguuucuucuacagcauauaaggcagguuugagggaaacagcuuuauaaagacacaugcaggacagagccagcuggccugacuuaacagcuccugggaaaggcuggcugcuguugcucuaacaucacaaacaaggagaugaauccacagaaagccggucuauucucaccuagcugcugagugaugaauccaagcccaggucauuucauucauuauuugccuaguaaguguuuaugagccugcuaugggcgggccagagagaugcagugauguaaucaagggagcuauaguagccguagaaaaccuauuguucuucccagaacagcucaacuucaagggggaaaguuggcauucuggaaauaagccguaacacauauagcuugcugugaaaggugagguggaccuagggcagaacccugcagcacugcaguauuuagaaggaacucucuggcacagagccugaaggagcagcuggugaggaaggaagaacucuggagagccuggcuucuccgagcugcauggggugugagugugagcaccugggcccaaggcagaggagaaaaaccacucaacaggcaggccagggaguccucagcucuuccuccaaaauguggcaccagccaaagaccucaucuccucugaucuccccaggucugcucucuacaccguaccaagaugauuuuccuaaaauacagguuuuauaccaugguuuuaaaccuccccagcagguuuucaguuuccgguuggcucugugaauuacaaguuccuggcagagucaacaaguccuuggccuuggcaaagcccuuucagcugccacuuucuucccacguggcaaagcugcacccgcuccagccuucuuucacucuuuugcugacucaugcuuuccugccccagggcccuugcauccucuaucaucucuggccccacuuccuucucuucccucgcucaucuuuuagcuguuccuuuggagaucuucucccugggcccucaucuaucgcccauuuguuacacaccuucugaugguucaggacacucucuugagagucacugugacuuguaacaaugugucugcuggacucagugcccagcuuggccaggaaccacuucucuuuuguucauugcaugaugcccagguaaguuaccauauaucuggcacuuaaacguguguuagauggaucucugacuaaaugacgcaucucucaaccucaagacugaugcugcugcaaagcagagaaggaaggaaacaaaagggggaaaggaaaugccugugagaaaccccaagagaguuugacaaaaauaccagugagagguagcccaauguucaugcuuaccaaagggggcuccacucuccuccaggccuguguccgaacuuuccaugagacuccucuccagcugcuggagaagaucaagaacuucuuuaaugaaacaaagaaucuccuugaaaaggacuggaacauuuuuaccaagaacugcaacaacagcuuugcuaagugcucuagccgagguaagcacagaaggggucagcuacagggagggugugugcaaggugagacggggcuaggggaaucccagaggcagccugggugcuaaguguguuucuguguuuuguguacucguguggcuucauguaccuuaagguccugggcacaugucucugcugacaugugugugcauguacacugacuuaugccugcauguacugucucacugccaaacuucauguggcagcaucaagaaggccccugcugguaacugugauggaagugaauggguaaggggaccuuucuuagaaagccauauaggcaugguggcgucccccgggcucugcaggcuggcugaauaaauggggguuccggaaagagcaggugcuccaccuggcaaucaggguccuugcuccaggagcucugcugcaaaacaccaggauaaccuggcuccagaaguccccaggaugccuuggauguucccucaagggauaaggcuggauuugaagucugaacaucauucaaacucucucuaccugugcacucugaguguacucgucucugcauccugugccacguguguccugcguucagccucgcuccccaaggcaggggcugagguccugcaaccagacaauagccacauccagccuuagugcuucaauuccaaaacccugaacuuuggcugcuuuccagcccugccuugcccugccuguggcaguggcugaggugguuccacuccuggcugugcaugaaaccagugucuuggaggcuucugagugucuuguguuaauccaggagcuauugcucagcccuguggccugggugcugcuaaccccuggcuuggcuucuggccagcuagagccccaguacacuguccuguggucuuccucaccucaguccuucucugucugucuguaccuugcuuuugguuccuaguccauauccccugcguauugaucccuccugccugaguucugugucaugaucguuuauuacuguccugcccucuccaccgccccagggcuguguuagaagagggacccccuucccaugccccagggccauaugccccucuuagccccucugggggagcugugcuggaggcuggugacucuaucuccuccccaucuuucucucucccccucucugugguucuuucagauguggugaccaagccugauugcaacugccuguacccuaaagccaccccuagcagugacccggccucugccuccccucaccagccccccgcccccuccauggccccucuggcuggcuuggcuugggaugauucucagaggacagagggcagcucccucuugcccagugagcuuccccuucgcauagaggacccaggcagugccaagcagcgaccacccaggaguaccugccagacccucgagucaacagagcaaccaaaccauggggacagacucacugaggacucacaaccucauccuucugcgggggggcccgucccugggguggaagacauucuugaaucuucacugggcacuaacuggguccuagaagaagcuucuggagaggcuagugagggauuuuugacccaggaagcaaaguuuucccccuccacgccuguagggggcagcauccaggcagagacugacagacccagggcccucucagcaucuccauucccuaaaucaacagaggaccaaaagccaguggauauaacagacaggccguugacagaggugaacccuaugagacccauuggccagacacagaauaauacuccugagaagacugaugguacauccacgcugcgugaagaccaccaggagccaggcucuccccauauugcgacaccgaauccccaacgagucagcaacucagccacccccguugcucaguuacugcuucccaaaagccacucuuggggcauugugcugccccuuggggagcuugagggcaagagaaguaccagggaucgaaggagccccgcagagcuggaaggaggaucagcaagugagggggcagccaggccuguggcccguuuuaauuccauuccuuugacugacacaggccauguggagcagcaugagggauccucugacccccagaucccugagucugucuuccaccugcuggugccgggcaucauccuagucuugcugacuguugggggccuccuguucuacaaguggaaguggaggguaaggaggaccccaagagaggaagacauccuauggggcagaacaaaggcuggguaggguacaggcuggaggcuaaccagguuccaauacguuaugcaguugcuggaagguggggaugacagcccgaacgguagacgguagugauggaguguggcuucacacaggagcugccagguuugguggugugcauuuaacccuagcaauccagagguacaggcaggccucugaucuacuggucaacaaagcaaguucuaggcuagccgaagcuacauagauccugucugagaaaguaauuaaucaauuaauuaaugaggucuccagccucaagaucauuaagaaaggaugaguucuaggcuagucagagcuucauagagagauucugucaaauaaauaaauauauaaauaaauaaauuuaagaaguuuccagacuccuugagauuauugagaaaggaugagaacagaauccuguagaaaggagaauucuuggcugggaacucaggaggcagagaggcagagagagaggcagagagagaggcagagaggcagagaggcagagaggcagagaagcagaaaggcagagaggcagaggcagguggaucucugugaguuugaggucagcaugaucuacagaguaccagggcagccaggguuguuaugcaaagaaacccugucuugaaaaaaaugagagagagggagagggagaagggaugggagagggagagggagagagggagagagaggggggauauucuuaaacaaccaagugggagagggaaggaaaggggaagagcuugagggagcucugggagcuugagggccuauaggugguauucuacaugggaggggacaggagaaggcgcacccauccucagaggcccaggaaucucccccagcugugcaugcuuugggguagugggaggaauucuagcaagucucucagugaugcucaggggcaugccagcgccucagugagauaaaucuuucuuguucucagagccaucgagacccucagacauuggauucuucuguggggcgaccagaggacaggugagcaguuggaguggggcuauaggaaucacuggaugucugucuugggaccugcuuccccucaagacugaaagagaggcuucuccccccuugcccuaaggagauaaagcugcagagcaggguggguaccaagaaagaagggccccucuucuucccaugacaguggagcuuucuccugauuucuuccuggaguugggcaguucugggucuucuaaaucucacauagauggaauccacgugcaggguuggggguaagcuaggagguccccucagucccaugcuccugcugaagucuuaugucagcccuguguucugccugcagcucccugacccaggaugaggacagacagguggaacugccaguauagaaaggauucuaugguaagguucugauuuugauaucucucuaucccuuaaaaagaacuaucuccagguacccaguccuguuguagaaaccaccugaugcccaagaggcccacacauuucaacuuccucuccccgucccacucccaagcccauacauucaucaucacgucuagcuaggcuccucucuuccaggccucaggucuccucuugcuccugaaucccugcccuggaccaguuacugcaaccucugcauuauguuucuauucuugcuguugcuacaucugaucccaaagcaaccacauucuuccuccucuaaugaggcuuuuuacaaggucuuuaccacccuggagaauuuucauuagccuuugcauggccgccagcccccuucaaauacgugcauuuccagcuuggugcugagcccugaccuccucagcauccucuucuugccaaauugugccuuaucugguccuacucccaagccaagguuauugcugccucccugauuuaggaucauugugccauagaaauuuagucuuaggagagcugucgagaggucauuuggcccagugucccagccuaaaaggguuacucugcaucccccacagggagucagccagcuuccugcacacacacacacacacucccaguuccaggcaaguucucugcaugccagucugcucaacuggggucacaacauuggggucacaacacacaacacugggggaguuccuuccuuauguaggcaaagcugccuuccuuucuucccuucccagaccaauccucucucaucuucucaugaggccugauauuuaaagucagcuauucaugucaccuuuuaaaauucucuguguuaaguguggccaagccccucaaacauuccuuauaugauaugguuuucagaccccucaccauccuggacacacucguuugucaaugucccucugaaaauguggcgcccagcccuggacacaguacuccagauguugucugaccagcucagaguacagugggacgguugucuuccuugaucuggacaguacucuucuacucgugcagauuaagaucacauuaguuuuaacagcugcaucauauauugucauauguugagcuuguagucuauuaaaaaccccaguucuauuuccugugaaccuuuguccaguagaccgucgccaucccauacucccauacuuggacacaaccguuuuagccaaaguguagcuggugcucaccuuuguuaaaacuccuuguuguuuucugcccauccccugagccuacugaaaguguuuuaguuccuaauuuggucacuuuauaacuccugguuggguccccugcacauuaaugcgugucuuuuguuguccuugcccacgcuauugguggagaugugaccuguauucuuccucuacacccacccacaccagccuauccagaagccuucccuuccuaaaauauuccacaucccucugguugaucuuuuaauucauucugcucuguuguauauggcugaugcuauauuaauccacauacauuuggauguuguuuuauguauuuuaaaucauauuuuauguauauauguaaauuuugaacuacuaagaagauuguaagccccuagagggcagggacuaucuuccuuuuuauuuuuuuuccccuucacuucauuaauucuaguacagacagugcccccucuauccuugucaaaaacuuaguaaauggugguagcuguuuucaggucugaaucaccaacuaaccccggccagauuucucuaacugaccagccuucuggcugaccaauuaacuagccaacuaaucaacucaucuuaccagcuaguuggcuaacugacuacuuggccaacuagcugguaacuacuuaacugacuaguucuugauugaugagcugauuggcuaacuagcuggcagagugcuuaguugauuugcugacugacuggauggcaaacuagcugugugaucgguugaaguuuccaguuauaccccuugccacauguaagcaaacugucccauguguaggaugaugugucuaagccccuuucccaaaggaaauaucacagaugcucagagagccagggagauuuauuugaauuaaagcaagcagcaacccauaucuagaaucccggggacccacucagcaguaauguggguggagacgggugaaaugaauuagcuggcucacuggaacagcuacaaggacacagagucccucugaccugaaucagagagcaaagguugcuggggauuugggggcucagugcugugucaccuuaccaagggcuaccaggguucuuccucccugccaccuguaugaccuuguccucggcccugguuucucuguacccaguuguccuucccaugccuccuaacucucagaccugcccaagauuuuacguuccucaccuaaggauuucaagauuucacucagucagcgcagaucuaaccugauccccauuccaggcucaaggagccuaugggaacugaaugucuguguccugauugaccaauacucugacaaggagaugaguggggcacacagaaguggggacuaagaaaaggucaccaaguuguagaaaacucaggcccucggccccaggaaacugggaguuggguuagaggcuaaggucaugcccucuggggccuucuucccgaugggcccugccagagccuguggccugguuguaccaguauggcucaugcccaguuuauaguuucuucuuguuuccuauccaaagcaugggaauaggcugguggccaaaggcuguaggucucauuuucuuucauacccaucacaggcuugaccaguggggcuauggacauuacuggggaggcgccauacaggguccaaagucaaacuguuggcugaaguccaggggauuucugcuauggaacaaagaguucugaggauacuggacaaggggacaaagaugggggugggguggggagagggcagggcccuggcucccauggaugacaagaggcaagucccucaucccaucugggaggaggcuaggcugcuuggggugagcaugccuguugacagggcaagcccucccuuuuccuggcauugucucuacccucugccccucaagccugaguucuuucuauucaaaugccuuugcccaagugucuucugugcagauacccucuaagggaugguaugagaguuggcagagaucaccuuaggucauuggucuaagacuacugagauggccuuaccugagaacuagccuaguaggggcauucaagagcuuguucccugcucccaucugcuagagcaauagcccucucucucucuuggccucgaccuccuccagucuuagucccucauuuuguggucacuacucccccaggaggagagguaggaggugaggccaggcuauccaaaggcuuggacugcugccaggcaaagcugccuggucucucuguggugucuggggucgccuagagggccaggaaaaugaccagaggaagucuugccuuaagucagccaacaacccacaggaaugucacaccucccccaacuauguccuuagcgacccucccccacacuccccugcugaccagccuucuucccuucuuuccccuacagcugggcacacaggacuaucucuuuauggaaggagacauaugggaacauccaccacuacccucuccuaccaucuuccugggaauguggccuaccacuaccagagcuccugccuaccaagacuggaugaaagaagcagcuuugauggggucuuuccauccucacccuuagacucucaaccaaagagaaagggcuggaggaugccccccacauacugccacuauuuauugugggcccuggaggcucccugcauuggaggaagggcagcucagcagcucaggacccuuucccuuaggggcugcuuccuccccucaaaaccagaaccuggcaagggacucacuagccuggauggcccaugggagaccaggacagaugagaaggagcagaagagcccugugcccagaagacccaacuggugccaaggaaucccagcauggacaggcagggaccuguuucccaagaagagagccugauauucaaagggugggacagcaucugcccgacuucccguaaaggcauaaaggcacgcagcccaaaagacgggaagaggaggccuuuggcugcuuguguugacagcuuaaaggggucuacacccucaacuugcuuaagugcccucugcugauagccaggaaggagggagaccagcccugccccucaggaccugaccuggcucaugaugccaagaggaagacagagcucuagccucgucuucuccugcccacagccccugccagaguucuuuugcccagcagaggcaccccucaugaaggaagccauugcacugugaauacugaaccugccugcugaacagccugucccauccaucccuaugagugaccauccguccgaauguucucccacuuccuucagccucuccucggcuucuugcacugagcuggccucacguguugacugagggagccccugagccccaaccuuccccugccucagccuuugauuguccagggugaagcugugggagaaccgccugggcuaccagucagagcuggucuuugggcuguguuccuugcccagguuucugcaucuugcacuuugacauucccaggagggaagugacuaguggaagggagagaggaaggggaggcagagacaaaggccacaggcagagcuaugaaugagaaugggucuugaaaauaugugugcaccccuaagcuugaaauugaucucuauacucuagccccucagccagccuccuuccuguugucugaaaccuggagcuaagcagguuguccugucacaagcucuggggacugagcuccaugcuccaaccccacccucuucugaccuuuguucuccagaccugacccagguaggcaaggguacccucccagucucaccuaccauacugugccaucucuagccaagcaagccagguuuagagaagggucaaaaaaaaaaaaaaggguuguuuacuuccaacuuguucugaugcccucuguuucccaggccaggcuugucuguggugaccugggcaugggugacagggcucucauuugccccuuggucucuuuaugcugcugagucccccuuuccugcccucccuggcuacugggucaauaaucuuucaggccaugaaucugggaggagaguggucuguaagcuccaucagcccuguccugagacagcaggggggaaggacacuggagacuuucuuguggggcuuacuuagccuucugguuacagacuauuuccaugcuagaaaauacauauuuuaaaauagaaggaaaaacacagaaacaaaacaaaacaaggcauucucuaccccuccaccuuaaacauauauuauuaaagacagaagagaaaauccaacccauugcaagaagcucuuugugggugccugguuacaucggagcaggggagccucaaauccaccuuuggagccgccccugugugcauuaggaacccuucucuccucugagaaagcucagagggagcacugccucacaaacugugagacugcguuuuuuauacuuggaaguggugaauuauuuuauauaaggucauuuaaauaucuauuuaaaaaauaggaagcugcuuuuauauuuaauaauaaaagaagugcacaagcugccacgugugag

SEQ ID NO: 1658 - RNA, 7366 nt, Mus musculus
ccaacccaacgcugccaagcuccugcguccuguccagggaaauuguccuuaggcagccccuucgcucacgcccgggaacuuccaguaccuuauuccucuacccacaguccuggggaccccauagguaggcuggagaucggcccaccggccccugacccccgcccggccgccugcaccucucugucccagaggcugggcuggcgagggaccacucaccccgcggauaucccaguaacccagaaccauagacuuggaugacauuuugggcgaucuuagccccuucggggauacagcgauggacugugggcggcuaacuuuauacuggacgcugugggccgggcugacgcgaccgaacugucuccuccucucucgcucuaugcuccacccgcccuccgcguggucagugggcggugcgcaggcgcagcugcugcggcuccugaaauccuccggugugaacuucucccagggcuguugaugcuucaucuacucuucuggcagugggggccuggaccuuaguuacccgggaagcgugagucauguugcacaguugagcuggcacauaaaacuacgagguaggaaacgauucagguauaagguacuuuggggauagaaacauuuucuauguaagauacaaauggcucugugaagacugagggaggcuggggacacuaaacagguccacugugaaaaaggauaggucaugcacauuggaaaugccucaaaggacacuccaggaaagaggaggguagagcaaacaccgaaaggugacaaauagcuaugcaagauaaacagcaggugcugucgaguuaggcugguuuaugggaggagucaaaacauuaagcauuuggggcagguugcaaaggguauggacagccagacagacagagggugugaguguuuucucucugcucuguggggaguguauaggaucuagaucauaauguucacuagcaguauaaugcaagacagacauaugauuguuuuuaaaugguuugcuucuaguuuuuuuuuuuuuaaggaggcaaugaauccauaguauacuuacguagcccaauauauacuguuucagaauguaguaugaaaauuauugagaugucuucuauuuuuuuguuuuaguaccuuacauuuaaaacacaacuccacuaaggguaaccucaucuuuuaaaaaagauuuauuuauucauuuuauauaugugaguauacugucgcucucucucuucagucacaccagaagagggcauuggaucccacuauagacuguugugagccaccuugugguugcugggaauugaacucaggaccucuggaagagcaguuggugcucuuaacugcugagucaucucuccagccccagguaaccucauucugaugcucaggauccacaaguuagucggaaaaugauaagcauauuguggaguaaaacagcacaaaaggggaaaggccccuugcgggugggaccaucccugggcugggugucuuggguucuauaagagggcaggcugagcaagccaggggaagcaagccaguaaggaacagcccuucauggccucuucaucagcuccugcuuccugaccugcuugaguuccaguccugacuucuuucagugaugaacagcaauguggaaauguaagcugaauaaacccuuuccuccccaacugcuucuuggucaugauguuugugcaggaauagaaauccugacuaagacaccaggccucccggagccccaagucugggugugggaaauuaugucuccccguuaguuuaacugacucaaacuucagacuuuguaaaaggacauuuuucuaaaauaaagaagaaaugguacagagacaugugacuguauaaugccuggguugauuccucccaagaaaacaaaagccagcaacaaauuaacuugagccacgagucuaaaacuucuagaguagucuaaguauucuacuuguuucaugauauaucccaauucaggcuaaauaacuuugugauuagguguucugcccaguuuauagaacaaggaauugaagcuuggagaagauugauggaccacucaaguucccuggaugguccaggaugcagacugaggauggccuaaaacauuaguuuugcuggcucccugugcuuggcuaacuuuagagccucuuaccuugccacagucuuuucuaugaagguaggugaacacugggguagagcacauuuuuuuuccuaauccuauagauuuccccugguuuucagcuuuaagaugggccaaggccaaugggauaguggcuccuuccauucgaagaccuuaacuuuucugaauuggcuaccuugccccuaacaacucugaaggccuuucccucccucuccccccacccccuuccuuugagguaaaaguuuugcuuucauacucaguguuacugaggauuuugugaggccaggaaguugagagugaaugauagaguccaucugaaaauaagguauuuagcucgggaugauguuacagucuuggauaaauucagccaaaagagauuuccuggacaaucuuaagaaccuguuaggggcucuugaauccaugagaacagcaaaccuuaacaacaggguaucucaauugaagcauagcuucucuuccauggagaagaauucauuccaugagcuuugagccggaaguaaacuauauacaccaauagagaguacaagccauagacagcccuaacucuucauuuaacccuaggacagagagccaaggaguggaccaacaugccugaguuuacacaguggaccugaggaccgucaccucccagugcaauguuccuguguacugccacugaagagacaggugggagggagcucaagguugacuugccuaacaaccauugcuugaaagacaaagcucccaaggagagcacaaaauaccucacucgagacuccucugcaucaccaaccagugugaagaaagccugcagcugucagcagaguauucuuugucucggugacacgcugugccuacaguuggacuagaaacuuuggauuagggugugagucgugccccauaggacagagguggugcauguagccucauuuuggaguuuauuuagagaggagaaagaauguaccauaguccccaaaggcucuagguuacagugaauucucuuuaguucaguuauaguuuaguuuagcuugguuugguuagcugugguuccguucuguuccguucuguucuguucgguucaguucgguucaguugcagaguuguugcucuuucaugcuuugcaucccaacucccugcucucucuuggcuuugguucccaucagguccagaauaaauggcaaggagagggucauagaacaaguuaaacgaugcuuuuuauuggcaggauugggacuaaagagaucaggaguaagacugggaauaaguaugccaacuuagggugugggguaaaauaaauaguaaccggugagggucuccaacccaaugagguaccauuugccucagugucuggaccuguucaucuucuuugcuuugugauccaggauauguggcuugccacuaacugaaagaggacuuccaggggcucuaacuggguaccaaauacuccaucuugcacaugagagguccuuggucuuagagguauucgagcuggucucuaaugagucaucugaagggagaaaacaauucagauggggcugguuccuagugagggacuccccagaguuuauaucaccaaugcgauuagaacuucaagacacaccugaacggauggagcugaguccccagaggaauagcccaugccuaguguccccagcucucccuuucucaccccaggagaauuaaauuccucugaauaggagucaggaucccagagcuuccucacccccagcauccuucugacagcguccagccgggccuggauccguggagccuccuguggacacagcaucugcagcuccccaggucucaugugaaguagcuggcuucccauuagggacccgaggguccuuacagugcuguaaauaacaaugguagaauccaccagaaguagggugggcagauucuaggucuuaguauuuguguagagaaggaaaguugggguuacaggaauuagguaucugcagguacagggauacaccuagugguuuggucucagugaaccacagaacuccgagauuugagggcagaaacacuuuaaaaaagacuggucuggaagggaaggguggcuaaggugggcagcccaaguucuuccagaauuugcuacccuugacucuuucucuuucacuacauauggccucugcacugggugaccuacccuaggcucagacaagcagcuuucauucagcagagaaagccuaagauggagucaucaaguacaguggaagcuaggucacacucucuaacucugagagugaauggagccugugguucucccauuuacagggcucaccgccccucaucccccaggggacuggucacucacacaguggagaaguucucugcuuguagccaggcugugaccuccucaggcuuugagcucaggcgaagcauuggggccuggaaucaaggagcacuagaagucagaggucaucccaucuuacaaacauacacagccuccuguauugggucccuucuacugagaucccaucaggaugcuuaucucaccuucugguuuccuaguucggcagggacgcucaccuaaucuuuguucagacccuauaaugaacuuggcaccgaggaagcaugcaaugauauugauuaaacugaacuaagauugucucuguuugucaccuaauccucccuacuaccacuucugacuucugacuuaggacucagggcuucuggguaccccagcgugggaaguacccuaaaggaugguugucgguggccucucggggcuccagcuggcaggggcuccaggauauugcugggaauguaaccagucaguccugcuucguucuucaccagccaccaucgcuugcucugauccagaaccuaccgagaaucaccacauuagcccccagagccuccauccucccauccccucugcccccaagaccgugucuuuccccgccugaccuuucccacuuuccuucucuaucuguaagccacccacuccaggcuaauuguacuucccacccauugccucuuuuuuggcuucaagcaugggccucaccuccagaaucucccccugugccacagucaguuccugggcauuccuugcuucaaacucguacaggacuugcauuuucagggcugcucugccagggcuggggcuggagagugggagguuugaguccucguauucaggguuaugguuguauggcucaucccgagggaaauguaggcugcuccucauccuagaaccucugacaugagagacagauucaggauggauggagaauaggaauugugcccccggccaauggucucugggauucacaggugcaaagguucuguccugacccucccucccugggaccucgagaauccacuaagcaugugacugacauaccggagggaaaucgaauccugguuuguuaugggcaucuguaagcaagaaaaccagaaugaguuagaaugggaggcagccagcacaguggcagggaggggcuaacuaaccagcccaguacaggccugcaacagcugccuuuuguccauugcucaccuccccaacagguacccauauaacccaccucguaguugugauuuugaucuggacuggaaaugcuuuucauagaucucagagcuaagcaacccuuaccauggagcggggcuguggaaucugccagccaucguagaauguggguugguaggguggcgguucacugccuguccagucagcccugaggggagagcaaagcugagucuagggccacuguguagcagccuguaggauguggaaagggagaagaugagaagaccuagccucagggauguguggcuaacggggauguggugcguguguauacagaugaaaagcuacaggaaacccacaaaggagcaaaugguuucacaggaacaugucuaacaguguaagcaucagugggcagccucaucuugauuccuaaguacagcuauguugccucccuagaauuaaaguaauuuaaucuggaguauuggggcuggaagaccccuuuggagacuugcaaaaacugacccuaccccuucuuauuuauuuguuuauuuauuuauauugaaauagauuuuuucauacaauauauucugauuauggcuucuucucccccagcuucucccagaucuuucccuauccccacccacccaaauucacgcucuuccuuccuuccuuccuuccuuccuuccuuccuuccuuccuuccuuccuuccuuccuuuacaaauaggcaucuuaaaaaaucaaaauaaaauaaaauuagauaaaacaaaaacaaacaauaauaggacauaaacaaauaggaggaaaagagccaaagaaaaggcucuggaaaagcaaauagaugcagugacacacauugccacgcacacuccagugaagucugcuugacaggcugagaggccugggagcacucacgaggcagagaguuucaaaaggaacucaccuccuggagcuuuggcguucucauuaaccuguacacucauacccuauccccgaguuagucuaguguauggauccacgugcucucuuuuaguauuauuuuauuauaagugucuuuuaagauugaauucugacauagcuaaagccucccaccaguguuccaauguuccagaagccaacaagcuuggaaucuggugggaaugcaguaauaaaguuaccuauucaguaacuaauuaagcauuccaaaagacagagccagcagcucagggcuggucugcagaguguuuacuaaggacaguagccagucucacccaaacaagggaaugccaugaaagagcuagggaaucccacugagacagggaucuucucuacagccagguguagcaggcuuuauuacauauuagaagcaaguugguaaauucuucugacaaauggagauucuacacagauacuuaaaagaacagccaagauacaagaauuuacuaaggccuaggaaauagggggguugugguauugcauuauucgugagaaggucugcuagagcagaacucccugguacuagccuucacaaggcucaaaggaguagcacaaauucugacuagggugugaaauccuuagcugucauuagcuaacccuaggcaggacugcuuuaucauuacuguaaacauuuaccugguuccuguaagucccuuugaagucauuccuuuguuuugugucagggaacuucaauguacuuugccugcugugacuuccuaccccuuuuauuuucuguacuauauaagacugguguucacuuugugacaauacauucagauuuuuacccaau

SEQ ID NO: 1659 - RNA, 2880 nt, Mus musculus
ugaccacgcggagggcggguggagcauagagcgagagaggaggagacaguucggucgcgucagcccggcccacagcguccaguauaaaguuagccgcccacaguccaucgcuguauccccgaaggggcuaagaucgcccaaaaugucauccaagucuaugguucuggguuacugggauauccgcggggugaguggucccucgccagcccagccucugggacagagaggugcaggcggccgggcgggggucaggggccggugggccgaucuccagccuaccuaugggguccccaggacuguggguagaggaauaagguacuggaaguucccgggcgugagcgaaggggcugccuaaggacaauuucccuggacaggacgcaggagcuuggcagcguuggguuggggacauugacggagggggccugcgagcaagugggcacugcgcaggcgcgcugaccggggucuuucuccauccccugcuuuuagcuggcucaugcuauccgcaugcuucuggaguuuacugauaccagcuaugaggagaaacgguacaucuguggggaagguaaugaaugucugugggugcgcuacaguuguuuuuuacccagaggguuguaccacaccaagauggugugggacccccugcuccuguaagcugggaacuuugccaagagaggcccauagaguuaucucuugcuguucaggcccaucuuugcagaaacucaaggguuaguuuuuggggauugggaacuugagauaacaggucuaagucucagcuaggucgguaacgggcuugggucccacuucucucuuacagcuccugacuaugauagaagccaauggcuggacgugaaauucaagcuagaucuggacuuuccuaacguaggugguuuuggaggagugggcagaagggaaggccuucaaguguaucuguuuucacuucaucucuggcuugggagcaucuagauagagacucuucacguuuauagaauggauagaauucaagggucauugaacagaacugagaauaacauuuuauuuccuacuaacgucugagaaacacuaauauucuccucuuaaaggcaggcuauaagagacaugaguugauagccaggucugugacuuuaucacugauagauuccagguauuuucaugguauccuaaauguauccucauguguccugguuguuaaaacaccuauuuuuuuuuuaaauguauccauaaucacccuacuuuuacauacuuuaagguauaaaauauuuacauuuugcuuuuuaaacgucuauaugccacacauacauucacagugacacacaggauuaagcacccuugucuagagucaggugaggacccagugcuacuuucuauuuauuuaguuauuucuccuggcuucuacucucacacaccuugcaagucuucucuuuuccagaggaguggcgguccuggaggacuagguucacauuaacuuuccccuucuagcugcccuaccucauggacgggaagaacaagaucacccagaguaacgccauccugagauacaucgcacgcaagcacaacaugugugagugggcugaaggggauaggagggaggaggcaguuggcucaccuggagguuggcaauccugagggugauuuguugccaucuggcugcagguggugacacugaagaagaaaagauacgaguagacaucauggagaaccagaucauggacuuccgcaugcagcugguucgccucugcuacaauucuaaccacguaaguuuccucaucuggaaucaccuuuguuggguuucaggccaaagugcuaaggauuauucugcucgcuucuaugguugccaucuuucuaucaacccaaacuggaaggauuagaaacagacucuauuuuuuggugugguuuguccuguaagucugguguuagcuccuccuccuuuccaaagccccagcucuccauccugccuucuccaauuaaaggcagaaagaagcugccuagaguguguccaucacugguccaggcccugacuauagcuauugggggaaggggccaguguguguagaaguccaaagacuucuacauuaaugugggaccugggaaucaaacucuauucacccccauugagccauguguugacccaacaauagcuauugcuuuucuuuccuaggaaaaccugaagccucaguacuuggaacagcuaccugcacagcugaaacaauucucauuguuccuggggaaauucacaugguuugcaggagaaaagguagggagaaggcacagggagaggcugccugccugccugucuaucucugcagguauuggugaguuccuuaggcaugacacuucauuguccucauucuuucuagcugaccuuuguggauuuucucaccuaugaugucuuggaucagaaccguauauuugagcccaagugucuggaugaguucccaaaccugaaggcuuucaugugccguuuugaggugauguucacuaccccuuucucaaagcacuaugcacaggcuccccuauggccuguaggccccauugugcuugcccaacagcagcagagaucaguggagucagacagcauguuugcugugagucugcugggcugggucaggguccuaauaagaccugguaugcuuuuucuucaggcuuuggagaagauugcugcauuccugcagucugaccgcuucuucaagaugccaaucaauaacaagauggccaagugggguaacaagugcuuaugcugagccagagcucgcugcugcugagccaucuugcccugaggggcccacacucuuagcucacugucagucuuguuccauccuguccugagggcccccacucugucuccucugcucuuucuaauaaacagcaguugcauuaacuggu

SEQ ID NO: 1660 - RNA, 2880 nt, Mus musculus
accaguuaaugcaacugcuguuuauuagaaagagcagaggagacagagugggggcccucaggacaggauggaacaagacugacagugagcuaagagugugggccccucagggcaagauggcucagcagcagcgagcucuggcucagcauaagcacuuguuaccccacuuggccaucuuguuauugauuggcaucuugaagaagcggucagacugcaggaaugcagcaaucuucuccaaagccugaagaaaaagcauaccaggucuuauuaggacccugacccagcccagcagacucacagcaaacaugcugucugacuccacugaucucugcugcuguugggcaagcacaauggggccuacaggccauaggggagccugugcauagugcuuugagaaagggguagugaacaucaccucaaaacggcacaugaaagccuucagguuugggaacucauccagacacuugggcucaaauauacgguucugauccaagacaucauaggugagaaaauccacaaaggucagcuagaaagaaugaggacaaugaagugucaugccuaaggaacucaccaauaccugcagagauagacaggcaggcaggcagccucucccugugccuucucccuaccuuuucuccugcaaaccaugugaauuuccccaggaacaaugagaauuguuucagcugugcagguagcuguuccaaguacugaggcuucagguuuuccuaggaaagaaaagcaauagcuauuguugggucaacacauggcucaaugggggugaauagaguuugauucccaggucccacauuaauguagaagucuuuggacuucuacacacacuggccccuucccccaauagcuauagucagggccuggaccagugauggacacacucuaggcagcuucuuucugccuuuaauuggagaaggcaggauggagagcuggggcuuuggaaaggaggaggagcuaacaccagacuuacaggacaaaccacaccaaaaaauagagucuguuucuaauccuuccaguuuggguugauagaaagauggcaaccauagaagcgagcagaauaauccuuagcacuuuggccugaaacccaacaaaggugauuccagaugaggaaacuuacgugguuagaauuguagcagaggcgaaccagcugcaugcggaaguccaugaucugguucuccaugaugucuacucguaucuuuucuucuucagugucaccaccugcagccagauggcaacaaaucacccucaggauugccaaccuccaggugagccaacugccuccucccuccuauccccuucagcccacucacacauguugugcuugcgugcgauguaucucaggauggcguuacucugggugaucuuguucuucccguccaugagguagggcagcuagaaggggaaaguuaaugugaaccuaguccuccaggaccgccacuccucuggaaaagagaagacuugcaaggugugugagaguagaagccaggagaaauaacuaaauaaauagaaaguagcacuggguccucaccugacucuagacaagggugcuuaauccugugugucacugugaauguauguguggcauauagacguuuaaaaagcaaaauguaaauauuuuauaccuuaaaguauguaaaaguagggugauuauggauacauuuaaaaaaaaaauagguguuuuaacaaccaggacacaugaggauacauuuaggauaccaugaaaauaccuggaaucuaucagugauaaagucacagaccuggcuaucaacucaugucucuuauagccugccuuuaagaggagaauauuaguguuucucagacguuaguaggaaauaaaauguuauucucaguucuguucaaugacccuugaauucuauccauucuauaaacgugaagagucucuaucuagaugcucccaagccagagaugaagugaaaacagauacacuugaaggccuucccuucugcccacuccuccaaaaccaccuacguuaggaaaguccagaucuagcuugaauuucacguccagccauuggcuucuaucauagucaggagcuguaagagagaagugggacccaagcccguuaccgaccuagcugagacuuagaccuguuaucucaaguucccaauccccaaaaacuaacccuugaguuucugcaaagaugggccugaacagcaagagauaacucuaugggccucucuuggcaaaguucccagcuuacaggagcagggggucccacaccaucuuggugugguacaacccucuggguaaaaaacaacuguagcgcacccacagacauucauuaccuuccccacagauguaccguuucuccucauagcugguaucaguaaacuccagaagcaugcggauagcaugagccagcuaaaagcaggggauggagaaagaccccggucagcgcgccugcgcagugcccacuugcucgcaggcccccuccgucaauguccccaacccaacgcugccaagcuccugcguccuguccagggaaauuguccuuaggcagccccuucgcucacgcccgggaacuuccaguaccuuauuccucuacccacaguccuggggaccccauagguaggcuggagaucggcccaccggccccugacccccgcccggccgccugcaccucucugucccagaggcugggcuggcgagggaccacucaccccgcggauaucccaguaacccagaaccauagacuuggaugacauuuugggcgaucuuagccccuucggggauacagcgauggacugugggcggcuaacuuuauacuggacgcugugggccgggcugacgcgaccgaacugucuccuccucucucgcucuaugcuccacccgcccuccgcgugguca

SEQ ID NO: 1661 - RNA, 400 nt, Mus musculus
ggcauucggagugagacauggagcugagcgaucgcagcggagaacgagaugccuguggccgugggucccuacaggcagucccagcccagcugcuucgacugcgugaagaugggcuucgucauggguugcgccguggguauggcggccggggugcuguuccgcaccuucuccugucucaggaucggaaugcgggguugggagcuaaugggcagcauugggaaaaccauggugcagaguagcagcacguuuggcacuuucauggccauuggaaugggcauacgaugcuaauuagggcuaggaugcccugcaauaucuaaacuuccccauccauuucgacccuuguacaauaauaaaguuguuuucuucuuguuuaaaaaaaaaaaaacaaaaacaaaaaaac

SEQ ID NO: 1662 - RNA, 1297 nt, Mus musculus
uaaaacucggggugggggugaagaaggggccggccuucgagugacagcggcgcaagaugucagccaccacaggcucgggaguaaaagucccucaaaauuucugacuguuagaagaauuggaagaaggacagaaaggaguaggcgauggcacaguuagcuggggucuggaggacgacgagggcaugacacuuacaagauggacaggcaugauaauugggccuccacgaacaaucuaugaaaaccgaauauacagccuuaagauagagugugggccuaaguacccagaggcaccccugucuguaaaauuuguaacaagagucaauaugagcggcgugagcaguucgaauggagugguggauccgagagccacggcagugcuggcaaaguggcagaacucccacagcaucaaagucauccugcaggaacugcggcgccugaugaugccaaaagagaacaugaagcugccacagccaccggaaggacagcguuacagcaauuagucaccaaggccccggccuccccuccccauccaacccaagucuucauuuuccacaguagugaauuuucuagauacaucuguagaccucaaaguacuggagaggaagcuccacucagccuucauccugaggcacuguucugauacuaacuucucguccauuugaaauaccuaaguugugcuguguaacaucaacugucaaguguaaccgcugucugccugguugaacgucugggaucaagaagguguugaaaucgguuuccugugggagcggugggcacagcuaacacaacugugaacagacacgucacacaaucaccugcugcuggcccuuggccugagucugccuuugcccuccccgcccucugccacggcugugugguggcccuuagaauagaugggaaggcuucaaguagcaguugugggacugacuacugcugggcuuggggcgcuuuggcugcaccccugcuuucuucagucuuaagugaugccccauccaagccaugguccccacucuuccacucccacccuuggccaaagcuuagauuguaacccuccccucccucugaaauuggccaugggugaggaauucggggcuucccguguccccaccuuuaucaagggguacugcuuuccccuccucaacuccccuguugcccaucaccacccaacacuugcuguggccagaagccaucagaugagguuggaagagccuggccuaccucacuuagcuccggaccacacucaccugccaccagccugggaagggaaugccagguccuuagcccugcugccaccauc

SEQ ID NO: 1663 - RNA, 12630 nt, Mus musculus
cggggcguggccgcggacuuggcggggccugggguacgcgagauuggcgcgcagcccggaagguuucggcggggucgcaccuguugcgugacucccccguagcccggccacaggagccggaucccuaauugauucccagaaaguggugaaagaacccuaggcgaauuccggguccgguuuucuggggagcacguggccuguuuccucuugagugcaggcuuggggucgcgacuccggggucuccugaggucagucuggccgcugaagucggcgggaguccgccccccggccagcuggccauuuugaaaaccuugccuuccuucccgcuucucagugcgggugcaggggccaguggcgcgacuucgccccggugggggcccucuccccucuucagcccggcucccucgcugugcagacuuucguaggcugccuuccugguccacgcgggacuugggcagcauggccucagguaaguguguggcgcgugugugguugauaaagggacuccaaggcagaggugccugggucgggugauaaguggguggggggucuuggcaaugccugcaagaccuaggggacgugaacggcuccuagaaggguccaaggaagcagaucuugaguguacaggcagagcgacaggucagaguaggcuggggucuuucccaucgaccucagacaagacccagccuccuacucuuccugucuuccuaggagacagcuucugccggucaguggaauuuucccaagacaggccccucccuccugggcucgaauucucaguucugccuccucccggagcugggcugucccuagagcaggggucagauggagaagaaaagaggggggcucugccccagaggcucuggguuuucaugaguaccguuguuccuucccuggaggaaauggguuuugagguuggagcucaggcgguauucuugccuauuauuuuucucucuggcuggcuggaccagccuagccuggacuuuggcuucuuugccuuggagccuuggcaagggaugaggguucccgagguggggugaggguaguaaagagcuuagagcuggugcugcuccaucuguuuucucugcaucccgaccccggcccuagccaccaucagacagggcacucuaaagacuggagugggaagagagggauaaggggcaggauggaggccccacuccccgagguugccuagacaacaucagaaaucguggccagagccucuuccgccugcggggcgcugcuuccugcaucagucacucccgcugggggcggggcggaggaagggguuggaugugggagagcuuggccccagccggugagguuccuccgcugucgccuuggccccagccauggcauccuauccuggcccaggcaaguccaaggccaaauaucccuuuaagaagcgggccggccugcaagcuuccgcugccgcuccaggugagaguucuugguuucaggcauggguuccccuccucuuguccaggccacugagugccuccgauaagguccccuucugcagcacccucucugcaaugaugccucucgaccucgguuccccgguuccccggcugacuggcugacuugauggcgcagggagggaggugggagggggugccugagguuuccaugucaggggugcugcccuccguaacaaggaguggguguggaugugggugcccacgagauguauaugcacacgugucagcuugugcagaugcuaagacugcgugugaaguguaugugaauggaguggggagggugugggacugacugcggacuggcuacucugauugguaccaggcagacucaggcuagacuugccuuuacuuauucuuuccaagacccuagaucuagaacucccucccuggugagugggguggugaggucugacauauggggucaugcauugcuaacaccuacacaaccagauugcuaacaccuauugccaguguccuuccuguuggcuuguuccaggccuguguugugaauuucuucaggagaguggggagcccuugaaauggcuggugggcuauguacgcugcauccuuuggaccuaagugggcaucucugcaccaucugcagcuggcccugugguccauccuggugaggacuuagcuacuagaguuugugcuuccagggaugugucuuuaacucucaagucuaauggcuaaaagaaagacauuucgaugauugauuggguguuaucaacuccuuauagcugccuguauugacacccugacuaaccgccucuggccuauucuuauccugcugacugugcuuaucuaggcuuuguacuguacugagauagauucucugugcucgcaucugucuucuagguguaugcccugggacuagcucugugcugguuacucuguugcugaaccagagacccuuaggugcuuauaccuugagagcaucuucuacuuggggucaaggccuagugaggcagucuugagugagugagugaggaugcucccagucaaaggugauugacuaagcaccagaaauccuggagcugauggagugguccccuuuggcuuuugccuguaugugugguacuguagaugccaaguuuuggcacagggccagggagauggauccuggcuuggagaguggaggauagcgccugugcuucuccucuggugagucccuagcagucguuuacagucuugugguauaguaggaggauggcucuggcugcugguacccuucuuacucaccuagcucgucuguguaguuccaggccuaucugauaggaaaggguuuaaaaugaggacucugucuuccuuucugcagcccuguggucugccuucagggacucuagaagugguugguggcuugguguagugacacauaccuguaauuagcuauuugggaagcugaggcgggaggaucaugagcuccaggcaugcagagacacuugguaagauccuggcuggaaguaaaaauagaaaagaaugaggauauggcccagugguaaggacuucccuagcuuacacaagaccucagguguggucccaguaaagcaaaagacagaaaacaaagcccccaaguggucuggagcugaauuuaagaaggcucuggguuccuuuuuguuugguuguuuucugagacaggguuugucuguguguagccuuagcuguccuggaacucacagagauccaccugccccugccucugccugcugagugcugggauuaaagguuugugcuacuaccacccagccuaggaucugaacccuggguugggugaguagguguugauccuugcuucuuccuccuauucugcucucuugcaagggggaaguugcaucaccuccucccuacagagaucuuuucuccucggugcucugucccucuuaucagcccugacccugcacugggcucagagacccucucaccccccucacugaagggucuccaugucggaaguguuuagagggucccaggaauuccuaauugcagucacaugggcuuagggcucuaaccuaagcuuuauagagugcuuguaggacauuucccugugaguccuggggcugcggccagguaggacaaggcugcuucucacccacugauagccuguguccagagguuaaaacaagcaaguaaacaaaagcagaguccuaugugccuuccacaugcaguucccauuuuccaaggugcucuuccuaaagagguuguccucaccugacauuagccuugcagcugcugugaagagugcugcccguguggucuaggaagccuccguaacuagcuccuauccacauuagaccagugcuccagcuaccagccggauccuggguagcacagaccuugucucucuugaagagucuguagucagggcccaaaagacaguggugggcagagaaagccagccugaggcugcagggcucaggggaggauuguuggccucccucugugucucuccuucuacccuuuagccagccaggcuguguccacuuucuguccccuggggcugugguuuuaaggagacuuggccccuccccugccaggcugccuuggccacaucagcuugucuuguuucucccuguugagacccuggaucuggguggucucacuggcauggaagagguuacagccauguuagaguucucaccucucaacucuugcuccuucucuggauuucugaacuccccugaacucucccagcccccuacuuguggccaucucagggucuccccugcuuauaguugcacuugguauggcccaugccagccccugagcuguccugggggacuggcugcagcuuuacaaggcaaacagacagacaaggggcacagggcugcugaccagaauacucuugaacucugcagguagcguuccaguagggaccaaggcaaguagguagcuggguucugaucuaggguaagcaccccucuuuguccagcauugggacuguaccuagaguacuaggaagugggcacagagaccuuaaggcacaaugccuagacagagcuucugcguccuuuucuaagccagaguggaggugggggagcggguucuggagaggugggucuucuacagcuggcuggaaaaaccagauagucuguggagagcuuccagcaagaggaggcugaaacugggagguucuuuuguggugggcuaggagcuuaggcagcccaggagacuagcagcuuuugacgguccguguuagccuuguaggagggccuaugaagaggucugcccuuguuggaauagaaagaaucccuggcuuccaauucucccuuucccagggcccuccauggggccuccagcuuagcuccuaaggccuccaaguggcacggacuguggcagcucccuuugaagggucagccagaugugggacggguauccuggaaucuguccucaucuuggcagcuccagccaggguccuggagaggacaggccuccagugggaaaagggguuucuggcuaaccagguccucuuucuugagaguugcuucucaggucagagcuggguggcugcuguacuuugccugugccuggcaggucaaggaaagcagccagugguucuguucaucucggugaaggaucuguuaggccaggguaaaucugacccuggguuaguacccuagaaguugaugauccuuaguguaaccacuaguccugacugagugucuggugugugugugugaguguguguguguguguguguguguguguguacauguguacacguguaucccuuuuuggaaaauagucauaggcagauaaaauuuuuugaacuaaguaagggaguaggcuacucccaccucaagugcuuauugcagaguugacuggauccauuugcuccacaggcaggcccaggaccucaucccuagccugggguggugaagggccucuguguaauacgaugaauacccuuaggagccccacauggcuggcuuuucugucucaguggaaguauuguccagugucuaggcccugacuuuuaauagggucuggccccaggauggaaaggggcucuuggcuuucagagacauccaggcccugucccucuuccccuugaccuuggccccacugucucugcagaagcucgaagcggucugggggccucuccgcuacagucugcccgaucccugccaggcaacgccccuugccucaagcacuucccgcuugaccugcgcacgucuauggauggcaaaugcaaggagaucgcugagguagcacccuuguaccucuucaccucaaacucugcaucuguugcuguccccucuaccucagccaccucucaucuugggccauccucgcaucauccugucucugaugcuaagccucuccugggaagccuggcuccugccucacccuuugcccaggcucugcagggagggcaggggcagagggcuuggaggccaccuagccuuuccuccuuucccuuacugguaccaggaguuguucagccgcucacuggcugagagugagcuucguagcgccccuuaugaguucccagaggaaagccccaucgagcagcuagaagaacggaggcagcggcuggagcgccagaucagccaggaugucaagugagcccgcugcugccccuucccugucccguugucucuuugaggucugccuggaaggcagcauagaacacauucuuuggagucuagcuacugcuggaucccucuuccuguaggcucccagucuacuggauaacuaacuucuggaguuguuuucucaccuuugaaguggggugagaacagcccagagcguacaggccugcccauggaccgcaugugacaguauguggucagaagcugggacagugcugggaccugaaggcugcagccauugcuugugcucuaccagacuuggcucuucccaccuuuaggcuggagccagauauucuucuucgagccaagcaagauuuccugaagacagacagcgacucagacuuacaguaaggagagcagaggggcaugcgcagaugacacggggaugggucugcaccauggcugucuccgacccauguuuuaucucucuuuccuauaggcuguacaaggagcaaggagagggacagggugacaggggucuuugggaacgugaugugguauuggaacgggaauuucagcgggucaucaucucuggggaggagaaguguggggugaguguggagugaagccuuaaguuuccacccauauguuuuagaggguucuggccuggggaacuggugggagcuggagagggcauuucuuuuucuggugccuggaguggcagaggcugugggcucacugauucucugggaccagagaaggcuggauguucccugguuugaggccuuuggugcuggggaugggcagugugaggucugggcgaggccacaagcaggaggugagugugaacaugagugagcacagagaccaaagaaagugacugcuuguccucgucuucaggugccauucacagaccucuuagacgcagccaaaagugugguucgggcacuuuucauccgggagaaguacauggcccuaucacugcagagcuucugucccaccacccgccguuaccugcagcagcuggcugagaagccccuggagacucgaacuuaugagcagaguccugauaccccuguaucugcuggugggagcgcccaucccucuccaaccccaacuguccugggugucuaggcuuggagccuaggcacuucuguccuaugugccucuccgccaccucugaccccaggcucuuucuugcuucuugacauccaggaggguggaggaugggaaccauagcuacuguuuuggggcuucugacauaccuugcccuucauggagcccauagauuggguagcugcuggccgugaaacuucccaguccugauucuuccucuccuccuugcagaugccccagugcaucccccugcacuggagcagcacccguaugagcacugugagccaagcgccaugccuggggaccugggcuugggucugcgcauggugcgugguguggugcacgucuacacccgcagggacccugaugagcaguaaguggggucaugugaguugggguacacccuauggaaugacaccuuggcuugggaggggccggaggacuuggcuugcucuccucagcugagcguccugugugcuagcuguccggagguggagcuuccauacccugaccuacaggaauuuguagcugacgucaaugugcugauggcccugaucaucaauggucccaugugaguugccaccuguccauucagcucaucucaccccagcccugccccagacaacugucaccuugucucuugccacucccuggucaccuccuccuaguuggcugcccuccuucugugcuccugucuucagcuaacccaggggcucaccugagcucucucuucuuuccucuucuccagaaagucauucugcuaccgccggcugcaguaccugagcuccaaauuccagaugcacguuuugcucaaugagaugaaggagcucgcugcucagaagaaagugccacaccgggacuucuacaauauccguaaggugggcccucagcucauggccucuguguccuggccuacuucucuccuccaaagacuaugcugucccuccccacugcccccagcauccaauaugagcguccuuuuauaccuacugcuugggccguggacccuuccuuuaaaaggugaaaauuuuauuauacuuuaauguaauuuuuuuguaauuaaugcccuuuaauguaauaaaaauuuaaauaaaauuuaaaaauaaaaaauaaauuuuuauuacauuuuaauuacuuugugacuguggauguggacagguggaagcagaggaaagcuuaccaggagucauuucuugucuuccaccguguggguccuggccuugacuuucucagguuuaauggcaggcaccuuuauccacugagcugucucucccaaaguauauguguguguauauguguacguguguguguguguguauacacauauacauauguauauguauauauauaugcauguuuacaaguauguggcguguguguauauauauguauguguauauauauauguguguguauauauguauauauaugcaugcuuacaaguaugugguuguguguguguguguguauguguguuggugcauauacguguagugggcauguacaguagcagggcagaguugauauuggguauccucuaccuuauguacugaggcacagcuucucacuucaacgcagacuuggcuguugguuagucuagcucgccagcuuaucuuuuguauccccugccuccgccuuccucauauuaagauuauaggcaggcugcugcacauacuuggcuuuuauguggggucaguggaucgcaccugcaguccucauguuuguauagcaaacaagcacagauggcugggccaucucccuggucccaaggccuacccuuuguuggacacagcagcccuuuuccaccgcagguggacacacacauccacgccucguccugcaugaaccagaaacaucuacugcgcuucaucaagcgggccaugaagcggcaccuggaggagauugugcauguggaacagggccgcgagcagacgcugagagaagucuucgagagcaugaaccucacugccuacgacuuaaguguggacacgcuggaugugcaugcggucugucccaugggcucggcugggguguugggucagcacuaggaccaggggugaggguggggguugaccuaggccuucccaucuccaggacaggaauaccuuucaucgauuugacaaauucaaugccaaauacaacccuauuggggagucuguucuccgagagaucuucauuaaaaccgacaacaagauuucugggaaguacuuugcucacaucaucaagguauggagcccauucuccccugcugagccagagcccauguguaggagggcucaagggacaggagggggcggguugagagcccugaugagacauggggugggagacacgggacagggaggaacguagaugucauugcuucuggugucuaggaggugauggcagacuuggaggagagcaaauaccagaaugcagagcuccggcuguccaucuacgggcguucgagggaugagugggacaagcuggcacgcugggcagugaaccacaaagugcacucucccaauguccgcuggcuggugcaggugccccgccucuugugagugucccuuggaggaggaggaaccucccuagcuguguacaaggggccagggccugcuuccugcucuacugggauggcccagccuucaguggccaagcuagguacucuugagugccaggagaggccaagccacagucuguccagccugguuugucuggaugucccacucucccacuguggugcaaaugcacuccggugccucucaugacagcucugacucuugcuggccugcugcuggcccugaccugcaucuguuuguguccugucuccccgcagcgauguguaccgcaccaagggccagcuggccaacuuccaagagaugcuggagaacaucuuucugccccuguuugaggcuacugugcacccugccagccacccggagcugcaccucuuucuggagcacgugagcggugguggcaugggcugggacagggcaggauagcugggguuggccccagcuguggcucuaggucugaccaccagcuccucgccagguggaugguuuugauagcguggaugaugaguccaagccagagaaccacgucuucaaccuggagaguccccucccagaagcuuggguggaggaggacaacccucccuaugccuacuaccuguacuacaccuucgcuaacauggcuauguugaaccaucugcgcaggugcgugccccaggggugcgugcuuccugagcugaggucaauggugcccugacacccauggccccugugccuggacugacaggcucuuucucugcccuuagacuuaauuuuccauccuuucccguuaaggcucugccccugucuucucuccuaguuccccacugucacucacuggagggcauacauaugagugaugugggaucuggggucaggugagcuuaggcgugcccaggcucuggaucugacucugucuucauaccccacaggcagagagguuuccacacguucgugcugaggccgcacuguggggaggccgggcccauccaccaccugguaucagccuucaugcuggccgagaacaucucccacgggcugcuccugcgcaaggucagggucugcacccccagccuccacgugcagcugcuugccuuccccauccuccuccucccccagccaugagaucagauuccuccuucccaauauaauuagcucuucccacccauccucuagcuggggagcccagcccaggauucaucauucuuaugugaguccucgccuggaccacccucuuccccuaagccccagagccagcacgcaugcccucccagcacugaggccaccugacaaguccuccauucccccuuccugcccaggcccccguccugcaguaccuguauuaccuggcucagaucggcaucgccauguccccgcucagcaacaacagccuguuccucagcuaccaccggaacccucucccugaguacuugucccguggccucauggucucgcuguccacagaugaucccuugcaguuccacuucaccaaggucagacccaggccagcgggcagccaagggcagguaucugggggauacugggugccucuagguuggugcugcccccuugcugcuggagcuuagcaacuguuagcuaaguccuuaaaggagggggggacggcaggggccugauaccugccucaaggaaccuggccugugcaggagccccugauggaggaguacagcaucgccacccagguguggaagcucagcuccugcgauaugugcgagcuggcccguaacagcgugcucaugaguggcuucucucacaagguauggaacucagccugcuuggggcuggccauuacccuucucccuuccuuuguauuugggguccugaccuugucccugugauaauuggaucuaccugcaucucugccuguuaccuauaccccugcaggugaaaagccacuggcugggacccaacuauaccaaggagggcccugagggcaaugauauccgccguaccaacgugccagacauccgagugggcuaccgcuaugagacgcuaugccaggagcuggcacuuaucacacaggccguccaaagugagaugcuggagaccaucccagaggaagugggcauugucaugagcccagggccuuagugcaccuggucugugcagugcucgucccaucucagcgacuugacugugaccgugauuagaccccucccaccugauguggucucugcaugucuccgugcuauguuucuguccugcaugucuucgaccaugucuugccucugggccaccucagugaaagcaaguccaggaaucugcuucauuauugucucggcucaggugguaccugguggcugagauuuaagaguuggcccugcucgugacccaucucagaauugucagaagucuggcuguccuaugguauccucaguguccacaggggcuugggaugguuguguagggcuggccccuugagcaccgggaacccaggcuuugguuagaguucaaguugaguuucccucuuguuuauguggcugugggacaggaggggcucguuaucucucugcuguggcacuggcugcucagccucugaaguuccagcuggucugcgcugggcagagcaggacuuaggcucacucacggcccuggaggccuggccugaggggcuggcccacugucccugcugagucacugcccaucagccccguuccuccccagcccacguguuccuuuguuaccagcccccuuguaucccugugggagggggcagcugcccugaccugucucaguuggaggcuauugcaguuggagggugcuggaacuguuacuagcucuggagguggcaccuucuuuggggguuuccaggucuuugaccagacccaguucccagccagccucuuguguuauguucuagaccgaggccuuugcuaugaagaacaguguuucauaugacccauuuuuuccuagugcaugagaaauaaaaagauuauuuaauuaaugagg

SEQ ID NO: 1664 - RNA, 5558 nt, Mus musculus
agguuuuggcuuuucauuuauguuaauacagggagaaaucuugucucuugaacaagccagaaaugucugagaaguaagcaguccagggaauccaguacuucuagaaagcugcucagaacacugguuucaugcucuugggucagcgaaucaagugugugauuugggauuucgcugguaucaguugcuaccgauguaauuuucgcagaccucuugagauacccuuauagacacaaagauagaaugaagguggguugggagcucgauuaggucaguggagguuuccgggagccgcccuuuggggccgaggcgcuucccccccacucuacagagggcgcugugggcaccuccgccacacggccccgcagcuuccccggggaggagccucuccuguagccgccgccgccuccgcgauagcaaacccggaagaagccucugguagcuggauugugccggccggccuggcacugcuaugcauuccauggagguaggucugguucccgcuccagcgagggagccgagacugacccgcuggcugcggagaggcagugggaucuuggcgcaccugauagcuuugggcuucaccaucuuucugacugugcugucccggcccggaaccagugagugugcgaggcgagguggggcggggccaaagaaggggcggagccuaggcgcuggaggggccgcuuugggcgcacugggagacuggaaaccuggacccucagcugaggaggggcggguccgggagugguuguaaaagcguaguaggcggguucccggaaguccagggaggguggggcuugaaaagacagaacugauacuuccuuaggaggcccuacauggaaaagcguuagaggguccugggcaggcuaagguacucuagggacugggcugcagcaagugcaauccccaggccaaggggguguaagggccccuugacuccucccuuuguggugagcuccugauucuuguuuagguuuaagaugauaugcugaccuuguggcccggucuuugucauuuacaaaccacgggacaguaucagugaagcccagccgucagccuauucucuuugauucuuacuuaggucuuuucuccuggcacccuguguucauggccuuggcggugaguucggauauucuuagauuaacucuuggggagacauucaguuuuucagccuaagggucagagagauggguuuaaagagggcuucaucuuucccuaaaaccuauaggauuggggaaaguggaguaaagugucagguggcugagaaggucagggaaagggggaacagaagauauuucuccucuagugccuaaaaggaagacgcaagaaggauguuuaucaaggcuuuguccucagaacucaguagaaaguucucaguagaauguuugcuguucugugguccagaaaggaugugugugaggcugcaaguccuuagcuuccccguguccuucugaaugugugagaagaccuccuuuuccuugcgcuccauguagacuagaggcucacuggccuuuccuuaugauuacaguucugucucugcauggcugaagcuauucuacucuucucaccugagcacucccuguucuucuucugcucucgaaaaacccggauucgacuccacugggcagggcagaccauggccauccucugugcuguccuaggcuugggcuucaucauuuccagcaagauccgaagugagaugucccauuugguguccuggcacagcuggauaggagccuugacacuguuggccacuggaggacaggcacugugugggcucugccuccucuguccacgagcagcccgggucucaaggguggcucgccucaagcucuaccaucugacguguggccugguugucuaccugauggcuacaguaacggugcucuugggcauguacucagugugguuccaggcccagaucaaagguacagccugguaccugugccugggacuaccauuguacccagcccuggugaucaugcaccagaucuccagcuccuacuugccaaggaagaagguggagauaugaacgccuccaaacucugaaucuaggugggagucuugccuuggauuucaacaguuccuuggugaucuucacaggacccacuucagaaguagaugaauuuuugcacuucauggcugagccacaaugugcagaaacccuagcugcuacuguugaggcaugauacagugggcucaaagggggagaugcccuacuggguacaaguggaagguuugggagaaccugaaaccucacucuuggugggagacagaaguauuagguggugguaauggugauggugauggugaugguggugauuucuugugugccugaugaagaguucuccuagguuaugaaugacagccacagaugcugggaucccuauugagaaggcagugcuaucgagagcccguaaccucucaggcagugcuguacaaucaaccuuagacaaguuccauaucuuaggaccucaguuucugacaucugaaggucccuuaucuuuaacauuggugucugacagauugauguugccgauacccucuuagcucuggaccaugugggcagcucaggauguaauucucucauccauuuucccucuacuccccuagaaggacccuucagaaauuaugucaacuugguuccugaaccaagaaacaagggccacgcacgaacuguggaaagaagggacccaggggaggucuccuggacaauaagguaguaaaggcacugaagucacuuuaaaguucuucagaggaacugaaggcaguagccuuaccaagcccuugccuccugggcuccuuagcugagcuaaggacuuccuucaggcuaccucuggguaugcuccugccauucauucucagggcagagugguccugggcaucuuacuuggcauguugcuccauggaacuauucuuaagcuuuuagaacaaaauaaaaaccaaggaguaggccccucuugaccuaaggaagacucucucccuguugcccgucuuuccuugucguuuccuaagcuuuccuuaguugcugucuccggccagcugggccuaagaguaggaugauguugauaacuguguucuucccugccgauguaccuccuugaucugaguucccuagcgcauccuugguugugaggguuacaugucagauuaguaagcugugguguaggucagucuaggagaugggcucucuauagauccuaauaaagacugaagacugcugaaccagggaagguauccacgcagcuuucuaccucggagauagagccaaucaaacacucugggagggaggccugcaguauaggggcuggagcaccaguuccagagacaaggugucugcuugccuaucucagauccucuucucccaguggcucagaagcaaggcaggugggauucaguagaggaauggggacuagggggcagaaguauucucaguggaccucaccgggcuuuccucagggaucuagcaugacucucuaaauacagcuugaugaacagaggucccugcagugcagaggggaacuaacuguucuuggcuuuuccaaagcccucucuccggcucaagccauccagugugcugugaacguggaggggaugguuacccggccacgugaaagagacccucuuacuagggucacuuugauaaagggcgcccaucuccuuuccucauuaaggccagugcugggggcucccuagggugggccagguaagguucagcagcuuguucucagagcacagaggcgaugccagaaagccugagccugccugagguguugccuccucccagguggugcgggggcuggugggcgggcgggcaggcgugcugacagccggcaguuugcgugggcugugccaucugaugucuauucgcagccccgggaggaaggggagucauuuauauucugcaggaagaaaggacccagcugucgcuuccucugaccagugggccuggagggcaucggugcagagcacagaggaagaguacagguagugguggucuccugcuuagggaucugaccguaguguagggggcagggcaccaggaggagcccuucuuccuguuaggccagauuggggcggggcuuucuucccucccgucuuuccauccuagggcagcagcuggacagccauuaguccucagugccagggugcgcuuccuccagcugggaucuguggcugccggcugcggaugccuccuggcugaaugcucccucuuccccacaccugcccccuuuuguagcuucuaaugucugaauacuaccugggcuucucaguagcaaggaaggggccuuagcaggaacacaaauggcuguccuuuggccauguuccuugacuagggaaagcuaguaguagucagccuguuuugcuuuuuucaaggggacacucaggauguucaagauuuuuuuaaaaauugccaaucauuugcacaaauuuccauaucaugcuaaguucugauuccauauuugaugguguuccaagcuugacuauauucagacucaaccuugagggcauuagaaagauaguuuuauaucaaccccaagugggcacacuaucuguggaguccucucaggagccccuuugucccuccuauugggguugggguggcagugaacaaaugacaggagcucugcaucugagaacucuugcuucccucuggcugacgccccauccacaauaggcugcuaucaguugccagccuauucuugcuuugcccuucaaagcaggccacccucagcccaugacacugcccugccccaucucucaguguccccaccuuuuccacucccaugcauggcugcugugggucuuguuuuuuaaaccucgcugugggagauccaggcauccucccugagccagcuggcugcugugccaaggccuguucagaguuaauaauaaucauuaguugaauggugcuggggccuuucagcuccagaucucuaagcacuugcaggcugagucagccagucaccuucccccucuuccugggcuuuggaguguaacagcaugggaagacacugugggagagaaggggaucgggauucuugcugccuggcuauaccagaggcuuuucuccucugagaggaagcagucaggccaagauacacagagaauacagugugcucagcugagauggccguggccgugguagcugauaaccccaagccucuagcgcuccuguguacuugccuuggcuucugggggcaccccacccaaaugcccuuaagcaagucuugagagcaagaaagugucugaguuuguacccccgcaaugcccuggucuguggcuggaacaaagauccuguguguccugaacuggaagguguaucagccuggcaaagcuacuuuaugaguggcucggcuccgaacacuggguggcacaggccaacuauuugcuucuuaucuuaccucacagggauguugugaggauuccucaagagaacaaggcucaaagcauuaaacaaauggaaaacagaugcuaugcucuguccuuuucucuccgacuccggcucuggccuuuaugcuuccuacagaggcaauaaacugugagaaaugaugcug

SEQ ID NO: 1665 - RNA, 8715 nt, Mus musculus
ccuauucgaucuacaggggugcagaggcgcuucguggccgccagcccaggaaggggcgccagccagcuggcggaugcacggcuuuagaagaguaucuugggcagaaagagguuuggggcucggguaugcgcaguaaguuugggagagugaacuaguggcacaaaggacguguacggagggguugaaagaggauaucccgaggcuuugaucucuccuuccccgcgugcgauugugcauuucggaagggaucccucggcuagcuccguaagcaucgccaccccuccgcaacuacacuucccagaaagcuguguugagagugagguaguggcaggaggcacgagcugcgcuugcgcagagagugaacuggcaagguagggggagagggaggcgugcccccggucggaggguggggggagggggccgcgcggcggcggcgccagggcgggcgcgcguccgcggcggugauggcggugcgugaacgcgcgguggcagcaauggccgcucuggagcggcgagugccgagucucgaugacuucgcgggacagagcuggagcucguggguggagcgggccgaccugccugcggcagacggugaguacagacacauuagaauccggggaccccaucacuaucuccccucccccccagggcccccuccagcugaggggagccgccgacuagagccgccguccggcuccccggccccccaaacaaaggacccgccggguccuagugcccgccugcucagacaccuucgcgccuccggguccuagcgccggcguaucgcucgcagcccacccugcccaccucugucucugcggguguacaguaccugccccccacuuuacuugccuuuaucuuucuucucgugagccguccuccagcuuuuuucgguucugcaccugcuccggcucuacccaucugcaacaguccucuccacguguuucccacgcaccccacuucugugccccccuccccacccacuugauucuucgccuuuugccccgcaccuuagcuucuuucaacgucucccugucugcucaguuuucccgaacccccgcccccucugcuuuaguucauccauccuccauccauccauccauccauccucccgaccucccucuaucaguccauccauacaugacuccaagccuccauccuuuccugggccucuuguccugccccuuggcucucuuccuugaccccuauuuucuguaggcccuugagugucuuuggugagcaggccugcagccccuucugaucuuugucuccugggccccagggagcaccuggccucguggccuuucggggugacaacaagcaucacaccccugaagaaguuugcaagugagaagagguggaggaggagaucucauggagcggucucuaaugccacuuguucucuuuugagaccucugacuuacagcucuguucugucauuccccacacuugaauuuaagggacuuaaaagagugggagcugccccuuaucuuuugcaugccuaacccacuaccacuuacaucuggguauuaugauugccaauaaucuucucauccuagaaaggggccacucuguuagugagcauuagagagucauccuagaugggcauacaggccacccuuggacugcccccaugcugagugggcuaagauggggcccucgcugggucuaggugcacugagaacuggaaauggacucagauuuggugacucagaauugauccccccacccccaccccaagggacagggagggggcuuagaggaggggggcgaggagugagguagggggauggggaaagagcugcuuugcacagcuaagauguuuuugucauuaacccagaaacugagguacaagggcaaccccuggacaaagccccccuaagaaggggaggggcuugcguagcugaucaaggagacuuugaagaugccaaaggguccaaagacaacaguuuuucuacucuauggccauccuaucagugcaggaccugagaagcugaguguaacuuugaugauacuaugguaacuuggguggagcaaaaugaguuuauggggguggggaucugggagggcauuugucugggaugccacagaguagaagaaaggacccaugcgagcagucucaaaagggaccuguagaaaaauuuuagaaccauuucccuuuuaaaugggggaagcaaggcccagaaaagagacauuuacccauaguggcccaucuagucagccguggaacuaacucuguacuguacccgggagugaagggucacugugauccuuaauggggucaucauaggcauuugugagugacccguggaaagugucuucaggaauucugagugcuugucugggaaugugggcuucauaccauugggcugcaggcccugcuggguucugggacucgggugggcauccucaacugugcuucuccuccaggggcugaacuagaggagaacagcaaaaacacgaagaaacuugacgccaugacccucauuaaagaaggugggaguccugcacagaggcugggugucgggaacguggaccaagcuuucccucucccacuggaggaaggagcuugaagcagcagcgggacugcugggggaagaaaccuccuuuugauaagucugagucagucaguuguccuggccccugggaccugcugguggugauccuaaucacgugugguuggugcccacauacaggaaagcccauacacuuugggucuggucagauggacuggggaggcugggagcguccagcagaacuaucaguuggaaggcugagcgucuucuaagugguggcguugagaguguuccuugagcuagggaaauccggagaauuugacccgagugauaaaggguucugucguugcagacauguccaucuucgggcacugcccugcccaugaugacuucuauuugguuguauguaaccacugcagccagguggugaagccccaagccuuccagaagcauugcggugaggggcacccuagggaggcgauaagggggcgggcgggugggugggaugguggaacauggaccucuuaggacauugucagucuggaggucauaugggcuaaaggaagauggugcuggggacagcuugaguguuggaggugucgggauuauuguuggaacaagcuucuagcaucaagugaaguuaagaggcucaagaagcguggucuagaauuuugacucuugaaaggcucaaucuuaaaugggaaggagagacacucacaacccaagcgcuagggauuggcgggcugguuaggagagggggaaggaggcacucaauaccgcucaccucaguuacucucuccaccuccuggugacagaaagaagacaugggccccucagcaagcuuuaugcccgggccccacccccaccuccagccccugccagcucucaaaaaugccauguagugaaugggcagggcccagcuuguagagccccagguuccaccaaaaccuccuccagggagaagggccaggggucccggagccguggccaucagccuccugagaagacccagaaggacagccucugguaagaagaagcuggaaaccccuaaaaguagcccugacccugacccaagaaaggguugacacuuagcccugcuugcaggauacugcucacagccaagaaauagcuaaccccaucugcagcuccuucccauauauuccagggaacaugggcucccccuuuuuuuccacgccucucuuggaguucacccaagcuccagagcuagggaggagauggcucugggcuagaguccagaccccagucccagccuccccaccucccagcccauacccucucuccacguguagccuuuucgugccuguggugaaucuggagaagauauccagucucccgaaaccugaugcacauggagucaggguggccccacccucugcucuccucagucagccaggaggccuccccaaggacuccccuggaaaaguccccacggcccccucuccuaaagaaccuccuggcagagagaacaucgagcuuguccccggugagggcuccagucaccgcgccgaaggcagccccccggagaaggaggccaguggagccaggcuuccuccuaaaacccaccgaaagauggcucgugaguaguuauggacgugggacucagaaaggcggaguggagaccucacugggcuucucuguucuugggucaggaaggagugaaccuguccaggucugaccauuaccgcuuggaggguguggcagccccauuaccuccuguccugcuuguucccagaaagccuugcugguccaggucucugagguagucugagagaacacgaggcuaagccagcagagucacucauaccugccuugaccauucucuccuuccccacauccuacagcuguuuuuccugacaucuaagauguagguagcugcuuuugcuucuugguaccgacugcccugcuuugggcuuccagucuuccaagaguaccugggccaggcauagggcugaguugguuuaaacccaagggugaggcucuccugccuuaguccuacugcuuccugggcccuuggcaggaagaggccagauucuuccuuggcuccucccccaaauggacuugcgauucauuggaaccucuuucccccacagggaaggaguucgaccucaacaggcagugcggggucauaaauccagagaccaagaagaucuguacacgccuauugacuugcaagguaaccccaucucucugcaugaugaugggaggcagguuuagcacagacaaggaaccuuggaaaggagaguccagaaguuaccguaaacgcgguugaagggauggagcuaggccucuaccagggaaggagagaagaggcugcguauagugggcacaggguagaagcaguaggcagggaguaccuuccagaucccuuacccagaggagaguuuucgucuccugagaguaaaaugaacagacaaacgccccucacccacagcacacucugugugugucaaagaagaccgaucccuuuuccuccugcucagaucacaccucuguacugcucugcuguguucuagauccacucagugcaccagcgcagggaggucccaggcagggccaaggacuuugaugugcuaguggccgaacugaaggccagcucccgaaaaggagagucucccaaggagaagagcccagcacacaaagagccagcucuggagcgcccaucccaggagccucccacugcaguccaggguguggcagcgguagcugcccccaacaccaccuucucuucucugucuaagcagaccuauccguacugugcacuccccagguauguacagaaucuuaaguccaccuaacaaggggauauucagccccuaagguaccaggaagucuuggagacaggcccaaggaauguccugacgauggacucacuugcccuaagcacccaagcacgcugcggcacugcagcccccgugaggugugccagaccacagcacccagggugugaacgucuuucucgcuccuccauggauuagcgcuuaucaucagagagcuaaacgggccaggguccugggugaagcagugucacugugcagucauccacuggucccuuugugugcagaggcugcccugggcugugggaaagccugcucaugugcacuuccucaggggguagaugugaaacacaggcgcagcucccaggcaggcucccaggaguaugugacgaagagaguugacuaggcugaccagcgcuggggguaguuaagccgggaagguuuuucuggaggaagcaaaucugaagcagauuuucuccuuaaaaagacaaggccuaggaaggggcuaaagagagaaucucuuggaggcuguggcccuugguucugccucucacucugugagcuauauaguacuuuccugucuuuucacccuccccccucaucugaguccccagaagggugugucugcccuggcuguuugagagagcucggacacccucccucuacuccgaaucacucacaucauccuuccaucucccuuggcccuucaggucccaugccuccucugagagugagguggaugacgaaggucccugugguggugauggggauccaggccuauuccccuucccucugccccgggguggggcccaggccuccagugaggagagugaggaggaggggauaucugaugaccuccaccuuuccccugacugccauuacgcaacucggccccccaggccacaggcgguaagggggcaggacagggagcugggguggaggguggcuaagucuuguaucucaggcccucccaaccacguucguccuuucuucugccuccaguuuugcacauuuggaagccggcuggugagcccaggaugcuauguguuuagccgccggcuggaccgguuuugcucagcacucagcuccaugcuggaacggcaucucagcucacacauguggaagugaguuucauguucucagaacuuucuuccucgggcucaaguguacuugggcuucagaaaccccagucugguauaccauggcugauugcuaaaaacccaaaugggguguggcaugaaggggugagacucaguagccuggaggagggcaugagugggugaucugggugaaucuagauacuugcccaucacuuccaguaccuguuaggcaauguaggacagggagggcccaaacugagauaaaaaaucagguaguuaaugugucuacagguagcucugucuuguucugauacaaugaccauuccuccucuugugccuuccuccgcuuaguuccauugucucccagcagggggcagcagucuggggcuuugcuggccauuugaaggugcagagacuaguguauauuagggcagcccugguguuugcucaguaucacagugggccuuucucuuugcuacaggaaaaucccaccagcagccgagccuccaucccaucuugucaguccaucuuuaucugaucccuugaguccauccccuaugggcagcuguccccgacuuccagguccagccccccgaccugccuguccagccuccauaccccccgucaaggacagccuugucccuagcuauccugcaggcucccccaguguagcagcugccugcagccaggcagagugcaugggcgguagccaggcuauuaccucaccgcugccugccaacacuccaucuccguccuucagcaagcugccaccuuccaaggccagcaagucauccaaaggcaaggaggggguggagauggaggccccuucucgaaagcggaaguuauccccuggccccaccaccuucaaacggaccugcauccuggagccugcuggaaagggcaaacccucuagcugucggggucucucaaccaagacuaaaacagcccugaacuuggggcuuaauggaacaguggggccacgagugaaacgggccgguccccuggacugucgggguuccccucauccaucccccauacccgucaaggcuucucagcuagaaaaccgaggaguggccggacacccagcuaagguccugccaaccaccugccucuccgaggaggagguagccaagaagcggaaaaaccuggccacuuacugccggccagucaaggccaagcacugucaggcuggugucccuccugaugggaccugcucugugcgucgcaagaagccagguccagcccugcccuuugaggagaagugcucuacacugaagguaccaauccagcuuccugaagaccaugggcagagagggguugggagggcugaggcuggggagcacaguagguacacgacauggagaaggugcuaaggaugcuaaggggggaagaaagggggaauugagagagcuccugggcuaccuacuuuggggagagguuggucaguucuuuccagggugaccccagcucuuuccugagggaccuuuccuaugcccagucuuuuccuuugggccuaggacaugcugucuccuaucuuugcuuuaaugaaaggaccacuucuuuuugaacuggcugugacccucccucgaggacuuggagcuacuuuuccuuacggggaaaggccccagcaugcagaguagcugggugggugggcugcucuaguucucugguucucccacuggcauuaggacauugaaaagcaaguccacaacuucaggcccaccaagucauuucagauugcagcagguucuccagguucuggcaaagcuugcagcuagguuuauuuaccuuuccuguugaagccugcuuugcuuugacccugugaccucucuaaggagggacuucugggaggcuaggcaggguaauauucuucuggguuaggcauggcucaagugcugccagcucuccuggcaccuguaagggaaaccugauaguaacugacaggccugcuuguguguguacaggugugugcauguguguucuccagcuucauuacccaguccucuguuaggcugccauuccuuuucccuuacucgguuguauuuauuaggccagcugaaggaauccaaggguuagcccagauguucaaugggaaggauaacagguaggccccuagccugacccugucucuuaccucuugucucccugcagucaaaagcucauuaacgagaaagugccugcccacugcaacggagccgccagcaccuccuccccuccagaucugggccccaggcugcugccgcuuuuuauaacuuuauauuauuuuuuuuaagaaaaaaaaaaaacucuuuaaaauaccucaag

SEQ ID NO: 1666 - RNA, 15179 nt, Mus musculus
ugcuaagguccagaaaguaccuuaaucacccaccuucucagcugauaauauuucuucccacccucacagaagagacaaaaaucuaccuucaucuccguccccauucucauuggaaauuaaauauuaauccucuuuuucuuugacuaccucacccaucacgccauauugcaucccuuugccuaaaaugaagccaaguuugggagcaauuaagucaaggucugugacuuucugccucccauauaagagcaguuuaacuacauaaagaauaacaucugagggcagaaguucuaaaccuaagacccacccagagguggucccuaagaggcccagaaaccugaugagacuaaauguaaaacugugcccaaguacauuuuucuagagaauguaaaugugacaugugacugucugaggagauggauaggugugaguuugugcagcgugaacacuacagugagaagagggaagcauauggcccucgauuuguccuuugggucacagaugguaggagagcaaacggaggcagcauuguggaagccacugucuuuugccuuuugaguuugguccaaguuugcuaaugagucuugguuucuuuggaguaauugggugccgccaaaagagucgaugucacuagacuggggcuugccagaagcaauugccuagccagcagacucuguugccugggguucagaguugcaaggagaggagugucuugguagaaaugcugaaauuuguccaagaacauagagcgagggaaaaggagaaggggaaaaaaauccccagaaguccucuggucuuggcuucuucuuggcaaauguucgcagcacuguuuauucaaauguguaguaacaagcaccacagaacaacaugcaacauucuccccacauccucgaucugcaaucccagaaauaggaggcccauggucaggauguugaaggggacucaugucuaagaaagguccuggauaggcgucuccacaugguaaagucuaccagggcaaagggcaaguucccugcuuguuggccuccugcaauagcuagagaaaccagacaccucucccgcuucaggccugacuaggcaaagugguggugccagcccugguuggagaggacacgagucucaugaggacagagcugcccuuggcacuuacugcugcccagcccccuggagguaaugaggugaacuggucuuuccucuuccggcggccauggaaagaccauagccuaaaucaagacucucuuggccauagccagacucuugccaggaagagccuuuucaacccuagagcgagcccuggaguacgaaugcucggugggaguggauaacuccuacucuaaaguaguugaugggccaguugcuaacuugggccccaaaugagaacacuuuauccgucacaguucaaauaaauuauaaauauagacgcagaauccaaacacaguuugagucgaagcugcucccagauccccacagggacuuguuugaagaaaaauggucacucuuuuguucuuuguaccucuggagcuggaggcaaaacugucucccuuguccuuaaguaaccauggggacaacuuaggauagagaguuucagauuuaggaucauucucacccucaucaaauuuuccccuccuuaaaucuuuucccuaaaaucuuaagcagaaaacaaaaauuccaaauuauuuuacugaauggcucgggagcaucugaaaguguguaaauauccuacuuccucugaagggugggggaauuguaacccaaagaagaaaugaacagcccaaaguuaaggauucugagcccugggcccccaagaaauacaucuugauguggguagcauugaggaaggcaaggggguuggagagggucgaucaugucaugaggacagguuggcacaagguacauucaucuuuggggugcuaagugggacaauugccacuaaauugggaaacggcugguuucuuccuucuuuaucaucuuucccuaagcaacccuacugccaggguagaucaagggguuuugaucuggguaaaaggcagauggcauuugcccaguugguacccucuggccuucgggcccaaagagggaugacaggaggaaucagggagaggagacacaccaaagacaaauauggaucugggucccgaaaugaagaagcaccaauagcaucgggcugcccaggacuggggaaggauggggccuggcuacugcauggaggcgagagacaaggacagauaacccucuuuguaaagaugggacagaaagguuugaaagaacuagaaaaggugcuggcuugagaaaaugaacagacgguaagggacaggugggcccauguauccuugucccgggacuccugggcaucucaugucacgaugguccuucaggcccucccaaagcccacaaaaccaaggccgagaaggagaagggaguaagggguuucaugaguaagugguguauagggugcuaccgaaaguguuccagcugagggaaaggaagggcugagggaacagaaaacuuauucugccagcaacuuuccucacuuucuuccuuggugcugcaauguacuugcaacucucucugcucccauuggguccgggucucauguggacccuuagagggaccucugauaggauaaugggucucccugcuucacacauggugggagcacacugggcucugggagggcuagagauaggauacagauuagaugccaguuauugagggaugccacaaaaucacuggugggcccuccacacagaacucagggcaagguugccagucagcuuccccaaguaagaugcuucaguccaggcagcagacaagaagcacugagauccugccguuugcugccccagcaggaugagggauaggaagccaguggaggucugcccagguuaccaacagcugaugcccacccauccauucucucaaaucucaaaguccagaaugaugggggaagggaguuggaggaggagggagaggaggagcaggaggaagaggaagaggaggagguccuguagaagcuggaggagcugacaaggugccguccaguuggggaguaggcagaugaaggcugcuuacugcuucuccacugcccccugcuccgcugcacucuccuggcuggggcccuggcccugguccuggccuuguccgugccacggggucucuuugaacacaaaccaacaguuuccagcccacaggaagaaguugauaaagccaaagagcuacaaaagaaaucaggagagucugugagaauagucaggaaagugcuacaugagaaacgggaggaggagaagcacagagaacuugguauagagacagggcucaaagccacugucuacuaacagauuuucuagcgaaagugucuaaacucuguccagaggacucauucacaguguagcuuggucacuacucgaaucuggccccgggaaugcuaaguaaaucaaggaacacaugcuugccuuccugaggugagcguggcuggagcuguccaagguacuccccuagggcuaaagacuaaucaaaggcuuuauucaaacaucuauuguuuuuguuauuauucuuuuguuuucucugugcaccuagccuguucuaggacccuuaacccuucugccucugucagacaggcuguugguauuacagaugugugccacaccaacucuauuaaaauauuuugaaaaacugacaauauagaaagaaggguguuguggcacaugccuuugauaauaauaauaauccauaauaauaauaaugggaucaaugaacuagguaugguggcuuacaccuguguauuguaggacuuaggagauuaaggaaggaaaacugaacucaagacuagucugggucucacaacucaaauugaacagaaaaccugaguguaguggcacaaaucaguaaucccaguacacagaaggcugaggcaaaauaaccgugaauuuggggcuggagagauggcucagcaguuaagggcauugacuguucuuccagagguccugaguucaauucccagcaaccacaugguggcucacaaccaucuguaauaggauuugaagacagcuacaguguaugguguacuuauauaaauaaaauacauaaauuuaaaaaaagagaauugugaauucaaaggcagcuuggauucuauagugaguucaaagacaacuuggguaauauacaaagaaccugucucucaaaaaucaaguaaaaacaauagacgaggaaagauagauaaauagauauaaagcaaguguguugaaugguuguacuuuagaaagugacuaugugggccuuuccuguaaauguuuuucagcuuuucuggauauauaugaaauuuuucauaauuaaagauuggaggagcuggagagauggcucagcaguuaagagcacugacugcucuuccagagguccugaguucaguucccaggaaccacauaguggcucacagcuaucuguaaugggaucagaugcccucuucuggugugucugaagacagcuaacauauacacaaacauaugcauauauauauaagaaaaaagccccucugcaggguuccagaaggcucauugguguacuagccauuaggcauuucaauugcgggccauugggaggccugugacauuuucuaaguuguuccgggauggcugagaugaugggacauuugagaaguuuaaugcuauguuaauuuacaaacuuauauagauguagcucaacgcuacaacuggaugacuaaagcuuggacugccugccaaaccauuccaguagagaagguuaaacgacaagggacagugucucucucauacuaauccacucacagcuaugagcccagccacagccaugaaccccuucuacgcaugcucccaugugacacguaguugaacagacaggaaaggguagccaccagggccccuaaacguggaaaggaaagauggugaaggagugacucagauuuguuucauccaaaauaucuucucaggucaccacgagaugcagggguuacuagucuaggugcagaacaucuugucucuggugacaccuucccuguuccucucagaacgaguuagcuagcuggacagcugggcuaguguaccauucccagaccccuccgauggucacaaaucucaccacagagagguuagccagccccauagaggguguggccccggcgcugcacacugccuccucuccauggcacacagacauggcugcagucaggcuggauggccggguggccccuuugacgucagucaagcccuugccccaggcagcggcagcaaccagccaaaagaaggugaaagagacagucacacagaaauccuaggaggagcagaaggaggaagauguucagaggggcccagugaucauugauuaucuuuccuuccuccgauucacacaagaaucccgagguccugaguaagaugucucuucucauccuaccgauaccuaacucccauccuaccugaggacucugcucagugccaccaaaggaaugcugccacccagacuaccauauuccuucccaaagaauuaaggucaggcaaugaguugccugucacauuaucaaucugcugggaaccuucccuccuugcaacccaaguuacacaaacuccuuacucucuccucccaacucccguuuaaucaccaucguucaaacuguaaggaaugaaaaggacacauucaggagagaauugagauuucuaaaguacacuucccaccuugaaugccuagaauacagaggaaguaaaugaaacgauacuaauaauagauagcgcucagagaauaacugcauguuagguacuguacaugcaaacucauucuauccuccuaaaacaggaacacaaguauuuauuacuucaucuuuauuuuauagccaagaaaauuaaggcagagaggcugaguaacuugucuaaugucacaugguuacugagagcaagugcugggauuuaaaccuguuaggucagcucuagagccugcuuuauaaagauacuacuuuucuuccucugacugcaaacaaaccacugagagguccuucuaucccacacauaggcaucaggacucagggaaacuauuacuuuugaucgccccuccaucucugacauuuauuggcccuaucccucugggccauggcucacucaccaccaacgggaagcguuuguucucuguguagaguuuguggaagcgcagguagaugaccagggcagccauuguguagaagaaggaaaagaugccaagggucacaaagaacucggcgggggcagagaagucucccaugagguucaugguuuuggagguggaguccugaucacagagaggcaucucauacuggaccugguacaaccuaaagauggcaaugaaaaccaugcugagauagggcuagccucuccuacucugcccaauaggggcuccuguccggggcucacccugggaaaggagucauguagauaggaacuccugaggaaaucuugcaguuaagagaggugauacuucaagauucugcucauuuguuucuggcaguacuggggauugaacuuggggucucacacauguuggguaagugcuuuaaccacuagaccacaguccucuuccaagauugcauccgaaccccauguuccccucagcggccacuccagaucuuuaagucguaacauauaugcaguccagccauuucugguagcuaagccacuagacaaaucagauuccgucugcccuuaggaacacacagacccauauuaagcaguggccaaauuaagguuuaaguuacccguucacagacuugauuuaggccucccugaugugggcacauuggacaaaauaaagugaaaaaauacagcuuguugugaacaagagauacuuaaucuaaguuggacagugaagugguuucagacacucugaaaagauguguucugccuccauccuuuucugaacagucauuucuccuccccaaccagaguuucagacauugagagauuaguauucucuucuacuuccuggacagggcaaaccucccucuucuacauccuggucaagguguaccuccuuacguuuggguguuaucaugugagcauccuaugucucuuguuuaguaacuaaacucuaauaagcuuccuucaaggcacagaggaauaugcggagggucagauaugcacagaggaaugugcagagggucagauaugcacagaggaauaugcagagggucagauaugcacagaggaauaugcagagggucagauaugcacagaggaaugugcagagcugcccaacuggcccagaccccuuccacccuuccucccaaugacuggcuucccucugucuaagcuguggugagcugccauugcuugaguuuggacuggaccaccaugacaaugauauaaccauguuucacucuggucagagugucugaaaaauggcuaauggacagaaugacccaggucuuguuuuauuuuaaucuagaccagcacacaauaaauggucuuuagauuguguguccucugaguagaaacaaaugagagguugguaggagcagaggcgggagaaagcccugcuaauguaauaaaagaagggcacugggucagaaccaaucccgacucaccugaagggauagccgaacaaaacaaugauggagcucacguccuuggcuucguuguugcagagaaccaaggcucccgucuccccgcuguaagagccgcaggacccgaaggcgaaaauagcaaagagcugagagaaagugaagccccuuugagaaucugaaggucucucaaagaaccacccuuugacuccaggggaugcagguacacaguggacacagaguaacaauuccuuuuauugaguucuucccgguagggacccucgcugccauucuucuuucaacugcagagauuguguucucugaacaaagcauuggaccaaguagccaagugaaggagguagacucugaguacauccucagaggggaaaaaggguuuucagaucucucuauuaagcacacauggccucuuaagauaauggcuaauauaaaaccucuauaauucuggcuauggaaaugucuguuucaaagcuauacuuauuuuuuuuucuucaaaugagagaucagaaauagacacuuuuuuuuucuccaagacagaauuucucuggguagccuaggcuggccuugaacucagagauuugccugccucugccuccugagugcuaggauuaaacgcaugugccaucacaccuggccaauagauucccuuuuaucaagccagaucagguguacaugggacauuguucauuuaauuucauuuucauuccuccuugagcagucauagauucuugcccuuaccuuauugcuaacuugcaaguuuccugccucaccggagccauggagccgggauacugagccaucucaugguacugccagcuugacuuuucuucccuuuagaaacagugcuggcuggguagauguugacaggccuggcucaagcucagagaaaaguacccuccacuuggcuuaucagcucuacucucuccuacugcugccugcuccucuuuguaaucugcuacugcuguccuuucccaaugguagggagcaggggugugucagaacacuugaauuguuuuucauuuccaucuugcaucauagcugacuacaccucuguuuugagugaucugaaaagucuccaucuuaugccucucacguuucuuuccuggggaacacacauuaauuagaaccgaaaguaagaagcugcauucuccugcucuaccauguucuccauccagccugcuuucuuuccuuucuucuucuucuuuuuuuuuuuugguaaguauuauuuauuuuauguauaugaguacacuguggcugucuucagacacaccagaagagggcaugggcucccacuacagaugguugugagccaccaugugguugcugggaacugaacucaggaccuuuagaaaagcagucagugcuuugaacugcugagccaccucuccagccccacagcccguuuucuaugcacuuaccuuugucaugacacaaguauucuuauuaaauacucugcuaauuguuuguuucuaucuguuaaucuguggcucagucaguguuuuggacauuaagcaagaagacaguaaucucuacuccagacuugcauccaggcaggaauagcauuguacauuauuuuucuacugcugauuggagugaaaagagaucuagauuaggaaucaagaaacccuggucccagucuuggcccuguaacuuauucgcuagguaauuuggcucugaguccuaguuucuucauuuguaaaaugaaggacuugagaguaauuuaaaggcuguguccagcuuuggaauucuuccacccucugaaguuaaugguaucagcagagcaugcucuuggcuggguuuagcaacagcuguguucugccccugggugauauccagugcuaccgcccugccuugcauggccuggccuggcagaacuccgugcuggagccauugacugcucucuaaaggucauaugugccccuauuuucaguagauuuguuccaaaugagugauaauuaucuauggagguaaagauacccaggaaagaagacagugugauuugccugcaauggcuacauaaccuccacauccaaacuaaacucugaaagcugcaguagaggacaguuggcccaccuuccugacagugucagagagacaucacuagaagccucugggucaucacccuuaacauaccuaaagcuggucucucacacagagcagugacccucuacuagcuguuccucugagggacugucucuucuuuuacucugugggucuccaauucccccagaagacuuuauuccucuuggcuugagggugucccauucgaggaaaggcagcacaguuggauuggcguguuuuuauucacuggcuguuggucggugaguauaaaagugcauggaaagauuccuaacucggggcaauauggaaccucuucuacccugggcacuguugaacaucuaccccccccccccaaaaaaaagacauuucucgaguaugugccuguagcaggcacuuuaacagugagagacaguauggguggguguggguaugugugugugagagagaaagagagaugggaggggcacuguccucguggaguuuaugccuuagaguuauacuguucaucauguagcgcccaaacaaccauggcuauuuggguuacuucaaauaaaaugaaacgaaagcuaagauucagcugcucagccauaccagccacaaagcaagugcucgauagccacgcauggcaaagcacuucucuacuggccagcauggauugcagaaccuuuccacugucuauuaaaauucuaagucucauuccaguucuggaaacagaagaagcccucuuuccuccaauuaaguaacauucucaaagucacauuuagcuaaugggagagcuggccuucaaguucacaucuucugagucacuguucugagcuccauucauucauucauucauucauucauuugaaauuaagcaucuaccuugugcccugaugcuauugauauggaggugaguaagacucugcacuauggucccuaaggcugaagagaaagucuuuucuguacagugcauguuacaaggagagaggcagguguucugccccaagcugcaggagcaggauaccuguccagaccauucacagcuuccaacuucucuguacuagauuugcuuccggccaugaccaugaagggaauuaacuaauccacaggaacaagaagagaagaacuugaaacccuugucuaacauccaagcuaugagauagcacauuggccauaaagaauaaauauggagucccugagaguaagggcauuuccggagcucagaugcugggaauggugauggccauacuuugcccaccucuaccucuucuuccuccugccuuugcaucucuuugaaaagauagaauaaccuucccaggcuccacuuaagguuggggcuccacucugaucccggcuggcuuacuguauucgcuugugucaacccuaagggcacuaaccaucaaggauuucaaggccucgccaucuauuggugcuauggacucugacaguauccauucaaaaucuccagcaaggaaaaaaaaaugcagcaaacaaauaaaaacaaaucccaccaaugagauagcucuccuguaucauagaccucaaaaugccccuccccacaaagaucaucagccaccauugggagggugugcuuggcuaaaguuaaugugaucuauuauuuguaagaaauuggaaucccauaugacugagucaccuggauuccuuugcacuguccacucgaacugaagaguuggcagugacauuugagcaaucucacuggaaggcaagucacacaggacagucuccauaaggaagaaaguuagggaagguuugggaauaagacagaacggauggagcacagguuuaugaaaguucucacugugaucuucaggaauguucuaugcuuuguggacauuauuacccauaauccucucaguaagcccagaggacauggcuuagccucaaaugaggacaaugaagcccgaaaagauuucaccccuuaucugagcuuugagggauaaaaaacagagauugaauuuaaguaaaaguccaucuaaucuucaucuaaucuuugacuuccuuuucuuuuaaagcugguuuuugggaccaaugagauggcucagugggcaaagacacuugccauguagcucuggugaggaguucccucuccaaaaucuaacuaagaguaaaaaaacaaaaaacaaagcaaaacagaaaaacaucaaacuccuuugacccuccacuugugcacauaccucauucucucucucuuucucccucccuccaucccuuucuccuucccuccuucccucucucuccuuccuucccucccucucucuccuucccucccuuuuuccucucuccccccucucccucccucucucucucccucucucccucccuccuucccucucccuccccccucucucaugcacacacacacacacaauaaugauaauauaaaaguuuuaaaaacccuacuucaauaaugugucuauauaauaagaguuauguggcugcacucaggaggcagaggcaagcaggucucuaggagcuggagaccagccuaauccugugaguuccagacaaccagggcuauacagaaagacccugucucaaaaaaacccuaaaauagauagauagauagauagauagauagauagauagauagauagauagauagauaggcagacagacagacagcuagauagagcaugcuaucuggcuaguuugauauagacaugauaacauucuugaauuggaacugaggugagauucauuucugaaucuuaguuugguugauuuggcaaaccaggcugagauccgccugccuuugccucccgaugguugagauuaaaggugugugccacuauagccagccucuuuucuaauucuuaaagacacucuaaguccugacuacaucacuuucuucucacaaggauuccaguaaaacccuugccuuugggugaugauaauaauaaaaguuuucaauugccauuauaguaacuacaagaucugugcuuucuguuucuccucuggugaggacuauuucucacacuggauccugugcacuuuucuguucaucugcaaagauucaagcaagccaaacccacgcccugagucuaggcuaccugugagagcaccaaaagcaagccauggcuccuuauaauguuacuaugugaagcagugcuucucaaucggccuaaggcugugacccugugacacgguuccucauguugugaugagccccaaccauaacauuaucuuugaugcuacuacaugacuaauucuauuacagucucauuuaacuccaaaagggucucagcccacaggucgagagcacugcugugaaugaagucuaucccccagagaccugauuuagugguacgagggcaagauagaucgauccuguuuuguacaauuccuucccuauaaaguuggagaucauaaaagucagaacggucuuaauucuuagggaaucagugaugacuuuggaagaagacuggaccauugagugaggagucacuguguucagggguguuguaggaaguagagugaggacaguggcaggauuacagaaggaagcuuucuagaaucuucccaggggggauaaguccauggucuuuccugcuguuuccaccuccugacaaccugucacuuuccauuagaucuacuugucugguuuauauagcacguaugucuuguuccucaggaucucucagcgccucccugcuucugaaccccaguuccuuugaaaccuuaccuuuccuacucgguccccucugguacucaagucagaacagggaaggucaggaggugaaagaguucaggcaacauuggccccacucuugaggcagcagagaaagucucagaguuuauuuacucucaggacucccaggcuggccugcagcccauuaggaucucagauacccagagacaaucccaaaugcccuccagauuugaugauuuccauccaaaccacaauuacuuaggauuuagugacaucgugcuaaguccuaucuccugugaauucaaagaucuuuagaacuugguucucuuggauauuaaggguaaauuggucccuagcugaauccagugcuugaggguacaguaauaacuucauauagaaucugguauauggcuugucuaacaaaaucuuuucugcaagaaugcacaaaauguuccccaaaucuuuaugauuugaaaugcuggcugcaucucaaggaccagugaaacaagccaguauucccacuagaccagagaaggggaaacugaggccaugggccggugaauguuucaaggucacaggguaaaucuaauauugagcuauacucuagaaugcugacaggcauuugauccauguuugacuaauguuggaaacuaguguccagagaagugacuuguccaaggucauagagcugagacagguagcucuaggccugcaaccuaccaucccuccuucccggcucaauguucuguuaugccagcugucacauuuucuucugucuuaauugguuuuuuuauguaaucauuggauugggaaacuguucauucauccauccauuucuuuacucgguuacaguuucccaaauugcuccagugacuucagcugguagucugucuccugaguccaccccagggaucauccagguccuagaagguuccaggcaggaugguuucuguaacccauuuccuuuccuggugccuuuaguaguagcguuguucucacugcaaaguggaccuuacccuccuuguccuccucaccccucccgccacugaagagugguaugugcaggaucagaguucuggaaagguuacacccgggucuucucguccgagugaaaugugagcgcccugggcaaaggcgccuugcacauagaagguccgaauccgggacuccgcaugccgggcuccucucccuccuuccaccgagcgcuggagcagcaacccugguucuccccucccccgcccaccugucgccaccccccacccuuccgcgguggcugggcccgcugcaucuccccagccuccuccggggccacauugcuucggguccgcgucacaauccaggcucccgaaauagcccgggguuagggccgacucacccacuggagaacuuugaugaagcccagcggcuccuccaggcgcugccagcgcagccccaggagcaggcgguccaccugcggagacaaagccagcagacggucaaggcgggccggcccggagggaaagcguggggcuuucuauucacauugcgggggcgggagagacggaaucagacacauucgggacaucuagguagacagggacuagcgagaguccacaggccggguacucggggcuuaccugcuggcgcggagacuuguccgaggugcggccggggcucuccgucgaggacaugcuggcgcgucggggcgcagugcaaggguucgacucccuggccgggaggcugcguggggcgcgggggcgcugggggcggcgggcucgaggccgugggcaggccgggcuccaggcuggcgggcugggucgugggggcgcugcugcucgcgcucucggaggcucuguccgccgcgcugccccgccggcugcagaaaacccccgaguccgauucaaacuucugucaaacaaucug

SEQ ID NO: 1667 - RNA, 651 nt, Mus musculus
ugugcaaauauaaagagguuuauucacuuguuacuggguauaaaacauaacauauaaaaagccaccuucucucucuuuagugugaacaucuugugcuaucuguggccaccucaggcuucucaccaucaucagcauagucugcaaggccacacagcacacaggccaaagcacugcagccccagcagguguauacacacugcccacacagggcccgcucacacuggcugcagaccgccuucccauccacagaucuuaugcaugacgaacaagcgaugggcgcuguccugggaaggccaccuucugaggccugagcuuggcaccgugucagucggcuaucagauccaaucaacaucuguccucucgcaguuugaggggcucccaccacaccagacuucagugacucccgcaggugguucacggaacaaaucuucgcucgauaugugaucucuauaggcccgaaccccuuggaaaaggagcugcuugguucuuucgaagaccucgugugaguagcgcucggcgaacacaccguggcucagcauuuucaggcccacguggccuuugaguuggagcggggcugcgucugcaaacgggcagcuccacuugggcauggcagcggguaccagacacagcccucagcagcgcgcagcgcgu

SEQ ID NO: 1668 - RNA, 651 nt, Mus musculus
acgcgcugcgcgcugcugagggcugugucugguacccgcugccaugcccaaguggagcugcccguuugcagacgcagccccgcuccaacucaaaggccacgugggccugaaaaugcugagccacgguguguucgccgagcgcuacucacacgaggucuucgaaagaaccaagcagcuccuuuuccaagggguucgggccuauagagaucacauaucgagcgaagauuuguuccgugaaccaccugcgggagucacugaagucugguguggugggagccccucaaacugcgagaggacagauguugauuggaucugauagccgacugacacggugccaagcucaggccucagaagguggccuucccaggacagcgcccaucgcuuguucgucaugcauaagaucuguggaugggaaggcggucugcagccagugugagcgggcccugugugggcaguguguauacaccugcuggggcugcagugcuuuggccugugugcuguguggccuugcagacuaugcugaugauggugagaagccugagguggccacagauagcacaagauguucacacuaaagagagagaagguggcuuuuuauauguuauguuuuauacccaguaacaagugaauaaaccucuuuauauuugcaca

SEQ ID NO: 1669 - RNA, 783 nt, Mus musculus
cagggagggcacaccucugcuucugggcuguccaacuucugcgaucacucaagggguaauuaugccuccagcuuccugguagguaccagcguugguggacccggcguucuauauucgggguggggguuggggggggggggggaugaccgggagauucugacaacuuaagaagcagaagcaaagaaugcagcgagucaaagucucggauugccucggcuaugacgacacacagccccacgggccgcagccaccccggcccccgccgcccccgcgccucgccgcccuccgcaaccggggucucgcgcuagccucgaagcgugcaaugggagcggagcggccgccuggggccgcgggcccggaggggcgacccaaccggggcgggcgcccgggccucgcgcgcucaccuggugcguauuguuggucagcuuggcgaugaaguccgggaggcggccgcagucuugguccucggcgggcgcgccgcggcgccaacggccagcgcgggggacggggcccccgggcgcggcggcgcgcagcccccagcucaccccgaccggaccggcccagcgcagcagaggaggcgcgggcggcggcggcgcguccagccgguccuggccgacggcggcaggaggcagcaguugaaggagcaggaggaggccgaggggccagcgcaaaaggccguccgcagcuccccggggccgcuccaucgcugccgaaugcagacgccgcugacaccugccacccggcgcgcccgcccacccccgccggcgcugcgccacacccccg

SEQ ID NO: 1670 - RNA, 4925 nt, Mus musculus
uagaauuacacagacguuuauuuuaaaacuguuaaaaucuacuuucagauauacagaaaaaaauuuuuuuaauucauuuauuuaagaaaaaauaugaagaugugaguaagcuuauaacugauugaccugugagaagucaaagaauucauaggaaacaaguucuguacaucagcuguccuccuggccuuuccaaacagaccaguauccagucaggaagacaugucauagagaacugagccggcgggcuccuaaggccgcucauaugggaauggccagugaaccgugguagaagaucaagcucucuaguccugaccacaagauggaaggagacagauaggucacucugccugcauuuauuauuuuguuugugaguuucuccacgggcagaugaccucugccccucucuucuucuuucagggcaggguagggugggguugaguccccucaagcucaaggcacccgaucccccauagucucuacuucagaggucagcccuggaggcaucucuuccucccaucucugggcacagagcuacuggaguuagggaccacuggcagaggagaguccagacuuugauggcuaagaugguaguggcuugcuauugagucuuuguuugcugacgugcucuucuuaccugaaagaagaggggggggggggugcuuuaaaaaaaccuucuuccuccggagccugucugguacccagccaaacucacacccccucaggaugggagaguagcaccccucaccccucuccuccccacucaacacagaauucgaggaugcugugugcaccgcagcuuggaagcccaggugaugagaacagagggaccaguuuuaccuagucgguccagggacugcagcuuuccugaggggcugcgcccugccucgagcggcacuggugguccugccucgagccgcacuggugguuggaagguuuguuuucugggaaacagaggcuugauggaaauuaacaagagaugaguuagaacgaagcucagcugacgucaucagaaagacuggaugaagguauguguuuccugaccaagguaaaaccaugagccacguagaaagcaaggcauucccuccuuaacacuacgugaaaguaguguuaacagcaguuacagcuguagugggggaagaucaagccgugucacugcagacauucuucuaucuaagguucucuguuuuuguuuuguuucuuugguuuuugagacaggaucuccccauaauagcuaugguuguccuggaacucacucuguagaccaggcuggucuugaacccagaaaucugccugccucugccucccaagugcugggaucaaaggcgugcgccaccacugcccgacucuauuuuguuuuucuuuuucuccugagacaugguuuuauauagcuaaggcuggccuugagcgucuuauucucuggugucuacccucugagugcugagacuacagaaaugugccaccaugcuaagccugaccauuuguccacucuaucuuaccucugugcccuauggcgcuuggaugcccuuucugaguugagagagaaucuggagcuagggcaccuuuuccaggugguagacuccgcccaaugaguggcacucggguggcaggcuuggggauggcugaagggacagggagucgacuggaagacuugacagcugcucccuggagccgggaugaacauugggaguugcuagcugaggacuguggaacuggucugacaggaauuggugggccuguggacaggaguguagucgggucaggguggagcucagcuccucucuuccccucaucagccucgcccacaucucugcugccugggucucacuugcuguuguccgggcaccgaacccaguuuuccgccgagguggaagaauugguugugcaagaggagagcgccccgggcuuuuggaugcagggaacagauugcaagugggugauuccugaaacagaacaaggaaggaaaaaaaagaccagaguggaggcagucuguguucugcugccuuaaggagaggagauaguagguagggcguugucuagaaccuauaaggaagauaucagccagcaagaucuaccuaccuaccuaccuuccuuccuucuuuccuuccuuccuccuccccccucuuucaaagcagggucucucuguguagcccuggcuguccuggaacucacucuguagaucaggcuggccucaaacucagagauucggcugccucugccucuagagugcugggauuaauggcgugcgccaccacugccacccggcuacuuuccuuuuuuuaaagucacuuuauauuuauuucuuuacuguaugugacauacacauauguggcaacaugcauguguaagucagaggacagcaugugggagugugcucaucacguagacaacaguccucacauguaggucacaaggcuugaacucagcuucaucaucccugauggaaagugcuguuacucacggagccaucucaccaacuuauuauuauuauuauuauuguuauuauuauuauuauguuuuguuuuaaaugagggagucaaguagcccagguuggucucaagcucagcauauagcccccugggacugaccuugaauuuacauuugccacauccauuccugugaugcugaagaauccaacccagggcuuuguuuaggcugggcaaacucuagccaccuggccaggucuccaacccaauuugcuuaauccuaaaaauuccaggggauaauuaacuguguuccucugcccuguaugggaaugacacuacgccuucagugucuccugcaccuugucuagguguacgcacgcauguccacucuccacacucaccuucuuuaugcuggagggcuucuuuccggaugccacccggacagcccuggcugaccccuuuuuaucacugcuccggagcccagcuaggcugcuuggagguggggugcuccaagaacucacggugggcagcagaucucggacagggcuauccuucaggacgaaggucucccgccgaggacuggguuucccucuggggcugggccuuccagggccuguaccagcccucucccgaucuuucagggcacacuccuccagcugagccgccaggcgguuggcuucaucaagaaucucuuccagcuucucugggcugagcgggcccaagcuaaaccgcacacccuggagggcgggagcuacuucauuuggguuacuccgaugggcgaggccccgucgaagugguuucucuggacucacuaauacuguuaugucuucuuccucaugacugaaaaacaaauauggcaccaugcuggacaacagcuagcagaaggcauuccugucggcgagucggggacaauccccaacccugacuccauuuuggccaugagaacugcuuuuaggugaggaaaacuuaguucuacucccauuuucugagacaaugucucaacucuauagcacagaaugaucucaaauucaaaaucccuccugccuucucucucucucucucugucucucuuucccucucucccucccccucucugcacucuagucuauccuaggagugugggggugguuugcagggcaugccucaacaugcccagggacauucaucuuucauuuacauuuaccccuaaauuucccuacagcuucucuguucucaccagcauguguucuagaggcccaauucuaccagacuacugccaucagaggguaccauacucugcuagauuaccaaccacgguucuagaggcccauaaguuagcaguaaaggguuacagauguauugccggaggaaaauaauaaauggauaaauaggcugguaccugucagauggagacagcccuccgaaguccaaggucucguccacaaugaacuugauaucugaagggaugagaagaauaaaugccagcuaucaguucuugacagacagacucucaggggcccguuccucccuccauggcuuccuuacccucuuucagauccuccaugcucagccagcauaagcgagucggcuuagaccugaaagaaaacaugccuaccucaggugucuaucauccugccuuagggccccaucaagacucggagugcauuagcuggggugaagaggcaugguggugguaaagcaggaucagcacgugucccugaaacuaguccguuauauuagggaaaggugcagaaagcucgacaccugaugugcaauccgccaacuugcgcccuggccucuccucagucggucagucuucaccuccauccuuacuauuauccgaaauuucgcucccccccuaccccacccauuuuccacuccgcggcaccacauccccgccacaccuccagcgcacacucgguuuccacuccccaccucgcuucacagucuacgcaggaagcuuuucuucuacaaucucccaguucccgggaaagggcucccgaggggcggagcuucguucgaauuucuuaggcuccacccagucccgccacaaacgcacagcgauuggugaguccaagggggcagggcugagucgggagcagucgggaugucagccggagaagauugucccuuggaccaaagggcacuucccaaaaaggguagggggcuacagcggaacggcgggaggagccgugagugcgcgguggcguguaccggagcgccuccuucuaaccgcgagucagacaaggggagaacugucgaaccaauguaggcuuggagccccgccucuucccccaccuccuggauuccagcaucugagacuggguuuccuugcuggguuucucgcguacuugcagagaccaccaaauagaccaucucuccagcacuggagccacaagauuucuucauuuagcauaaggccacuucucugagauaucuggcauuuuuuucuuccugcuucaaccccaacccccaaacgaugaguaugagcagcuauuuaagaguuuaaauaaauaacaaaga

SEQ ID NO: 1671 - RNA, 25186 nt, Mus musculus
cugcuuuacagaagccagcgaugacauggcuccugcacagaacuaguuuauucaguaguauggggggggaaaaaaaaacaaaaacaaaaacaaaacucuaccauauuuacagcgacaaucaaacuguacaaucugaugguuaguaucaaguuagcauccagcaucuuuguauuuuuuuuuaagucaagucaucaguaguuaaaaaaaaauauauccaguuaaauuuuuaacccuuuacaggaauugcugaggggaagagggcagagggcaggugagaauccauggcagaaaagccagcggccagccuuccaaaugagagacagggacaucuuuccugccuccucgagccuuuauucuacaccugcucuagaagggaagucagugacaagucuggaauacaugcucagaggagagggggacucaaaugaacggugguugcaaaaacccgaggagagcaaauggagcgagaggaaggaugguaggccccaaauccagggcugccagggacucacccagccugcaaugggcacaugagacccccuggggaccagacacaaacccaucccaacacacacacacacacacacaaaaaaaaaacccaaauaaauaaaaaauauauuaacucucucuucgcagggagcuggggucaaguagggggacaauggggaccaaggaccugguucuuugaagaagagagccaauuccaggaagggguuaaaaauagaacaugucucagaggccacagcaggucagacaaaaaaaaauggcauuugucugauuuggcggggagggggugaguggacagcagaacccagaccuggcaccugugcugggggccccucagggccaccaugccagcucugcgcuuacccuuccuccugggaccgcccacacagcaaagaagcaauggaagagugacuggcccuaccugcaagggugggcaggagaaaugaagcacuuuggggucagcaaacugagcaaacaccugggcuguagcacauggccagaguccaggaaaaggagaggggcugggguaguccuuccccaucacgggggcaacaggcuuccccuuaaaaaacgguucaugcagcauuugggggguccaggggccaugaguccuucugccccuggccggacagggcuugucaguuccugggagagguggaacuggcggguggaaagugccuuuguuuuuuuuguuuguuuguuuuuguccugaccccucaccaacugaggccugucuguccgucuguccggugcagccuugcaggggcuccugccccuggugcacguggcuuuguccuuuccuuuuggugauggcaaaugaggggcaggcccccuaagagucccucuccucccagaggcacaggagaugaaacugaagagaggcugggacacguccugggugguccuguccucuuugggaaggggaaaggggaguccacuuccggcguauaaaaacaaaaguaaucccugaagucaugaagaguggagauccuuuuuuuaaauucuuuuuuccucuuuuuuuuuuuucugaaaaacuuugucuuggagauguuggcccccccgaggguccaaagugcagugagggggaggugggggagggacuuggcacuaguuggccuucugggugcaaggcccaggcuccucagauggacgguucgucgcugcugcuucggaaggcaggcaggugggcgguagggagcaggggcaggauaaagcagaagacaggauuggggcaugagcgcagcgggggaaggggacgaaggaacaccggcccaggguuaaugcaggaaguuaaagaagagaaaucuggagaggcaggagaggagaguggcagagaaggcagacagaggguuagcuggagcaacagaggggacagugaacagcuuccaccagaaaaagaaacagaaaagcagccccagcccccacccucucgcaagacgggggacaggcauugcgcauaaagcccagggggucugguguacccccaacagagcaccauguugucugggcgcacaagggagcuggacuccgcuuagcccaacugccaagcagaguagcccggugaagcucagaggcagcagugggucaguggcuuggguuagcaaggaccucaggcagguuccccccaccccacccccgucucucccgcccgacucacucagagccagaggaguccucauccaccgugccugccuugaugcucauggcgacaggcaugaccccauucagcuguuccugcagagacuggcgcggaggugggcggggaggagguccgugccgacugcccucacugauggaggagccccgagaagacccugugcccugcuccaggggcagccuuaggaggcugcucuuuucgcugauggugggcagacacuucuucuugaggaugccuagguacaagguguggguaucaugagaugggaaguccuaauagcuccggcaagagaaugggagaguggagcugaugggagagacuccacucaccuuugugagguuggguagaagggcccggaaggggucccagagacccuucccgaguuagggcaucuccauucucccguggccgcucuucaaggggcccacuaccacuauucuccuuuguuguggucccaaagucucccagccaagggaccuucccagaacccggacccccaucugucaaagaaaggaaaccaauagucccagagagggcagacaguuaggauagccaccaccccagcucuauuuuccaaaaagcccuggccucuuaggcuucuguugccccccaauggcugcagcccuggugcuggcccacccuuggggguacugugaaggggcagucucucagcuccaggacccagcaggcugucccagcccugcucgccagggaaggcggccuccuccuccucuuccucgcugucugaugaguggguggaggcauaggaaccacucuggucaucuuccagggacaggucacugucagaguccgugucgggaucugggaggucagggagggaucacaacugucccaccugccccagcccacccucagcaaaagccaggccccugcccugcuaggcauccagggccucuguccucaccauguuguugggcuuggccuuccaagaacaggccgcuuggguccccuaggccagggggaaccuggccaggguucagcguggacuccucccuaaaaagacaacacuaugcuguagagggauucccagguccuacuuugugucccuuacugcuguuaaucuaggcugcgaccugugcuggcccccaucugagaugcucagcuccuagcagcuggcuggucuugguucuagcguucacagucuuucccccauucccaauucucccguuucccggacucaccucagcaagaaggggauguagcugggcugacucuugccggagcggcuggcacugugcaacgagccagccgaaucuccguaaggcugguacagccucccgucugcguaggggcuggggcaguuauaggacuaggccggagacagacaugucagugagugagugagcaggagggaguggccccaggcuaaaaaguaaagggucccaggaacuuaccccaaacccuaccucccacaugcccagggauuaaaguggaaaggccccuucuguguugccuucaucauagggccuagcagugggcacagcuacaccauagcuguguagcacugaacacuccaaaugcccuggacuuguagaagggcuuucugguuuuuuuuuaaaaaaaauggcauuuggaauugucuccugagaauauucuaggagacaggaaauuuaucaaaauucaugaggaauucucuggcacagggugucccagcugacaaccaaucucugccugcaucucccucaagucaaaaucucuuuuacccagugauagcauuuccucccaagggaacacauuccacucugcccccuccuccuaacaugaaggugugcagagaugggaaaaaggaugcccagguaaaaaagcacagagagcaaacagcuuccccuuccaucagacccaggcucccucaccgaggucaggguagacuuaguggucaaggcagggucgggacugggcuuccggcugcaggcgaacuugagugcuuuccggaccuccuugcugagcaccacguaggagaggaagaugaaggggcccuggcaggcagagacagccacgguuggcacacucggcaccccaccccccaggcgugcucgcaucuacucagcagggguggggguggggauggggccagggccagguaccuggacacaauugcaggcagcgaagagguaguggaagagcagagugucacuguugacagagagcagugccagcagccacguggcacucagcagcaggaggaccgugaaggaggagcgcaggcccgagcuggagggcagggcagaugugaguccugccgugauguccuccacaccaacacccaccccaugcccagccaccugccaguacucacacaggcccuuucuucucgaagcccugccguugggcagcacaggaggcucgggccgacaggauguacaggaagacacucaucugggcaguggagagggaugugagaggaccagagaacagagacuuuacuuucugccuugcccugggggcuccagaagccuuggcucuuccuaaaggggaucuguaggaccccccucauccugcuuacugcacaucacuuucuaaucacuuaccgaaacagcaaaggccacugguccagcaaagcuccagaugaggguaucauagacagagagccagcagaagucaggguucccauagccuuccggauccaagcccacagcgaggccugaagcauagauacaguagcaagacagggugcucaggguggaggcaauuaugcugccaucaaagcucauagaaccaggcguggaacacauaaggucuguccacuccucucuccaaggagaagcccagccccugacacccaauaccagguuguccaaguauaggggaaggaauucuuaggacucgaacuauggguuugggguacaugcaugaagguggagccagggccuaggaacaggggaucucuaggccagaaaaggaggcaggauaccugugaugaaagcagggacgccccagcccagcauguaguagaaacgcaugggacuggcauugacgucgcgcaccucugugagcgcgcgguacagguguaaggccuccagcagagcccaggagaaggugcagagguacaggaaaugcagcaggauagcgaugacuguacaggcaaacugggggccaggacacagagucaggagccaaggcggguaauauggggagggcacccaggggaaggagggaggcaguggggaagccugguagugugcgcugcccuggaggaagcccaggcuauaagcaagaacaucugggacgcuggaaaauuaugagagaacuagagaagagcauacugugggccaggugcugggaugggcccuuuauccgcucacugccaugggagcagggaugggagagggccacaggggcgacaccaggagccuugguggggcuggaaguugggagggucucugagagaggaagaaucuuacagggaggucagccugguugaugcccaggagaaagaccagcugggccaggcccagggcagcugugagguugcgucggaugccgugcugguuggagcggagggcacggaggagggugaggaagaggaaggugagcaucagggcagccaaggugacuccaagggccacguaugucagggucuucaguggcaagaucucaccguucugagggaugaguggcagggcaucaggcacccggccccuggacuugguucccacccaccgcucugggccaccccuguggggucaccucucgucgugacauauccauaagcacagcaaagcuugucauaugguugcacuggcagcugacguggcucucguuacggaagacgacuucgcagccucgggcggaccagccgccagugccacugacccugcaggaggaagacggagucagggagggagaagggugggcggccaggagccuggacucuugauccaaagucguggagguaagagggguguacaggcucacaggauugaaugguuccagaagacacagaugggcuugguccgcuccucggucuccagcagccggaacugcacggugacuggcuuguccagagcccgcggcaggaguuccucgucgucgugaacgcugaugcucaccacagggguguugaugacggggcgcuuggggacucugaugacaggaaggcacacggucaccaaagaggccaccagacaccuuaucacugggagauguuuccuguucccuugcuaacccuaacuucccgggccucguccuagcugcuuaccucaggcuacgcuuaucggggucauaguuguggggcagcaguccagccagggugugguagaugaugacacuggccacugccucucccugacucaguucugggugccuccgcugccgccgggccagcuccuccgucuccugggcuucaccagguccugcagaccucaccauggagggcaucucuggaaguaaaugcugcuacgcucagcuggcccuacccacuguauggacgucccacuccaagccguuaccacaucuguguuccccgcugaccucugaagacagauucuggcaaaaugacuguggucucaagaucuggggggcgcuccccacguaaugccucauaacggggcagcuuggucccagcaaaguuccccuuauccaggcgcacuacagagaugacuagaaaggaacacggccacagucacucacucaccaagugaggcaggugggcccuaagcacgguggcccuuugaaacaggggcagggcucucuccacaacccucccaccccagcccagcaccaccucaccaauguugggugugacgauggugaaggggcuuagguaggugugccgcauauucugggcaagggcgcuggcguaagccucauagugcuggagcagccaggcggugccacccucugucugcuggaucaguucccagugccucuuguuggcugcauccaggagggcgcugcccacccucagcagauucuggggacaggcauggucacaguagcauaugcuuguggucaaccucauaccaagucccagccugugccuaccccagacccgcccucugcguccuucccucagcaguccccacagucucuccugggaagccuuguguaucauacuguccacuuccaacauggguacccgccucuaacccuuccuccacacuuuaaucagaggacccaguguguccuagcaugucuccuucuguugugugccucucugguucucugaaaagacugagcucuugguauaauaggcagggcucugcuuuaggucagcguacaccucaauacaagugccucugcuagguacuaggaugcugauacagguaggaggaaguacucuuaaucaacugugcugcaccauggcuuacaagcuggcauggaggcuucaugccagggguggggcuccuuccaguaggggaguaccucccucucucccccaagaucuccaggaacaggcugucucacuggcccccaccaugccuacuucaagccccaccuccgugaaguguacauccuguguggcggauagcccaaagccccgcugggcacucucaugagccaagagccguguggccagcugguaggccaccuugacaucacugccgaaguagccagaggugugcuggguggcauugcgcaggagcagggcuagccucugggagcguccugaguccaggccugauucguuccucugcagccgcucagccugcauggaggaccagaauugcagagggucagacaggauggaggugaccggagggacucgggaguaaaagggcuugaagagguagguggggaagaggcggccucugcaggucggagucucagguaaacaggaaccaggagucaggagcucuacuuccaaagacaagggugugaacaagagaagacgagggaucaacuuacgaagcccuuuagcucugagaaggugacugacgugcaguugaagagguuuggggggagccaaccccugugcucaucacaguggcgcacagcagucccuggagggaagaagccaagaaggcgggacuuagggagacaggaagcccggaguaccccacgagccggacaaguacaagcagcccaaaagaaaguaagaauauggguguucagaagcccagagccaaaacaucugagcaaaaucaguacaauggaacagaggucuguaaccuccgccaccacgcccccaagauaucacuacgccugucccuccagcuccugccuugcauucggcuacuccuuagccaugaauccuguacaucacuaauugggaucucuugggauaggacccggcacuccacacuccucgggacugccucccuuuaaugugguauaacuccaguacuagguagaguuagcugaagacaggaggagccucaugcaaaccgccuuugaguuuaguucccaacuccauucccagaacacgcagggcuuucaacaguucuuuuuggguuggauacaggcacauuuggucagccuaggcugaaggguaacugagugaaggaaggugagacauugacucucugggagcuagaaaucagaaaguggggccccaggagcuacacgcugggggcuugcugucuuuacuccucugacaguaaaggucaaggguucacuaucuuauuguaguccucuaagaccuaccaaaggagccuuuggggcagggggcagcagcagguagcccgaaccgcgugcggggccaccagaucccagccucuauggcccgugggcagcugucguaauucacuauggagaagagcacauggucaccuauaagcaguuccguccaggccccaaaaccuuccuuccacguccccgaccgacccacaaccagccucauuucuagccucugcaauguaagcucuuagcauacggugaggagggagccuaccugccccaagaguccuaccuucacagccauugguggugaccucagcaaaaggguugucacagcggucacacugacgcccaaugacuccaggcuugcacggacacuggccguccucggggucacagacucgggacaaagaaccagugggguaacagucacacaagagacaaguggggcugccggggggccgguagugauucuccuaggagggaagauguggggggaggucacuggaucaagaugucauccuggaugcugguggaggcuucaagcugcggccucccuagagacagucuccccugcccuggguccucaugggaaugugacuuaacauucucaagagcuacccaugaccuggaguugaacucaucaaugagaaaccaagcauucagaauaggcugcagccagccagccuguagggcuaguccagagaucccugccucaauacugguccuggaucccccugcaucuggauauaagggcaaacgaccucuugccaugccuaauauggcaaaggcacggggugcuccgcucuccggaggaaggcccggauccucuacuccucuucuuuccccggcgggggcaggccagaagcuacagggcagggugccacagugggggcucacucgggacucucaccuugcaguggcacuccccacuugucuuguugcaaucugggucaaagccuuugcugacaucacaguugcauggaccacaugugggguguccccaccagccacgggggcaagguuggucaauccugcagaaagacacccagacaggcuugagcccccucugccacuacaucuccucccacuugguucaaccacaggugguccuuucagccucggcugcagcucagcuagacucucagggcucagagugacagcagagauaagcccugacccaccuaccuggucucacaauauggcccaagguaauuugguaaacacucgcagauguagccgugggguguauuggguuuucggguacacacggacuggugcucgcauggguucaggucacacacauuuguacaguugucaccauaguaaccuggacaagaaggaccaaaaaguuucagggccaacccucuacuggcauucucuucuguccaucuccucuuaucuacuuccacucuaagcauugcaccaggcagccauaacccuguaggagaugacggcucagagaagaagugacuggccacauauuagagauggagugugacccguggcacuggccccgucccccgucccucucccuccccgcauccucagcauaccuagaacacagcuacaagaauagcugucccagucauugcugcaguagcuguugguagggcauggauucgagucacagggaucuggccagcuacagccuggcuccacauugaugcucuccccgcggcugggaucuagacugcugauacccucaggugucucgcuuacccugacacccuggagggauaagagcagcauuagccuucaguggaacagggcuccagguaggaaugggaggucaggggaggagacucaccugcaaacagccccggaagccacgggccacuccgcuggcuggcccaggaacucccccgacuguaauauugcucaggugcaguccaugcagccgagggcccagauuacccucugccuucuguugcccauagucaaaggacagaauggcauggccagggcccccgcuggcucccagugccagcugugcaugaugccagucaccaucauuggcucggccuggcucaagacgcagagaugacgccuggagcccugugcccuccacacuuagcacuacguggccugcccgaagcuguacaagagggggaaaaaucagcagaccaccucaaucaauggguucuuccauucugccugguugagggcagaggaggcugcuuauuucccuuaaacccaguagguggcagcacugacccacggaaugggcccagccagcucuucgcuucugccaaacccugcccagccaccuggguccaacccccugaaggcuccuacaacgcuagccaagccggggcuugccacacucccacgugcccugcaucaccugcagggugauggugcugcgcccccuggugacggccugcagcaggacgccaucugccuggcgugugcggaacaugaggcugaggugccagggcugagagaugggcagagagaggccaugccaggccacaaggcugcugcccaggaaacgcuggggguuggccauuucugggaaggcagaugaaaagugacucaagggcagagcaguggagucggaagcggggcagcucuaugagagcuggacccuugccuccccucacacccaauccucucagugccccgcccuccagagcauuuaccugucccgggccggcccuacauugugcccagggccugccugucucugacuaggcccuuugucuccugccuagcuucucacucugcccagacacgcuuuuccacccacagcccagcuugcagaacccugcccagagccugccccaagcccugccugugaucccagacaaacugacagcacccaggccccaaccuguggcaggugccacuccuacccugggcgcagcucuugcccccgaagccuaguggacacucgcagcugaacgcauuccacugguucacacaggugccaccguuguggcaaaugcugcugucgcacacgaucuucuugguggggcagccuggaaggaagagaaagggacucagggaccaacagcagagacuggaagaccacacaggcuggucaggucacgcacagccgagccucuuggcaguuggcucccagccuugccccuaccccggguccucauaccaggcacagugccauuguuggcaaugaagucggccaugucgaugugccggcuauccaccuggagguccuucaugcagcccacaaagugccgcauucggacggggaagcucucgggcagauccggcaccccacccagcaacaagggcccugucagguccagagaccugggggacgaaagcgugaagacacagggguuuaaguuuaugguuuuucucuuaccccguacccugucacuaggcccaagaaagggagcacuuggaccaaggcugaggagcccuuuuagaacaaugcccaggaaguagaggcacugcaguauauacaaaugugcucucagcccauacccuucccucaccauccgccaagaccugacucuaacucuccaacauugccagugucaggaaggggcgcaucugacuggcucccgcucuggagccccuucccuucggcccguacuacccucucccuagcuccugccccccucacccccucgcuccugcccccaccuuccccgcuuacuucuugcugccuccuugggugcccugggcagcacaggaguaguugcccagcauagcuccaaagcgcagagccaccccugugucacagccauccacggacaccacggcuaccuucugcucagauggaccuuggggaagcccugucugacccaacaguggcuguggacagagaagggaggcaguagacaacccggcauagggcugcaccucuccaugcacacacacccacagacgaggaccgcccagagggauggaggugcccugcacagcacauccccaucccccucccaggcacaagagcugugagcagccucccucaccacucacaauaucaaccggggcuggaaaaacgcaugcaucaagaccuggacccucuaauuccuccgucccucagccagacccaccuuguuauaguacuucagcugcacugugugccacuggccaucacugaccccucccggcacaaacggagacacggugguggucgauuccccuagagaaaggacaggguuagcugggucacaggaagagagucgggaguggcagagcagcgggcaugucuagggauggaggccggguccggguuugacugggagggaaggcgcguggcuugaggucagagggucggaggcaugagcucuuaggagcugggcaaggacaugagacucugggcucaccugcagagaaggugagcugcaccuguuccuggaucaccucgagagccacaaagucgugcuucucauugaagcgcccauuguacagcaguagcccguuacgcuccuugguagcaaaccuguauaggggggguuggucaugggggcaaggaaugggguacccaccugugaaccaguaccccagacaucuaagcaauagcaaaacuggcgcuuuggcuaaggcuauggagucagaacgcagauaaugagcccaaacgagaacccuggcguucugacuccucauccucaagggucagacccugauggugagggcagccugcuggcuaagcagacagguaguucugucaacaacugcucccggugcguucacugaucugcuacccccaucuaauagaccaggagguaccccacacucucucaugugcccugcaaccccaggaccucgucacacucacgagagggccagggugaaguggaagcgcuggcgcaggccacggaaggugaugaaggagcgggcagggaagcugcguguggucaccuggcagaaggguuucucaaaguccccggaggggcagucacauuugaaaccucccaccaacagguugacacagguacccccguucuugcagacaccuggaguacaacggccugaguggguacucgcuucacagugcucgccuggggaggaaagacaggcagggugaggccccgaggagaaggcaacugagcgugaggugccccucccucucccaccgccuauaauaaaggcuugguucuggcugagggagcucuguuaggagguauuggaaacaucgggaggaguguagcuggaggaagccaaucacuggagugugccauaaagggcuauauguugucccaggacccuugcuaucugggugaguggcuucgccacccugauguucuuuucuuauagcguggggccggccaccagaacugaaauggcacugcagagcuuacaagacaaaauuaaccuuuuuuguuuuaaacagucucucuuggguaauccgguggugagaaguuuuuuguuuguuuguuuguuuuucgagacaggguuucucuguauagcccuggcuguccuggaacucacuuuguagaccaggcuggccuugaacucagaaaucugccugccucugccucccgagugcugggauuaaaggcgugcgccaccaugccugguggugagaaguuuaccacgucccuggugacaucuccugagaccucuacccauccucaagacucucccacuuccucuuggugacuuucuccucugaaaucaaugacacaccagcuccucuuauuggcccgccacgcuauucucucugcagcuccacagauacucuguugcaagcuccucaaaguuuuucagcccuuccccacaccuguccgaaacccugguccccaggcucuggccccugcagaggcaaaugccaagccaggaaggaucuagaggacagcauagggcugugccagcccccacucucccguuccccgcuucccucggaugcuuuuguuccugucagggucagagaucaguuuucuucccuagagaugugaccagguuuccaugucuauuugaguaacagguuggggugguuggcgugaagcaagccggggcucccccaagaacagaacugaggaucccucugcacccaaacaaggcugagagagugggggccuaagccugaggacagacgaggaagcaggggacugaaaacucagauaucagaugggaaagccacucccuucucucccucccaauucugauucuagagauagguucuccguucccugugccuagugacuggcucuuguuuccauggaaacuguuguucgccuacuugggagcccccuuccccauccuccuggacaaagacuccccuccccucucucagucccacccuccccucuccucccuccccgcagcaucccccccacccccacccccagcagcagcacagaagagucaagucuggcaaguucugagcagaaggaugcagcaggaggcaccgagccugccuacgcuacuggcagagccagugcgccuggugcuggaggacaugaagccugggagucugggaaggaaaaggagcaagggagccaguaggguggggcaggguaugaagagaccugcagccacagaccaauagggaggcagaaauggagccuugcugcucagggcuacacagguccagcguccuggaacucccaugacgccaaagcccugcuuuuccgugccuuccuccuguuccuggguggggaaagucuggcuccagguuaaugaagggauucacucagcguuaugaagaccugguccgcggccagaaacaccucgaaguggaucaagucaucucaucccaggacuuccucaaacaaaagccaacucucaccacacaagccagcuuucucuucccgucaaauuacuggcaugaauccucccaagcaacuuuugaccuacauaaauugguuaucuccaucuuaaauacuagcgggaagagaagcuaaguagcucgcucauuuucacacagcuauuagugggaaagcuggaacacgaagccaggugcuggacugaccucaauuacacggucuuagugggucugugugcaggcggcgugugccagcgugggugugugggcuugcacagugaacacaaggcuccucauucugacuuaccaagcaggcgguugccaaacggcaauaggaucuaagaacggcugaugcgccuauagguuguacgcgcagaaggaaccaggcagccccauuauuagcuugauuggugcuuggcccagagcgucagcccugcagggccgcccccacugucccuugcccuaggcucacccguguagccauccagacagaggcagguauagccacccucucggcugcggcagcgcccaugggguccacaaggucuugaguaacagagguccaccucggucucgcaguagucgccugugaagccuggugggcagcgacagcgcagacccccgacaggguggaugggccggaagagcaccgaagaggaagcgaugaagggcgcagaggagucgaaccgcagcacagacacacaucgcauguaauucucgcagggcucccgcaggcaaauguugucgucgaaggggagcacgcgcugcgccgagauggcggugagcaggcugcgguugagguacaggcgcuccuggagauccucugaaggcagaaaggguggcccacccccggguccuggaggcuggcccaccgacaggcuuacguugaggauauggccgccuggggcaucaguaucccuuugcacauugaagaccaccacaugauccggggguguggccaacguggcugccacggccugaaugaagagucccagcaguggugagagaaagcguucuggagacaugucuuccaagcgcagcgugaugcugugugugagcaucucguccgugaugauggugacacguagcgagcacugggcugucacacuguggacaccaucugaagagaagcaacacggaucaacaucaguccugggggaggcaggcagaagcagaugugccaagccacaagacccugacuuagagcaaaggagggaguaggcuugugugauagucaggggcggagucaagaaaaaggagcaaggaggagggaguaucaggaggagggaacaccaucagaaaaaaguacugagaagagagagcaccauaaggagagagcauuagaaguggggagcaccaccgggcagugguggcgcaugccuuuaaucccagcacuugggaggcagagacagguggauuucugaguucgaggccagccuggucuacagagugaguuccaggacagccagggcuacacagggcuacaaaacaaaacaaaaaaguggggagcaccaagaaaaagaagugaugaggaguaggaaggccaggaggagggagcaccaggaggagggagcacuaugaagaaggacuggugagaagagggagcaucaggaggagagagcaucagaagcagggagcacuaagaagaugaagaagaaauaaucagaagagugagcaccaggaggagagagcaccaggagaagggagcacgggaggagggagcauaggaggaagaagcaucaggaggagggagcaccagaaggaggaagcaucaggaauagaagguacaagcaggcuaaaauccagcccauauccugcaagguacucaagaaaaccuuuuucuagccggcauaaagguggccaaugggaugaaucaccuguggacaagucucuccuugagggggugaccucauacgagcuuaaggaaaggagguuuuucaaaacuguucuuuguguguuuucccgguacuccuuggcaugacgcaugaaccgccuuccagcaucucugccugucaccccacucagaccccugagaccaguccuuggguuucucugcuccacgacugugcuuuuuucuuugcuugcuuuucuggagggcgcagaguaccgugagaggcugcuuccccuuacccuguacuucucagucccacugugaccccgccucucagcacgcugcagcagguuguguggaaggugaaucuggucagaggugccagguuccccucgcacucagcuccacaagugcuuccgugcaagccugcuagcccauggcaacaccuuuuacacagagcccuguacccacacaacucuggguagccugagguccccaucccaagaaguccagcugagccaccucagccagugguagcgacacacacugcuccaagcuggagaaaggguaggcggggguggggaacgugggcaguuuucacccugagccccacugggcuggucucuccucuggcacuagggccucuuguuauucaucacucacuuggcucaccaaguuguacccaaaggucugccugccauaccccaccccucccgggcagccaacucacuuauaaacagcuaagugcuaacacauucgauggugucucacuccacccacacacgcuaugcucagaagugccaugcacaccugaauguugcauacacacggcaauggacugugcuuagauuaaaaaugaauucugggaggcagagaaagggaaauggcuuggaaggcuauagggguguuccuaguuaacacagcgcuuuacacauaaugaguguucaguaaaaacuaagaugcucaugggaaucccuuguacauaaaaguaucuugaaaacauggcagcaagcuaggcgauggugauacucgacuuuaauacuagugcucaggaggcagaggcgggaggaucuccgaguucaagggcagccuggucuacagagccaaguuccaggacagacagccagagcuacauagaaaaaccuuaucuugaaaacccaaaaggaaaacacacacacacacacacacacacacacacacacacacacacacagagcaaacucuccaaucagaugcaaaauaugacauccaagugggauaggaugggagccagugucacugaggcagaaaagagauauggagauaugggacccuacaugucacacuucgaguggcugcuaccuugggcauacugaaggcaggcacccaucucagcgaugcccugggcccacugccgaccugcccugcggcccucacugcuguggucacuuuuguuccuccugcuuugcccagagucaugguccuccaagcccucuagccugcccaugggucaccaucucacugcucugcuaccuuuuagaagcaggguucaggagcugaugucacagcccaguguuuucuggauaggauguucccuccagacagaaagcaacaacacagggcucuacaaacagugcuccuggaccaacaagcaagagaaucucugccauccccugguucugggaagcaacacuccugcaugauguuguccaccaacccaggcccgucugugccccuuacucagcaugucucuugcuucccaucuggcccaccaucuguggccaccugccccucugcuaauguccccaucccagcaaccaacccauugcucucucuccuuccucuuuguccuucucccgugccuugcucgggucacuccuaaggugcaaaggcagguugggaauaggaguggccgguacauugccugauuuguuuuagacagaagagagagcugggguaggcucugacccaggaaauaccaccugagucuaggccucagccagcugcacccgagaagaugccagagccagccucccagccuucccucuucuggcagaggcucugcugucugggaggugagcaggccuugggcagguucuccugugugucugaagaaggcagcagccggggccauuugggcugcaggacccguccagcccaggcuggggcagcugcagccagagggaagaagggaagacaggaucuaaacacagagaccaacaggggaagacaaagacccaggaaaagagccagcaguggaggaaacgugggagaaggagagagacagaagccggggagaaggugacagacaggcagugcaggaggguccccaugggcaggguugggagggaaggaggagacaaagaaccagagaaggaagacaaagggacagugggcgacagucccccucacccagccuccugaacuuugggguugccuuggugacugacucuaagggucagggcugaugggggagggggacaagggcagaaaggcagccacaguguguccuagcugcagccccagccugcccucuagccuagagcguuguguuuggggcugugugcccuggugaggcaguagaggcuaagcagagcuguccuccacacggucggucccuagguaucuagccagauucacuaccgaaggcuguggauggagggcaggagggagaggccuuucuucugccucuagcgccaggcucaggugaggguacuccuggcuucuuuccccuggagggggacuggacgcuucaggugcuuuacagccugacccauagcuuggagagcuccuucucccugguccuugcagggugggaccugaggggugggaccaggaagugucuguccaguaagaagugugagcaggaagggagguaaggccaucuucccuucccugaugugcaaagggggccuggagggggcugccaggccucgccccuggaaaaauuguuaacaguccccccccccuucacuccaagugacuuggcuacccagucugccuugcucccaccuugcuucucauccccagagcugacagaaaggacagaauauacugucacccaguccugcuugccuuccccaaguccugcugucuggggagucugcaggcugagcgcuugaccaagcagcaggaaugcccaggcuggguucuggccaggcucccacgccccuagaaaucuguucucucccccaccaagucagggcccuggagucucugcccucaaagcucagcaguccccgugcacucugauccccaggucuguuuuccugagaccgggccaccauggucagcagggaaggccuagcaccccaagaaaaagccacagggagucuaggggcccaaaagguccaucugcccugacuucauugcugcccuccccggaagccagaccccaaccaagaacucaggacagugaggucuguuuggacagagacaaugagcucuggcuuuacuuccugccuggagcucaggagggggagccaaggcuccuucugccuggagggaaaagcaaugccucagacaaagucuaagccagucucugcugcagcucuacugagagccagagggggagagaaaagggcagcaggguccugacccccuugguggaauccugagucccuaaagcccucugaccugccaaaggccuugugagaucacaggaccauccuaaugagggugccaggguacugaggagccaacuugccucgccccuuccucgccaaggucuucccucccccucccccagcucuugggccuuccaggcuuccacgcgcccuuuuuuucacaauucuuggcagccauagucagggcaggcucacaacacuuccccccaccacgucacagucugguaggcaggggggcagccaaccaaagcagcccagcccagccuggggcagcaggcagggccugcgccagcugccaggaguccugggcuuuuuucccaggccagguucccgaucucucagccucugagcuguccacaggguagagaguugggucaccagcuccuccuggauggcaccccaccuccgguggcugcccagaccucccugaagcacuaucuccaccccaacaucacugggcaucuuccuuaccugacaccagcacacucaugauggcuuccaggggccgguuguuguccagugcccggcucagucucagcucaccgguggaggcauugagcaggaccaagcugaguucauuuccucgcucgaagcuguacgucaggcugucugagauaucggggucgugggcaggcacacggccuauggcaccaccggggaagcugcuggagcgguuggugacauaguuguuaaagagaaucucaaaguugcccagcacgggcggguuaucauugcggucaaggaggcggacauggacaguagcccugcucaccaagggagcagacguagccuggaugaccaggacauauucaggccgguccucauaguccaaaucuaccagggcaguuagcucgccagagaauauauccaacugaaagaccucagggauauugcccuccacaaucugguacaugaucugugcguuggucccuucaucugggucaguggcugugacccgggccacggccagcccgauggggcuguucucuuccacaaauacgucaaacucauccuguucaaagacagggggguugucauucacauccaggacaguaacugucacuuccaugggugugcgggcugguggcaugcccuuguccaccgcauaggcccgcaggacguacugggccacguucucacgauccagccuccgcagugugcgcacaaugcccgaugucgacucuacaauaaagucaccguccccaucaucuccuccuuggaagguguagaaaacccugccauucagaccggagucucgauccguggcugagaucugcaggacgcuggugaagggcggcacguccucguagacgcugcccugguaggaaucucugaggaacuggggggcguugucguucacgucauucaccaggaucuccaaauagguggugucagacuucuggggaaugccauugucccgagcagugauggccaggguauaagacaccugguccucguaguccagcucagccuggguggugacagccccaguguccgcgucgauucggaacugggggaugcuauccuccauaaaguaggugauucgggcauucucccccguguccucauccguggcgcugaucagcaccacuguggugccugcuggccggucuucauuaacguugacuguguagugggagcucuggaagacgggacgguggguguuggcaucggugacauucacuacuaucugagcuguguccugccuugugccaucugaggcagucacugccagcacauacugccgcucgaguuuguagucuagcgguaaggcaagggagaccaguccaccaccacuuuggcuggugauagagaagcgguugcggguguugccgcuggugaucugguagguaaugacacugugagcgucucgauccacggcugacacggucaccacacuggugcccacggcggcguccucguugagccgaacgguguacucuggcugcgugaagguuggguuguugucauugacguccaggaugguuacacugacacuggcugaggccgugagcgcuggggugccauggucccgggccucuacaccaaagcuguagaaaucaaccucuucccgauccaacucugcggccacagagauccagccugugccauuguuaauggugaagggaaagucgugcccaaccccugccaggcuauacucgaggcgggcguuaucaccagcgucagcaucaauugccuggacgugcagaacaagguagccuaaagggacacucucuaggacgguggccuggaaaggggugcugacaaagaugggggcguuaucguugaugucuaggacuugcacuguuacuaggccagagacauuggagaguggaggacggccaccguccugagcccggauccgaagcguauacucuuugguugucucauagucgagugggcuuaccacauccagggcuccagucugagcauccagauagaacuggccccgagcauugccacucaugaugcuguagugcacuagggcauugcugcccuugucucuaucggaggcggugacucggagaacuggggcuccuggggucacauccucccgcaccuggaccacauaacgcuucucgcuaaacuggggggcguugucauuaucauccuccaccgacaggaaaacaauggcuguggaacuccgcgggccugggucccggcccuggucacucgccuccacuguuaacuuguaggauuccacuuccucccggucuacagggccgcggguucggaucacccccgagcgaggaucgaucucaaaggcgucugaggggcugccuccggcccccuccagcaggcgguacagaauguuggcauugggaggggcgucgccgucgguggcccugacuguaagcaccucauagccaaccuccagguucucccugaggcucuccuuguacucuugcugcucaaaaacagggucgugaucguuggugucggucaccaagaugguaagcguggccaaggcacuccgucggggcauaccgugauccugugcagugacccugaagacgugggugcucuuggucucccgauccagcuccucagcuguggugacaacaccggugauuggguccaaggagaagaaaugauuggagcggcuaucaaagagggcauccaugguguacucaagucgacccgccucacccucaucuggaucaauggcucuuaaggaugcaacagagguaccagcaggcugguucucaggcacuguggccugguagcugggaggcuggaacuggggagcuguauucacauuccuuuuccugcgcccacccagagauuccucuggugagccuuccccagcccugagcccuggggccugugccagcuugcaagacuggcaucugagccguggggccuuuaagcaagggugcucuucaggcagggucagcgugccuuguggagaaagguguccuccgauacccaggagacgacagcuccaggggcagccuucagaggauggcggaagagggauaugagccccugauucuggacaccaaacccucaggccaucgugguggggcaccagguggccggucagcucaaugcccgauucucugcagcggcugguguagagccagagguucgaagcagaggcugggcagagccagcccacgggggcgcaggccccagaggagcugcgucccccggaucccagagaacgacagggccccacuugaucucccaguaguggcgacgguggcagcagcagcaacagcaguagcagcggcagcagcggcguugggaggggggcgcuggcagcccggcuccgcaucucucccuguucccggccagccgggucaacagccgcggcggcucuuccuccggcuccugccggccccgccgcgccucaugcccgggccggggcgcggguccccgggggccaccuguacgucccacugggccugcacccagauggcucggcggggccgcgcucuuagcccacgaugcgccgggcucccaccacucucgaagccgggcccgcucccgagucgccgcgaccacugcggguucacgcugcgcuuccaccugcgcucugagcguucucuaccugcgcccgcgggccgcgaggaucucuggcucugccgggucccccggucccgagccccagaauguccccuccgcccgcguaaggucgcccaccugcgucugcggagccucacgcuccggcccgggcccggcugccaacgauggcccugcgccacccgcucgcgcccugcguccccgccgcggcagcuaccggucgccggggucccgggcccagacccgcguucccucgccucccgggcgggcgggcgagcucugcagagcag

SEQ ID NO: 1672 - RNA, 47389 nt, Mus musculus
cgaggggaagggcccgcccccgagcgcagcuuucagggccaaaguagguugcgagugggaggcgguggcuguagcuccacggcugggggaagauggcgccgccgguaucggagcggggacugaagagcgucguguggcggagugagugcggaggggucagggaugaggccgggaagggucggcuguacgggggucuucuuucccgcugcagcucugcagccucucugggagcugcaugggcacuuguugcuuugggaccaagucccuggcuugacuccuuccggcuugcccagagucggguuucgugccagcaccagggaugggcgggguggccagacgcggccuucuccgcggcuuuggccaacucucaccccggugagguucuuccgcaaagccccacccuugggcgaccugacucgggccgacuuucccucccaagucccugugcugucccgggacagcucuucccauugcaccccccucgccacaccaggcacggacgucucuccauccgacacagucugagcucuguguuacuacucugucccgcccucguccccguguuuucagaagccgcuuggugucccauauucauguuagcaccgaggguuuuuacuaccauccuuuucagugucuuguccuuuaaaaagugcaggcguagcuuuucaagagcgccuucugccacuguuccaagagaauaugacuugcuuuaaaaaaaaaaaaaaagaguucuugagaaagcaacagcggacuguuaaaguuuuaucuaguauccggucccugcauagucugcuccuuguguuacaauuggucuucuuguugguucgaccaacuuuaaugacuuuuauuaaaaugacaccaaaccuaggucugccagguuagaagagcaaugaaagcagcaaaccggaaggaccuuccuuguuuggcaucucuggguucuaaguaauuauagucuaguaguagaaaaggaauaacgucuuauuaguguuucuuacuccgacuuggggaacaaggaacagaauaggaauuagccaacagaauucugccuucaagaauuccuuguauaaaauuaaaauccaaaacaguacaggcaugguguuuaccauauagaagguacuaaauagauaaguagacuuugugaaauacaaaauuauccuuucauauuuauuauuuucaaauuuauccuuucugggggccugcaagguggcugaguggguaaaggugcuugcugucaagcccaaggacacgaauugcauccccagggacccacgugauguaaggaaagcacugacuuaggcagauugucuauauugacucucauacgaaagugggugacaaauugugcugaagaaauuacuucugaguuauaauggcaccuuauaucagggcuuaugagaaaaagauaccguuaugcuaguaacgccaguaucaauagcaugaagauaacaggcuuucccuguucuuguuaacuuaggguaacaccaggcucaccacauggagaguagaauauagauaggcaggcuggaugaaaggaaaaagauguaaggcuguaaaauagucuuaggaccgccuguaacucgaaacacacaaccaaaagacaagaauagcccaaaacauauacacauuaaggggcugaagaaauggcuuagcugaaaaaauaagaauaggucaccuuuccacagacugacgcauggcguaacagugcacauacaaaggaauacaugucuuuuuuuuuuuuuucaguaaacguaaguacaaugcugauauauuuuaugcuacugcaucuuggaaacacgcuaaagaaaaagccagucacaaagggcauaguaugacaccauucaugagaaaaacauccaggacaagcaaaucuagagaaacaggaacuccuuccugugucccagccuggagagaugggauuaaagggaugggguuucucuuuugguuuuuguuacuguuguuuugcuuugguuuuuggguuuuuugagacaccuucuugcuguguauccuggguugucuuuaagcuauguagucugggcuggccuugaacucauagagcaccugccucugccuccugaguccuggaaugugccaccacacagagcuuuguuacguguuugaaacagggucuuguguaccuuagguggccucacacucaacuuuguagccaaggaugaccuuaaacuuccgauuucucugucuucaccuccugagugauacaauccuggguaaaucccaccauaucugguuuuauacaguuguacucagagccuuuugcaugcuaggugaacagucugccagcugagcugugaacacccccagccccagggaaugaggcuucuuuuuaaaguaguguuaauguucucaaaacaguuguggugauguaguaauggaugcgugacagaacauacauacuggaaaccuuuagaguauauacuuuugagugagagaguucuguaguuugacauuuuuauuuugauaaugcuauuaaaaugaaaccugacaagagcuauuaaaucuagaccuaagggucaagccugguggcuugugcccauaaucccagcacuuggagguagagguacaacuaucaguucagcuucauagugaguuuaaagccagucugaacuuggaggccuugucucaaauaaauaaaaucuauaccgaagauguacaccuagcauagaaagaguuaauguuugaccugucuguggcuuaaauuuuaaaccuucguuuaggaucuuauuuuauacacaucauauugcaucagccucgaaaugaaccucagagcucucuccuucucuuuccuuccaguccauccagcagauagcugccaggauaaucucuucuaauaacugccuugaagaccugcagaggcacccagugcacuauugacuauuaccuagcucuaguuuccauuguauaauauugauuuccccccgagccucaacugacuauucccucugcagugucuuaucuucccaucuuaucuugauggcccauuccucugucuuuugaucccuuuucccugacuuuuucccuacucaaauuuuaguuuagacaggcuggcuuucuuucacgcacccuccucuguuuuaguguuuaauuugccuuucuuacugccuaagagcggucccuuuugcuuugcuuuuuuguuuguuuccuuuuguucuguuuucagacaagucuuccuuuuuaagcccaggcuggccuagaauuuguaguagcccuccugcccucuggauggugagguuauaggcaugagccuccauuuacagucaggaguuucuugagaagcuuugagaugguagguccacuguuuugucuuacaagcuuuuaaauguaugugugcauacccagaugcaugcuugcaaaggccagagguuggugucggagaugaagucucucacugaaccuggaguccccguggcuaggcuggcuggugagcucugagucuucagcugugcgccaccagaccugucuuguaugugugcuuggauccaaacccggguccucacgcucuugguaggcaauguuagcugagccucucauucaccuccuaggacuguaaguucuuacaggccccagugauagguagugauuuuuuuuuuaauuuuaaauuauuuuacaauucguuucauaaauuuucuccauuccauaaaagaccccauuugugcagcacugaauuccuauaggagaguucccagugcccugcaagcauucaagugggaucuaauagaacaagaagaaaacaaagaguaagcaccgccaucccagcuugugauacacaggaagagaggccacccuaaacagguggaucaggaaacguuuaucugauuaggugacacaucucagaccuaaaacacaagagggaauccacuauuaggaacuaccuuaaccccucuaaacaaaaaacugagaggaugaaguucaguagauaaggggccugucucaagcgugaggaccuaaguuugaaucuccaauacucacguaaaagucaggcauggcaguguggucuagucaaguagaugaucuuguucagugagaucaguuuguucaguccuguguuggaaacuaaggcugagaaugauggaggaagacacucagguugacuucuaaccuccuugcacaugugcacacacccacaggaauucuuacauacaccacauguaaugcaaggcauuuguuacaaaggauacaggguacuggaccaaaagguagguuggagccaguuguuaaaugguuuagauauucccugugcaauagagaaucauucaagaugacuuucccccuucuucucaaauagcaacacaggcauguuugcagucucuuaaugcuaaaaggaaaacauuucuugguccuauuuuuaggagaaauuuaguuagguguaaugguaaguuauacuaauguuuaguguacacuuagauaguaauuuuguucacauaacuaccacccaaucaaucuauaaaauguuucuaagcacucuuugguuucccagcacagacccacucuucccccacaaaugaacacuucugacuuacauuaucauccagugauuuguguuuuuaccuguacacucauguuucagagagcauccuugaaacuguucaauagauuuucauauguggacauggacuguuuuugcuuugguauuuguauuugcuguuggugugugggugugggugggugcuguguguguuguguguguuuuguguguguguauguguguguguguugugggcugaauggaaacuaaacccagggccuucuaugugcuaggcaagaaggccucugucacugggacacugucauagaagcccugccuuguauuuaguucuuggaguacuccucaguuucauagguuuugcuuucauauacuuuuaaacuaaacauggaugguugaagaaaauaucagccagacaucauguauggaagauaccuaaaauugauuaauaauaguuaaugucccauuagaaagaugagcagaggaaauuaagaggcagccuacagauagaguagucugguuuugacuuugaaaaaugcaaguuaagaccaguuucucccuuuaaccuaucacaucgacagaaucggugauugaugucauguagcaguuggaaagcuugcuggugggaauauuuacagcauguugggaaagcugcuggugauagguaaugagacaggaagcaguacugugugaucucagcaaucccacugugggccuuucuguaaguaaaagugauaagaauacaugcauacuuaaaaauucuuuucucaaaagaucuuuaaauuauacuuuuuuuuuguuugguugguuuuuuuuuuguuuuguuuuuuugaaacaggguuucucuguguagcccuggcuauccuggaacucacucuguagaccaggcuggccucgaacucagaaauccaccugccucugccuccggagugcugggauuaaaggcaugcgccaucacugcccggcuaaauuauacuuuuaaaauuguauuuugagccaggcaugguggcgaacgccuuuaaucccagcacuugggaggcagaggcagguggauuucugaguucgaggccagccuggucuacaaagugagcuccaggacagccagggcuaugcagagaaacccugucucgaaaaaccaaaaaacaaacaaaaaaaaauuguauuuuggccgggcgugguagugcacgccuugaaucccagcacuugggaggcagaggcaggcggauuucugaguucgaggccagccuggucuacagagugaguuccaggacagccaagacuacacagagaaacccugucucgaaaaaccaaaaaaaaaaaaaaaaaauguauuuugugugcaugcacauauaccagugcauacauuggcacauuguggaagucagaagacaaccugcaguuuuggggggucauagggauagaacucagaucauuagguauggcagcaggcacccauagauucugaaccuuuguuuguuuguuuguuuucucuguagagcuugacugacucuguagacaaggauagaaauccuccugccucugcuuccugagugcugggaguuagcacaacacaguuggagaacuguuagaagcaauucuggaaagaaacauguuuucauccaauuuugacauggagucaguggggaauagugucacgaagaacaugggucuuggccggacccugacccuacucuuggguuaugguuggaggugguggcucacgccuuuaaucccagcacuugggagaagguuagaauguaaagggagauaaagagaagacagauaguaguggaauguucuguaggagcuuggaagauaauguugagaacagugcagaauauggaggccuggcuugugaaauuucagagggaagauuaaagacucuuaucagggcuauugcuguuuugauugugaaaauucugugguuuugguuagcuagggcugaagaaucagcugugauuaacaagauaccauaaggacuaaagcggaaccuuuguauuacugggacuauugaugcugguuagcuggagguaagaaauuaguggugguuaagaagagaccagcaucauugaggugaaaucuucugggaaauguuuucugagagcacaaagagcacaguguguuccagagagagucaagguuguaccuuguguugcagcuggauuuuguaauguguaagagucagucacccaggcaguacugguuuugaaggcaugaaagggucaugaagaacagcugaggcacagcacugugagaggccauggaaggccauaggugaaggugcagccucaguugcaauugaugggccaggacugaaggggucauacaaaggaguugggacuuggcaucacaaagagagccuaggagagguuauuggugaagccuaguugcaauggaagacagcagaguuuuggagaugccaguaccaugagaugaccaccaagaacagcagcagcgccgggcguuguggcacacgccuuuaaucccagcacuugggaggcagaggcaggcggauuucugaguucgaggccagccuggucuacaaagugaguuccaggacagccagagcuacaaagagaaacccugucucaaacaaaacaaaacaaaacaaaacaaaacaaaacaaaacaaaacaaaaagaacagcagcagcaguggaguacaggcaucuggagccuagacaacaaggugugugcuacaaagggcauggcaggagacgagacccaagccuuuggaggagcccagaaggucgugaguggaucccagacauuggaugguuggagguugauuuuugcuuuugauugugacuaugcccugauauuuuucccucuugaaggaagaaaguauguuaguggagcccacaguuaagagacuuuuaauuguaaaaagacugaauuuuaaaagagacuggauguguuaaagggauugaaauuuuaauaugaauuuucaaagacugugggacuuuuaaaguuauuuagaucuuggggaugaauaagaaaguaaggguugaagcuuaguaguaacguguuuguaugucaaguugacaaggggucgauuguacuggcugguuuuguaugucaacuugacacaggcuggaguuaucacagagaaaggagcuucaguugaggaaaugccuccaugagauccagcuguaaggcauuuuuucaaauagugaucaagggugaagggcccauuguggauggugccaucccuagcugggaguucuggguucuauaauaaagcaagugagcaagccaggggaagcaaaccaguaaagaacaucccuccauggccucugcaccagcuccugcuuucugaccugcuugaguuccaguccugacuuccuuuggugaugaacagcaguauggaaguguaagccaaauaaacccuuuccuucccaacugcuccuuggucaugauguuugugcaggaauggaaacccugacuaagauaggagcuacagucauccuaaacugacaucugguccaggagacuaaguggugauguugcuguuuauugaugaagaggaaggaaagaugaaucugggggaaaagcaguucugaguuaaacuauggugaucauaaguggcaguuugggugucucaugggcauuggagauguaaaaguuuacaaaguagaagaaggcgcugaguuaaagaucaggauuuaggucauuuuguauaguagucaugacgccguggauucagaugaagcagagcaauuagaaaauaguuaccuuuuccaaccaaaguagaggucucuuagaaccagcagauuuucccccccucuuauucccuugauugcgguucccacaucauuuaguuuuucuuuuuaaaauaucuuucuuuuuaaacucuaguuacucaaaaauuauuuugcuuucuaaugcauugcuaucauguucuccacuuuuucucugugacuuaaggucacauaugaguucugcuggcacugcucgaguacacgguccuacguuucucccuucccugguucugucuuuuucaucacaguaugcguauuuccuuuugugccucagagaagccagugagaacagguggguagcgguccuaguggguugcuguugggcuagcauguaggcugggugagagaugagcuuacagaguagguagaagccagucagcggcagugccuuaaaugguaguguuuaggcuucccucagugagugcuugagggccuuuugagguggguaugguuauaaaccauggguuauguuucaggaaggugacuaaugggugugaagaauugagauuguagguagaaaacagcaaagccagauaggagaguauugcucagugaaagauguuaggaaucgggguauugucgaugucaguggucccaaaaauaauggccagaagccgaagaacaaucaguaaugccuaaugauugaauguggggcaaggugaaaagagccgcaggcuguggcuaagcaugacaaacuaccgaaaugcagccuagagcaguucuauggaacugugucuccaugaggugugcaagugcucacaccuguaucgugugguugacuaaaguccaggagcggagcucuguaagacuguuaaacugaggggcugaacuaauggaugagacgugaguagugaguagaggcucugaggagaagcauggcggagguagagcaaaggugaaggaauugaguuugggguccaguuucaguugcugaagaagagguuaagggauuuucauuguauuagugcauaaagggccuuuacacucugccauagcugaugagguccccaccacucucagcauagaccugcaguccugucacuguuguugagugcuccuggucuccccgcccacaaccgguuauuuaguaguuauuuuuaagauguuaacaugguuagcaugcaggcuguacugucuacacagaaaaacugcgauaugaacugggugagguaacuuaccauuuuguaguuaauuguauuaaaaauauagaaguaaacaaaauuaacuaauauauuuuauuuaaccugacauuuaaaauauuuaaugugauaugagaauuuauaaagcaaagggaagagaauucauaggauauuuuauauuucccccuuuuuaaaacuccauagucuuucuguuucucauuuuguuaugcucgggaucaaauggggccgcacacaugcuaagcuacaugugcgcucugccucggagucacagcacagccuucucucguguuauugucuuucucauggaacuuuguacauuucaagugauuugguuuuuuuaagccaaguuucacucuggcccgggcaggccuggaaugcaaagugucugcccagccucccaagggcuagaaucucacagugugaccgccgcaccugccuucuacagcucuauuucaagggcuccgaggucacgugugccuaguuccugucauccaggcagugcaggcguaagguaucaaagucuaaugcugugacuugugcuccugcagcauucguuccuuaugcagugucuucaguuuucagcuguggcacauacagugaggcuggcuugcaggaaagucgccugucagggucugagcucggccuuacaauagcggacaugcucauccgucagaucucagaaaccuuugcuuccuggacuaauuacaguaaaauacuuuaggguuuaaaaaaaaaaaaaacuuguuauuuccccuauaacauaacuaccuaguaagcaauauauaacugucuuuacugacuucccucuuucuuuuucuggaggugacuggguguguaugcaccuguaggcauguagagccagagguuggcaucaggugucuuccucccuaguucuccaccuuagguuuuuuuuuuuuuuuuaauuuguuugguugguugguuuguuuuguuuuucgagacaggguaguccuggaacucacucuguagaccaggcuggccucgaacuccgccugcuucugccucccaagugcugggauuaaaggcgugugccaccacugccuggccuuccaccuuaguuuuugagacagguuuucucacuggcccugcagcccaucuaggcuggcgggugggggagcucugggauccuccagacucuuccuucccccacagcugaaguagacucagaauuagaaucaguuuccugugcuuguucaacacacacucuacuguuuuguuuugcuuuguuuagguuuggauugagauaggauuucuuguagcccaggcuagccaacucugaugauaauuuugaacuccugaucuuucugccuugucauccaguuacuggucauucagguaccacuccaccgcacucaacuuuuuuuuuuuuuaaagauuuguuuauuuuauguauaugaguacagaugguugugacccgucaugugguugcugggaauugaauucagaaccccugcucgcuccggugggucccgcuugcuccugcccaaagauugauugauugauugauugauugauugauuuuuauaucuaaguacacuguagucucauuacggauaguugugagccaccaugugauugccgggauuugaacucaggaccuucggaagagcagucagugcucuuaaucacugagccaucucuccagcccccacacacucaaguuuuaacuguuauuucuuaacacuucauaaucuuccugaacucaggaaguucuaacauuccauuuguugaguguguguguuagagcaggagcacauaggccacaaugugccuguggaggucagaggacaacuucagggagucgguuuucucauuccaucaggggacuuggggaucgagcucaguuugucaggcuugguggacaaacacucuagccacucagcccaucccucuagucccagagcacagcuucugugauggguguuaacuacuuuccccagaacacuucgaacagcaaagauguugauuuuuuuuuuuuccuucuuacuagccaguucuccagcccugcaauucaguagaauucugacugcugugccagccuuggcaggcuuaaggauucagagccgaaacucaguucagaugcugguagcaccacacucccugccugcccuugcagcgcaguaauucguaccuuacaagcucuagaaacuacuuccuguuuucaggguucuuguuguuggguguuuuuuuuucuuuuuguuguuuuucuaaaguacacaaauaaacagccaggugacagauauaggcugaggucuagaaggguuuucgacauuggcacuucccugccuguggggcuggguauaucaccauugccacucauggguguauucaaugacgcagaaacuggauggguuaugggcguuucauuauguagacuuuccugaugaaaucuuuggccacugguaauugaacacaaucucuagucccugaugccuccuuagaagucauaguuugguucuggugacuaacugcuugcugaagcuagucacgggucaugucaccagcauaccauagaucugucacauaagaaauuucaaggauuuuagauuuuuuccaggaacuagaaacccagaccagauuuuuuuuuaagauguauuuuuacuuuuaaucauguauaugcuuguguggguauguauacaaagccauaguugucuguggaggcaggaggagggcucaagaugcaggcaaaugaauaugagccacccuacuuacucacaaccacugagccaucucuccagccuccccccccagauauuuuucauuauguuacaauaacaccuauugauaagaucguuacaauuguaucuuuuuuaacaggugucaaaaugugaugguaaucgcccaaaagcauuugcugaaaacauauacauuuaaaaauagaaauguguaaacagauuagaguugggcacgguggugcaugcuauuauuuggaagguagaggagggagggggauugcuucaaggucaucuguaaaggaugucagaugccuugaaauugaaguuuacaggugauucggagaugccugguauggaugcucacaacugaacccagguccuuugcaagaacaucgaauguucuuaaccaccaagccaucuccccagccccagccuacauguauucuuuaacaagaaaguaaaugaagaugaaaccuguaugcagauuagauuguaagauguaauuuagccaugagccaguuaaggaccuuccugagaauuguuuguuucuuaagauuuaagaaagaaggaaaagcuaaauugaauaauaguucagaaauaguuucugacguagucauacacuuaugucugagaauccauuacaguuuauauguauagguuagauaauauagcugcauuuuuaccuacagcuuaauauauaguauuuauaucguuuaacacauuccaaguugcaguuuuucucucauuuugacccuuuugcauagacuuacauuuucaauuguugcuuuagauuacuaaacccuuuuuucuuuuucuuuuucuuaacagagauaaaaacagccguguucgaugacugccggaaagaaggcgaauggaagguagaagcugugugauugcuccucuguggagggagggcuucagugcauugugcuuccauaggacagaggccuggagcuucuccucagaccgagcuuugccacgagccguggcaccuuaagcaaggcgcauagcagucccuugcuuccuugucuagaggaugggacugcagcacaucguagcugcagaugcuaagcguuugcacagagcucuauagcgaugauucuguaaaggacauuacauuuucagaaaauuugauguuaaacauugauauacuuacaaugaacaagcucugcuucagaauagaaauauuucuauuuuauuaccuguaugaaauaucuccauguauguguauugagaaaggacucccaccagaucaagcuaaaagagggauuucuaaaacucuggguuuuuguuaaaucuugacagucaccuuuaugcucuuuccuaauuuccuuuguuuuaagauaaugcuguuagaugaguuuaccaccaaacuuuugucgucaugcugcaaaaugacagaccuucuagaggagggcauaacuggugaguagugcugcccugcaggugugagauggggaaguaagcccagcauucuccagaaauccucaucacguaggaccgaggcuuugaucuuuaugaauaaagugauuuauuuguuaccuauugcauacucaauuuguauuugcuaucauaauagcauguuuuuaacacaauuuuuuuauuuuuaaguuuuaucacauuuuauuagagagagaacgcaugcguugcacaugugaaagucacagaacgaccuucagaagucagaucugucugucugcugugggguccuaggggacugaacuuaggucaccaggcguggccagucuuuacuggcugagucauuucacuggccccaagaaucacuaauuaagccaugaggaaucauuuuucaagcuuacuugacagcagauaagauguugaaaagcauuuuagagagcacacaacucugcgauguucuugaugucucauguagucaccuagacuuucugugugugugugugugugugugugugugugugugugugugugugugucccugugugucccuggguuuguauuugcuugaguuaguucgucuacuguggggguccugagcagcagguuuagggcaucggccucaguaguagguuccuuuaccugcugacccaagaaugauuguacuuuuuaacauaguucuuuguuucuuccucacauuuccauugcuuaugcuguauucuggcacagcuaccuauguaaugacuccguuguuuuuuuucucauaauucuacauaaagucucaggagauacauuuuuuuaggacuuaauaauuuagcaaaugagaaaaaaauaagcccaauguauauaaaugugcuuuuuauuauuauuauaaauggaaaauacaauaaaguuuauuuaaaaauauuuuaaacuuugguuccaucaaaugacuuuuuguuguuguucucaguuauagagaauauuuauaagaaucgugaaccugucagacaaaugaaagcucuuuauuucaucucuccaacaccaaaagugaguauucccaggcuugagcgugaguuuuuaagcugugguagagugcgugcuuuucaugugcaagacucauugaacgcuuguaauuuuccugcucuuuuuuuuuuuuuuccguaugugcacacgugugugcaggugcccauggaggcucucagaagaggguauuggauccccugccacugaaguuagaggccagcgugagcugccaugugggugccugggaacugaacagguccugugcacgagcagcacgguuguaacugcuccagccccuucgcccucguuguaaaacaaacaagagcccguuucuuacgcagagaauuaaguugccuuauuagaagacuugcuauuagcugcuuauuaauaaacguuuuccuguguucuacuauuuuauuuguacugcucccagugagaguauauaaggaaagauuucuuuucuuuuagcaugugaaagcagaauuuaaugauauaaaaaugaugguuucuuugcagcauuugagauucacauagcuccuguuggcccuuaauuuuggaagagacagaaauguuuuaaaaaacuuuuuuaaaggggguauuuauuuauauuuuauguguauuagucuucugccuacauguaacguaugugcauuguauacgugcuuggugcccaugaaagccagaugaggacaacauauccucuggaacuagagacacaggccuuaguaagggucucucauccccauuguggugcugggucccucuggauaaacuaagcacucuugaccucugagccgccuucuccagccuuaauaagucuuuuacuuauuuuagugauuuuucuauaguauacauguguauauauagauuuacauauuuguguguguguguguauauauauauauauauauauauauguuuuuuauguuaaagauuuuuuuuuucaguuuuuuccugucaguaugacuugcuucuugagccaaaucucaaauauaguauugaauucauuuuuuccuguguaauauaucuucuuguuuguuuuuugagacauauuuucauuauauguccuaaaccagccuggaaaugacuguuuauaguccaggcuggccuugaacucaccaacuccugguuaagccuccaaaauaguaggauuacaggccugagcucugagaaugcauucuugacgcuguuuuugacucccacuguuaacucuauuagauauuggagaagcaagcaaacagaaaacaaugcauaaaaauauaucugcauauagacuccuaggaacagaauuuuuuaaugguauuuuauaauuuaucagucaagaaaaaaauucaugacuggaaaaaaauugcaaccuaaaagcugagcaugugacuccggcaagccuucaauuccagcucuugggaggcaggaggagauggaucucugugagucuggggccuaccuggucuacguagcaaguuauaggcaagccaggccuauauaguaagacugucuuagaaaagaaagaaaagaaaaccaaaccaaacuaaacuacuuuucaucuugcaaauuguugaaaggaguguuuguguguguguguguguuugugcgcacacacacauccuuucucuaacucucucaguuacuuuagcuauccaugguuaaugaagcaaaauuugccauauucuccuauacugauaaugggacuuucaguaugcgaaaauggauuugccauuuucaagaagcuuuuuaaaauguuguuuggaguaaggaauaaaugguugaauuaagacgauaggaaucaaucaauuaaguucugagaauugauaaaaagugguauaaaagaccauguggccauuaacaauaaggcuuaugugaaucucaugacucgggaauucauuccuaauguucagugacaaaaggaugcacagcuccauacucacuaaguagcagaagguuagagaaagcaguaccgacugggacccuuugucugccuacaaccaaccucagguuuucucguaccuugaauuaguugccugcuggcccucggagcuucugugagcaggugaggcccugcucuuugggagcacugugaagaaccauauugugagauuggcuucccuagagccugagagcagcuccagggcucccagugcgacacauaggcagcugagggagguccgcuggugucagaagggccuucgugcuguguguacuuuacuuugugguuugcccuugggaagagaaacuuuuuugccuuccuacucuuguagaaguggcuguauuuaggaucuucccaaaguuaaaucuaagucccacaugauugauaaagcauccagccacacucuuaaggucaggcugccagagagaggcagucuggugaaaggaagaaaacauccaguuagggaaagagcugcuugaagaguuugccacccugaacaaaaaaauaggagagcauggagagacucccgcagcuccugaaaugcuuccuagagcucagggugugagugcucgcucggauggagaugggaggagggguucucuggaaauuugagugagugaaggcagagaaauuaacuugcugucuucauuuucccaucaaaugaaugaguguguguguguguguguguguguguguaaguguauaauauuuaaugcuacaaaaugauaguuucuuuacagaauuugugauuuucauagcucuuguugaucuauaaauuuagaaaugggaauguagaugaaacaagucuuagaaaaauaauuuauuuuuguuuucugugcauguguguuuugcuugcauguaugcaugaauaccacacauguucauggugucuccacaaccagaagagggcaucagagucccuggcauuagggcuaaggauaguugugggcagccauguguaugcuaggagcugaacccagguccgcucuuaaccacuaagcagucucugcagccccucauuaucuuucuuaguaaacuuagcacauuaaggcacacaccgcuagcuauauuauccuauauuaugcuuccuugagacagcuguuaccagacucuaagccucuuauuguaaugucuuagcaguuuuagcuccuugcuuacuaacacucuuuuuaacauuucuucaaugauauugguaauuuuauuuccauauaauacugccaguacguuggcuucucaguuccuucaauaaucuugucaucuguugucuuuguccuagaccuccucauuccaauaauagcaucuggguauucauauuaccuucccgcuuguuaccuugucauguugccuuaauagcuaucacuggcuggagacaugguuauuuaaaaaucagguuauaaguuaaacuuaguaaaggcuuauuuuauugaaacaaaauaaucuuuguuacuuugaagccagcauauuuaaaucgguauuuaauaaacuguguguuaacaucucacucuuuuuaagucuguagauuguuucuugagagauuuuggaaguaaaucugagaaaaaauacaaagcagcguauauauacuucacugacuguaagugccuuucugagguucuugucugacagccugcuaacuguagagugucugccuuucaguuuauguguuugaauacuuugcagucuuaaucagaaucccaccugaggguuauuguguuaugagaaagaagccuauggggaaguacaaagaaauagccuuuucauuucacauauuuaugggagaaaauccgucguguuuuuccuaugguccacauuuucauagcaaaagugaggaacaaagcccccagacaucuauguucuauguuguguuguguaauuauauuuuaauaaguaugaagccuggugugguggcacaugccuuuaaaccuggaacucaagggacauugacagguggaucucugaguuugaggccagccugugcuacagagugaguuccaggacagccagggcuacacaaagaaacucugucccagaaaaacaacaacaaaagaugcccgccuuuuuccucaccugccucaugucuugucaugggcaucuccauccacaggguagccugcuuuaccagagcccagucagcuguuguacacaaaguguucuugcauguugggaugacuguuuaaaaugaguaacacuuagaugggcuuaugcuuuuuccucccucaguuuguccugacagucucuuuaacaagauuaaagcaucuugcuccaagucaauaagaagauguaaggaaauaaacauuuccuucauuccacaggaaucucagguacugguaauuuuuacuuuaaaauuuuuguucauaaugaauuuucagaacuaguuuuaugagcuuguuacuagagcauggucuaaggguguuauaguugguaaauuuugugguuagucuucuacaagcaagcauuuucaugauaaauggagaaacauggacaaaaauuggaauagaacauuaauaaugacaagggggacuuacauuuccaauuagcaccaaagccuguguugugucuguuaaguuccaucaccguuagaugaugaaauucagagacuuuuagcuuuucuaauccuuuaugauaguuagacaaacuuuaaaauaaauacuugauaucauauaacauaacugugggauaaaugguguucauuuguuuugccuuuggcacacuuaauaguaauuuaaugauggucguaguaaccgccaguagaguauugacucuguuagaucguuuucuugguugcuuuacauaaauuuagucauugcaucuuuucaguagugcuguggcuucuucuguucuucugcuuugcuuguucuguucuguucuguucuguucuguucuguucuguucuguuuguucuguuuguucuguuuguucuguucugagacaaggucucacuguguagcccuggcuagccuggaacuuacuaugcagaccaagauggccuggaacucauagagagucacuuaccucugccuucugaguguugggacuaaagguguacagcucugugccuggcuucuguacccauuuuaaagguuggaaauugaagagguuaaauaacuuaccgaagugaaacagccagugaauagaucgguuuguuauucucugaucucucuuauuccucuauaagauuuuauagagaaguauuuagagauauuugcaaacuaccaggucaguauuuggggauaggaagaucuuagagagaggguuuuucuuuuaagcuuuacugucugugacagagacuauaauccaaaucauaaaauuuuaacaaucuguugaaauuuucuuaaaauucauccuucagcacaauaaauauauaaguuuaguguagauggaaauaggcuuccuaaaaucaugugugauauaagcaauugugcaguaaauucuaugaacauuucuagaacauuacuucauaacaaacaaauacaguuuuagucccaaaacucauuaaaauccuauaguugcuguguuugcaggaaaggaacuucauagcaacaugacuugaguugaugacuuuuggcagaaaauauguaaagaagucccuugagaaaguuucacugccacucugugaaauaggauuauuuaagguccucuccauguauuuuuucuaaguuuuuuuuuuuuuuuacuccuaguucacuuccuugaucuacaucuuaugagaauuugcuuuuaaaaauuauuuugagcuaguaucugauucuacuuacuaaguacuguguaaguaauauccaauaccauaccugguuuugccuaauaaguuuaauugauacagaauaauuauggugagaacaagaaaucaugugaaagauuacuaagugcuuuaagcuaggaacagaggcauaucugaacuguaauccuaacaucuuuucagagccaggcaugauggaacaugccugaagugccagcacuggggaggcacaggccaucagaaguguaaagccagccuggucuacagugacuagagacuaucugcuagaucaaggcagucuucucauuucagaacuaugaaaaagauacagccauagccaaaaguuguguaaauuagaauuagguucacugaguacaacaggaaaaucuaaacuuucaguugccuaaagugugaaaauguauuucuuguccuaugaaagucaagaaaugggcuugauaagccuuacacaguagaaguacagaauugucggagccuguucuuuuaggcagucacucugugaacuagaugacuauagaauuccuagaugagauagcaggacagcggaagauauagaauaaauagacagaaugaagaaaggaucuucauuuauacuguaucagcuaaaauuuagucacacuacacuaagcaccugggaaacccaaagugucauauagcauccuguagagcuauacucuaaugagcuggagucauuucuguauaaaguaagcagaguuuauuugcugagaauauaugucacagucagccacaaaugaguguuuacuaggagacuggggaagcauuugaaaaaugaauacaauuugacaugguagcaauuaagagagauaagaauaaucugaaugcaaagaagcagagcgaugucggagcaguggggugugggucacaaggagagcuguguaauaggcaaggcuuuccuaagcugacugagccuguagaccacagcgguuccuggucccacaggacaaucguugcagaugagcuggugcagaacacguaggagaagucauugugauuggcugcaguuucauuuuauauccucuauauucugggaccuaauggauguguaaccaggagaagaaaauauguuggaaccacacaguuguuuauuguggcucuuuugcucagucauuuuuguuuuggggauuuguuuguuugucuuugguaaauguuagacucagagccuugaauaagucagacaagcguuccaccacugaguucuuaccaucugccccgcacacuccugagcacaugugcacacauggacacacagugguucuuagggcuucuugcaugcuccaucucuuccaccgugacuccaucgucaagguaucagugggugggaauaaguucccuuagggcagggguucucaaccuuccuaaugcucugcuccuuuaauacaauuucucauguuguggugaucuccagccacauaaugcuguucuccgccacuucauaacuauaauuuugcuacuguuaugaauuguaaauaucugauggucuuaggugaccccugugaaagggucauuugacccucaaagggguugugaccuccagguugagaaccgcugccauaccgagaacucuuagguauaggauaauaacauuuccuguugcacugggguaguaacuacaaggugacaguccauguacagagugcuugccagcugguaauuaacacagcaguugagccuuugagagcagaggcccugggcuggcacagcugaacuugagucuauguuugggcugcagcuauugguagaugguuauauucugggaguaaaugacucugagugaaaggaaaagcagggaaguguauucaccucuuguuacauagccaguguuuguuacuuauccauuccuacacccaaugccuuagcuaaauggagaagggauuacuccuacuaguuuuuuccuuugagacaggguuucuccauguagcccuggcuguccuggaacucacucuguagaccaggcuggccucaaacucucacuguguuugaaaacuccaaacuuaguugacugaggaacuaucucucucagaaaacgcaguacuacuagacugcuagcccaguucuuugcacauaagagagugcauuuguuaguugaguaagugacuauaucugugagauuucauuguauuuauguggucuuaugucuuucauggugacuugugauuuggggaagaaauguuagggugugacuccagcauauauguauggaccuugggaaguuugcauugucugcacuggguuaggcuucuuuaucuuucugccaagccuuagauauuuguaguuugacuccucccuacuucagucuuuucucuguugcacaggugguaaaaagcagucagcuccaucuguauaugaaagaaaacaugaaggagucaggcagacuaaacaagggaggagggugagaagaagaugaaggaagacaggggagugaggcagaggagagaugaagggagacaggggaggcagaggagagaugaagggagacaggggaggcagaggagagaugaagggagacaggagacagaggagagaugaagggagacaggagacagaggagagaugaagggagacaggagacagaggagagaugaagggagacaggggaggcagaggagaaaugaagggagacaggagacagaggagagaugaagggagacaggggaggcagaggagagaugaagggagacaggagacagaggagagaugaagggagacaggggaggcagaggagagaugaagggagacaggggaggcagaggagagaugaagggagacaggagacagaggagagaugaagggagacaggagacagaggagagaugaagggagacaggggaggcagaggagagaugaagggagacaggagacagaggagagaugaagggagacaggggaggcagaggagagaugaagggagacaggggaggcagaggagagaugaagggagacaggagacagaggagagaugaagggagacaggagacagaggagagaugaagggagacaggggaggcagaggagagaugaagggagacaggggaggcagaggagagaugaagggagacaggggaggcagaggagagaugaagggagacaggagacagaggagagaugaagggagacaggagacagaggagagaugaagggagacaggagacagaggagagaugaagggagacaggggaggcagaggagagaugaagggagacaggggaggcagaggagagaugaagggagacaggagacagaggagagaugaagggagacaggagacagaggagagaugaagggagacaggggaggcagaggagagaugaagggagacaggggagacagaggagagaugaagggagacaggugagacagaggagagaugaagggagacaggggaggcagaggagagaugaagggagacaggagagacagaggagagaugaagggagacaggagacagaggagagaugaagggagacaggagacagaggagagaugaagggagacaggggaggcagaggagagaugaagggagacaggggaggcagaggagaaaugaagggagacaggggaggcagaggagagaugaagggagacaggggaggcagaggagagaugaagggagacaggggaggcagaggagagaugaagggagacaggugaggcagaggagagaugaagggagacaggggaggcagaggagagaugaagggagucaggagagaucugaggaagagaaagacaauggcuucaggaggcaaccugcaacauuuguccuguaaugucucaaacagcagcugcauuuuuaaaaauauauuuucagagucgagucucuagauugacaguauaacuuuuuuggcccaacuuagguuuauacucuugauguaccggacgcauucuauuacuguuacaguccagacccuaguaacgccagcaggaaagaaguggucauggaggcaauggcugagcagauugugacagugugugccacucuggaugaaaacccuggagugagguacaagagguaaggcuuaugugcauccuguucacucaugccgaggccgacacacacacugagacucugcuuuuuccuuugcaacauagauuuuccuuguguaguugccaugcccugcauaaagaagauuuaagguguaggcuccaggucauagaguagcuaacagccucugcuacugaauuuuagagcuuaaauuugguuccauuuauuuauagaaaguuuucuuauaccacaugccuuuauuuacuuguuucuuuauaaaaaucaacuuauaguaaagugcauucaauuuaugaagguuuguuaguuuauuccaugugaacagcguuugcuccuccugugacaaacagcaucugcaguuucccagaggccccugcucucccagccgcuccccuccucccuccucccuccucccuccucccuccucccuccucccuccuccugcuuccauccuacauccucccuccccagaaccagcugcugcucgcucuccuuugccaugcagcucaggauugccuaauguugagcugguguaggugggaucauaggaccgugugugcaauaguuuuugucagucacuuggauuuaauccuagcucugcaacuggcuguguuuaaucuagucuuagaguuauaagucucagaauuuauaauuuuaaaauaggaaugaugauaauaguuuucucaugggguuguuagaaugaaaggaauuugccuguaaaugacuaagaaagauaguaacugcacucuacugcuacauggaaugagugugucuuugacuuuuccuucagcagguucuuuuuccgaauauuggcauuuguccaguugauuggggacacauuuaacuacaaguuuauguacuacuacuauaaacuucaucacucuuaauguacacauuuuaaaaucugcuguuggggacuagcaagauggcgcagcagaugaaggggcucacuaccaagggcugauggauacucuugguuuuaagcuacaggaccugugugguagaaaaagaaaaucaguugucauaagcuguccucuggccucuauacuuggcacuacuccaugcuaguguccauagauagauagauagauagauagauagauagauaaauaaauaaauaaggaguaaaaucuacuguuaauuauuaaaccaacauaauaaaucucuuuaacucagauacaccuggaccacuuuuuaccuugggaauuagaacacuuguaaauaauaugcuaauuacaaucaguacuuauggagcuggguuaaaugguuugccucuugauggaguuuaguguccuuuaagcuucuacuguugaugguggguuacgcuaagaggagagagcaacccuaaaccauuuuacaggcuaauaguuuaccuguagacauauuuugaaucacuaaaaaacugaaauuuuugaugaauuuaaguauucuauuauugauucuucauacuauuaauauuuuauugauaucaauuauuaauagcacugaugguuguacuauuaauguuucauuguuacguguuuuauuauugcugauuauuaugauuaugguuauuaaauuuaagugacauuuuaaaauucuggugcugagagauggcuccauugauaaaauacuugcugggcgagcaugaguauaagaguucagaucagcagaggucacauaaaccuggcuuuaguggugcucaugccuguaacacccgcacucggggaguggccagccagucgagcugaaugggugagcgccacauuucagugagagacccugucuuaaaauaaaaaauaaaauaaaauaaagaacagaggaaaggcccaguguuaaccucuggcuuccacaagcauucacacuagugagcucacacaaacacacacacacacacacacacacacauacauauauacacacacaccaauacacaaauucuaccuguucuuuaagaauaugcuguauuaacuuuuaagguaaauaaauaaaauagaauuauuucuuuuuaaaaacauuuuucugcaaaaaauauauauaaaucacucuuuguaaguguaccuuuauuuuauuuuauuaucuuauuuuauuuuugguuuuuuugagacagggauucucuguguagcccuggcuguccuagaacucacuuuguagaccaggcuggccucgaacucacagagauccgccugccugccugggccucccagaugcugggauuaaaggcaugcgccauauauuuuuauguguacauauauuuuuaaaauauaaagccgaaagauucuuaaacauuuuaaaaagccuugggccuggagagauggcucagagguuaagagcacugacugcucuuccagagguccugaguucaauucccaguaaccauauggcggcucacaaccaucuguaaugggaucugaugcccuuuucugguguguuugaagacuaugacagugcacaaaauaaauaaaucuuuaaaaaaauaagaagccucagauggggacccccccauuccucuuuuucucguguuaguguucuagucgaaaagcauuuuccagcauuuuucuuguugcuuuauaaaauauacuaauaccacugaucaugaaguuaccauuugaaguaugaugcugccaucuuauuuuuuuacuguuaaguauuuguuuacuuuuauccaaguuugugucugugccuguaugaauucaugugcaccacaggugugcaguuaccccagaggccagaagaggacuggaguuacaggcaguuguuagcugccugauguggacucuagaaacgaaggccagguucccagcaagagcagugagcccuuuaaagcacugagcagaucuccacccgggccuccauuuuauaagacagagcaugaccauauuggaagacugagucaaguagaguaugggagggaauaccacacugccagugggacugucacugucacuucuucacguggacagcagauugguuguguuuagaaaaguugaaaaugcguauacccuuuggcccaggauucauaccuucaugugcaguggacauggagaaaugggucaagcauccuggcuuccauguuguugauaauguauggaauugagaaugguuucaguguccuucagugacuuccaggggacugaauguaucgauggaaggaggaauacggggauggcacuuugugugcacuauucuauuuccucgugcuaaaaugucugaagcgcgugcugaggcagcagcaaucacgugacguuugauagcugaaguuuuccauguuuauaauuuuuauuuucuaaaccuaagguugcuaagucuuauuuuagaauuuaacuguauaguauuguaaaguguguccugacagauaauuguuaaaccauuuguuccauuuuuaguaaaccucuagauaaugccaguaagcuugcacagcugguugagaaaaagcuugaagacuacuacaaaauugaugaaaaaggccuaauaaagguaauuucuaaauggcaaauaaugacuacauaaaguuuguuuuuucuuuuauaagucaacagcaaccuguucauucauuuucuagaauugauuuggggaccacuaaggugggucugaaguucugauuugagaguccucaaguggagagcuuaguagacugugguuugacaguguguggccuagggggaggcuggaggcuuugaagucagcagugaguccauaucuuggcucugcuauuugauuaauaauuauguuaauuauggcaaacuacagaucuuugaacuaaguuuuugucuccugaaaguggaaauaaaaugucaucuuuaagcuaaugaaaggauuaaaugagcuaaugucugugaagucuucagaacaaugccuucuacuaaguuaauauuuaauaaaugcugggauuccuacuaucugcagccuugaguugcuucucaucucugaaaugaauggggguaaugugugccuugcuugggugguaugagaauuaggugagggaacauccaacuauuuuguacauggaagaguaauaaauagugaccuuuguuacuguccuauaaaaauaaugcaauguagccagagaccaagguugggaccuggggaaugccagcacauaaguguggccagagaaggaagagcccaaggagggagauggacaaauaaugucagggcugagacgucacaucucuauagcuacagaguaaaggacagaacuauccuagucuagaagaggagguggccagggaaccaucgacuggcagugccgugcaguagguggcuugaaaggaguauaccgaauauaguggcagcacaggcuaggauuaccuuaccugaacuagaccuggaaagccucacaggacgaggcccgugagcuucaagaauggugagggcauaauaaagggaguuuuugcaagaguagcaggagucugaguagagacauagaaagguaaaauucaguauuaaacaacguggauggaagaugucaauguagaugcagugcugguuacuugaaaaguuagugacuuuuggcuuagaggccuaaugaaagcuauuauucuguuagaaaauagaauggcuuaauaaacauagugggcagugaauggaaauauuuguuaaggcaaagaaugauaauaucucuuuagucaugcacaguuucagugggaaaaggcaaaaguuuucucucucucuuucuccuuuuuauucuuucuccugggaaauuauucagccuucaaugcucaacaccuucccuuuauucaagcacuugguagauaaaggcuugccucucuuugaagcccuucccgacucuucaagccaagugcuaccaccauggucuuuccuguccugaggcuuuuaucgcauacacauaguacguuuccgcagacucucacucguguguuguauuucaugggacugcauuuaacuucacaacaaucgugcaagggagaacuuaugucauuuugugucguuuuaguaauaguaauguaugagaaguugagaaucuuggccaaggucauauagcaagaaaccaaauguggcugaacuuaacugauuugacuccaaaauacucuccuuaucuaucacuguaccuuaccauuuuagccuuuauuagcagagucaguaauucauucaaauguauuuggaaagucuaguguagcauaccucugucugcuauguguaaaugaguaggaaguguugucugaguuguaaucaccuuacuccuuugacuaagaagcuaaagcaugagguacuuuuccgagugaagugugaaccagaguuggcagcacagaccugcgaguaaucccaguuacuguggaggcugaggagggaagaucacaagcucaaggacugccuggguacagcaugagcucaaagcuggccuaucucaaaaucacaguggaaagggcugggacguaguccagcaucugcccggcaggaacccugugugguccccaccaccuccucuucaccccagaacuguaaugagucaaccauuggcaguagaauugcccagcaaagucacucacucacuguggagugguacauguuguauuuaauuaauguuaacaggguuuuauuauuguuuauaauucuagcuuugauaauaugaucucuacucuuaaaauagcauaauaguucaaaguacaagccaugcauuuacaaacucaauucggccaguucgcagcugugugugaccuggagaaugacuuaauccuaagcuuuaauggccucuuuugucacauggauauaauaucugucucaaagaggagcuguaagaacugugagguagugccccucugaaauaaaaugucuuucuuggcuagcaaaugccuaauacaaaggacucaaguacuagcuacuauucauaauuuauaucagccuucuuacuuguggagcugaguguacaagaagauaacuuugacaaggcauaauaguauuugucuguaggcccagcaugcgggaugugggauggcuaagaccagauggugaguccacagccagccuggucuacauacauagugaacacucuaucccagaaaaacaaaggaaauaaaaagaauuuagggagagccaaauauuacuuuuguaaagaaaaaauugggauuuguauauuguuuacuuagccucuuaaccuaauuaugaaaauguuaguuguguagccuuguuuucccuacuaugccacucgaauuuuuguuuguuuuaguauagcuucaucuucuuaaggcaguuauuauuuguuuuguuucauuguguguuuucguuuuauuguguuuuuguugagggaaaggauaaaacuuucuaagauauuaaaaauguguucacauaaagguacuaaaauuucuuaagauaauuuuaucuuguuauucuaggguaaaacucagucccagcucuuaauaauugaccguggcuuugacccuguguccacuguccugcaugaacugaccuuucaggcaauggcauaugaucuacuaccaauugagaaugauacauacaagcaaguauaaacugaagggcuuauagagggcguguagacagacuaugaaaugacugacaaugggggcagaaucuggaagaucuggagccugcuuauucagagaccuucccucucucucacucccguaacuguaacccugacagaagcuaacgggcagcuugcuucagagcuuugaaguggacugguuuccuuaacuauccuaugauagcagugcauuuaaacaaauugaauucagacauuuuacuuacauuuagaguaaauaccagacccauuauuauauuucauauauguuauauucaagaugauuaagcuguguuuauucuaaaucauauaccccaaaauuauugauguaacuuuuaaauaggaauauuacuugggcaaauaaccaaagugagcaacuuuucuuaagaagcugcuuaggugucacaugauuuacacacucacacacacacucucucucacacacacacacacacacacacacacacacacacacacacauacacauacacacucauugugcuuuuugacgucaugaucucuaaguccacauaaucuuuuccuggccaagcuuugcuuguugaggccaggcguacagcccagcccgcaucuguaacucggcacucaggagccuucagcagaagacucaggagguugugcuaaccugggcugcauagcagcuuucaaggcaggcagauugacugcuuuaacgugcaguaaagaugaacauuagcuugaugaaaucuuguuuggguucaucugcagagccggguccuguggcucagaccuguaauuccagcugcuuggaggcuuaggcaggaggaucauguguucaaaugugccagccugggcaauuuaauaagacucccaacaacgacaacaacaaaucagauuuaaauaaaugaacaaaaagaagacaugucuaaggcccuacaguaaauccauuguaccacaaaauauccuaauuaauuaguuaauuaauaguaguuuuauuaaacagguacuuugauaauuauacuuugcaguuuuucuuaauuuuuguauuuuccauuguguuuuuacuugcauuauaguuaaauccugcuuuuuuauucauucauucauuuuuaguucuuuuguacuguuuguaucuacauuaggaaaucagcagaggcauuuuucuauuauaaaaacuguuuccugcaguucauuuggaauuuugagaaguauuuuccacacccuugcuacccucuaggucuccaagauggaucgcucaauaggucuugaaaagaaccugguaucagacaacaauuagacuggauagaaguuuuggacaguacucaccuauuauagaaguguguucuuuccagguuugcuggcaaacaauugcuuaagaguuaggaagggaguuaauguucaaagacagcuuuaccuucuuucacugaaucacccaaguucugaaagaagacugauaugggacuauaaacucugcuccauccguuuuuacauaggaaaugauuucuuauuaaaaaugaaguacugugguaguuuacugugcauguguuugugugugugugagagacagagagaagcggggaaggguaaaugcagguacgcaugugccccuccaugcauguggagugugugugugugugugugugugugugugugugugugagagagagagagagagagagacagagagaagcggggaaggguaaaugcagguacacaugugcccccuccaugcauguggagugugugugugugugugugugugugugugugugugagagagagacagagagaagcggggaaggguaaaugcagguacgcaugugcccccuccaugcauguggaggguguguguguguguuugugugugugugugagagacagagaaaagcggggaaggguaaaugcagguacgcaugugccuccuccaugcauguggaggguguguguguguguguguguguguguguguguuugugugugugugugugugugugugagagagacagagagaagcggggaaggguaaaugcagguacacaugugcccccuccaugcauguggagugugugugugugugugugagagagagagacagagagaagcggggaaggguaaaugcagguacgcaugugcccccuccaugcauguggaguguguguguguguguguguguguguguacagguacacaugugccccuccaugcauguggaguguguguguguguguguguguguguguguguguguguguauguguguauacagguacacaugugccccuccaugcauguggagugugugugugugugugucuguguguuuguacacaugugccccuccaugcauguauagugugugugugugucuguguguagguacacaugugccccuccaugcauguggagugugugugugucuguguguagguacacaugugccccuccaugcauguguagugugugugugugugucuguguguagguacacaugugccccuccuugcaugaggagugaguucucuccuuccccgugggauccaguggucagacuuaaacacucaggcugucagccuucuguugugagagcuuuaauccacugagccagcccagaaaugccuuuucuaccucuguuuuacacaauccaaaagucugaccccaugcuccuccuuaaucccugcuucuuagggcuggaauguucugguauuuagucuggggauuccguguauacuuucagagucacacuuaagccaagguuugucuuggcucccacauucuguauauucugacccucagccucaagucuguagugagcaucuuaaacuuguguguccacaccugaguugcugguaccuucaaagugcacagccagugcuccccacaggaaaugcaacuccugucuccuaguuacucaaagcaagauuucagucauggacagucaagcucaaaaacacucaacugaguaggaaauauucaugacuacguuuuaaagaccgaucuaacuuuuuaacuggagagcaaccuuagccuugagcucauggcguuacccgacugaccuccaacucggucuuccugcagguuucugacuggccucuagugcucugcuucugucucucccaccacccuuuacgucuuuccccaacucagaggagaaagagucuuaguaagaucucccucugugcucucacuucucucagaaccuuuaaauggcuuuccauuucuucagagagaaaggcaaaguggaugcaguaguccuaagcucaucucaccccugcucccucccaccccaacugcaggucaggcccauugccugcccuucacccuguguuccugcucaucucuagcacacauuuccucccagggucucauauagcccuggcugguguggauuuuaucauguagaccaggcuggccuugaacucacagagguccaccuuccucugccucccaaggucugagagcauugccccugugcuacugguuugcuuauaagccacuuaaacagcaaagguauuauguaagcauacauugguauuccgcaugacaaagggcuuccauccuuaggugagccuuguaauuaaacauagccauuuuaucuuuagcuaucuuagcuaagaccacauaggaagguuguuuuguaaaugaagcuuguaguuugggaguuauagaaauuauugcauuuguacagcagagaaaaacugcauguauuguccauaguucagaacugaggaaacgcuguguaauccuaauauugucccaagaaauuaacauucccaagaacagccuagucuuccccaccucuaaauggaaggaggguauucauuaaaaggaaaguaauuacacuaaggaaauuggucaaaaggcccauuguauggguuccgagaaccucuugcauuguuguggacuccagcagaacuuguuaaagcugucauaacauuuuuuacaaacgaauuagcuuuucucauuucuuccuauucuuuaaaagaggugcgacucuaggguuggguagaguaaagcagcagauggugugugguguuugaauuuugugccacacacuuuucagcagccuagcuguaguggcagcucuuugcuuaccagaugcuugaugguugagcugaguuguuagcauaucagucaucuuaagcggucacagacgucaccucuugugcauucaguauugcugguggugguuagguugucuucacagucuuugcuauuuggaaugggugccaagguguaacucaggcugcccuggaugaacacuguuaucagguugaccuugacuccaguccuucuaaccucugccuuccgagugcacuauacuuagucuuaaagcugacugucgggugcugaaguuuugccuugcaaggugauguucugucaagacuguaaccuaacauuugagaggagaaagauauuauguuuuuggguuuucugcuuugggguuugaucccuuagguagcaggcugaaucuguacuccaguuuguaaauguuucuucugccuucugagauagagaauccaaaaauacucuccuugguuuaucauagguacaaaacagauggaaaagagaaggaggcaguucuugaagaagacgacgaccugugggugcggguucgacaccggcacaucgcgguuguguuggaguacgugagcuuguucuaacuuuguucuauaguuuuuagguacuaaauuacugaaguauauuuuauagccuuaaaacaguuuuguaaagaacuaacuuagacuuuuucugaaaaucugacagggaaauuccaaagcuuaugaaggaaauuucaucaacaaagaaagcuacagaggggaagguaagagucuuucaaggcgaugcaaggcuacauuuuuuaaaauuauuuuuagagacaaagccucuuacagcugaccucaggugaguuuacuguguacccugaauaggagcuccugccuccgucucuccaguaccacaggacgcuuuauuaucucguguguguguguguguguguguguguguguguguguguguguguguguccuucugucugucugugucugucugucugugugucuguguguauccuucugucugucugugucugucugucugucucugugugugugugugugugugugugugugugugugugugugugugugugugguggggaguugguuucucucucauccucacauguauucucauguaaagcucucaggcaagugcuucguccacucagccauucugccguucccacaaaggugaaucauaaacacaguugacagugcagaagauggagaucaccauuaacugucuaucuggggacauuuaauaccgaaguagagaaaauaaaguccuaugcaaccauuaccucauuuucauaacuuaguuacucccauuaaaauguaguuguuaaaggccauugaaucaguuucaucggugcauagaaacugaguuuguuuuguguggguucuggggucauggccagcacuuugaccuguugacccaucccaucagcagcucuauuuagacuaguuuuagauuuaguuuacuugcucacaguuuuaaugcccuucuccuuguuugauuugauuuuuccagcucccugaguugggcacucagaguacugauguguaacucucucccucagcaucuauuccagguauuuccuggucacuguugccuagucucagagccgggaaaagcauucuuucucuuucuuucauuucugguguuaguuauuugagaugugaucugaaugucuggaguguuugcuuaaggcuuuuuguuuugucuacucagaaugcugccauguccuuagcacugagacucuucugaaaucccugucagugcuuagcucccuagcuguuguccaccgggccuuggagugcugcacccguaguuguacaggauagggguguuaggacagccacugcagugcucuuauguucuggcuggcuccuuucucccuguaacucugagccugugaaaccugccuaugcagcccugagggaagcaucccuagggaccggcaggcugagcaugggaucagcugcggggcugucagcugcccagaagguucuguuuuguccaacuguccacagggaagaagaacucaauggcagcugcuuuaccguggcagucagaagcccccaaaguucuuuuaaaaccuagcauauuuauuaaacuugcuaaguuucuuaagacuuaagaguguggguggaacagcuguaauguggacugucugaagcacgggucuguuccuuuuguuugguuccagacaucacuuagcgcucuuacccagcugaugaaaaagaugccgcacuuccgaaagcagaucucgaagguaagcaggcugcucugccuugucugugugacgccgugggccagcuuagcagggucccuggaacagucgcugauaccagcuuccucccuuuacugugguucugagaaaugcccagagugaccgaagcagccacugacguuuccaucuacaucguuuggauuuuguaaacgcuuuuuaaaagagacuugucuugaacagcugaacagaacaauuuuaguguuucucaaacucauagaaaaauucagcgugagauuaacuaguggcauuuugucaacccauauauuuccuuaaaugaauaguuacaaaugagguuuaaaaugcuuaagguauagcuguccagauaaauucgcucacuuccuuuccauucuuuucccuuccuaucucccucccucucuccuuccauccauccguccaguuauccaucuguccauucaucuuugguaugggggaggugggucucauucuagcucugacugaacuggaacucacucuagccaagguuguggucagacuugugguagauccucccaccucagccuugagauuucgggcacuguaggugugagccaccaugccuagcccagccuuuucuagaaaucacuaucuuuucacacuuuuauaauguuguauuccagucagaaaccaauaauauagaagagaccuuuguugcgccucuuuaggauuugacuuuucuuuucucuucccugugccuucauuauucuucagaccccacgcagucucagcacugugcucuguguuugcuucuguugauuacgucuagcauguugacucucaccaccucucuuuucuuucuuauuuuucuaauuuuaaagauugauuuauuuauuuauuauaaggacacuguagcugucuucagacacaguagaaaagggcaucagaucccauuaaagaugguugucagccacccugugguugcugggaauugaacucaggaccucuggaagagcagucagugcucuuaaccacugagccaucucuccagccccucacuuccuuucuugagcuguuucuuuuuuuuuuuuaauguuucuuuuuuacacugaaacccauauuaucuuaaauuggggcugaugagaaggcucagcaguuaagggcacuggcugcucuucagaaggucccaguucaguucccaguacccacauaauggcucacagucauuuguaacuccaguuccacaggaucugaugcccucuucuggccucugggcacuaggcccacacauaacucacacccaugcagagaaaacaccuauuuauuuuuuaaguuuaauauuaucaauuauacaaaaaaguaauucgaguauuguaaauaaccagugucuucugguuuucagcaaguaguccaucuuaacuuagcugaagacugcaugaauaaguuuaagcugaauauugagaagcucugcaaaacugagcagguauguacagacccagaaacacccacaucuguaauagauucccagagugacuuuguaagcuaucacauaaagguuuugcucaauacagcgguugaguuccacagaaucauagacucuuagaagggacucgccuaggcaguguguggugccugacggcucuguguuacuauagcaaacccugaaaugauagucuacugagaaaaggcugauuuugucucacagguuugcugguuggguuuggugcugggcacacuugguugagaauacuugagacguagggucuuauaaacaauuggcuucacugcuuuuaggcauguggcacaucauagcagggaugucugacagagcacaggagcucaccgcaugguaaggacaccaggagguagacagaggcgaggacaguuguccccuucaaaggcacaaaaagaccugaagagcucccucuagguccugcucuuagauccuucaccucucagggacaccagagucagccuuaucauggggccccggggucacucagaucacacuggagcccuccaacacuggcacgagucccuccccugugaucugcaguuugagcucuggagugcuaugcuaguggagcguugcagggccuucucgggggcugcggugcaugugagcugucccacagaacucugcacccaacguuucuguuuugauucucuugguuuuuuuuuguuuuguuuuguuuuguuuuuuaaauauuccuaaccuguucagaauaugacacuaagagauauagaaugcauguugcaugcaguacuaacuauucugauagccacacuacaaaguuaaaaagaagcgcaagugauugcggugauaaaucuaaccuaacccaauguguucacacuauuguuugaacaugugcuuaauauuaaagguguugaugagguauuuucuguucuuucacaaaucuucagaaguccauuguuuugcacccagagcccauccugacuccgauggagcacaucagaagugcgcagacucucauucuuaguggugaccuuagugucuagcucagguccacaugacuuucucucccgcugauugcuuuaugaccuuuuauguuuugugaaaugaauacuuugcaucuaacguucccaucuccugugaaauaccaucugucccaccaaaaucugacaguuuaauaguagauacuccuaucgggaaagcaagcauggauuguagagcacugucugcauuuuacuguccuuaggaccuggcacuuggaacagaugcugaaggccagcgggugaaggacuccaugcuggugcuccucccagugcugcucaacaaaaaccaugacaacugcgacaaaauacgggcaguccugcucuacaucuucgggauuaaugguaauggagugugcgccuacucggucccaagacugcauuaaaguccuagcucuaagaucacucagcguagucacacuuuacauucaguugguauaaauuauuuuuguguguguggugggaaugguacgguaugugucacagccugugaccggaggugauuuuauuuccagauuacagcacccacaggcauggccaguccccacguggugucuacucugugaucuugcgguucugguuacauuuugaguuuccauuuucuccuucaccauguggguuucagggaucaaacccaggcugucggucuuggcagaaagcacuguuagccucugagccaucuccgugccccacaagucacauuuuuauaacuagcuuguuacuacucaacguaagggaguuguggagaccucaaaaguaaugcuuaguaagguggagauaacagaacugucuuagaaagcugagagaagccuggagggauagcauuccuuuaagcuuuagucccugugugaguccuucaguucuagaguugguuuccguagcagggaucugacugcaugccugucucacuucccuaaggaaccacugaagaaaaucuggacagacugauccacaauguaaagauagaagaugauagugauaugauucguaacuggagccaccuugguguucccauuguucccccaguaaggaagugugugugucucugugucugucugucugccucuggcugugugucuguauguguaucugucugucugucuuugugugggugggcauauauuaacuacuuuugaagucagacacacugccauuccuccaugaggucucuguaaacuacuuuuguauaugagaaucuugacuucaucuuacagaauuggauuauuaaguaagcaauuaugguuuuuuuguuuuguucuuguuuacauuuucugagacaagguuucauguagucuaggcuggccucaaacuuacuaugggaaccaaggauaaccuugaacucugucuuuaccuuucagugauggcuacaguugugugcuaccaugcccagugucuguguugcugggaacuacugggcgagcacucuuacaggagcugugugcccagcccagaguuuuguuuucauauguaaccugagugcauaaaguuuucuaguggguuuguauuuucuggcgucuacuguaauuugcuccuuacacuugucucuuuaugauucaugugugccaaugguugcauuuuacaugcagccuuuucuacacacugcugagguacaacaugcuguccugugaccagcaugucccaaccuuguauggugcuuuuuucuuuuucuuuuuaaaaguaggcaguuuugcuguaauuaaagcuuuguuagaaaauauaauuauauuauugaaugaaauuauuugucccuucaauuauaucagucccagcaagccaaaccacugagaaaggaucggucugcagaagagacuuuucagcuuucucgauggacaccuuuuaucaaagauaucauggagguaaacgucccaaccugccugcugaccccugagcaccuccugcgggucauuccuuccacuucgcuguuuaccugccgcuguggccuggcucucaggcccugcagugcuggaaggucacacaagaugucugggucugcugggacuuuauaggcagagacgcuucuuaaagucuuaaggaccucagaacaauucuccacugucuaugaaugaaugaauaaauaaaugaaugaaugagcacaugccugcuucaugaaaagagucgcugggugaauaugcuuuuagugcugcgggaucuuaagaaaauaauauuaauuuguaggaauuauaaacugaacuaauuuuaaaauugccuuaggcgcuaaaugaaaaacauuuuuucuagcuuuccucugacuaauuauaguucuaauuucuacuuuccuuugugugcuaauaguuuuacuaguuucccaauuuucaaaauuuuauguccucgucaaauacaugagcauauuggaaaaguccaaagaacuuagacuuuguuugcugcacuguaagucaccucccaccccggcaaugauuacagaaguaguuauuucuuuucuuuuguaagauuuacuuuauguaugugaguacacuguugcuuucuucagaaauaccagaagagggcaucagaucccauuacagaugugagccaccaugugguugcugggaauugaacuuaggaccucuggaagagcagucaguuuucuuaaccauugagccaccucuccagccccccaaaauaguuuuucuuaugauuguuuuuuaaaugaaaaccaaccuguuuaaacccucugacaagguuugcaugugaaacccagagacugcacuuggaucuguggcugaccugggcuguuagguuuucuccuaacuuaaaacagugcuucuuccucuggcaaucguacuaaaacccuccugaguugcuuuuccuucuuguguccacuuuucacuaccuuugugcaucaucuauaaagcaaguugauugacuaauaaaaaguguaacuauaguaaauugugaacauaacccguugauugaccaaacauauauuacuguauuaauaaagcauucauaaucuguuuauucaucauaaacauauacaaaggucauaaaacauagcccugagaaaagaaggguuuuuuuuuuuuuuaaacguagcaaacaggaaaacauuccauaaucauuggacugccuucagugucucgagguuaggugugugcauucuguuuugaggaagugcuaugaaggaccauggccuguggugccauugagaaaccucucacuucccuagagcuggacaguccucagcauugcagaaccuuccaguaaagaaaggcagaucucaagugcacguuuaauauguaguauguaaacuaguacauuaguuuuuaauuuguuuuuauuauuuuaacuaggcguguauaugugugggcaugugcacacgagugcaggugcucacggaagccagaggcauugaugcccuggagcuggaguugaggcaguugugagugucacuguguggguacugggaccugaauuuccguccuccagaggaacagugauucgcuuaaccacugagccgucucuaguccuaguguauugauuucuacugcagucaguauucauagguauaaagaagggauaaucuuaauauuuaugcaccuuuaauguucaucaagcuguguauaaaacaaaucccugaaauuuucuugaugguguuaauaauuuucuucccuaggaugccauugauaauagauuagauuccaaagaguggccguauuguucccggugcccagcaguguggaauggcucuggagcugugagguaagccuguaaggggaagccacuguggugguucgcugggaugcuauagaccaaugguuagaaugcugcucagcgcucuccuugaacaagggcccuuccugugugaaacauagaguaacauaaaagguaguuuuucuucuauuguaaccuaguuaaauaaguucaggaaggcauacuuuauaaugcagaauacuuuuauaaaauugcaucaccucccacacagcuucuuuacagcauaguugcuuccuucucccucugguuucuucuuguuuuucuuuuccucuuuucuuuucuuuucucuucuuuucuucuuccucuucucucucucucucucucucuuucuuucuggaggcaggaucucacuguguagacagccaauccucugaguaaccacacccaacuugauuuaacccuuuugauaauuguguuaauuauuuucaacuucagagagacuauguucucgugcaugccccugcacucagagcccagcuuaacaaauuaaauauaauccaagcuuucuggguuucaagcucugagguuacucucccucuuuaucagaucugucguaguuuaaucauucucugcaugucccuaccuuuucugccugcccuguguaauguauugaauuguuccuguguguggaugcacacaugacagagcauguacggaggucagaagacaacuuacagggaacaguucucucccucccccgagcgggcccugaacauugaacucaggcgugcagccacucaugaccuauguggggcuuuuucuugagauuuggcuucuaucacauggacugugcuauguugacacacaggucucuccuguuuacucuuccugggguuugcuguguugccugcaucuucaucagauaaacaggguuugggguauuguauuucugagguguuuuguuguuucuggagucacugggguucugucucuccucuccccuccccuccccucccuccuccccuccccuccccucccuccucuccuccccuccccucuccuccccuccccucuccuccccuuucucuuaccuguuuauuguaguuccuucaaauggcacagccgcucgagcucaucucugacuccauguuucauuguguggcagauugguucuuguaguuuccauuucugcuuuuguuuugugguuuguggugcugaaggcaaaaccuaggcaagcacugacugcugcuuccucaccaacuuuccuaucguuucugcugaaccacaaucuuacauucagauagauauagauacauagauaugauguagguauaaucugcuuuaaagucuuugcucaauccaaccucuacuuuuacaaaacuaaguuucuaccacacuguuucuuucuauaucuacaaccuuugauugaaaacagacccuuuuagcaacucugaguugcuuucuguggugaguuuucaugcuuaagucuguuucguuuucgauuuuugagacaguuucucuguguaacccuggcuguccuagaacucacucuguagaucaggcuagcuuugaacucagagaucugccugccucugucggccuagugcuggauauauguagguugggggaaguauguacaugugugugcagguguccacagaacccagagaugucuggguccccugggguuggagucacgggugugaaccagauccucugcaagagcaauacugacgcucuaagccaucucucuagcccaucgugguagcaauuuguguagacuuaaacuguuggcuuucucucuugcugugaauggccacuucagucuuuugaguuuuucaguuuuucaguuuggcuuagugguuguuugugccuguguaguugcagucagccaauugucugggcagacauugucagacacuugaggcaugucccuuccauccuccacugaucacugaggauuuagggauacacugaucuuccagaggacccagguucaucccagcacccacaaccauccguaacuccugucccacaggauccagcacccuucucuggccuccacaggcccugcaugcacauggugcacagccuuacauguaggcaaaacacccauacacaaaauaaaaauguuuuaaaauuuuaaauauuaaaauaaaauguucgcuuuauaaauaaaaauacuaagccuagacugugugguuuuuacuauacuuuuuggaaauaagguuuuauauaugucuccuagaucuagccuugaucuuuuuccuacugucucaccacaaauaaaacuaugugaucuauucaaauugaaaucugaaagggggggggggugugcagccuuugccuaaauuacuguagggaaagcaccacgguuagauugcuucguuauugcuuccaaaggugaguuugagaugcacgccgcguggcuuugggagugcugacagcauguuugcuuuguguuuuacuuucuagugcucgccagaaacccagaacuaacuacuuagagcuggaccggaaaaaugggucaaggcugauuauuuuuguaauuggaggaauuacguacucugagaugcggugugcuuaugaaguuucccaggcacauaaauccugugagguuauuauugguaagauuuucaucuuuuuuguuuguuaauguuuaaggcaagauuaugcaugggaaaauuuaagacuauuauuacaugcagaaaaagaauuaauuauaaaacauuuguaaaauugccugaagguuuuuuuuuccugguugguauuuuaauacucuuauuuuuaaauauuccaauuuuaggagcuuaagcuugcuccuuuaaaacugugucuucugauuuuauuugcuuggaucauuaaaaagcuuuuaugacauauuaauacauuuuuacuucagaagcauuugguuuuguguauauggaucugacauugaugaggccuguguaggacugagcuuuaaaauaucagucuggaccagcaagagggcucaguggguaaaaaaaaaaaaaaaaauugcugagcaagucugacaaccuucacuaccagaacucacaguggcaggagaaagccuacuccugaaaggcauccucuggccuccacgcgugagccaugacaugcaugugcacacacguguacaugcaugugcacacacguguacaugcaugugcacacacggucauaguaaaguaaauuagaauguuuuccagugaagccgcugcagauagaaagccgccuagcccagacagcugcaggaguuguauggccugcuuacagucucugugugaaaaugacaacugcugcaguucuguaacgaggcuagaaaaauccauuuuucucuuuacuagacaccaauaaaguacaaaucagacaaaacacuugugaugggcaaaauuucugaagaguuacugagcaugcucagugacaaggguugaugugaauuuuggagacaugcuguuagaaguauuguucaaauguaccaaacauuuguauaugaaagggacaagaucuuaagccaaagaaaaugauuucauucugacaauuuacaauuucuuccaccagguuccacacauauuuuaacacccagaaagcuccuggaugauauaaaaaugcugaauaaaucaaaggauaaaguuuccuuuaaggaugaguaacuuuuuaugguugucguuuagagguuuuguuaauacgaucggcuacagcaaauguugcuguuguaauuuaagcgguguaaauaguguauggaguaaugugguuuucaaguguacaucuuacagaagcuuauguguuauggauuugccauuucuaauaauuuaaauacuguugcugcuuuguacaagaucugacacuacagggcuuucuaaucaggaugucuucacccuagggacagaaucuguuaggagggauggguaguuuuuacagccugcuguauacauacuaguuacuguauacuuacgcugaaauauaguguugggggcaaaaugauuuugaaugaagagauuauaaaaguaaaaacuguaaauguauguaugauagaauuauuucuuauaagugcaguuucuuaaaacugagauucauaauuuuuuauguguaaaauaauuccaguguuuaauaugauuucacuguguauauuaccugugaaauaauucuaaagaacacaauuuuauauguuugagaucaugucugcuuaaguuagacgccaaaaauaaucaugaacauucuaagagaaaauaaauauauuauugucaaaauuuu

SEQ ID NO: 1673 - RNA, 10040 nt, Mus musculus
agaccugcacucuuacgcccagaucucuacuuuacuaaaaaaagcauuccuuagugucuaagaaaugaccaaugaaucucguccgccacaggaagccacucuauagucugcuuacgcuacugaacacuuccaauguaguaaugguaugcucaaaggcugagaacauggcucagagaacaucugccuaucauguagccaggguuagauacuuuaagggggaaaaaaucaacugaacauaaaacugaguuauuaauuacacuuaauggcuucccaauuuccuuaaaauucugucugaguaugugacagcaacaguguaggugugcccagaggacaccaugcaggccccucuucacuauguggacuccaaaagucaagaccuggcagcacucacuuaacuacuuugcugaauaauaguuacaucuguacuacuaguuguaacagacuaguugucaauuugaaauaggacuagaguucuaaaaguacagcauuuuaaccggagcauuucacuuagagaucuuucuuacaagugguacaaacgcccccugugggcucuucaaugaaaugccugauuggucaacacaaacccaaaaccauaaugcuaauaccaauaacuaaccacuuugguccucucucucucucucuuuuuauuuuguccugaauacaugucuuaaaacuuucaaaaccaaacuuuaaaugguauuaauacuguucaaguacaauuucaacuaucagcuuugauguggacagaagagccccugcaacaaaaacaaaacaacaaaaccacuccuuccccuaaaagggaaacugcuauuaagagucuaguaaguaccagcauagcguaucuccuuccaaccuacaaggauuaagagacuguuuccagggguacauguguacaccaugagauaguauuguugccagccuucuccucccagcccaggggugaacucaggucuggcugggugggaagcaccuuuacaggcugagcaauguguucuuuuuaaauagucacuuuugcucaagaucuccucuacagaaaacugcugacauuuuaucaguucccacaauuuucuuuaaauguuaacaaauggggggggggggaaaccaacacccaggauaaaggauuuaauccaguauuuauuccacacucaugaugguuuucugaaaucagaauacaagucauaagaacaaucuaucaaauaauuugcugauagucuuaaauaacgcagcacugcauuacugguaauauuucuguccuagauuaaguuuaaaaacucaaacagcaaucuucauuaucaauaaaaaaaguuuuaaauucuuaaaaaaggauacuauaucaagcuguuucauaauuuaaguauucuccauuauaaaaugcuuuggaagcuuaggcuugacugcuccucugcuccugcgccccgcccucgccugcuccugcgccccgcccucucccaaucacuccuuaguauagggcugcuacaacgccaggcuuacacacuuuaauauaguacuuuuaaagucugagaaagaauucaagagggagggggaagcacauuguaaaaaggaaaguaauaaauuuuaggcauacuaacagugucccuuugagguagaaugcuaaaaggacuucugaucaaaucuaagccuaauuuaaaccucuuaaaaauucucucgaacauuaacuguggagaauaacaacauauuaacaagagcuuccaagguaauauacaguggacaagaauguuaacccuccaacuguugccuccauguauacugaaaaacacauaauucuccuaaacaaacauccaagauccauucccaaagucuuuagcauucuauuaugaaaagcacagccaugcuaacuucaguacacaaccauaaucucacaccuacaaaacaaaaauagaauuaguggcaguuuauugccuuauacaaauuuaaccaacauggcaaccaugccaaaggaauuaaaacauuuuccaggacguauguacagacuguacauuuuaaaaacaaacaaaaaugcaagaacauucugugcaucaugugucaacucaacagggugaaaacaucaaugcguaaugggauuacaaaggcacuucccuacacaaaagaaaacacagccuacggggagcucagagugcauaacuacugcacaaucucaacuuggggggaaaaaagcagaauuuaaucaacauuuauaggauucaaugugauccaaguuuacacaaucuucacacagucucaucuuugcuuuuguguuccuuuucuuggcucucuggcucuccacucuggcugcucugaugauccugucugucugacugguccuugcuaucauuaugcucucucuugugggaacggucuuggcuccugcugcgcuuucuagacuucucucugcuagggcuguguucucguuuucucuuuucaacacugccaguucuuccuugacugccacuucugcuucuuuuauuugccuucuccuugcuuucguuuuuaugucugcuugacuuguccuugcuccugcuccugcuccgcuucccugcguuucugcuccugcuccuguguuuccucucucugcuccugcuucugcuguguuuuuucuuggacucuuuuuugucaucucugugucgucuguccuccuugucuucuuugugcuucuucucuucuccaucaccccuacuucucugcuccuuggagcgcucucuugaucucucucugucccuuucucggucacugccucucuccuugucauaaucucggucucgucuucgaccccucucauuuucuuucucucuuucccgaucccugucucuucuauccccuuuccuaucacgacugcgacugcgacuucugugccucucccgacugcggcuucgccugcgaucuaagccccgaucaaugcuucgggaucuucgccuuucuuucucucucucuuuggcuucccgcucuagucguuggcguucuuucucucucucuaauucucugucaaaacuagaagauccauggcccucccggugaugacuucugcuucuugaucuucuuggagaccuccgugggcucagugaucuucuuggagaucuaagaaaaggggaaaggaagaaacuguaauaauaaagcaaacacuggaagggccgggauaccugcagcucaguggaacacuuacgugggauguccuuagaacacuggggcugauauucaaccacaaauacucccuagcacauaaaccaaccaaauauacugcaaacauuucaucagcuuacuacacacaucaaauauaauuauuaaccuuuggaugguacggccugugguagugcuugccuggcaugcauguguacaauaacguuuaggggggaugacaaauuaaaggaaaaccacauuuuccuaagaacuuuguauagguaaauuaaaauuaauaacugucauuaccuggaucgccgucucucaacaugucugucuaucuccucaaugccuuccuuuccgucuuucuugauuuuccuaggucgaguuuuaaucugcugaucaauguucuucuggacuggaacuggaauucuuggaaacaaaguagaaaaccauuccaguuuugugagaaaagaacgaagcaucucuccaauggucauuacacagccuccaccagcuuugacaucuagguccuaugaaacauaagagauacccuaccgguuaaaaaaaaaaaagacacaucaacauauacaugaacacuuuaaaaaaaauuuuauaccaucuuuggaaucaacuauaaaaaaacuaacagaaaaauuucaauuuguguauccuaaucugguaaugaaugaagaauauuuaggcuaauuauauacaugcaggugaaaaaaaaccccugcagccucuugggcauaaagggaccugacuuacucauuaaccaaaaaucuggaaaagccccuuauaucacugaacuacguggaacaaguggguuaacaugacauuucacauaccuacacuugaggacacguuugcacacauaccuagugcugaaaccuagcuauguagggacuacuuucugaaaauuccuaucuaaagguuaucuuuuuaacagcugcaauauaaaaugaagcccugcuaaaacuggaagcaauagcaaaccaacugccaugaagcagugagguuucuaauuuaaaguuauguacaaaauaaauaaaugaacaaagaauuggaaacgcauaauccaugaugaccauugucucugaaaagggucauuaccgcaugaaggccuucuugcuaugcccucucacagcucaggacauguuagucagcuauugucagucccaaaccuauagugcaagcacacaaggaaagugagauuuguuaucuaaacaggaaaacaagagcuaaagguaaaacugcuugcacucacacacauuuaaguguucagauauacaguauuuccaaauauaaucgcugcagauaucuaaagaagaaaacauacguuagcucaaauagaggaccucaggcuuguaaacacaguaaagaacagauaaauuagaagcauucagaaaccuaagaacaauuuuuaaaagugacaugccuuuuugaagugcuuuaaucuuucuuuagaaaaaagccauguaaauaggagaaaaguuuaacaauuaugauuuuaccucaaauacuuccuggaucuuuuuuauuaauaaacagcuugguaaauaggccaaaacaggacagggaaauuuuuaacaaccaucucugggcuugcuuguaacccuagcacuaaggaacugagacagaggaucaguaguagaggccuugauucucagcuagucugaggccaacaugaguuacguaagaccuugucucaaaaugguucuccucuaugucuacagagugagguuuuuuuuuuuuuaaaggugggcauauaauaaaaaugaaauuuuuauuagauggauauauucaucaaccacaaaaaagauuuuuuugagacauggucucauuauguaacucuggguggccuggaauuuacuacauagaccaguuugguccggaacucagcaauccaucugccucugcuuccuaggugcugggauuaaaggugugccauauuaaggaccaaauuuuuguuugcacgcacagaagcaauuuaauucuacuauacaaacucugaacuacaaauuagugauaaaaguggaugcaaggcuaauaaagcucacaauugaguauacauugauccucuagucuucauuaaguaaauuaauauggguagaauuugaauaugacucuaaucuuugcucagcuuguuuuaaggcuugagacagugacuagauuagccaaaaaaaaaaaaaaaacaaaaacaaaaaaaaaaaaaccucaagugcuaauuuuaggcaaagaacuguguuuuuccaagguguugggaucaagcccagagcuauggguaugugacuaugaggucaaguuuuacaauguuaagccugggucuuuaaaacacuguguuguauagugacugagaaagcuagaaggagccaggcauagugguaaauccuguguguaauccuagcuacucaggaggcugaaguaggaagauuacagguuugagacugacccaaguaacacugagugucgggcucaaaagaaaaauggaaaagaauuauuauuuucuuacuuggauagguauaauugucaggcuauugaagcuagucuuucuaagccuauacuuacacgcaaauauaaauauugcuguuugaaaaaggucauaguaaagccaagaaaccguucggagauuuaaaaugccuacaguuacaguagugcauguugccucucaugucuagccccucggaaagcaacuaucagcuguaggagcuaggaucaacacaauacagaguuaauuugggagagaaaaaguuaucauugaaguuauuaaaacauacuaacucuuaaagcauauuaaaauaacuuaaaauuuuaaccuaacacagaaaagucaucaaaucuuagcaaauggauaauaaucccaaaaguacgacuguacagaaacaaauguacagaaauucugaagauauuaaacuuccaaaaaagaaaagggcaagagcagagcaaucagaagaaaggcgaugauuacccuugcugacauaccuccucaucaucaaggaaggacucaaaccagucccacaggucuguaggggguuggguauaccuacaauuauaacaagaaaucuacugaguuuaugugaacuaaaauauaguauuuauuuaaauauguagauaaacacacacauaccuuauauacauaaauccaagggcucugauauauggagagucuguauguguuaugagacccaucacuugcuuucgaguuaacuucaggguaaauaauuuguauagaaggcaaaaugcuguagaaacaaugccuccuguuccaacaccucgaaccuuuaaagggaaacaguuaagaacaaauaagcagauacuuaauacccacugauugaugcuguuaucaacaaccauaaucuacaauuaaaaggagggcauaaaaacuaauacuuuuccuaaucugauucaauggagaccugacuuuugcacuuuugaaaagagucaguauuuggauaucuaaggacacuuagcucuccuauaaacuuagcagacagaaaaacuggaaaaaaaaaugcacguacuucuacuuaccccuccgcacauccccgucuggccagcaguuuuccuacuccccuuuucccauggcucaacaugcgugaccugaaaauaaaaaaaaggaagacaacaaacguucggacucugaaacuacagugagcacaguuccuaagagcaacuccucccaagugccgagccacugugcgggagccuuccaccaucauccuggacucacacacuaaguacagcaucacugggaaagcugcucagacuccacaccaacaaaguuagaggagucaacaaaacccuggcaugcuuucaaagcagacaggucacuuuuacaguaaaguuaaauacauauuacaaaaaauaugaaguuuauuucuagggcucuggaggggcaagaagggcuuguuuaaagccugggguagugggugugaaaagggggucuuacucuguagcccuggccagccuggaucucauuuagaucaggcuggcuuggacuauaaaucaaacccacuuugggacuuuuuaauuucucauuuugaucaauuaauuccuaguuaaauauuuuaaagauuaaaaugauaaagcuacaaagaucauucuuaaacuuaauuuuuagccaaacugcaaacccagaguauaaacuguuaaaagguuaagugugaagucauuaauauuuaccaaauugaauaacaguaucauuuuuauuaaagggaacacccuaugaaaacagcuuuuacccccaaauagcaaaaagcuugauacuagagauaagugaaaaauauuagaccuguuuuuguuucuuaaauaaacccugcucuuuauuucugcccacacacggcaauacuuuauacuuuuuuuuuuuaguggcuuuagacaagcaaaacaaccaaccaaccaaccauuucaauugaaaacaauacuguuuugcucaccuuauggaguuuuuuccuguucccaacaaacagacuaagucacaucccacccagcccccagugcuggauggagacugaaccuagggucucaucuacguuggauacgugcugaaccgacuugccacugaaccacaaccggcuucuauuccuuaaaggguacccaaaagagggcauaccauguuaaacuggaagccuauacauuucaaagacuauuugauccaaagaaacuuccuagcaaguuuucagucacauuucacuuuuaauuacauguaugugugggucuguggagccccgagggucuggugguuuuuagcugccugauguggaugguggaaccugaacuuagguucuccgcaaaggcaaaaaaugcuuaguccauggggcaucucccacccccccauuuuaguuuuaaaaaugaauuuaaacauacuuucuaauauaauaaguuuuucagaauacauuugaaauuaaguugaaauauuagucucuauuuuaaaacaaccugucacaaagguacagggacccaaauuuucaaaguuaacugcauccacaaucaucacucaccaugcugcauccacacugaaaaggccuuaccuuuuaaaagcuaguuuaaaaaaacuacuucauaguauuaguuacaccuacuuaauagcuuuuguaaaagaacaccaagaguacguguauauuuuauauauacaaaguuaaaagguuugucuauaaaaagcaauuaguaccucaaaaaucucucauuaaccugaacaaguggcugggagaaaaguagguaaaauauacagaaucucuuuucguuaacaucuccacguguaugucaagacaagaaaaauuggauguguuuuacuuuacaugcucuagcgaaaaugcuugaagacaugaagacuauuaauacucauuaaaauauaaauuaaccucggaggccuggaagguuauuuuuuaaacuaccuaauuuguagggaaguggagacucuaguuagugagaccaaaaucaauggcccaacaccaaaccgguaaaaauaaaccuaauuagccauucauuuaaccagggaaaugcauuuauuggcgauugagcaugauuaauagugcauaccucuaccugcgacccugggcugcuccgagccucgcugcaagacugagucaauccugcuaacgaaacaagaacugagacaagagugcagugaggaggcgccaggugagcuccccagcacagccaagccagcaccgacccugccgcagaaagaagcccagggcccagagcauucuaauuaugcccaacgcacagguggcugacaccuucgacuccugacuuccugcugggaaaaauuuccaggccuucuguacaccucuuuugcccuggcacuccacgccacccucaacccucccggcccacccgacacacucacuggccaauuucugucgggauuggagagcuuaacgaagagcacgaggccgacauugaaguaauuacuucaguaauuccgcuggcccggggggcagcggcagaagcaccgaguuagugcuuagucgacacagguaaaaaggagucauuuuuuuaaaaaauggugaacuuggacaggcuucugguauuacuuuucuccucuccccuagaguucuugcccaacagcucccuagggauaggcaggagguugggguagguuaaagaucgauuguggcgggcucgcccggcuauuaaaacaaaacaaaaaaaacaaaaccugaaaaggaaaaaaagagggcggcccuagcccgacccgucccaaaccagccccaagcuucacuucucccuccgccaacuuucccccucccccaaauccgcgggucucaggagggagggaaagggggugcauccacgguauccgacaccccgcucuggcgaacuuacccccgacacgcggccuagaggaugcguaccuuaaaguagaucucguccaccaccucgugguaggucuugagcucguagagcugcacuuugaaguaaggcgacgacaggauguuggugaggaucaugggguugagguucauggucuucucguugccccacagcggcagcacauugcccugcuugcccgacaccgccggcuugguggcgccgccgccgccgccacauugcugcugcugcugggucacggccgcggccgccuggugcugcgguugcgaguugccggucagcgcggggcuguuguuggccauggugccgcggcaggaaggaaggagggcgggcgggaggagggaggccaagcucgaucgcgcucuucgggacaacggucccggaccuacuccauggaaggccgucggggcaaggagcccgccgcguugugccccagccgagcgggaaacugcaacugggacgccgacacacgggagcccgggcccgagacggacgccaaaaacgaggcggggagaacuccggacgcaaagcagaacgggcagcagaggagcucgaucucuuccgccaacugccccugggaacaagauggc

SEQ ID NO: 1674 - RNA, 1827 nt, Mus musculus
ugagaacugggaaagcacugccaggagagaaccuggcaccgugugacaugcaugcgccaggccucucucaccggaagcuugguaugggggcaccugagacuaugacccucuagaccuuagaagcauucucggaagagugugugaauaccaaguccugugaagugcagcuaaggggagcacauuucucaagaagugcagcuggcccuccagaaucuccuuacaucauuuccaagaagcuucccggagccucucucaaagguccgugguguaaaggugggguucuccuccccaucuuuuacaccuuaauacaacccagugaaacaagguggcaacuuuuucaaaauuagcauuaucugcagugccgcccugggaaugauggugacugagucaggccaugagugaaguaaguggcuaugccucaugcugaggccuggagggcugaguaaaugaaaccuuuucccuuuaguaucuagugcccuaaggccgccccuaauccaaggaagaucagcaaguaggcaucuggaccaagagcagacacuaccuaccuggucugaagaaggaagagaggaacuuguccuugcaccugucucaacguagagguuuccaacugacccauuuccucuuccuugucucucacuucuuaaaagaaugcagucucaggggcaggcguaucucugacuucaggaccaaccuugucuacagagcugguuccaggaugccagggcuacacagagaaaccgucggggguuggggaucgcacgcauuaccaccaccaccugccuacugagccuccggauaucacaaaacucaauaaguacucuaaaugcuuugauuucuugacccagguuuucccuccaagcugcuggccaugcucuucauccugagacaucuccugcgucuucugagacacuaugagcuucugccucuccucuuucucucuccuacacccccggcuccuuugugagcccaagauauucuaaacaugaggcuuugaaaauuugccauagauacacuuaagggcagaaagauagcuuaguaaauauugcagugaaguuuugugcccucugaucagguucuuugaaagcuaacagcagaguauaauagccccaguuguuuuuaaagcuuuaucuuuuuauauguaagugucuguguaaguuuagugugugugugugugugugugugugcgcgcgcgcgccagcacaugccagaagauaguguggaaucuuccggaauuggaguuaccagaaguugugagcuugagaacagaccucugauaucuggaagagcaacaacagcucuuaauaacaguugauagauuuuccaaccccugacacuugggggagggggaagugugugacacauguuuuuaaaugaauuauuuuuucuuguucaagccuaaaucuuaugucaugaagcucauucauuucuuaaaauagcacugcuuuacauguguuuucuuauguuauuuauacguguuuuaccauaugucuuuucucagugcuaaaauauaauauaaauaacuaacauugaaucagcucucauagacagucaacaucuaauauacucuagagugaaaugcauccuaagugcuauaauaaauauguagucaaauaucauaaaauauguauuuguauuauuucauuggauaaauucauaagucaacaauaaaacaaagcuacuaaaacgacuuucaaaaauguaagugcugggcauuuauaauuauuaaagaccauuuuucuuuaaaagauaauuguaagacauaaacagcauauuguguaauuuauaacaugucagaacuaaauguauggcaauaauaaaaaaguugua

SEQ ID NO: 1675 - RNA, 735 nt, Mus musculus
auuugaaaaauacauguaauauuuauuacaagaggauaaaucaucaacaaacugaagcauggaaaucacauaggaagcugaggaagacaccugcgcgcgugcgcacacacacacacaccccugaauauaaauuuggcuuaguuuuuauuuuaguagcugaggaucaccuauuuaacauacuuggucuauuaugaaacagaccaucuuuugucuaaguuugcaccaucagaugggaaaguuucucagguguucacaaucuuccugaugauaggaacacgacuuuugauccucagagaggcuuaaaggaugacagcugccuuuccauccuugcucaguggagcuaagcgcugcaaaggauuuccaggcuuauggaugcaugaaaaucacugauguuguuuuauuguucccacuguauccuaguucuuugagggggcagaugugcucauucauuauagugcuuagauauucuguagcuauugauaaugaaauuaauggagauccaucuacagagaugagcagguggaggaguggggccuguuaguaaaggcuccuuaggagccaucuuuccucagcacuagguaaacuguagggauaacagcagggcuggaaguaaacaggaugccaggcagcuguuugcagcaggugccuuucagucaccuugaacuccauuuuaucuuuuacauccacgucucucugcccaaaugaccaaaugacaaggaguucacuugucuuugc

SEQ ID NO: 1676 - RNA, 3694 nt, Mus musculus
ggguggccgggugaaaaggcgagguggacagcaccagagguuucuccgaguccccuccgggaaaggucacuugaaaccagacggcgaaaccauguagaggcgcggaaccauagcagcugcagcggaagcgcccgcccacaccagccuccagcuccugcuccaggccggcucgggccagcucgagcugggcaaagcgcugcggccgggccagcacguccucuccggacagauccugcaccacgaucuccgaauggcccaugaggcagcgcguggcgaagcucuccaugcagcucauauccacgccauagugcugcuucaccuggcuccagaaacccagacgccacucgagcaucuggucgcuaaucggggccacgaagagcuccgcggaagcuggcaggaggagaccgcccuccuucagccauuugguccgcgcguggagcacggagcucagcauggacucgugcagaaguccguagcccauccacucgcugacgauggcguccacucgcuccggcagcuccacggucuccaccgggcccggcaggacgugcacgcgguccuccaacccguugagccgcaccaccucccgggccuguugccagauggcgcuggccuccaccgcguacacgcgccgugccccggccugggcacagaagaugcugagaaugccggugcccgcgcccacguccagcaccgucuugccucgcagcgcggcccaguucuucaggaugccuaagcgguaggcuucggugcggaccuggucggcgaucaucuccucguggaccgagacgucggaguagcacucguaguacagcuggucccgcucgcucuugguccuccggggucguggcggggccgccuccugcuccccgccauuuuccuccucggcucccuccccuccggcgccggcgccuccgcugucccccgacucaagcuuucuuuucuugcucagcgacaucuuggccccggcagccgacccccagcauucguugcgcggugcggugcgcaggcucagaguccccggggccugcugggauucguaguccgcuuccugcaucccgcuuccugagggcagaggcucaaccagagucaaucuuggcacaccguuauuuuccucuaacgccaugacaaguuguucucuaagaccacacuauuuucccgagauccuuucaguuuuugcccuuuccuuuuaccccuugucaggguucucuagagucacagaacguauggguagccucuguagaguaagagaauuuguugaugacuuacaaucuguaguccccaaagauggucagcagcagcugugaaugaaaauccaaggaucuagcagcugcucagucccacacggcguccuggcagaaaaagugaguuuuccuucuuccagugaccuuauguaggccucccgcaggugugucccagaauaaagguguguaucaccacuuccggaucugggacuuccuuuucccaggcugaccuugagcuuuugucucaaguuuccugggauuaaaggcauguacuaccuugccugaggcuaaacuuuucauggccauaugccucaagaucuuccugccaaggccgggcgugguggcucacgccuuuaaacccaacacuugggaggcagaggcaggcgaauuucugaguucgaggccagccuggucuacagagugaguucuaauacagccaaggcuacacagagaaacccugccucaaagaaaaaauaaacaaacaaaaaaaccuccacucgguucaagucagaaaccugugucuuucagccucaagaucacaggugagugagccuuccaauucuggacuguaguucacuccagauauagucuaguugaugauagccaggaauagucacuacacucauuuuuacacauucuugauguaggcacaccacuuacagcuacaagucuauguuucccucacaggaccucccccgccccccacuacugaauuauguggcacaguucuugucccuucucugacaguuguaacucaccaaacucucuguucuaaccagaguuaggauacaaagaauauguaugacgcaaagugaaaaccaaauaauacaagaucuugauucugaguccaaagugaucccugagguacguuaagcuccagggcaaauacugaagaagugcuguggccaugaaauguaucagccaccacugugucucuggagaauaguuuacuuggucuugaguccuguucugaaacuucuguaguucaaacuaaagaacaauuaacaucaaggguaugauauucucaaacccauuuccagugucuuuggugaccagcuuauauauacacauacauacacuuaaaucuauguaucuguguaaaaacacuugcuuggagaaauggugaaacucaucucuuuugacuucuuuuccaaugcaauucacuuuuaaaaaaaauucugcuauaucuccuuuuaaagccagaauugauacccacaggcucaguuauuuuauuuuuucuguuagucaaaaagaagcuugguuaacaauaaauuaaucucuucauuggccauaacauaaaaacaauaauuuaaagaauguguacugguaucuggaacaggagcaauggacagcacuggcugcucuuccagaagacccagguuagauuagaauauccacaugaaugcucucaguuggcuuuaaccgcagucccaggggaccuguugccuuccuuuggccuccaagaguaucaaguauguaugugauguccaaacauagagacaaaaaaaauaaaauuaauaaauguaaagauguuaaacuacuuucuuauuaagaauaauauuuuucaagcuuaaaaacugaucacacaaaagaaaaugggcuuuuagcguguguguguguguuaaaaauacuuaacuacauuaaacuucuaggcaacagaauuucuuccccuuuucucucuaucagugucgcuaaugaaauugguuuauuaaugugaaauccucagcuguacuuguaaucucaaggcucccaguccuggcucauuagaacccuccauggagcuuuauugaaauacccaugcuaggguccaccucaacccagcuaaaugagagccacucaggggaacucgggcaucuaguuuuuaaagcugcuggggaaucauaaugugaaaccagaugauuauggcuaauuuugauuuaauuaaaucuuauaucauuauuuucaauagucagggcucagcaaccuauaacugaaaauccauaaaauagguauucuuccuuuuuaccuugguuucuuaucuuccguuaaugaaguaacgccuagaagagcacaugagauuaguuauaaaugugagaauuugauaacacacaaugagcuuucccuuagccuauacuucucuuauucugaucucaaaccgccagcuucccuuuuggguguguuuaguguuucacuuuugaagaguuaauuaauuaauuaauuaacuuuugcuauuuugcuuguguguuauaggaugcuuguagagguuaaaggacagcuaaggagguuggggcucuccuuauaaugugguacuugggauccaacuccaguugucaggcuuggcuguaaguguuuguccuccugagucaucucccugccccagaauguguuuauuauaaauccaauuuuuaauuuacuucuuuuuaguuucuuguaaaaaaaaucuuuaaauaaaaguuugucaguucaucuac

SEQ ID NO: 1677 - RNA, 2846 nt, Mus musculus
ugagaugagucuaaguguacagagagagcgccaccuauguuuggacuguaggagaucugccccagugucuccuaagcauaucccaaggcaaaagguuuagaucccccuggauaagugagcagcugucuacaaggccauaguaacagacuuucuggaagcuagaagauaaaaacaauucacuuugagucaauggagugaccugugugccagaaguaaaacucaucuuuuguuuacaacaucucccuaagaugaucaugauauaaagguauaaaaaaacucagcauauucaaaucugaaacacaugugcacacauauacguucaguacaaauucuaagacucaaugcuuuccauggggaggaggggcuaccacuguucccaacugaaaucaucucuuccuucaaagacgaggaagaagccuagaauugugaggaaaaugacagcguugcuggccaacacaagaccacaggcuccccacuugaucacauccacacgagcaagaauaacaggaaguccaaaggcagaaucaacaaucccaguggugaagaaauacaccaauuccggacaggcacugcuggucgcgucagagucauaugugacccuuuuggcaaugaaguaggggaugggggagaugacguagaaaaucaagacgaacaggggccaguaaaugucauaguccuccaaggcacaucccagcauaagaaaagucagcccaauugccccacugaaggagagcgccaugagugcuuuaacacucacccagagcugcuuccggcuuucuccaaaagcugcccacacccacuuuccuguaauucuuuaagggacuuuuguguuucuucuaccuguuuagcagcauuugccuguaguucuuuaaggacuucuaccuuuuuagcaguguucuccuguaauuccuugagggauuuucuguguuuccucuuuaagagcuucuacuuguuuagcaguauucuccuguuauuccuugagggaguuuuguguuuccucuuuaagggcuucuaccuguuuaacaguguucuccuguaauuccuugagggauuuuuuguguuuccucuuuaaggacuucuaccuguuuaacaguguucuccuguaauuccuugaggaauuuuuguguuuccucuuuaaggacuucuacuuguuuaucaguauucuccuguaauuccuugagggauuuuuguguuuccucuuuaagggcuucuaccuguuuaauaguuuucuccuguauuucuuuaagugaguuauuaaugucuuuccuaaaauuuucuaccaccaucaugagauaugguuuuaaaucugcaucuugcuuuucggguguuuuggaguauccaggacuuguuaugguggguguacuggguucugaugaugcccaauguucuuggcuucuguuaguaaaauucuuacauuugccuuuuaccaucuggaaaucucugguguuaauguucaagcugucucugguuggagcuugauccuccugugauucuguuagccucugucagcacuccugggaguccaacucucaccugaguuccaguggucagagcacucucugcaagaaagcucuccucuugcagggcagguguccagcagucuagagcucugauccaccuucugaguucuggggucagaacccucccuauaggcugacucuccucuggcaaggaaugugcccaggagucugggucucagcucugccuccuggcugaagaugaaggccugauuggacccugaacaagaagcucugcugcuucuaucgcccacaugaucucaggugaucaggagguccugggugugcuagggguccugcagaguggagagcccucugguguccuagaagcccuugccuggguucacacagaagauggagggguuggccccgaccggaauggaucccagccucugguagagcaggguuccuuugucccuguuccuacuggcacaagacccuccacaauucuuuggagcugauguugaguucuaguuacccgugaucccaaggugaucccgagguccugcgguguggagagcacucuggagcccuuagcagccucugcugggcucagaaggaagauggcaggugaacuuuuccaaucuuauguacaguaaauucucaguagccacaaacaucccaggaaggaaaauaauucuuuucucucuucauguggccauuuuggagaaggcaagauguagaaaacaaaacaaaacaaaacaaaacaaaacaaaacaaacaagcauuuuauaaaccauaggcacaaguuuguaaauggucaucugccucugcuaagaauaguuuauuccaguccaagugcuaccaguuuuauaucuuucagucaucuuuaacgaucauaauuaauuggccaaugccuuucuguuguuuuaaaagcuguuuauuuuacauaauaguuuguacauauguaauacguuucuucagauuucacagcuccaaaaugauucuguauccugauuugauuuggaacauagcucauuuauuugaccucagaaauaaguaggugcauuacucuacccugaauaguuaucuagcugaacccauagcuggucuucaucagcauaguguaguagcuacuuguccauucgauuucuuguuuugauuagaaccuauaauguucugugagagagaucccuauguuucuucuugugcuauuuuggccauacuuguaauuugacucuuuuguaguucagaaauauuuucagauauaauaucuaaucuggucugaugcuuauuagucauauaaucuugaaaauucagucuucgaaguaguucuuugaaacucaccuuugguauacgauugauuuuucaaaauuggaaauacucauu

SEQ ID NO: 1678 - RNA, 2846 nt, Mus musculus
aaugaguauuuccaauuuugaaaaaucaaucguauaccaaaggugaguuucaaagaacuacuucgaagacugaauuuucaagauuauaugacuaauaagcaucagaccagauuagauauuauaucugaaaauauuucugaacuacaaaagagucaaauuacaaguauggccaaaauagcacaagaagaaacauagggaucucucucacagaacauuauagguucuaaucaaaacaagaaaucgaauggacaaguagcuacuacacuaugcugaugaagaccagcuauggguucagcuagauaacuauucaggguagaguaaugcaccuacuuauuucugaggucaaauaaaugagcuauguuccaaaucaaaucaggauacagaaucauuuuggagcugugaaaucugaagaaacguauuacauauguacaaacuauuauguaaaauaaacagcuuuuaaaacaacagaaaggcauuggccaauuaauuaugaucguuaaagaugacugaaagauauaaaacugguagcacuuggacuggaauaaacuauucuuagcagaggcagaugaccauuuacaaacuugugccuaugguuuauaaaaugcuuguuuguuuuguuuuguuuuguuuuguuuuguuuuguuuucuacaucuugccuucuccaaaauggccacaugaagagagaaaagaauuauuuuccuuccugggauguuuguggcuacugagaauuuacuguacauaagauuggaaaaguucaccugccaucuuccuucugagcccagcagaggcugcuaagggcuccagagugcucuccacaccgcaggaccucgggaucaccuugggaucacggguaacuagaacucaacaucagcuccaaagaauuguggagggucuugugccaguaggaacagggacaaaggaacccugcucuaccagaggcugggauccauuccggucggggccaaccccuccaucuucugugugaacccaggcaagggcuucuaggacaccagagggcucuccacucugcaggaccccuagcacacccaggaccuccugaucaccugagaucaugugggcgauagaagcagcagagcuucuuguucaggguccaaucaggccuucaucuucagccaggaggcagagcugagacccagacuccugggcacauuccuugccagaggagagucagccuauagggaggguucugaccccagaacucagaagguggaucagagcucuagacugcuggacaccugcccugcaagaggagagcuuucuugcagagagugcucugaccacuggaacucaggugagaguuggacucccaggagugcugacagaggcuaacagaaucacaggaggaucaagcuccaaccagagacagcuugaacauuaacaccagagauuuccagaugguaaaaggcaaauguaagaauuuuacuaacagaagccaagaacauugggcaucaucagaacccaguacacccaccauaacaaguccuggauacuccaaaacacccgaaaagcaagaugcagauuuaaaaccauaucucaugauggugguagaaaauuuuaggaaagacauuaauaacucacuuaaagaaauacaggagaaaacuauuaaacagguagaagcccuuaaagaggaaacacaaaaaucccucaaggaauuacaggagaauacugauaaacaaguagaaguccuuaaagaggaaacacaaaaauuccucaaggaauuacaggagaacacuguuaaacagguagaaguccuuaaagaggaaacacaaaaaaucccucaaggaauuacaggagaacacuguuaaacagguagaagcccuuaaagaggaaacacaaaacucccucaaggaauaacaggagaauacugcuaaacaaguagaagcucuuaaagaggaaacacagaaaaucccucaaggaauuacaggagaacacugcuaaaaagguagaaguccuuaaagaacuacaggcaaaugcugcuaaacagguagaagaaacacaaaagucccuuaaagaauuacaggaaagugggugugggcagcuuuuggagaaagccggaagcagcucugggugaguguuaaagcacucauggcgcucuccuucaguggggcaauugggcugacuuuucuuaugcugggaugugccuuggaggacuaugacauuuacuggccccuguucgucuugauuuucuacgucaucucccccauccccuacuucauugccaaaagggucacauaugacucugacgcgaccagcagugccuguccggaauugguguauuucuucaccacugggauuguugauucugccuuuggacuuccuguuauucuugcucguguggaugugaucaaguggggagccuguggucuuguguuggccagcaacgcugucauuuuccucacaauucuaggcuucuuccucgucuuugaaggaagagaugauuucaguugggaacagugguagccccuccuccccauggaaagcauugagucuuagaauuuguacugaacguauaugugugcacauguguuucagauuugaauaugcugaguuuuuuuauaccuuuauaucaugaucaucuuagggagauguuguaaacaaaagaugaguuuuacuucuggcacacaggucacuccauugacucaaagugaauuguuuuuaucuucuagcuuccagaaagucuguuacuauggccuuguagacagcugcucacuuauccagggggaucuaaaccuuuugccuugggauaugcuuaggagacacuggggcagaucuccuacaguccaaacauagguggcgcucucucuguacacuuagacucaucuca

SEQ ID NO: 1679 - RNA, 1120 nt, Mus musculus
uauuuucaagaaauuucauugacaaucuaauuacucauuaaacaugcuuuuggcuacuuggaaaauccaucauugaauaauuucuucucaugacuguuuucuucaaguuccuuucauaauuaauuauuccaggaaagaaguuuccucauuccacaauacccaccuguuucuuuuuugguguucuguuaugcguggccugugguucuugugaucagggagacccuuguucaguagaaugucucugcuggggauuuggcagcuugugugaccucugguguuuaggguacugggguuuuaggaacuggcauaaccugggauucuggauaagucauggucucugguagagcaaagagcuucugccagaauugugguaugggacauggauaugagugaaggggccacuguuggggaaaguuccacaggcucugaggaaauguugguggucugccucagggccugaccugguagagcagggugauucugcuggagcuauaggucaggauauggagaccuggaaagcaugcacuuguaccugcugugcuauguugcuggcucauauguacuuugauuuuaaaaguuuauuuauuuuuuaccaauagccuuaaacaaugaacuugaauagguagacaugauaaauuguacauguaaucauuagauaacuucaucccaaauuuacuaugcauuaggagaaaaucuaaauuuuuuucgaagaaaauaaucagaacuuuggauggcaucccaagaaauaucuuuuuaccauuaauaugauuuccuucauuuucccuauauauuuuaugaaaaaguauuucaauaaaaauucacucacuuauuaaacaugcuuugguuucuuuaaaucucaucauugcucaauuuccucugguggccauuuuuuuaaaaaaauugucuuauaaauaguuauuucaagaaaaaagaauaucguuuuuuaauuccacaauacuaaaaauacucgcagcacauauuguaaccuaucuuguuacucaguugauggcauucuuuguuugguguacagaagcauuuuagugucaugaauuacuguucuuauuguaugagaaauugcaaucacauucaguaaagccuuccuuuugcaaaugaguuuaag

SEQ ID NO: 1680 - RNA, 5044 nt, Mus musculus
agugaugaaauaacuuuuaauuucugcuuaacuuuacagucucgaaaaggcuaugaaaagacagugauugagaucaauacuccgaaaauugaucagguacccaucauugauguaaugaucaaugauuuuggugaucagaaccagaaguuuggauuugaagucgguccagcuugcuuucuuggauaagauuaggacgaagaccuuaugaaaccaacaggaaaaaaaauaccuuggugccaccaaccauuuuacgccacaugcaaguuuugaauaaggacgguauagaaaacgugcuuaggaaucgcuguugccuacuggaggcacagacagaggaaagagguuuugguaguuaugacgauguaagguaguguggcggagauggcaauggggcuaauucuugauucucaacccucaucucuccuuuuccuauuuggauuucguuggugcuguagaaaacaaaaagagagaaaaauauauauucauuuaaaaaauggugcucauucccauccaucaaagauagaguaaaauuauguuuaauaaaguguaauuauuuuauguacaguucuacacugucaucccuguguccauuuccaaaacuugcacgugacucucaaucccacccagcucagauuucaugacaauuguggacugugacggcaauaaauauuugugauacaaaacucaaguuguauuucugcugacucuaauugccuuuccuugauuaauaauaaaaugccuuuguauauguugauguugaagacuucaguuauuugaugucacugacaaauuucacgguggucaaaucuagacuuucaggaucacacaccaaucgucccuucucugcuaaccguaacuuguugcguuucagccagaaguaucaugcauuuuaauaauuaauucagugcuauaccucgaauauuuucuucucagaauccagauuucaccaaauacuuguauauauggggaacaagaaaaguuauauuuuuggacaggaaaguauguaugagaaacugcuuuaacauccacccagaaaauaacuuuauguacaauuauuucucuacguaaucuucuucauuguccucagagugcuucaguaaugccaacuaauacuaaagauggaaaauaagcaauuauuuauaaauuugugcaauguuagguuaaagcaaugaacuguuaaaguggcauaguaauaauagucgcaaauauuauuuuacuugcccaacaaauacaguuccuuuguuuuaaaauaauuauuuucaacauuugaccaaccuaguagcuaaaaaauacauagggugagcuguuucaaaagucauauuugcucaagacaaucaacccuucucuuuuuuuccacuuagguauuuucuuuuacauaccuugaacuagcaauacaauuuuaaaaucaccaacugaauuuuguaucuauuuuaaguaauauauguaagacuugaaaauaaauguuuuauuauaauuucuuauaugaaguguuaaauuaauugauaccaguuuccacuggaacacuuaucagcugauaauuuaucucaaagaauauaaucuguaaucuugacauuuaaaaaugaacauuuguaauucagaauuucuuuauuucugaaaccaaguuuguaaauguccuuuggaggaaggagauaugaauuuuaucaauaaaucaagucuugucuaccuggauuggucauuuucuuucuuaaacagguugcaauucacucuuguguucaaaaguacuuuugauugucauacuugaccauccagagaagaauucuguaacccuugcauguuaacauucaaagauaaguucucaaauauacagcauaguaaauaauggcauacaguauuuccaauaaaaugauaauuuauauuuaaugucacaaaaugguuuuuagagguaaaagguuuuacagguaaaagucucauacuuuugacuuuggaacuaaaaauaauuuccaagcaaauuauuaaguuuuuaaaucacacgcgaaauaauauuaguuuacaaaguuuucauauauguuaauuuaucugcauuaauuaaagacuuuguuguauauuaacuuauuccaaauuaguugucuuuuuaaugaaauaaauuugacuccuaagguaauggaugcagacauaacuauucuguacuuuucuuguacugacaugaggauuuucucuuuccuucgaugaugucaucugggaaauaaauaaaacuucagugaaaauaaaaagcacauuucuuagaugacauuggaacaaaugaagguuauuagaauuaaaauuacauaugcuuauucgaucuugcacaaagcaugggucacauucuaguacaaggaauuuuugguauaauuuucuuucuuaaaguaaauuauaagccaaaaguaaauaaaaauaaugugacagggauaauuuagagugaauuaacaugucaucauaauuguuuuaauggaaaucaucacaaaaugucugaaauuuugggaagaugacucuuauuuaacucuuagauauacaugagugacuuccuuugucaucuacaucacaucuuccuuggucacugcaacacacacacacacacacacacacacacacacauugcagucucuucaagaguuucuucauaggaaaacuccauauaauuuaccaaagaguacauuuauucauuauauacaugaaaaaguguuaaauaauuaauagcuuagaaacgcucucauuuuacaccauguuuuuggcauuagaauauauuaggauuguuuugaaaaauuugguaagcucuauuaaauuuuguccauaugugcacauuagauuuacuagaacuuuucacaaaggaguuucugcuauccauuucucucuagcuguggauauuauucauguagagucauagaucuacuaugugaaaacucugucacuauauuuucuagucaucaugacauguuugauaguaagauuauuuaguaaaccaucucuauauuaggauaaaagaaucaauauacuuauaauuuacugaauuccuaaaagcuauguccuacccugugaaguuauuauauaaauaccagaugaauaaccccuaauugaacaucuucccagaagcuaccuccucaacaaauucaaggaagaauggcaaaaggauacaaggaugcagugguaguuuucuaaccuaucacagggcuaaaauauauaaugaacauaugauuauuuuucaggaucaaguauguguuuaaaugagguaauaccuaagaauaguccuggaacuuguguuuuauuacuuucauuuccuagucuacugcaugcagaauaacuacaacuuauuagauaagcuuuuaauccaugucaucuaagcagcaguagcuuuauauuuccuguuauuacauuauuacuaucaucagcaccguaucaauuuuugacaugaagccugaaacuaacacacaacagacacacccacaugacacacguaguucacaauuuccauaaauaucugccuguucagaaauaaaucccuacaccaaccaugucauuacacagaucccagauuagcagggucacaccuggcagauuaggaacaauuuacaaacaauagcaaacugugugacaagccauguuaguaaacagcaagucuaaagucaucagacaaagcuccucaugucucuuucuuauaccagaauguuuggcuuuacagaaaaaugaguuuaauagguucagcgcucucuccaguucugcuuuccucguccuaucuucuggcacuggcuguaagauuagcuauagcuugaugcacauauagcucagagagccaugaagauggcagggugauuuaucaugaaguaaaugacagaaaauguccugcauacaacacuaccguuucaguaauuacuacccaucaaucucuguagaauccuuggguauuuucuuucuaaauguaguaguccauaauuaugaggaaauuugaucagggcaaaacaaaaaugagaguggcagaaaagaguuacagaaacaugguuaagcuuucuacucaaaaacuacaaauuucuauaaucucuggaauguucuuuuauuauaccuaggacuuauuaaauaggauccuuucaacagcaccuuggaaaaaguauugacagaaagauagacaaaauuacacaagccuacuaccuuuauaugccuauaauuaacuaaagagcuagacauuuuuaugucuauauagaaagauuugcauuuuauaaaaugaucaauaaaauuaaauucuuauaccucuuccauccacugucauuccaucacacauuuugagcagagacuaaucucuaaauggacuaauauguaaagcuucugcccuaaauaaaauauuugaaugccuccuuggaauagucuggagcacaagagaaaauguaucugagaugacagagaauuuuuugaucaaaccuauauggcuuuaacacuaaauuucauggaaccaagagguacagugugaaauuuuauuuguagaaaccauaaacccaucauuuugcaaaagugcugaacccuuaauaagacaaacuuagguaccccaucuguuucaagaaaacaacaaaaugcugggaagugguggugcacgccauuagucccagcacuugggaggcaaucuugacaggcagauuucugaguuugaggccagccuggucuacagagugaguuccaagacagccagaacuacacagacacgaaagaaagaaagaaagaaaggaaggaagaaagaaagaaagaaagaaagaaagaaagaaagaaagaaagaaagaaagaaagaaagaaagaaagagagaaagagagagagagagagagaaagaaagaaagaaagagaaaaaacaacaaaauauacuuaaguuguuaaauaagaauguaaauaauaaauucuuaaauaaagaauuaacuucauaucuucauaugcauaagaagauuuuuaccuaaaaguacacuuugcucaaagcauauccaauauaaauuuaaaaauaaauaaaauuacaguugaaaaaaugacucagcaguugagggagaguucugcucauaaagaacccgaguuugguuccug

SEQ ID NO: 1681 - RNA, 4642 nt, Mus musculus
ugguuuuauuuuagucacucugccccagaucuuucugggaggcugcuucuuagcagcccagacccugaggggcccccugccgcuggcagagggcggaggaguuaaaagcauuaaccccucccagucccuuccuagaggagccacccagccucggcggggcgcucagagacuucgucuugcaaaaguggugcgggcagcgcaggcagggcuggccauuggagugcaccgcugaggagggaggggaccccagcucagggaacuuugcgagugagcuggucgccgucagucgccgacagcagcaagaugcggaucgcgcgguguagacccagaguccugcggacgcagcuucguccggcuugagcgagguaggggguugugagccucgcaggcuccggcuauggggcguccaggugucaagaacgaaccuuuaaacacaaacgaaacaaacaaaaacuuugagaaaaaacaaagcaaaacgaacccgggcaucaccaagaugcuauggaguccuucuugacugacuucuucuuggggcacggaguuuaugaaguuagaaaaaaaaaaagauuaauuuccaaauuauagaaacgacugggggagggcaugcuagagaagcugugauucauuagaacggagaaaagggaagacgcuuauuauuauuauuuuuuuuuuuuugaaauccuguagacaaaauuaucaggcaccacgccaauaauuuccauugccugagaauggacuguagcgauaagaguggagaaauguugaguuucguaagcuuuugucacagaaaugacuacaaugucucuaggguccccuccccccucauuuguuauagaguugaucaauuacugugcagacuuuagaguacuuauuuagugcuguguguccaacuuaaguagugcugugugcccuuuagggauugcuaguucuguugagaggaggcaauguuggggguguggggagcggaggaaguuaaaagugcccaugcaaacuuagcaguauguguuucuggaaauuaauguaccugaaguuaaaacaaaguggcgugcuucguuaucgcuagcagggugacuuucgugugugugugugugcaaguaagcguuggcuaaaguuaaaacuuucuuaagcaaucaguucauggagaaacgucuaggauuugcugcaaucucuuaggagggguucuccgugaauaccuuuaaacguaauaaaugaacuuguggggcgguugggugaggcggaggaguaaagacagaaguuuuaaaaagaagaauaggcaguugcuucacggaggcgccaagcuuuccuguuuacuucaaggccuggcggcccacaccacaccucgcuuuacccucugaccaucggacccucagcacaccugcuccuagggaguuauuaauagagcccagaaaacggcuuacuugucaaaugaccuccuacaaagcuacuuuuuuuuuggcaugguaaugagaaggugggcuggucucuucgagguguguguguguguguguguguguguguguguugggguaugcaugucugcccugcacccagaaugggcaguuggugccuucugugagcaagcagucgauuuucgcuugaaggaaucucagggcuggacacugaacguggcaaugccaguggaaauggcgugggcucgaaaacuagaauggguggcucucauuuccaucuugguggauuuagugacccaagggaagguuuugucuccucagagucuggguaaauuguuuuuucuaccucucuuucuaacuucauuucucuuuuguuuguuuauuuuuguuuuguuaauagaaaugaccauuugaguuaaaaaaaauccucccuguguccuguauccuuaaaacaaaucaucaacaaaguuggagcaaugccuuggcuagaaugaauuaugcuagugugcugggcauuuucccugauucuuuucuuuguaacuuguuuaaggcugcuguuucucggaggccucuccagccaaggaaaagcuccauaaaagaaaaaagcauuggauugcucgcugaccuggcuuugcuguaacugaaggcucacucaaccucgcccucuagcguuugccuggagaaauaccaccccaggcuccuggggacacaauuagcagcuaugguguccacuagcaucccggagguuaaagcucuccgcagcucagucucugacuaugggaacuaugauaucauaguccggcauuacaacuacacaggcaaguugaacaucggggcggagaaggaccauggcauuaaacugacuucagugguguucauucucaucugcugcuucaucauccuagagaauauauuugucuugcuaacuauuuggaaaaccaagaaguuccaccggcccauguacuauuucauaggcaaccuagcccucucggaccuauuagcaggcguggcuuacacagcuaaccugcuguugucuggggccaccacuuacaagcucacaccugcccagugguuucugcgggaagggaguauguuuguggcucucucugcaucagucuucagccuccuugccaucgccauugagcgcuacaucaccaugcugaagaugaaacuacacaacgggagcaacagcucgcgcuccuuucugcugaucagcgccugcugggucaucucccucauccuggggggccugcccaucaugggcuggaacugcaucagcucgcugucuagcugcuccaccgugcucccgcucuaccacaagcacuauauucucuucugcaccaccgucuucacucugcuccugcuuuccaucgucauccucuacugcaggaucuacuccuuggucaggacucgaagccgccgccugaccuuccgcaagaacaucuccaaggccagucgcaguucugagaagucucuggccuugcugaagacggugaucauuguccugagugucuucauugccugcugggccccucucuucauccuacuacuguuagaugugggcugcaaggcgaagaccugugacauccuguacaaagcagaguacuuccugguucuggcugugcugaacucagguaccaaccccaucaucuacacucugaccaacaaggagaugcgccgggccuucauccggaucguaucuuguugcaaaugccccaacggagacucugcuggcaaauucaagaggcccaucaucccaggcauggaauuuagccgcagcaaaucagacaacuccucucacccccagaaggacgauggggacaacccagagaccauuaugucgucuggaaacgucaauucuucuuccuaaagccugaagaagcuguugauacugagggaagcauucugacuugaucacccacuaccccagcauuucaaaaaugucucucgcucuccacugcugcaaggaaggagcaacugggagccugagagagggagggaagggagaaugugcggccuggugauaccaugauguagguagguaguaauugugaacaaugcacugggaaggguggagaucaggucuggccugcaguggguuuccugccccccccucccccguacccuggagcuuugauuuugcacugagccaaaggucuagcauugucaagcucccagagggcucaucuggucccuccucaaagacuaaggucccaagagaaaguguugugaucucucacuguaaugucaaagugaguaugugcccuuuagcuugguugggugguguacauguccccacccuccgguuucuucucacccugucuccccuuaccaccccuucuuuauaucguaacugccugacuuuuguucaucagaaggagguuguggaggggucuauuucuugauuauagugagcaagcuauuugcugggaaggcuauuugcugaggccaaaguuuccauguaaacugggucaaguuguugggaauuugguaggccaucuuuaagaugaaaauguguuccuuuuuugucacauguuccuuauucccauuacaaccacaaugguugugaaugaagaguaacaaagaauaacgaagucuacuuuauuugaauuauacugggcagaaucuuagaugauacgggaaaagcaaaaaacaaacaaacaaacaaacaaacaaacaaaaaucuacagcaugaggugaaaugugagaguuaagucgugcagaccaagagcuguuucuugcugucuuucucuaaccccuacagcaccuuuggcacuuuuauugaugauuucagaauguugugugauccauuucaaccaacugggggagaguuguauuuuguuuaaagaacauuuucugauuuucgaauguauuuguuucuuugaggucaucuuauugaacuucuuccuaacccguguuaacaccacugaauguguaguucuuaagaaagugucauccuuuuguaccccccacuccccaaaagcauuacuuuaacugacagggaacaucaggaauucuuuauuucggcugucacuagguauugaugaugguuauaaauguuacagagaauaaaaauauauuagucucuuuagucugguguucagugagugcaauuaagccaagaaaugucuuuuuuaaaaaauaguauuuaauagguuccugacuuuuguggaucauuuugcacauagcuuuaucaacuuuuaaacauuaauaaacugauuuuuuuaaaagau

SEQ ID NO: 1682 - RNA, 1577 nt, Mus musculus
auucacacagcuucccgcaguccccagcgcgggacggacucugaaacuaggcauggggaucccugggaaaacuuuucuucguuaaaaaucuuagaggacagaggacaagccugcacuugguagaggagcuuucuggucccagaccccacagcccugaggauccguguagcccgagugguccggugcccugggggccacuuccacgcggucaggggaaacccgagccacugcccggagagccgcagccacgccgcagagaggggauccugagaaggucggaggagagcagccccgaaguacugaaaagcuucuguccuccaccuccucuuccuccacccccuccacuccgauccuggugaagccuugaaacuugcggucuggugggcagaaaguggcuuuccccgggugcacggugaagugggccagugcugugcuugauguuggaccggggguuccccucucucagcugaccgcaaagccaggcggugugccccagauucugggaagcucagaggccuuugaggaggugggcugcugcccuggccucagagauuuaaacaauccagcagcaguucaggaauguccacaggggaaagagguugccuguccuuucacuggccagugccuacagcccccugccuaaagcuggaccccucuucucucccugucuacguagagauaacuaagagauccccaaaucuaaggaauugcaccuuguccacauuuuucuacuguuagauaaugcuagauugaggcugaagaggccuuggucagauuugucugaguagcagauggaggccuuuaugccuugucugucuguccuucuguuaaaaagugguuccacccaaguccccuguucucacugccuucccacccugagcagaugugaucacaaaacuuccucugcugugcaguuucaauuaacagacacacccuguaccugaaugacucaagagagacagaagaaacaaacaacagaccccuaccuucugggauuuuaugagcuugcaaaaaaaaaaaaaaaguagcuguuaauucauauuugccuagaagcacucauugacaguuuccuaccuuaccuacccacaaacuacagaucuugcaaaacaauauggaaaccaagauaacagccguccagucuccuccagaaaagacagaguuugagacugguuucauuugaaagaggagauaacuucugucuaucgcagugcugcagaggcaaggaguuagcuuccccuucucccacuaacaauuuaugaggucuuuaaaggggaacugugcacuuuguugucccaagaugugauggccacugucccaugaagcaauggaguagcaugggccguucuacccaugagcaaucccucagcccugagagaccuguagauuguccagguaguauguggcagagaugggucaccaaauuuaaguugucuugccugucugcucaaaugcugucaaucagcuuagaacuucacauuccuuuccugaacagaggagacuucugcacuuggacuccuuacauuuguacuucugauuguacuugucuuuacaugugcauaaaacuauuacuaauguau

SEQ ID NO: 1683 - RNA, 19776 nt, Mus musculus
guuaaggugauaugaauaaauuugucuauuuuaucauguucucuugccgauuuugauaaaaguagucugaccauguuucgaguaucuguauuagguuagcaguuugaaguuuuuacucuuauaacaauuccagaagaacaaaacaauuaagggagacaauuuacaacaaaugaaacacaacucuuccauguucagaaacuuccacuuuacuauaguauuuauaaaagacaagucaaaugaagucgcauuuaaaucagguuagucauuacacaagaccccaaugaagaaacagguccccguaccguacaguaccauguagagaaaauuacuuagccauucuaccaugaauuagaaaguaguaccugaaagucaacccagugaccucuuuaccguuugccuauaaaaauauagaacccugacuucuuuuaaaaaacaugaaaucauuguuaauaaaauucauaggaauaaaauuauguugaagaaaauaaaacauaaaaaggugacacugguuagcugccuagucaacauuaacauuaauauuaaacuuuucuaagaagcauuaaguuacaacagucaguccaagcaacacucucugauuacguucugaccugcauauggagugcugcuacucuaaacaaccucgcgacggcauaauuuuauuuuacauauauacaguuuauguuauuuacauacacaucaugggaccauuccagucacuucaacgauggggacuugucaagcagaacuuuucugguuagcuccuugcauucagcaagggaucaagcagccacuuugccuucuuuacugagaaggguucugggaagucugaaugcauggcuugguuuguggagggggcggggcuguaauaaacaguauuaaggaucuggguuuuauaaauaaugucucuucucaaacauuucagauguuagcuacacuuuggauuucugugccuccaccagacuguacgauccuuucauguuagcuuuucuugcaaaauaaacgaucaucccgauggcagguauuaccaaggaagaugcgcaguagagugcaaggaguucgggcgaaaaauaguucuuguuauguucuuuuccuggaaaauaaccaaauggaugcaauuaaugucuaguacaaaaggaaauaauuuaaccacaguguguguuuuaugguaacaguacaacuaguucuucaaagaagaagcgauaaaagcugcacugaggaccaucgagacucauauaacacauuuuuuuauuuuuucugaaauacccaaauaagcagcucgugguugcaauacucaugauggguacgaagaugacaguuuuuugacucugcaaacuuggguuuuaaaggauugcuuuggguguaaaauggaagggggagcacacauuuuagugaucuguuucauaagaguaagaauccgaaauaaccccaugacacugcuagccaugaacagaaaugccuaacacauucaauaagacaaucuaugcaacacucaguguggccacuaaaguaaaagguagagcauucuuguugaugguuggcuggcacgcgcuucuaugcuuuguucugugugucugaagcaaaggcaucuuuauaugauuauuucccccccaguauugacaaccucucuugacuuuacugauggucuuuggagauuucacuuaaguaaaugucagaguuacucauagagugcacacucaaaauccaaccaccacaauuucguaucucucuaacagcuuguaauucaauauuugaccaguuaaaaaauuuuaaauauuugcuauuuaauaaauauuuguuaucuaaauaauauuuaaauaauagauauuuauuaaauaauaaauuuauaaauuaaguuuauuauuacauaaauuuaaaaaauauaaauauauuuaaauaauacauaccuauuaaauaauaacuauuuauauagauaaauauuugauauuuaauaaauaaaaauuuaaauuuauuuaaauauuugaccuguuaaauuuguuuuccuccucugacugcaaacuauauaaagacagcuauguuuauaugaggugcuucacaacuagccagcacuucagacacuucuuggcacucuauuuuaauacuauuaaaauauuauuugaguacuaauaaacuuuuuuccuucuaaaucuuaucauuuugccacauagucauaaauuuaguacugaaaauggcaagguauaaacacuuuaaaaucuuuuaagagaacacgugacaacagcaacaccuugagcaacaucugagcuucauaaaaacaucuccagagagaauggcauucucccaagacuugcuucugguuuuuauuuguuuguuuguuuacaccccacagcacggccucacaguuccauuuuacuaaguggaaggcuaugcuguaucgaguccuggcagggauuagugaucugaucuggggcaccauuacaauuccuuccagagcuuucaaaacacagaaagucauucaaguagaaagacuucuuagcaucauaugagugaguuguuucaaauuacugaaggaugaaaccgaugcuccaccuuaagcauccugauaaugucuucauuucucugcuuccuuucauagaacugauggaaggguaauauauuaaugggguacuuauaauugugguuacucaucaauacugaugucaaacuaggaagaaguauuucuauuauuguuuucuuuucaauuuaauuauuaucuuugucuuuccguuugucccucagacaucuguugaaaacucaaaauugauccacuuguuagggcaauauucuaacacauuuuuccuauuaauuauacaaacuuugaaaguuuuaaagauuccugaccauguguauuaauaggaugcauuuaagccaaaaccaaacaagacaauaaguauaaacauucagcuauaaauacaaaggaaaacuaguuuaaauuauccaguggaggggaaggucaacuuuggauaauucauauuugcauaauucauaugcaauuauuugaaaucaucuucauauugagagcaugaaugucuggcugggugacuaauaugcuuucauuguucaucuaaaagauaaauuaaaaguggcacauacguaagaaaauaauuaagcaauuagaaaagacaaugugggaaaaagcaguuuucauggagaaacagucaagcacaaacgggaugacaaaaaucuucgaagugcaaaugccuggggcuuggcuaaauuagggcuaaccagaggaagacauagcucagccuacgcauaauugagaucucaguccauuucuccggaggcaacaccuucacacacugucucauauccaguugcaugaugggagauacuuccccacucuuugaauacauggcaacccccuuggccagaucaccuguuuucagaacaaucaccacagcuagguaccuagaaguuugacauuuaauuaugauauuuucccuuccuuuaacauuucuaaguagauauauaaauauugcucugauuugaagaggugcuaugaagauagaaaaaaacauguaugcuaagguuuguaaucuugaugaaugugacuaguaaaauguguauguuuucucacucauguucagauuuucucuacacugacaugugauuaguuaacucucacggucaaugccagaccucuucagagucggcauucauuagcgauguuacucacucuaccaggcuggauuucagcauacaacaguucuuuggugugcagagggucuaaggcuuacuagucaaggcuagcaucaauaaaaauuagcaggcacucacaagagagaagaggaaaaguaaggagugcuaauaugugucuggcggggccacugccccucccuuccucuucaucagguuaaagucggacaauuggggcauggauuucaaaggaagcucuugugagaucuagagauccugcuuaggauccaggcugcuauccccaauuagcauccucacaaaagagccaugcagaaaauaugcaguuacucugugcucugaaaacagagcucuuucccaguggggagcaagaucugcccaggacuguuuuucugcugugccagcccugauuccuuaguuuccuuuuaccccaggggaaacguuguaaaguauauuguuaaacucuuagcaaaucuaagaccucagagaccaaugaugaauuggcaacuuuggaaaaaaaaaaaugggaauuccacaucaccgaugauuaauggccacuuccuggcuaaaugcuauaggauagaacagcuguaucugauuauuucaagaagcauucagaaacaaguggucagcacagaauuccagcucauuuuaccagcuccaccuaacuguagaaacuuguuacucuccuuggaaacuuggaauaauuuuaaaaauaaauuaaaaaaaaaaaaagcaaacacagaaagcuaaccuuuuacaucaaguguuaaacuucuuaauugugagccaacuucagucuuagauucacacucguauaugccggcauccugcagcugugccuggcggaugguguacgagccauccacagacuuuaauaccaugucuccugucuuugcuuucuucuucaggauuauccauguuucgggcacauuuccacaagugcaggagauaaugacggugucucccucuuugacacucuuagauggaaagacuguaagcuguauaucuuuuggagagacugaagugagaaugaacaguuagaguguguggggggagggguacagcaaucucuuccugacugagaacauuggcagucauugcuaagcuguuugcaaugcuuucugcaugagcuguaaggaaggcaagcuaagaagcugggcguuugaccaauucccaguaaucauauugcaagcaagagaagacauaucucgggcuucuuuucuagccuuaauaugauucuuucuuuacccugagguagcaguagcaacaaaucccaacaucuaccuuaacagaauaauugcaaaagaugcagaagagugcucuccaaagaaagaacauguggggcggggcaaggcaaguuuaucgcuucauaauuuugcccaugaaaccuuaugguuucugugugucaaacagaaacuguuguguuuucuaucuugggucuuuaucuuggagaagggagagcgauaccuagguucagcccagugguucucaacagcgggcugagaggaaacaauuacugugacccuuaaacucauaguucacaaauggugcccucuugggccucuaagcaaguccuaggcagcuucuuggaaguugcuccugaguguccuguucaggccaaugugaugguuuucauccucaauaacuuccuacccuuguuucuucaccaaaaccccgauucccaagugucccugagcuuccagcuugguuucuguagugagcauuucauuugcuaugaauaggauuuuagggcaagcgauuuggucugaaaugaaaauccaauccaggagcaguguagaacugcuuuuauaauuaaugaauuaauuuuuaaauuuauuuguauuuugcacauaaacgcaguuuugaaauaaagguuuuucuuuuugugaauuuuuuuuuuuacaugaagaaaguaaaccuuuauugcuauauuucauauuagauauuuucuucauuuacauuucaaaugcuauccccuuuccuaguuuuugaggcuuauuuuuauuuuuaaauuauguuuauuuguaugugucuguguggguuacacgcaugugguacagugcccaaggaagcaaggagguggaauuacgggcaguuguaagcuucccacugugaggcugugaacagaaccgaagucaucuuuaagaguagugggcacucauuuuggcuaggccaucucucuggcccccaaaggcuuucuuuucaaagagaaucuugaucaccaucaguaacucaacaggaaauguacuagccauaaauaacauaaagucacacacugcuuaccuuggauaaucaguucaacugauuuucugcuaauuccagccucguuaaucccuucacacacauaaaugccggaaucgucccuuuuuguagacaugaaggugaguguaguauuuucagaaagaggcugcaguuccccauuauuuagcugucugcuccacaggauuuugggagcugguaucccaucacuugagcaggucagguucacaggacugcccuccucuaguauaggagaggggcugacccagauggugguuuccuugggggcaacuggaaagcaacaaacacuuagcuugaaucucuuaugcccugaauuccaaagagucuagacaauguuguaaaaaccaggcaaaggacucuggguuagcauaguuuauaaauuaugauaaccagcccaggauguuucuguaggggagacacaaggggaguuagaauacagaugaaauguggauauuuucaaaugguggaaaguucuacagaacucucuucaugucagaagcacagagaaucacguauaguguaguguuugggugaaaugguggauuagaagucucugcaugacucguggagaagaaacaggauaagaauuggcucuauuuccaagggaagaaagagaagaguauuggaaacacacacacaccacuagacagagagugagacagagagaaagagaggagagagagagagagagagagagagagagagagagagagagaacgagagauugauugauugauugauugauugguucaugguaugcauugccuaagcauggugcauuagaauauccccugugaauaagaaaaacccauuuaacuacacuccuccccccuugaaccuggguugaucguuugaucaauagaauguagaugacguggcauggggguggagggaugcuccugauauagaucuuuaugaagcuacuuucauccccaccuuucuuagcuguguucuggcaaguaaaucuaggcuaccuucccugagggugauaccacacuaagaaacaacaggugggacaaugcacauaaggcucaggcauguuaagugacaugucucugacaagccagcugcuggccugccugaagaugcuugaauuguccugaggaugcauagcuggcuggcugacccaguccugaaugcuaaugcauagaaucauacauaaauaaauaauuugguuugcuuuauggagaaugguuuauuguaaucacuaguaucuugauucauuguuccccccuguuuucuucacagagguuuuaauugguaaccuucuguuaacuauuaacaggugaacauaguaaagaaauccauauucaauuguaucugccccauguaugcacuuaccguugacauaaagaggcuguacacucugccucuguuuggguucagauuccauuucaccacuguguaaccuagcgaggcaaacaagagauuucccgguaucuucaaugguggggaugaaggucguuuccaaaauuuuggucucuagggacuuuaugcccauuuccuccaaaaaauauuucuucaucaguguagucucccccuucaguaauucaaucuccagauggucaaagggauacacauuagggacugugcaguugacagugacaggucucccaugcacaaguggcccacucauuuuaauuacuggaucuucagggaaugcugcagauaucaagcaaaaauaauauugauaugcaauauucaagggaauauugagccagauucuauuaaaugcauaguucucaaagugacggcuuuugaugaguugggaauaguauggucucaaguaguaaaugacaccauuaaguauaacuguacaauuauaauauuuuuguuguuguuuuuuucgagacaggguuucucuguguagcccugccuguccuggaacucccucuguagaccaggcuggccucgaacucagaaaucugccugccucugccuccugagugcugggucuaaaggugugugccaccacgccuggcuuauuaaucauaaguaacagaaacaaaauacuuagcauuuuaagucaaggagaaauaaaugcuuguacucccuauuuuucucuucuaacaaugccaccuugccuauuguguucuaaagucacaguggcuuuggccaucuuauuaaccauauaguuuaaauauuuuaaauauuugucauauauauauauugacuauuaaauauaaacuaauuccccucagccuuuauuaucuccuucuucugagcagccugauaaaaaugguuauuauguaacuuguuucauagcuagaaaaaggaacuuacagggacaaauaagacuuuucauaauagaucagaucuagucaaagucuguccuccaaccuacgagccuuggcuauacaguuuguucaauaucaaaagagcuucacugacuuucuuaaauuaguuuguuuaucaaaaucugaaugguuuguuuuaugauuaaacuuaggcaagaaguuuuaaauacuuuccacguuuuuuaaagacaggggcucacuuuuuaaacuugguugaccuggaaguauuuauguagaccagacuggccucaaacucauggagaucugcagaccucugccuccugauaagguaaauccuguaauuaacaaaugaacugacagccaggccugguggugcacaccuuugaucccagcacucaggaggcagagacagguggaucucugaguucaaggccagccuggucuacagacugaguucuagggaagcuaggacuacacagguaaaacuuaucucaaaaaagaaagaaagaaaagaaaugacuuaauacuguauguuuucucacauguguggaaccuaaguuuaacauuuaaauuacauacauuuauacaucgauguguacgugcuugcaggucuuagaacuaaaagaagaucaggagaggagaugucaucuuaagggaugugggaauuagcaaugguacaagaacauagucaauaggaaagaagaggaagcugucugggggcagggagggaagcagguagagaggaaacaggcacaagagggcaauggaacauaggaacagaugagaagaaagcauaaugacaccaacaucugauagugugacaaucaaggcaugucuuccuaugcuaacuuuaaccacaagaaagugcuauucaaucauauuauuuaaagucugaguacauauucucucaucugucuauauagcaguuaugauacacucuauguacauuaacaaaaaugacaugucauacaaaacaaaacauaacccugaaaaccaaaacuaaacuuuguuuucauucuuuccuuaaguaaaagcuguuaaagugguggauuuucaacccuggcacacugcaauagcugucaugcuguugggaaugugccuagaccagcagauccuggagccuggguaacaugaucgaccauaaaguuuacacuccuuuugagagauuuaaaucucuuaacggguacagucuuauucugaacaaaauccugaagauuaacacaaguuugggcaggccuguagauggaaacgcuuuacaauauguucucuggaauugggugaauacugggcagcaccacccucugcauaaaaaaaaauaacuucacagucacguggucacggucagucacguggucacaaugacguucuuuccacauucagaguagacugagggauuccagcaguucauagagacuuagaguugaaaagaauuucuauuaaggugauaaaaauggaggggacaagaaaacacgugccacuuguucacuggguaaaucagcugaaaaguuggcgcuuguuucugccucggcuccgcguaccgaccgccucacacucagacuaaggaaaaccugucuuuuucuguguguuucuggcacucugcuguuucccauugucccccacccccgaauccugcagaucagcuccucaaaucugccuuaaaacggcugacuucuuuucccauuucucucuuccccugcuaccuuccucucaaccccacgacccuuuguucuuucuuuuauaaaagaaaaaucaauaaugucuaacauauauuuaauuaaaaacaauauauuuaucauacauacuauauuaaauaucgacucuuuuauauauaguaauauauaguauuauaugcauacaauaaaaagaagcauaacuaguuggggagagaaaggggacaguggguggaaggagaagggauaagacacagaugagggagaauaguaagaaagcacaauugcccauuauuuuccauucuauuaaaaaauaauaaauacuguacacaguaaagcuaucuuccaaaaaugaaggagaaaugaagauuuugagugguaauaaaaauaaaaaacaacaaacaaacaaacaaacaaacaaaaacucaggcuagcagccuggggauauagcucuagcgcagagcacuugccacgcaugcgcagagucuuugauuccaucuguaccaucucaaaaaaaaaaaaaaaugaaaugaaguaaaaaaggcagaccugggccucacucacaauuugaauagcugaggcagucaccccuccccuucuaauuuucugaaugggcacagcuccucggccgcucucaccgcucucacuggcuaccuccauauacccaauguagguguggaaggggagagaagcaaagcacggagcaaggucaagcacuugcaugaggcagagagugggaccagucacgcacugugugcaugccauaaacauaugucauauauacugaagagcugggccaacuguauugcaucaaaccacauucagagaucuaaggaugauuuacaaugccaaaucucucucuacauaaauggauaucauuacagauccacauucuuuuucuuucccaaaaaaaaaaaaaaaaaaaaaaaaaaaaaagcuagaggaaacagaaauaaucguagagucaccaguuuccacaagcacuuacaguagaccuccaccuggguucucuuuuccaguguccuuugcagacaggucacagcgcacagguaagaguguucauccucaaaacccacagagcucaacacaagcguggauuuggcccccucauuccuuaccaccccauugaggggacugucugucuggguucuccaagaaaaagaaggggagucacagccaauagcagcacacgucagaacaaccgaauccccaacuugugcagccaccugagauccgggggagaugucaacaauaaaugguuucucuggaggagaagaaaaggagaaaggaccgcaugacuuacggauaagauucuuuuccuauugugucauauccccauauucaauguuuaucuuucuugaucucucuucagcuacucucugugccaagaagaaauaacuccuuuccaucuuggagccauuaggaggaagaccacaucuuuuaagaguuaaacccaugcuguucuguugaaucaggcuaucagaacaaguguagauagcaauuuguaaagaaugugguuggcaucuuuucagggagauaacccacccucugcucuacacaguccaucaagucacuaugauggugcaagaccucaaaucaucccaggguuucugugugucaaauaccgcaauucagucucauaugcgugcauuaucucacucaauucccagaacaauuuguuagcugggacuauuguuucuuuucuacuuucccauucuucugcucacaggagaauguguuuucccauucuguuccuccaucuccucauccuaucucuucuuuaagacauuuagacucagaaauacuaaauggcuuaaacuaaauuugcaaguggaagaacugaaacuugaugugagauaggucugacucgagauccaaccuuuucuguuucuagaaaacuaaaucaagucauccucgcacagagguaaaaugaaaucuaaaagaguuacagggaaacuacacuaaaauguccucuaauuaucaagcauucucccaugaauccuccuuguuauuuagcuucauugggccuguggauuguaguauggguauccuguacuuuauggcuaauauuuacggauaagugaguacauacuccgcacaaccaucaaccaaagaacauacaaaggcuggaccuaggccccccacacauauguagcagauaugcagcuugguauucauuugggucccccaacaacuggagcaggggcuagcccugacucuguugccugccuguggaacuuauuccccugacuggggugacuugucuggcuucagagggagaagaugugcucagucuugcagugacuugaugugccaguguggguugguacccaggggucucuuccuuaucagaagagaagggaaggaagaugcagggaggagcuaugugagggugacagagaagagugugguggucugcgauugggauggaaagugaaaaaauaaaguaauuaaugagaaaaaagaacuauucacauguaucuauauauugaggguucaauauaaaguaguaucuuugacaaucauacagaaucauacuguagacaaaauaaagaugacauuaaggugacaucaaauauguuugaugcauuaucaaaauacuuuauagucauucaggguugaaagcugagugaucaggacuaacauucaaguguccaaaguguucucuagcuuccagacacucagacucggaugaaaugacauauuuugagagaaagaauucuaaaguuuguuguuguuccucugaauuccugggaguggcuagacaacucugcaagugacaaaugaauccccaaagaacgucacuagaguguucuagcaagcuguagacaggcagaaaucucagcauacaauucuccaguuugcaagguucuuuucuguaccaggaaaaguugccguucucauuuuaguuugcauaauugcgguauuguagcauuuuuccaaagaagauguccucaaauuaucuccaaauacauuaauaugcuauuauauuuucaaagauauuauucaacacaguggcuaaguuguccaaguuccgccuaugcuacugugagaacagggaacuuaguaggagauucacuuccugucuguaaagagacuggcaucuaccacuguguaugcuugaagcuacuggacagaagcucuugaaagucgcugaaaugcccuucuaacuucagcauguaagguugauagcucacaugauaccaccccuuccugugcccagaaugaauuuuucccccauuugaaacagggccaaucauuucagaaugcaaccaccucaggacagacagcaagcuuuccacacauucagcuuucuaguaucuucucugaucauuugagaacagcagccacccaccugaauuaaguaacugaugguguuugaauucuacuuucuuaaccauuuaaacuuaaaauccauguuuucauagguuagaaaagaauguguucuccauauuuacaguucauguuuucauucggcaaauauuuacuaaacacuuacugugugucagguacuauacuagccagccauaaauccauucaaaggcacaaaugcaaacacagagaguuccugaguuucugaguuuaggaaccuuguaguuaauggacaaauucaaaggcauacuuuuuuuugugcucuuacugaaguauauacuuugauuuauucauuccacauuguauaaauauaccacauaucacaccauacccaauguaugcaugcaguuuugauuggucaauaauuuuuaaaaauagagaaaauuagcuacaauugaaaaggcauaggauuuuaaauuaagaacagcauauaaaugaaagaaagaaccauuugaccccaugcaaaugaugaauuauauugcgucugaguuuuucagcuuccucacagagcaagauaaagacagagauaacauaugaaguagaaacucuuggcaaacauuagguguacagucaauugauggccauuaguaaucugagacuucauucucccaucuguaaaauggauagaaaaugccccuuaguuauuucuuagaggcuguagauagcuuauauaaaaugccagaaauacagcugauguuugaggaugguuguuguuuaagaaaaucuugcaaaaucccaaaugaaaaauuauagacuuagguaacgguaagacgguugguuggaaaggaaguuaggucauaggaaaucaucuugaagcagaguggucaagauuaaguaauuuugaacaggagcauauauucagucaaaacaaguauguggcaguggaauuccugaguaugugcaaugagaagagcaggugaaguaacaugagaaugccaguauccacagggcaggagaggcagaccacgccaugaaauaaaacaacagcaaaaugacaagagcuaguaaaggacaaguguggaggugcuggagaaagaaaucccaggacagaugaggaggauauguacaucugugugcugugugcugaagcacaugacuuucagaugcgccaucaugcaaagcuacagaaggcaugucaccauuggcauugagcugcuauggcucaauccccaacaauggcaccucuucaccuucuacucaccuugaacaacuaauuccacuucugcuuugucucucccaaucagauuaacuccuucacacacauagacuccagagucuuccauccucauagcaauuaaggugaggguggcauuuccugagagaagcuggagaacuucauuaucuaacuuccugccccagaaaaucucaggagcugguagacccucgcuggaacaggucauugucacagcaccacccucuugaagccuuguggagggauguacagagaucguuguauuccugggagagacugaaaggcagagcauaggaagagccauuaucauaaagaaccaucuccauccaauggggaugaugucauucucuuguagacuguauucuugugccuccacagauuuggcaaaacugcucugccaaguuggaguuaagaaucaccgagucauuacgaaauuagacuggcuacuuucuaaccaguaaauuacaguuuuugaucuuuaauauuuucagggagccccagauagguagaaauuaaaagaagcccuuaaaauuaagggaaguuaaggaaaucccuuuuguguuucagccucuuaacaacugaaauccuauagaggaauauuugccauccaggucagcuucagcacuuuacggagggagacaaucuacccaggcccaaccaauuggcuuuuauugucauuaauuauugaaaaauucucuuauuuaacugaaauuuucuuggaauaugguggucauagucuagcauucuguucuuccagauaaaugaguaauaaucuuuuaucacacaacugacuuucagugacuuaacuaugcucucaacgugcuguauucugugaggagaaauaucuuccaucuugauuguuuucucaaaagguuguugaaagcgucuucuaucuaauugugcuuuggguaaauaagauuguaguugacaucaacucuuuugaauauagggcucugaguggaacacagcauuucaguuuuaacaaaguacaaugaguuccaugcgacauaguccaguauaggaacagacaggagcuucacaucuaccacaggaggagcuaggagccagaagacaaacucuacaccuucccacuuacugcaugugagcauccucuuguacguacacacacacacacacacacucacacacacacacacacacacagagagagagagagagagagagagagagagagaauaagaaaucauuuuuuuauuguuuaaucugagaaaucaauguuucaaggcuuauuauaaaauguuauaaaacauuguaucauuugagccuauucccucuuguuaaagcagaagucaguguuauaaugauuccuccuggauagucaggaaaauagaggaauuaaacaacccuaaagucucucagcuaacaaggggagaugacacucaagugcucuaaaccuaaaauccgguguccuguucuuuuaauaucauauccuggauaaauaaugcaguaaaacauauuucuuguuaaucuacucguuaacauuuauuguaacaauaaauaacauaaugcauguccaagaccaaacucccacagaccagagaucacugagcaaguacuuacuguagacuuguaguucuuugacagucucccuuucuuugaguguagaaucaauuuggucaauguguaauuuagcucggcaaacaagagcuuuuccaauauccucaaugacgggaguaaagguuacuuccaaacucuugguuucuagagacuuugucaucucuucugaagaaaacuccugucuguucaugagcuggucacccuugaacagaucaaucuccagccuguaaacuggguaaaugucuggagccaaacacuugaccgugaccggcuucccaaccuccagggggccacugaauugaaucucuggauccuuggggaaagcuguaaagccaaacaaaugcacaaguaggcuuuuggcuucuguugagaacaccucugacuguuucaacacaacggggauccuaacaaauguuuuuguuaauacuaggcuuaauucagcaaagcuaauugguuuaaguagcuagucaugguuuguggcgaacacaggaagcacuuuuuagaggccauuucaauuuuaauucugugacuguuaaagaguauguguuguuaaagaaaagaaaagggaaagccuaauauauauuaaaacugaucuauauauguaacauaaagaaguuugcucucuucuaacuaugaccuuggaugauggagaccacauuucacagauacggaagcuuggcuguagugugacugcagaaccagccuuggucacgcagccaguccauggugaggcugggaacaaagcucacgcuuucugucacucacucugcacugagauuccagugacgccucacaccccauucucuacucuuagugcagauacaguuccacauuccauuugagaagcccaggagggcucagagcgauaucacaaagaaguguuacuauguaagguugccuucagaagaaggagaaugacucuuaaugggcuggcuucugaaaaugagaccucuggcaagaacucguccaccagaaagacauuccuaugcaaucuccccagacugggccuauuccccuaaaagccugacucaguguucuaaucugcauuuuacugaacccagcagggcaacagaacacacgccugcccugcccacuccacacauguacacaagguuuaauccuucuuauuacaucuguccugaugggagcucauuggugucccagcuccacagaauauuacaaucaaacauggaauggagacugaacuguuaaaaucaacaagaaacaagcauucuugcaggggguuguggggcgagagcagagaauauaauugaauccagaaagcuccucacuucucuuuuuuaacucuccaacugaauagaacgugugagcacagggugaaggagcuagaaaugcuuuauuaucuaaaaacauaguauuuuaaauuuccccucugauuauuuauguccaucacacucuucaggaaaugugccuagaauccacacaguuuaaugacagguaauauaagaacucgcuacucuuuccugguauuuauauaacaggaccuuccaaggagcucagaaggcugccuagacauaaacuaugcaugcagagccagcauaauugaaagcagccguccaggcucagcugcuugggaagcccagcuucaggaggggcuugcugaaauuucaauuaagguucauuggcaaaguugggcuggagcacaguaggaagguaccaaggugauuaaaagaugaaucaaacaagaugcucaugaagaaaugccuuaugggagucucauuucuuucuuucuuucuuucuuucuuucuuucuuucuuucuuucuuucucucucucucucucucucucucucucucucucucucucucucucucucucucucucucucucucucucucucucucucuuucuucuuuuuggaaagcaacaccaucaguaaccaaagaaaaaugauuccuauagggcccauuuccccccaccucuccuugguaguuucauuugccgauuugaggaugauaguaggaugcauuuuggguaggcuaggguaauauggguaccugcacauaugccugagacagaucuaacuuauuaaacaaaaacucucugagauauaaaagcaaagcucucuggcagcaacaacaaaaccucccaaauuuaucugcaucaaaugacugaaauguuaauagauguuuuaauuaugucuaugcagaagguuugcauacucucagaguucccgagccuacaagcagaucccagaaagaaggaacucaucaauccuuuggauacauuaauacaugaacguguagaaauacccccaaauggaagauuagaggggaaaaaacuaacuaauagaaccagggggagguucacacugcgcuaagaacuggagccaagaaggugugagucucuuuuacaugggcaccauuuuuuuggcaaacaaggacacagggguuaaaauuuaguuuccuguucuuaacuagcuucuucuuucucuggcuuuauugaaauugugcauuugcuagcuaaaaaucuagauacucuuuaaaagucucuguuuaauauaucguuaauuuuuuuucaaacaaaaucaagagaaagcaaaagcuccuuccuucacuuacaguagauguccacguggauacuucguuccagcuucccagagccacauguugcugugcacagguaagaguguucauucucaaaacugacaggcuccauggucagaacggacuuggaccccuccguccucaccuucgcguuuagugggcugucuaucuggguucuccaugagaacaauggugacucgcagcccguagugcugcaagugagggccauggagucaccgauuugagcaaucguuuuguauucaggggagaucucgauuuuaaaagcuugagcugaaaagagagagagagagagagagagagagagagagagagagagagagagagagaacaaguuuaccauggucugccccauacuguguccuuuuucucuugcgcagcaauacaguguccaaagcacagcugggaugaucuacuuuuuaaacugucucagacuaauagcacaagacagacccaaagcccugaaguugcucuugaggaaggugcuggaaucgucaccgcgaagaagaaugcucaguucugacuuugaagcccauugcacaaaguuuuuuuuuuuuuuuuuuuuuuuuuuuuugucacuuucuaagcuugauuucauugucgaauacaggaaacuaaagagauagacccacuaccgauauaauccaaauuacucauuugacaguggaaagaaaauccguccccagcucugucagaauacuggcucuuauagcaaagcucuguaguacaccagaagcuguagaugugugaaauaggucaggaacuuacagacugcaaacaguauccaaaguaccguugaggcucccaagaccgcgaccaucuucacaggcauuucaagucucugcuucaaagccuucuuugugccccacgugaaaagugucugggaaaaguguucagccuccaaagccagccgggcuggugugagugaaauagaaagucugcucuuuauaaagggucuugcuagagaggcggagggaaaucccuucaaggggaaacccagagccagggaaaaaguuuaacugacagccagccaaguccccacguuaaccccuucagcugcuuucugggcugaagucauucugaguccugggaaacacgacacuuccaaguauauaaaucucuggcuuuuccugaccuucagcuccgaaagggcuaucucuccugaaaagaugauugcaaaaugaaacu

SEQ ID NO: 1684 - RNA, 19248 nt, Mus musculus
auuuaggguaugaacaacaauuuauuuauaacguuaggguaugauguuaauauugaaguugacuauuacacauauucauuacguuugaucguucacugucuauaucuggggagauaucccacgagcuuaacaugauggagcauucucagcaacugacagugccaaccuccaucuccaaagacucaaguccugugguagcugacgucucacucacuguguugcagcaugcaugggcuaagucagugcaacaaggagguagagcguacgugaacacccuagagguguggauuugccaucccaauuccuucacacucgaugacguaaguguccuuaguggcaucuucuuccucuucugauuucuucacgguaaauuuggccugaaaauggaacaguaguaagugaauacacaugagaggacagagggcgauccuaggauggaaguuaaggagacagaguuaauaucaaacccaucugaaaaagguauacacauaaaaaucaagagauacgugaagaaaugcaacccuucuuucaugcugggaucacuguuguggaguuugucaggacagagaaucaggcuccacuccacgcccacugacuggggacaggggacaugugggagcaggggacaugugggacaggggacaugugcagccaagucagauguagauucugaagcauugccuguugcuggcgaaaaggcaucauuucucuucccuuuuguuuuucuaaaacauguaucugaaccauuuaccugucagguaugacauuauuugcucucauuaaauuuuuccugccaauuuaauucucuaaauacauaauucaggaagcaugcucagaaaggguagguagggcggaggaguggcggugacuaaugcccuucagcaccgagccuaacacuguaguucucacuuauuagcuaaaguagcucugaaauaugugaucuuugucgaugcucuggaagugccauuuuaaaggcaaaggcugauccuuucaacaaaauaauuuaagucaaaacaacuacauagguuuaagauucugagaaagggauuucaagugugccuuagcuucuaggagucucuaaaguacaaucugacaccauuauucuguggccuuccugaccagcaguggucacaagcuuucaauuuccauacauggaacagugcgccguguaaguggacaucucaaaaucacugugccaugacaaaccagaacacagagcaaaagaaccaaacuccuguauaguuauuugucugcaguuucaaauuacaaacaugaaaauauaaaacacaagcaggagacugggagccauuucacguuuaugcuuaggccuacugagggagccuaaaagaugguccagcugaagucucugauuuuuacagaugagcuauuuguaaugaagcacagaaaauaaagauacuauggcauaagucacccagcaaaguacaacaaagagccagguguaggugguacagaccuguaagcccagcaugcacagggcugagguagaaaaaucuugaguuugaagccagccuagacuacacuuaguaagaccccuuuucagcuacuccccugccucugaccuacauacacaguuaaauaagaaacaagggucauaaccccaguucaggaaacuuucuguuguguacucucuucaaguaauauguaaguggcuacaaauauacaaaguccuguaaaacuguaggcuacaaugaauaaagcuuuguaccaauuagcaaggacgcuaaucuaugagagagaaaacaacuguaaacacagcauaaguagaaaugaaaguaacugaagggggcugaaaggacggcuaagcacuuaagagcacuggcuguucuuacagagaacccagauccaaucccagcaccuacacggaggcucacaaucacuuacaacuccaguuccaggggaguagacauucucuucuggcuuuucagagaaccaggcacaaauaugguacacagacauaaauguaggcaaaccauucauacauauaaaauaaaauagaaauaaauguaaaaauaauagggggcuggagagauggcuuagugguuaagagcaccgacugcucuuccagaggaccugaguucaauuccuacaaccacacuguagcucaugagcaucuguaaugggaucugaugcccucuucuggugugucagaagagacugacaguguacucacauacauaaaauaaguaaaucuuaaaaauaauaauaggacggagcucauugaaagcaugguugcccgacacacaaaaaucauugguuugauuucccagggcaauaaacaacaacaacaacagcaacaacgguaaaacagucaauucacgccugucuuggauguaaucuaccuuugauucucaucagguuuccugauuuaagcaagaccuucccauuucuuaucccaacagcaacuaagaagagcagaggcugugaacguucagugcagagggagaagcaggcagagggagaagcaggcagagggagaagcaggcagaggcucugugugagccaaggcuguggugcuuaagcucuccucagccagugaaucacuuuugucgagagaaggagugaggagggcauuugagacagggucuugccauagagcacuggcuggcguugauccccugaacccaggagcccccauccuccugcuucuaccucccaagcaacagaagauaagauugcaccuccaugccuagcucauuaagaauacagucauucucauucucuccccccuacuccgaauuaguccgccugccucugccucucaagugcuggguuuaaagguugcgccacuauaugccuuaggguggguguguguguguguguguguguguguguguguguguguguguguguguguguguguguguguguaugucuuuuuuacuugcuuucuuguucauuagaaaggugugaguuggaagugugaggagcagagaaggaucuagaagaagagguagggaaaccaugaucagaauauuuuguaugaaaaaauuacuucaauugaaaaaaugaacugaaagaagacaacucuguagggacugugguguaguucuucugcacucuuuuucuuguucuucuuguucucaaagucuaucuuacagccuagguuggccugaaaugugcuacauagacagagcuggccucugacucucaagugacagguggcagguaaucacugccaugccucaugugaauuacuuuuauaaucucaaagaaaaggcggcaaccccauaaaacuugagucacaaucuuacaaaauuauauuagagaauacagucauugugugugguagcuccugcugcaucuaagaacucccuguaggcugaggccagaggaucacaaguucuccuggucuacccaggaaguucaaggccaggccaaaauauauacugaggccuugacuaguaaaacuaaacuaaaaccaugcaaaagaauaaaaaugaaauuccaaaauaaaaaaucugcuacauuuucagaaaagaagcuguauguauuagcaguaauaagcagugagaagcaauuugagaagaaaaagaacaguggcuuuacuagcuaaagggaacaauguuuacauuuucuaugaaaagauuagcauuaaucucacuugaaauuuauauuauuauuauuguuguuguuguuauuauuuuagaccagaguacuaaagaaaagguauaaauguauuauuauuauuuuagaccagaguacugaagaaaagguauaaacgugagcucacacacuagucaggcagaaccuucacugaugcacaggacuucaggcuuccaaacuguccugggaugcucaaaacccaggcugcuagcccgaagcacaggcgucaaagcaucuacucucugcucgcucuaaucgcccagugugucaggagacagaagccgaugccgaggcugcugagagcucgccacucagggagcccaggagcagcgucaacggugguuacugcuggguuccuguuuauuaacccagucagucucucuaacaggacacucaccuuugcuagcuguucagcaaaauguauagcagucugcguguggagugugacugauccuguuuuuauucuggaaauuccauuggcuagcgccaugaaaauaaucagcuaucaaaaaagaacaaagaagaaagaaaaucucaaaaauaugcuaauauucagauuuacaaauucuacaaccacucacaggaaaaugcuacuagaaaucaaaauagcuuuuaaaagaaauuaaaagaauaauuccuauuuucuuuauguuucuagaagcuuuacacaguaacagagaguauguauguguuaaccacagucuguggcuugguaaaugcuuagccagacugacuucuuuucuuuaguuuuuugguuuuuuuguuuguuugguuugguuucuuuuuuuuuuuuuuuuuuuuuuuuugagacaggauuucucuguguagccuuggcuguccugaaacucacucuguagaccaggcuggccucgaacucagaaauccaccugccucugccucccaagugcugggauuaaaggcagguugucaucaugccuggccgauaagacagacuuuuaacaauuuauguuucagaauaagaugagagagcuggacgcucauacacuuacuuagaccaaauauuucugaagcugcuguacaugacaaguuuuuauacucuucaaaaaucccauuuuaaaagauaaauggagucuacagaauuccugggaacauaaauuuaggaagaagaaaaugacuaaacacaaggaaaacugucuccagaaaauggucaagaaauaccgaagagcccuccucuuccuucucccucucuucuugcuucugaggagcaaccacaagacuccacccacaguaggcaggagagccagaaggacggagaaugugaggguagagaacgagaccuugucucaaaagaguagcaguccaaagagucaacaccgccucccaaugggcgucaacucuagagacccuuuguguuugagagaacaagagagacaaaugugucuggauacuugauggcacaauaaaagaaauuuauaugcaacauaauuauguucaaaucugucaggaacaugguuuugauccuaacagugucguuaccuggucuuguagauacucauccacagugccaccgugucuaagguucgcuaauagcauuucagcagcuucaaucccaaccuugucugcauucacaccuaaaacaggagcaauaauaaauaacaacaaauuacucccaagucaccaacuuuaccugaacugaauaaggugacauauacuugaaaccccagcacuugggaaccuacaauacaacugucccaugugcaaggccagccugagcuacagagugaaauuuugucucagaaaaacaaucaaucaaaaccuuuaacugauauaucccaauuagcacugauguaacauuauuuucaggcgucuggaauuaaccaaugcccuuuucaggaaggaucucaaugcuauuuaaucuuaugaaacuugagaaacgucaauguuucaaagcaaaaguggggaaaaauaggucguuugcuauccacuaaaaaaauauuaacuauggagccagugagaugguucagcgagugaagguacccaaggcuacgccgaugauccaaguucaauuccgaggaaacagugaggagagagagcuguccucugaccucagcauggcccuggcauccauuucuuaacaguauucaugggcuggacauauggcucaaugcaugaacaccugccuugcacggugaggcucuaacuuacccagaacuaugaaaaacagguacaaaaacaaaacaaaacaaaaugcaggcuuuggagauugguacagucaagagcacuggcugcucuuccagaggacccagguucacuauccagcacccacaugauagcccacaacugucugcaacucuaguuccaggaaaaucaacaccuucugcucuccccagguaccaggcacaaagugcuacagagacauacauguaggcaaaacacucauacauaauuuaauuuuaagaauuaauuauaaagccaguauauaacaaaauuauaacccaaagcuauaccucaguuuucaauuuaaaacuugugacuuacacaaguuagaauuggucacaauuuaaucagaauugaagacuuuucaguauucucuuaaaacgggacauucucagauccacagcugagcucugcaacacuucagaaaugaauacagcaugcagcuacauguucaugacugggccaccuagcagaggguauagacucgaggucuacaacuugcucaaaauacagaguugaaaaaaugaaaaauucacugacucuaaaauaaaauuaguugacuaucuuuuaaguaugucagucaucauucuugacagucuauacuaaaaacauaaagauuccuccacuggggcuggagcucagcaguuaagaucacugagugcucuuccaggguuccugaguugaauucccagaaacuacaugauggcucacaaccaucuguaaucccucugaucugaugcccucuucugguaugucugaagacuaugacaguguauucauacauaaaauaaacaaauaaaugaguaaaucuuuaaaaaaaaagauuucuucacugaugauggcauuuaaagacaucuuugcuucauguauaccucuuuugccaagugaugauccagcaaacaagcagccaguggaugucucagcaacaaugcuacauaagagggaaaaagugcaauuacccacacuguaauagucuacauaccaugcaaauacgacacaagaaaccacuuacaucuacacugcaauaaugaaauuccucccacagacaauaaagucaccaacaaucucagggggcaggaggauuccuuugggcaaaguucaggagacuaaacuacucacaugagugguagagaaugccaccacccuccccuucagguuauucugccauuagcucugguuacagugcacaggauaaaaagcacuuuacacagacuuuaguuguuuuguuuuuaagguagaauuauagcaaagaaggcaaguacuuacuuuaaacuuuguaaauuucugaauaaaagguuugaaauauaaguauccacaaaauacuguauuucuacacuuuaaaaauaucaacuaaagaauuuguuugauuuuguucuugauucucuguguagccuuggcuguccugguccucacucuguacacuagucuagccucacucuuucucugucuccugggagcugggauuaaaggugugcccaauuaaagaauuuuuguuaagacuuaacuccuaacuggcuuaacauaauauuuuuaaaagacaacauuaccacacuaaguaauuauaaaguaauuucaaaccuaagguaucuuuaaaaacgaaaaccuuucuguugguguuaguuucaaagacuaccuucggaauagccuaaauaugagagaagccaauaaaacugcugcugcagaggaaccaagucaagcaccuagcacucacuuagggcagcucacggcugcuuggaacucuagcuccaagacaccugaggcccucucugaacuccacagaugccugcauucauacacauacccacagcuaaacacauacauaacuaacauaauaaaaauaaaucuuaaaaaauuuauguucaagcugggcgugguaguacacgcauuuaaucccagcccuuggaaggcagagggaggcagauuuugaguucgaggccagccuggucuacagagugaguuccaggacagccagggcuacacagagaaacccugucucaaaaaacaaacaaacaaacaaacaaacaaauuuauguucaggcuggugagaaggcucagcaguuaagagcacugacugcucuuccaaagguucaaaucccagcaaccacauuguggcucacaaccaucaguaacaagaucuaacgcccuuuucuggaguguccgaagacagcuacaguguacuuauaaauaaauaaauauuuuuuuaaaaaauuuaugucauuacacuuuaaaaauaucaacuaaagauuguuccucaguauucauggggaguccauuccaggaucuacacaaggauacugaaauccaagggugauuaaguuguuuauuuaaaugguaucacaccaauuagcucauauuuguaauuccaacacuugggaggggagacaccaggauugcuguaaaucugaggccuacaacaaacacaaggauguagaaaacauucgggagggggugggagcaugaccuuugucuuuucuccuuuuugauguuguacuuuuacauucugauuuaaggcaguauauuaauuuauuuauaauuaauuuaagguaguauauuaauagacagcccggcugccuuaaaacuugcuaugcagaucgugucuaagcuacccucaaaucugugauccuccugccccagucucuugaguuugggaaguacagccauguaagaccaagccuccacaaugaucacagugauucacugaacugcuguuugagguaggaauggccuuacacauacacugcagaacccuaagccgagcgaaugcacacaacucuuugaugaggacagugucgucagggucucaacuauuucuccgugugugcucacaugauuccacucccauugccgaaggcuuggucccuggccuccugcacgggcuggaugcugacguacagaucccggaucuccuuccggaugcaccgcacagccgccgccgccauaucuuuugcuaccuauuuuggcaaaccagaaaaggagaacaaauucgucacugguuauuuggaccaccguuuuuauuccuucaaaaguauuuaacguaguuaacuuuuccacguaucauuuuuacacuucuagaaagagcacuaacuucuaagaaacauuuaaaugaagacacucaaauuagggucugggaacaggagugacggcucagucguucagagcacuuguugcucuuucagaggaucuggggucaguuaccaacauccagaugguggcuaacaacaaucccuuaaccccagguucacaggacuugacccccucuucugaccucccaggcaccagguacauaugugguguacguacauauaugcaggcaaagcgcaugcacauacaauaaauguggggcuguagcaacggcucaguaguuaaaagcacuggcugcucuuccagagaacccacauucgaucccaagcaccacauggcagcucaccaccaucuguaacuccagucccaagggacccgauacccuguucuggcuucagaagccacugcauauacauggagcacagauauaugugcaggcaagacauaugugcacacaaaaauaauaaaauacaaaaccaaaaaacaaaacaaagccaauaaacaaaacaaguaaguaggggcuagaaagauggcucagugacuaacagcuuugacuacucuuccagaggagcaggguucaauucccaguacccuacccacauggcagcucacaaccaccuauaacucaagguccaggagaucugacucccucacacagacaugugugaaggccaaacaccaaugccacauaaaauaaagauaaaaaucuuaaaaauaaauaaauuaauuuuuuuaauuaauuaaaaaacaaaagcucugcuaguaaaguagaguacaguuuucaucccagcauuuggaagacagagacaaguggaacucuuuugaggccagccagauguacaugaugcguuccaagccagcuaaguaagaccaugucuuaaaaaaaaaccaaacaaaauaaauacauuucuagagauggcucaguggguaaaggcacugcugccaggccugcugacaugagagcgccccagggcucacaugacgagggagagaaauggcuccuuuagcugaccucuuuuaccuuuaugaacacacucugacaugugcccaauccccacuuccacauguucaucuuggaaugcagccuaaucccuauccacacuaaauaaauacauuuaaaaaaaaguucucgggccuggagagauggcucagugguuaagagcacugacuguucuuccaaagguccugaguucaaaucccaacaaccacaugguagcucacaaccaccuguaaugagaucugaugcccucuucuggggugucugaagacagcuacaguguacuuacauauaauaaauaaauaaauaaauaaauaaaucuuuuuaaaaaaaaaguucucgggccaggcaugcagcucagguagcaguguguuugacuaguauacauaaauucugggguuuacugggucugugaauucaaggccaccaucagcuauaucagagcuauguaagucucuauuucgagaaaaacaaacauuuugcagagaaacaggagcacagaaaagucaaggccaucuggucuacccaggaaaauucaggcagccuggacuacccaugccacgcuguuuuaaaacaacaaaaaccucaaaagaaagaaaaauaaaaccucaaauugucugaggcucuuguuuugaaagaaaaaaagaguacucucaaaaucaucaaggugucccuacacuucuaagagcacuauaacaacuuacuuuuaguggcaaaacaccggcaacaaaagcucucccauaaaucuuggucacagagccucgaucagucagauuuauuggguccaaucguuuaacuggggacacucggacaaucacuucaccacccccuuugggguaauagccccuaggaaaaguagaacaaauauaugcuccauaacugaggacagacaaaguaaggcuuaacaacccauuacaguaacagcaaugauaccaaaagauauaucauuuguagaaguucaggaaaaggucuguaugaucucugcaaccucagaugccgacucuguggucucaaguuacacgugaauacugaaauuauggccagaaguauaacucagagguagcuauacuucacaugcauccuuagcgugugcaugugaggcccuggguucaauccacagcacucaaagcaaucauccucccagcgacaggcucaacggcuacugcacagugacuacugccuaagacagggcaggacacgcuccucauuacaguguuggcugagagcauaagcucugucaacgcuggcucugcuaguuucuacuuccucggccuaaaacagcagcuggcacauggcacucagauuaauaccugaggaacagcuaagcagaugagcaguaauaaaauuuuaacuguccuauucauuuacugcagaugcugagaacugcugugcuuccauuccaucuucaagaauuucuaccugguaaggagaugguguaguuuacaaucuacuuagaugauaaguaugguugcgaagagguuccaacagaggaaugcaacaagagugaaugcauucaccaacaguccaaauaagaaaucauuauuuucuauuuuuaaauaugauuucuaauguuuaugugacaggggauaaauaacaugaauuuaaagguacaaaguaguuuaagacagcagauaaccaaguuagaauauaacugugugaaaguaggaaguaagaugaaacuggacaggaaaccuggggcacugcgaccauaacgcacuaagccccaugcagaacacuuuacucuuguacagcacaggacagcuuacagagacaucccuaaaagcugggcuuucuuagaagucaauucugacuucacuguggaacagacucuuuacgaucccagagugccuaguguaguuguccacacacagugagugaucccuuaucgccuauucagaggcauggauaacacuagcugugaagaucuccauguagaaauugccaugaaaguauuucugucaaggaacaaaugaacacuacugguggcugguaagguccuacagcucuacaguuaaugucuuuaagccacaaaguacaauuauuuucuguaggaaauauaucacaaaacacaaugcauuaagaguaucugaguaaacguucucuaaaucuaccuuuugcacuauuuuuggagcauguaauaaauggaaaaaguuaaggguuggagaugaaacucagcagcaggggcuggccuggcacgcacaagcccuguguuggguucacaguacugccgucagaaggaagaggaggggugcugagaccgagcaacuuaccucguuuuaaugucacaauuaaaugugaaaccaaacuucucagcaauuggcuugaaaaccugaaaaagucaguuguuccuuuaggcagcaguaugcacagauucacuaaguucaaucacuuaugaaaaccgcuaugcagugagcuagcuagcaggugcugcagauacaggaacaacagagacugacaccaacccuaucguucaaacaaguuacauucuaacuuggucacauagcuacacguuuaacauuuacuuaaggagacugucaaaucuauguaauaaaaaacagcagcuccacacacugacccuaggaaugacuacagggcggcccuccccgacccgaucaacacagugugcacuaagagccuuaggaggcuacuggugaacagccuuccacucugcauucucaauuucucaauacuguugaaacuuacuagguaggcaguguuuuaccauagcuuuuuucucauuuccuauuggaaacaauauuucaugacauacugaguuccucucaagcaauauuuaaauggcaaggcacuggagcagaauuuacagaauuuacucuaaggcacugacucucaaccuuccuaaugcugggacccuuuaauacaaucacccacguuguggugaccccaaccauaaaauuauucaguugcuacugcauaucuauaauucugcuacuguuaugaaugguaaguaucugauaugcaggacaucugaucugugagccccuaaaggggcugagacucacugcucugaggcaucacccucuaaggcacaugucauacaaugacaauuacaguuuaaacaaggcuaugcucaaguaucuuuaacauucauccuucacuguaucuuauauuuaguuuauguaaaguauuguacuggcuagcugugugucaacuugacacaagcuaguuaucaucagaggaaggagcaucagcugaagaaaugccuccaugagauccagcuguaagacauuuucccaaguagugaucaauuggggagggcccagccuauuguggcugguaccaucccugggcuggugguccuggguuuuauaagacaucaagcugucaagccaugagccaguaagcagcacccuccauggcuucugcaucagcuccugccuccaggauccugcccugugugaguuccuguccugacuuccuuuggugaugaacagaaaugugggaguguaagcugaauaaauccuuuccuccccaacuuguuuuuuggucaugguauuuuccuggaagcaauagaaauccaaacuaagaaaucuuuucuuucuuuuuuuuuuuuuuuuuccuucaagacaggguuucucuguguaucccuggcuguccuggaacuugcucuguagaucaggguggucucaaacucagagauccaccugucucugccucccgagugcugggauugaaaaagugugccauguucaccagguugaaaguagcuuuuauuacaugucuccacacacugaccaaagaugauagcacccaucagaauggcaggguuucagaaaaagaugguguuuaaaccuaaagccuugaaaauauaugagaccuauggagacuuuuacucaguuccccagacuaucaccauaugugucaaagggauagacuaaaugucuaugguuuugcuuuuucaucaaacacaggaguggugauguagcccacagcagagcaguugccuaacguguaaagccuugguauuuucuccccaaacauuucaaaacucaauuuaggguggggguguuaaagcacagaggcucuguaucuagugcuggguaagaugcagaagaaaaggagcucucaugggguaagaaaaggacagggcuaaaaacauuucaguagucucuagugaauuuguucaaaacugacaaaugauggaggcaaugcaagggccuucgacucaugcucagcucagaguuaagccacuuggccuuuacuggagagacacggagucucaaaauauaacuggggaggaaaaaaaaaccugucccugagcuggcccuggagauuggugggcaguguacuugccuugccuugccuugccugugcucacacuguauccacuggccauggcacugggcacacuuuuaacucuagggcucuggagguagaagcaggggucacaaguccaaggucauccucuguacauaucaaauguaaggccagcccgggauacauaagacccugucucaaaagaggaaaacccaccaaauucuaaagccacguacagcauuuguauuuuguaugacauugugaaagggcagaacucagaacagugguuggcaguagcuggggacaaaacuagcuacaaagguuuguaauuuuccuucuuucuuuuuuaauaaaacuuuuuuuuuacccucacuuugguucuggaaaugguucacagauauauauuuguacaaaauucuuaaaaguacauuuaaaggaguaaauuuaguugugaagaacuaugccacaauaaaccuggagaagaaaaaaaccacuaauacagauugaauauccuugccugaagaugcucagagccagaggugcaucugacuuguucagaguccguaguauuugcacaaacacacaggaugcaaacaugaaauugacuuguguuucacucguuauacacagaccuugcacaccgccuuacagugaccugugccccaagguugugaccacagcacaccacauagagucaggugggacauguccaccuacuuggaucaucauguugguacucaaauaguuuugaauuuuauaguuaucuuuaagaauuguguuaucugaguguguguguguggggaggggagugugauagucaagaggucacuuuucaggacuuagcucuggccuuucuucaguucugggagcuaaacuuaggucaucuggcuagcguagcaagugcucucacccaaugagccaucucacuggcucaaauucuggcucacucaguauuucagacuagagauacucaaccuggacccauuuucuuccuuauagacaugccaacacuaaaauaaaaacaggcaauuuauaugauaacugauaauuuacauaauuauauuuuagguccuuaaaaagaaucagucugaacacuaucuuaauuuauaaugcaaacccuaaaguaaaccuaaccugugcccucuccuacaaaagaacuaggaaaugugugaacaggaugucugugaggaugcugccgacauuuaaacagagaccauggcgcccuuaccaucaugguguaaucgaucugcggggccaucuccgcauuggugccgccuuucagacggagcuccgacggggaagccgcaaacaggacacagggcauugaaaccugcaucaagaggcacacacuccuaaggaaaaggcagaauggcuucacuggacugucguuugagucucagaacagcuguauuuguuacugcacgccagugugacuugaagcucagacaacggaaaaguuagaaaacauuucagugucugaaggguaaaaaaaauccugacucugacggaaguauuucaaagcagaaagacaaaagcaaacugugcugagguagugagucaacgguaaauggcuucagccucucauuuguaaggccuugguugaguacccaacaucaccaaaaaaaauuaaguuaaauugaaaauaaaaacauggccaggcagugauggcgcaugccuuuaaucccagcaccugggaggcagaggaaagaggaucugagauugagacuagccuggccuacagugugaguucaggacagccaaggcuauacagagaaacccugucucgaaaaccaaaccaaaccaaacuaacaacaaaagaauaaaaccuucaaauuuuuuucucaaagauuuccugaaagcagcaguuuaugaaaaugcauuuggaacagccaagaccuacccccuuauuccugggcuguugcugucaccaugcacaggacacuacucaaguaucaaaucacagcacuguuccucccaucagagaauucaugugacuagaaacagaauguuuaacaaggaguuuucuccuuauugucgacaugaagaaucacaaaacuuaggcacagaaugugaaguguuuuuaaaaaugaaguaucuagucagauuuuuaaaaugaauugcuguucuugaaaauaaaaccaaucacaauaaacagaguuagucacauagguuuuccccugaccuucacacacacuccaaagcaugaauguuuauacauguguacauguguguauacacaggagcaugcacaugcaugugcguguaugugugugugcacgcacaaacaaauacaauaaauaauauuucuaaaaguuaggaggcauagucagguggugguggcacacgccauuaaucccagcacucgggagacgagaagggggaugucuguggguucaaggccagccuggucuucagagugaguuccaggguuacacuuuaaaacccuguuuggggaaggggggggauuaggaggcaaaagacuuaaauucuaaugucacuucuuacccugacuccaagacggaggcuaagucacuuaacaccaaugggguuugacuuccuaauuuacaauauggaaguuuuagaacaaaugcuuucucuuucagcuucaaauuuugcgacugucuuaauuauaacuaugacuuuuucuuuuuuguauaaaauaacaauguacuaaugaaaagacacgucaaauucuuuuccuugccuuaggaacauucccacuugacagaucucauuuuaaaccuaaucacaggugccuuugccaagaagucugcuuauaccauagguccgauaccauggguuauuaaacaucuuccuaaaagaaccauaauucauuuaaaguuauuucugggcugucaaaagguuuauaauauaaugucuuacucugucaaaugcuucauaacagagcauugcaguuuaaaaaaagguuacuuuaagaagcaaucgggggcuggggaugaaccucaggcaacgaaccuggccagaauucuugaggcagugggcuagcacuccaguaccagacgcaaaauaaggaugcaaucaaccaaacagugcacaaaagcaagcaaacgcugcuuccucuccacagucugucaucgugggacgcuaggaggggcucuuagcaguuuguuaagccacccauuucccaggaggcugaguguguuugggugggguuuuuuaugacucuuguuuuguuuauuuucugguagugggaacuggacacggcaacuuuacacuaaucaagcacugaacucgguccagcuccauccccaggggggagggguaaccgggacagcugggauguuuagagucagcaucucccugcacagcaggagauggaacccaggaccuugggcaugcaaggcgagccuccgacacuuucuagaguuacauggguacuuacuaagacaauaagggaaaaccagguauaguagugacacaggccugcaaucucagccccugggggugggggcaguagggacagggacaggcgggaugaguucaacauuaguguucacuuacagggagaccuugccuuacaaaaaccaaaaagaaaucuguaaauaauaacagcuacaacuaaacaagcaggcuuaucauuuacauuuuaaaaagggagaaaacugaaccucaaaagguccaaagagcacucccucgaagccaaagaaucuacaucugaacccaggucugaauggaggacugagugagacauacauacccugcugucuugguaucugccguguggacuccaccucugaucuucucggggguaaagguuaucucuguugagccgauuucugcucccuccaggugcccgccacacaaaucacgaaccauuuccaguccagauaaaugcugaggccuucaggucauaagacugcaucaaaacgugugccaucagacugccuauaccccacucuaugacaguuacaaaagcaauggccagaaaacaagugugaugucuuccaacaggagaacuuugucuggggcuuuugauuucauucaaugaccaccccgugacaccaguacuaccuaaauuauguacuccucaucccuaaauucccaccuugaggccucaacccacacaaaaugugaucauuuaaacaggccuuuuaaagguacaaucaacauaagggaggcuauuagggggugcgguaauacaauuugacugcuauucuuaugaaaagagagggugagauuagaggaacagggauguaguucaguggguagagggcgugcacaguguggaggaggccuuagguuuuauuuccagaaccacauaaacugggcaugguggcacacagcuguaauuauagcaucugagagguggaaacaggagaaucgaaaguucaagguuauucacccuagcagagaaguuccggauuacccuggacuagaugauaucuugcaagaacaauuaacaauaaaccuaccaugacaagaacauggacaagcuacccuguuucaaggcguccuaaggacaacuagcggccugcccuauggacagaaacggagagcaaaggccgcacucuuaauugccgcccgggccuccuccccccuagaacccgggcuccgaucuccgggcucccaggcccccuacccaaacuccccgcccgcccgcccgcccgcaguaccugaggcccggcgugcugcggcccgcgcggaucuucugcacgcgcaaggguaggcccaggaggcagcucagggcgguggagacccugaggaucuggccgcccuguagagagcaccgggguggagaaaugacagagguugaauggaggcccccgccgccacggcucgccccggccccuagcagucccacacucaccccuuccaugaucccaccguccaccuccacccgcuggcccuccauggcgggcgccucugagcccggccggcagcgaccacgucccugcugcaaccggcaaaagacgaggcgcccgcaagcccgcaggccugauagugcgcuuccgggccgagcucgccggaaggagaaagaacccgcgccucccgggaaacuguugcuguggaaacgaauuccccaggggacccugccggcagcuguacgcaugcgcuccacccagcgcucagag

SEQ ID NO: 1685 - RNA, 19248 nt, Mus musculus
cucugagcgcuggguggagcgcaugcguacagcugccggcaggguccccuggggaauucguuuccacagcaacaguuucccgggaggcgcggguucuuucuccuuccggcgagcucggcccggaagcgcacuaucaggccugcgggcuugcgggcgccucgucuuuugccgguugcagcagggacguggucgcugccggccgggcucagaggcgcccgccauggagggccagcggguggagguggacggugggaucauggaaggggugagugugggacugcuaggggccggggcgagccguggcggcgggggccuccauucaaccucugucauuucuccaccccggugcucucuacagggcggccagauccucagggucuccaccgcccugagcugccuccugggccuacccuugcgcgugcagaagauccgcgcgggccgcagcacgccgggccucagguacugcgggcgggcgggcgggcggggaguuuggguagggggccugggagcccggagaucggagcccggguucuaggggggaggaggcccgggcggcaauuaagagugcggccuuugcucuccguuucuguccauagggcaggccgcuaguuguccuuaggacgccuugaaacaggguagcuuguccauguucuugucaugguagguuuauuguuaauuguucuugcaagauaucaucuaguccaggguaauccggaacuucucugcuagggugaauaaccuugaacuuucgauucuccuguuuccaccucucagaugcuauaauuacagcugugugccaccaugcccaguuuaugugguucuggaaauaaaaccuaaggccuccuccacacugugcacgcccucuacccacugaacuacaucccuguuccucuaaucucacccucucuuuucauaagaauagcagucaaauuguauuaccgcacccccuaauagccucccuuauguugauuguaccuuuaaaaggccuguuuaaaugaucacauuuuguguggguugaggccucaaggugggaauuuagggaugaggaguacauaauuuagguaguacuggugucacgggguggucauugaaugaaaucaaaagccccagacaaaguucuccuguuggaagacaucacacuuguuuucuggccauugcuuuuguaacugucauagagugggguauaggcagucugauggcacacguuuugaugcagucuuaugaccugaaggccucagcauuuaucuggacuggaaaugguucgugauuuguguggcgggcaccuggagggagcagaaaucggcucaacagagauaaccuuuacccccgagaagaucagagguggaguccacacggcagauaccaagacagcaggguauguaugucucacucaguccuccauucagaccuggguucagauguagauucuuuggcuucgagggagugcucuuuggaccuuuugagguucaguuuucucccuuuuuaaaauguaaaugauaagccugcuuguuuaguuguagcuguuauuauuuacagauuucuuuuugguuuuuguaaggcaaggucucccuguaagugaacacuaauguugaacucaucccgccugucccugucccuacugcccccacccccaggggcugagauugcaggccugugucacuacuauaccugguuuucccuuauugucuuaguaaguacccauguaacucuagaaagugucggaggcucgccuugcaugcccaagguccuggguuccaucuccugcugugcagggagaugcugacucuaaacaucccagcugucccgguuaccccuccccccuggggauggagcuggaccgaguucagugcuugauuaguguaaaguugccguguccaguucccacuaccagaaaauaaacaaaacaagagucauaaaaaaccccacccaaacacacucagccuccugggaaauggguggcuuaacaaacugcuaagagccccuccuagcgucccacgaugacagacuguggagaggaagcagcguuugcuugcuuuugugcacuguuugguugauugcauccuuauuuugcgucugguacuggagugcuagcccacugccucaagaauucuggccagguucguugccugagguucauccccagcccccgauugcuucuuaaaguaaccuuuuuuuaaacugcaaugcucuguuaugaagcauuugacagaguaagacauuauauuauaaaccuuuugacagcccagaaauaacuuuaaaugaauuaugguucuuuuaggaagauguuuaauaacccaugguaucggaccuaugguauaagcagacuucuuggcaaaggcaccugugauuagguuuaaaaugagaucugucaagugggaauguuccuaaggcaaggaaaagaauuugacgugucuuuucauuaguacauuguuauuuuauacaaaaaagaaaaagucauaguuauaauuaagacagucgcaaaauuugaagcugaaagagaaagcauuuguucuaaaacuuccauauuguaaauuaggaagucaaaccccauugguguuaagugacuuagccuccgucuuggagucaggguaagaagugacauuagaauuuaagucuuuugccuccuaauccccccccuuccccaaacaggguuuuaaaguguaacccuggaacucacucugaagaccaggcuggccuugaacccacagacaucccccuucucgucucccgagugcugggauuaauggcgugugccaccaccaccugacuaugccuccuaacuuuuagaaauauuauuuauuguauuuguuugugcgugcacacacacauacacgcacaugcaugugcaugcuccuguguauacacacauguacacauguauaaacauucaugcuuuggagugugugugaaggucaggggaaaaccuaugugacuaacucuguuuauugugauugguuuuauuuucaagaacagcaauucauuuuaaaaaucugacuagauacuucauuuuuaaaaacacuucacauucugugccuaaguuuugugauucuucaugucgacaauaaggagaaaacuccuuguuaaacauucuguuucuagucacaugaauucucugaugggaggaacagugcugugauuugauacuugaguaguguccugugcauggugacagcaacagcccaggaauaaggggguaggucuuggcuguuccaaaugcauuuucauaaacugcugcuuucaggaaaucuuugagaaaaaaauuugaagguuuuauucuuuuguuguuaguuugguuugguuugguuuucgagacaggguuucucuguauagccuuggcuguccugaacucacacuguaggccaggcuagucucaaucucagauccucuuuccucugccucccaggugcugggauuaaaggcaugcgccaucacugccuggccauguuuuuauuuucaauuuaacuuaauuuuuuuuggugauguuggguacucaaccaaggccuuacaaaugagaggcugaagccauuuaccguugacucacuaccucagcacaguuugcuuuugucuuucugcuuugaaauacuuccgucagagucaggauuuuuuuuacccuucagacacugaaauguuuucuaacuuuuccguugucugagcuucaagucacacuggcgugcaguaacaaauacagcuguucugagacucaaacgacaguccagugaagccauucugccuuuuccuuaggagugugugccucuugaugcagguuucaaugcccuguguccuguuugcggcuuccccgucggagcuccgucugaaaggcggcaccaaugcggagauggccccgcagaucgauuacaccaugaugguaagggcgccauggucucuguuuaaaugucggcagcauccucacagacauccuguucacacauuuccuaguucuuuuguaggagagggcacagguuagguuuacuuuaggguuugcauuauaaauuaagauaguguucagacugauucuuuuuaaggaccuaaaauauaauuauguaaauuaucaguuaucauauaaauugccuguuuuuauuuuaguguuggcaugucuauaaggaagaaaauggguccagguugaguaucucuagucugaaauacugagugagccagaauuugagccagugagauggcucauugggugagagcacuugcuacgcuagccagaugaccuaaguuuagcucccagaacugaagaaaggccagagcuaaguccugaaaagugaccucuugacuaucacacuccccuccccacacacacacacucagauaacacaauucuuaaagauaacuauaaaauucaaaacuauuugaguaccaacaugaugauccaaguagguggacaugucccaccugacucuauguggugugcuguggucacaaccuuggggcacaggucacuguaaggcggugugcaaggucuguguauaacgagugaaacacaagucaauuucauguuugcauccuguguguuugugcaaauacuacggacucugaacaagucagaugcaccucuggcucugagcaucuucaggcaaggauauucaaucuguauuagugguuuuuuucuucuccagguuuauuguggcauaguucuucacaacuaaauuuacuccuuuaaauguacuuuuaagaauuuuguacaaauauauaucugugaaccauuuccagaaccaaagugaggguaaaaaaaaaguuuuauuaaaaaagaaagaaggaaaauuacaaaccuuuguagcuaguuuuguccccagcuacugccaaccacuguucugaguucugcccuuucacaaugucauacaaaauacaaaugcuguacguggcuuuagaauuugguggguuuuccucuuuugagacagggucuuauguaucccgggcuggccuuacauuugauauguacagaggaugaccuuggacuugugaccccugcuucuaccuccagagcccuagaguuaaaagugugcccagugccauggccaguggauacagugugagcacaggcaaggcaaggcaaggcaaguacacugcccaccaaucuccagggccagcucagggacagguuuuuuuuuccuccccaguuauauuuugagacuccgugucucuccaguaaaggccaaguggcuuaacucugagcugagcaugagucgaaggcccuugcauugccuccaucauuugucaguuuugaacaaauucacuagagacuacugaaauguuuuuagcccuguccuuuucuuaccccaugagagcuccuuuucuucugcaucuuacccagcacuagauacagagccucugugcuuuaacacccccacccuaaauugaguuuugaaauguuuggggagaaaauaccaaggcuuuacacguuaggcaacugcucugcugugggcuacaucaccacuccuguguuugaugaaaaagcaaaaccauagacauuuagucuaucccuuugacacauauggugauagucuggggaacugaguaaaagucuccauaggucucauauauuuucaaggcuuuagguuuaaacaccaucuuuuucugaaacccugccauucugaugggugcuaucaucuuuggucaguguguggagacauguaauaaaagcuacuuucaaccuggugaacauggcacacuuuuucaaucccagcacucgggaggcagagacagguggaucucugaguuugagaccacccugaucuacagagcaaguuccaggacagccagggauacacagagaaacccugucuugaaggaaaaaaaaaaaaaaaaagaaagaaaagauuucuuaguuuggauuucuauugcuuccaggaaaauaccaugaccaaaaaacaaguuggggaggaaaggauuuauucagcuuacacucccacauuucuguucaucaccaaaggaagucaggacaggaacucacacagggcaggauccuggaggcaggagcugaugcagaagccauggagggugcugcuuacuggcucauggcuugacagcuugaugucuuauaaaacccaggaccaccagcccagggaugguaccagccacaauaggcugggcccuccccaauugaucacuacuugggaaaaugucuuacagcuggaucucauggaggcauuucuucagcugaugcuccuuccucugaugauaacuagcuugugucaaguugacacacagcuagccaguacaauacuuuacauaaacuaaauauaagauacagugaaggaugaauguuaaagauacuugagcauagccuuguuuaaacuguaauugucauuguaugacaugugccuuagagggugaugccucagagcagugagucucagccccuuuaggggcucacagaucagauguccugcauaucagauacuuaccauucauaacaguagcagaauuauagauaugcaguagcaacugaauaauuuuaugguuggggucaccacaacgugggugauuguauuaaagggucccagcauuaggaagguugagagucagugccuuagaguaaauucuguaaauucugcuccagugccuugccauuuaaauauugcuugagaggaacucaguaugucaugaaauauuguuuccaauaggaaaugagaaaaaagcuaugguaaaacacugccuaccuaguaaguuucaacaguauugagaaauugagaaugcagaguggaaggcuguucaccaguagccuccuaaggcucuuagugcacacuguguugaucgggucggggagggccgcccuguagucauuccuagggucaguguguggagcugcuguuuuuuauuacauagauuugacagucuccuuaaguaaauguuaaacguguagcuaugugaccaaguuagaauguaacuuguuugaacgauaggguuggugucagucucuguuguuccuguaucugcagcaccugcuagcuagcucacugcauagcgguuuucauaagugauugaacuuagugaaucugugcauacugcugccuaaaggaacaacugacuuuuucagguuuucaagccaauugcugagaaguuugguuucacauuuaauugugacauuaaaacgagguaaguugcucggucucagcaccccuccucuuccuucugacggcaguacugugaacccaacacagggcuugugcgugccaggccagccccugcugcugaguuucaucuccaacccuuaacuuuuuccauuuauuacaugcuccaaaaauagugcaaaagguagauuuagagaacguuuacucagauacucuuaaugcauuguguuuugugauauauuuccuacagaaaauaauuguacuuuguggcuuaaagacauuaacuguagagcuguaggaccuuaccagccaccaguaguguucauuuguuccuugacagaaauacuuucauggcaauuucuacauggagaucuucacagcuaguguuauccaugccucugaauaggcgauaagggaucacucacuguguguggacaacuacacuaggcacucugggaucguaaagagucuguuccacagugaagucagaauugacuucuaagaaagcccagcuuuuagggaugucucuguaagcuguccugugcuguacaagaguaaaguguucugcauggggcuuagugcguuauggucgcagugccccagguuuccuguccaguuucaucuuacuuccuacuuucacacaguuauauucuaacuugguuaucugcugucuuaaacuacuuuguaccuuuaaauucauguuauuuauccccugucacauaaacauuagaaaucauauuuaaaaauagaaaauaaugauuucuuauuuggacuguuggugaaugcauucacucuuguugcauuccucuguuggaaccucuucgcaaccauacuuaucaucuaaguagauuguaaacuacaccaucuccuuaccagguagaaauucuugaagauggaauggaagcacagcaguucucagcaucugcaguaaaugaauaggacaguuaaaauuuuauuacugcucaucugcuuagcuguuccucagguauuaaucugagugccaugugccagcugcuguuuuaggccgaggaaguagaaacuagcagagccagcguugacagagcuuaugcucucagccaacacuguaaugaggagcguguccugcccugucuuaggcaguagucacugugcaguagccguugagccugucgcugggaggaugauugcuuugagugcuguggauugaacccagggccucacaugcacacgcuaaggaugcaugugaaguauagcuaccucugaguuauacuucuggccauaauuucaguauucacguguaacuugagaccacagagucggcaucugagguugcagagaucauacagaccuuuuccugaacuucuacaaaugauauaucuuuugguaucauugcuguuacuguaauggguuguuaagccuuacuuugucuguccucaguuauggagcauauauuuguucuacuuuuccuaggggcuauuaccccaaaggggguggugaagugauuguccgaguguccccaguuaaacgauuggacccaauaaaucugacugaucgaggcucugugaccaagauuuaugggagagcuuuuguugccgguguuuugccacuaaaaguaaguuguuauagugcucuuagaaguguagggacaccuugaugauuuugagaguacucuuuuuuucuuucaaaacaagagccucagacaauuugagguuuuauuuuucuuucuuuugagguuuuuguuguuuuaaaacagcguggcauggguaguccaggcugccugaauuuuccuggguagaccagauggccuugacuuuucugugcuccuguuucucugcaaaauguuuguuuuucucgaaauagagacuuacauagcucugauauagcugaugguggccuugaauucacagacccaguaaaccccagaauuuauguauacuagucaaacacacugcuaccugagcugcaugccuggcccgagaacuuuuuuuuuaaaaagauuuauuuauuuauuuauuuauuuauuauauguaaguacacuguagcugucuucagacaccccagaagagggcaucagaucucauuacaggugguugugagcuaccaugugguuguugggauuugaacucaggaccuuuggaagaacagucagugcucuuaaccacugagccaucucuccaggcccgagaacuuuuuuuuaaauguauuuauuuaguguggauagggauuaggcugcauuccaagaugaacauguggaaguggggauugggcacaugucagaguguguucauaaagguaaaagaggucagcuaaaggagccauuucucucccucgucaugugagcccuggggcgcucucaugucagcaggccuggcagcagugccuuuacccacugagccaucucuagaaauguauuuauuuuguuugguuuuuuuuuaagacauggucuuacuuagcuggcuuggaacgcaucauguacaucuggcuggccucaaaagaguuccacuugucucugucuuccaaaugcugggaugaaaacuguacucuacuuuacuagcagagcuuuuguuuuuuaauuaauuaaaaaaauuaauuuauuuauuuuuaagauuuuuaucuuuauuuuauguggcauugguguuuggccuucacacaugucugugugagggagucagaucuccuggaccuugaguuauaggugguugugagcugccauguggguaggguacugggaauugaacccugcuccucuggaagaguagucaaagcuguuagucacugagccaucuuucuagccccuacuuacuuguuuuguuuauuggcuuuguuuuguuuuuugguuuuguauuuuauuauuuuugugugcacauaugucuugccugcacauauaucugugcuccauguauaugcaguggcuucugaagccagaacaggguaucgggucccuugggacuggaguuacagaugguggugagcugccauguggugcuugggaucgaauguggguucucuggaagagcagccagugcuuuuaacuacugagccguugcuacagccccacauuuauuguaugugcaugcgcuuugccugcauauauguacguacaccacauauguaccuggugccugggaggucagaagagggggucaaguccugugaaccugggguuaagggauuguuguuagccaccaucuggauguugguaacugaccccagauccucugaaagagcaacaagugcucugaacgacugagccgucacuccuguucccagacccuaauuugagugucuucauuuaaauguuucuuagaaguuagugcucuuucuagaaguguaaaaaugauacguggaaaaguuaacuacguuaaauacuuuugaaggaauaaaaacggugguccaaauaaccagugacgaauuuguucuccuuuucugguuugccaaaauagguagcaaaagauauggcggcggcggcugugcggugcauccggaaggagauccgggaucuguacgucagcauccagcccgugcaggaggccagggaccaagccuucggcaaugggaguggaaucaugugagcacacacggagaaauaguugagacccugacgacacuguccucaucaaagaguugugugcauucgcucggcuuaggguucugcaguguauguguaaggccauuccuaccucaaacagcaguucagugaaucacugugaucauuguggaggcuuggucuuacauggcuguacuucccaaacucaagagacuggggcaggaggaucacagauuugaggguagcuuagacacgaucugcauagcaaguuuuaaggcagccgggcugucuauuaauauacuaccuuaaauuaauuauaaauaaauuaauauacugccuuaaaucagaauguaaaaguacaacaucaaaaaggagaaaagacaaaggucaugcucccacccccucccgaauguuuucuacauccuuguguuuguuguaggccucagauuuacagcaauccuggugucuccccucccaaguguuggaauuacaaauaugagcuaauuggugugauaccauuuaaauaaacaacuuaaucacccuuggauuucaguauccuuguguagauccuggaauggacuccccaugaauacugaggaacaaucuuuaguugauauuuuuaaaguguaaugacauaaauuuuuuaaaaaaauauuuauuuauuuauaaguacacuguagcugucuucggacacuccagaaaagggcguuagaucuuguuacugaugguugugagccacaaugugguugcugggauuugaaccuuuggaagagcagucagugcucuuaacugcugagccuucucaccagccugaacauaaauuuguuuguuuguuuguuuguuuguuuuuugagacaggguuucucuguguagcccuggcuguccuggaacucacucuguagaccaggcuggccucgaacucaaaaucugccucccucugccuuccaagggcugggauuaaaugcguguacuaccacgcccagcuugaacauaaauuuuuuaagauuuauuuuuauuauguuaguuauguauguguuuagcuguggguauguguaugaaugcaggcaucuguggaguucagagagggccucaggugucuuggagcuagaguuccaagcagccgugagcugcccuaagugagugcuaggugcuugacuugguuccucugcagcagcaguuuuauuggcuucucucauauuuaggcuauuccgaagguagucuuugaaacuaacaccaacagaaagguuuucguuuuuaaagauaccuuagguuugaaauuacuuuauaauuacuuagugugguaauguugucuuuuaaaaauauuauguuaagccaguuaggaguuaagucuuaacaaaaauucuuuaauugggcacaccuuuaaucccagcucccaggagacagagaaagagugaggcuagacuaguguacagagugaggaccaggacagccaaggcuacacagagaaucaagaacaaaaucaaacaaauucuuuaguugauauuuuuaaaguguagaaauacaguauuuuguggauacuuauauuucaaaccuuuuauucagaaauuuacaaaguuuaaaguaaguacuugccuucuuugcuauaauucuaccuuaaaaacaaaacaacuaaagucuguguaaagugcuuuuuauccugugcacuguaaccagagcuaauggcagaauaaccugaaggggagggugguggcauucucuaccacucaugugaguaguuuagucuccugaacuuugcccaaaggaauccuccugcccccugagauuguuggugacuuuauugucugugggaggaauuucauuauugcaguguagauguaagugguuucuugugucguauuugcaugguauguagacuauuacaguguggguaauugcacuuuuucccucuuauguagcauuguugcugagacauccacuggcugcuuguuugcuggaucaucacuuggcaaaagagguauacaugaagcaaagaugucuuuaaaugccaucaucagugaagaaaucuuuuuuuuuaaagauuuacucauuuauuuguuuauuuuauguaugaauacacugucauagucuucagacauaccagaagagggcaucagaucagagggauuacagaugguugugagccaucauguaguuucugggaauucaacucaggaacccuggaagagcacucagugaucuuaacugcugagcuccagccccaguggaggaaucuuuauguuuuuaguauagacugucaagaaugaugacugacauacuuaaaagauagucaacuaauuuuauuuuagagucagugaauuuuucauuuuuucaacucuguauuuugagcaaguuguagaccucgagucuauacccucugcuagguggcccagucaugaacauguagcugcaugcuguauucauuucugaaguguugcagagcucagcuguggaucugagaaugucccguuuuaagagaauacugaaaagucuucaauucugauuaaauugugaccaauucuaacuuguguaagucacaaguuuuaaauugaaaacugagguauagcuuuggguuauaauuuuguuauauacuggcuuuauaauuaauucuuaaaauuaaauuauguaugaguguuuugccuacauguaugucucuguagcacuuugugccugguaccuggggagagcagaagguguugauuuuccuggaacuagaguugcagacaguugugggcuaucaugugggugcuggauagugaaccuggguccucuggaagagcagccagugcucuugacuguaccaaucuccaaagccugcauuuuguuuuguuuuguuuuuguaccuguuuuucauaguucuggguaaguuagagccucaccgugcaaggcagguguucaugcauugagccauauguccagcccaugaauacuguuaagaaauggaugccagggccaugcugaggucagaggacagcucucucuccucacuguuuccucggaauugaacuuggaucaucggcguagccuuggguaccuucacucgcugaaccaucucacuggcuccauaguuaauauuuuuuuaguggauagcaaacgaccuauuuuuccccacuuuugcuuugaaacauugacguuucucaaguuucauaagauuaaauagcauugagauccuuccugaaaagggcauugguuaauuccagacgccugaaaauaauguuacaucagugcuaauugggauauaucaguuaaagguuuugauugauuguuuuucugagacaaaauuucacucuguagcucaggcuggccuugcacaugggacaguuguauuguagguucccaagugcugggguuucaaguauaugucaccuuauucaguucagguaaaguuggugacuugggaguaauuuguuguuauuuauuauugcuccuguuuuaggugugaaugcagacaagguugggauugaagcugcugaaaugcuauuagcgaaccuuagacacgguggcacuguggaugaguaucuacaagaccagguaacgacacuguuaggaucaaaaccauguuccugacagauuugaacauaauuauguugcauauaaauuucuuuuauugugccaucaaguauccagacacauuugucucucuuguucucucaaacacaaagggucucuagaguugacgcccauugggaggcgguguugacucuuuggacugcuacucuuuugagacaaggucucguucucuacccucacauucuccguccuucuggcucuccugccuacuguggguggagucuugugguugcuccucagaagcaagaagagagggagaaggaagaggagggcucuucgguauuucuugaccauuuucuggagacaguuuuccuuguguuuagucauuuucuucuuccuaaauuuauguucccaggaauucuguagacuccauuuaucuuuuaaaaugggauuuuugaagaguauaaaaacuugucauguacagcagcuucagaaauauuuggucuaaguaaguguaugagcguccagcucucucaucuuauucugaaacauaaauuguuaaaagucugucuuaucggccaggcaugaugacaaccugccuuuaaucccagcacuugggaggcagaggcagguggauuucugaguucgaggccagccuggucuacagagugaguuucaggacagccaaggcuacacagagaaauccugucucaaaaaaaaaaaaaaaaaaaaaaaaagaaaccaaaccaaacaaacaaaaaaaccaaaaaacuaaagaaaagaagucagucuggcuaagcauuuaccaagccacagacugugguuaacacauacauacucucuguuacuguguaaagcuucuagaaacauaaagaaaauaggaauuauucuuuuaauuucuuuuaaaagcuauuuugauuucuaguagcauuuuccugugagugguuguagaauuuguaaaucugaauauuagcauauuuuugagauuuucuuucuucuuuguucuuuuuugauagcugauuauuuucauggcgcuagccaauggaauuuccagaauaaaaacaggaucagucacacuccacacgcagacugcuauacauuuugcugaacagcuagcaaaggugaguguccuguuagagagacugacuggguuaauaaacaggaacccagcaguaaccaccguugacgcugcuccugggcucccugaguggcgagcucucagcagccucggcaucggcuucugucuccugacacacugggcgauuagagcgagcagagaguagaugcuuugacgccugugcuucgggcuagcagccuggguuuugagcaucccaggacaguuuggaagccugaaguccugugcaucagugaagguucugccugacuagugugugagcucacguuuauaccuuuucuucaguacucuggucuaaaauaauaauaauacauuuauaccuuuucuuuaguacucuggucuaaaauaauaacaacaacaacaauaauaauaauauaaauuucaagugagauuaaugcuaaucuuuucauagaaaauguaaacauuguucccuuuagcuaguaaagccacuguucuuuuucuucucaaauugcuucucacugcuuauuacugcuaauacauacagcuucuuuucugaaaauguagcagauuuuuuauuuuggaauuucauuuuuauucuuuugcaugguuuuaguuuaguuuuacuagucaaggccucaguauauauuuuggccuggccuugaacuuccuggguagaccaggagaacuugugauccucuggccucagccuacagggaguucuuagaugcagcaggagcuaccacacacaaugacuguauucucuaauauaauuuuguaagauugugacucaaguuuuaugggguugccgccuuuucuuugagauuauaaaaguaauucacaugaggcauggcagugauuaccugccaccugucacuugagagucagaggccagcucugucuauguagcacauuucaggccaaccuaggcuguaagauagacuuugagaacaagaagaacaagaaaaagagugcagaagaacuacaccacagucccuacagaguugucuucuuucaguucauuuuuucaauugaaguaauuuuuucauacaaaauauucugaucaugguuucccuaccucuucuucuagauccuucucugcuccucacacuuccaacucacaccuuucuaaugaacaagaaagcaaguaaaaaagacauacacacacacacacacacacacacacacacacacacacacacacacacacacacacacacacacccacccuaaggcauauaguggcgcaaccuuuaaacccagcacuugagaggcagaggcaggcggacuaauucggaguaggggggagagaaugagaaugacuguauucuuaaugagcuaggcauggaggugcaaucuuaucuucuguugcuugggagguagaagcaggaggaugggggcuccuggguucaggggaucaacgccagccagugcucuauggcaagacccugucucaaaugcccuccucacuccuucucucgacaaaagugauucacuggcugaggagagcuuaagcaccacagccuuggcucacacagagccucugccugcuucucccucugccugcuucucccucugccugcuucucccucugcacugaacguucacagccucugcucuucuuaguugcuguugggauaagaaaugggaaggucuugcuuaaaucaggaaaccugaugagaaucaaagguagauuacauccaagacaggcgugaauugacuguuuuaccguuguugcuguuguuguuguuguuuauugcccugggaaaucaaaccaaugauuuuugugugucgggcaaccaugcuuucaaugagcuccguccuauuauuauuuuuaagauuuacuuauuuuauguaugugaguacacugucagucucuucugacacaccagaagagggcaucagaucccauuacagaugcucaugagcuacagugugguuguaggaauugaacucagguccucuggaagagcagucggugcucuuaaccacuaagccaucucuccagcccccuauuauuuuuacauuuauuucuauuuuauuuuauauguaugaaugguuugccuacauuuaugucuguguaccauauuugugccugguucucugaaaagccagaagagaaugucuacuccccuggaacuggaguuguaagugauugugagccuccguguaggugcugggauuggaucuggguucucuguaagaacagccagugcucuuaagugcuuagccguccuuucagcccccuucaguuacuuucauuucuacuuaugcuguguuuacaguuguuuucucucucauagauuagcguccuugcuaauugguacaaagcuuuauucauuguagccuacaguuuuacaggacuuuguauauuuguagccacuuacauauuacuugaagagaguacacaacagaaaguuuccugaacugggguuaugacccuuguuucuuauuuaacuguguauguaggucagaggcaggggaguagcugaaaaggggucuuacuaaguguagucuaggcuggcuucaaacucaagauuuuucuaccucagcccugugcaugcugggcuuacaggucuguaccaccuacaccuggcucuuuguuguacuuugcugggugacuuaugccauaguaucuuuauuuucugugcuucauuacaaauagcucaucuguaaaaaucagagacuucagcuggaccaucuuuuaggcucccucaguaggccuaagcauaaacgugaaauggcucccagucuccugcuuguguuuuauauuuucauguuuguaauuugaaacugcagacaaauaacuauacaggaguuugguucuuuugcucuguguucugguuugucauggcacagugauuuugagauguccacuuacacggcgcacuguuccauguauggaaauugaaagcuugugaccacugcuggucaggaaggccacagaauaauggugucagauuguacuuuagagacuccuagaagcuaaggcacacuugaaaucccuuucucagaaucuuaaaccuauguaguuguuuugacuuaaauuauuuuguugaaaggaucagccuuugccuuuaaaauggcacuuccagagcaucgacaaagaucacauauuucagagcuacuuuagcuaauaagugagaacuacaguguuaggcucggugcugaagggcauuagucaccgccacuccuccgcccuaccuacccuuucugagcaugcuuccugaauuauguauuuagagaauuaaauuggcaggaaaaauuuaaugagagcaaauaaugucauaccugacagguaaaugguucagauacauguuuuagaaaaacaaaagggaagagaaaugaugccuuuucgccagcaacaggcaaugcuucagaaucuacaucugacuuggcugcacauguccccugucccacauguccccugcucccacauguccccuguccccagucagugggcguggaguggagccugauucucuguccugacaaacuccacaacagugaucccagcaugaaagaaggguugcauuucuucacguaucucuugauuuuuauguguauaccuuuuucagauggguuugauauuaacucugucuccuuaacuuccauccuaggaucgcccucuguccucucauguguauucacuuacuacuguuccauuuucaggccaaauuuaccgugaagaaaucagaagaggaagaagaugccacuaaggacacuuacgucaucgagugugaaggaauugggauggcaaauccacaccucuaggguguucacguacgcucuaccuccuuguugcacugacuuagcccaugcaugcugcaacacagugagugagacgucagcuaccacaggacuugagucuuuggagauggagguuggcacugucaguugcugagaaugcuccaucauguuaagcucgugggauaucuccccagauauagacagugaacgaucaaacguaaugaauauguguaauagucaacuucaauauuaacaucauacccuaacguuauaaauaaauuguuguucauacccuaaau

SEQ ID NO: 1686 - RNA, 1397 nt, Mus musculus
auugguuugcguaccuuuauugaagaaaaauaaaucaauuacuaggagagcuauuagacauugacaacucauccauugacaacuugcaucauuuauucagugcuauauuaaucaguauuggaagauagauuaacuaauggcuccaagccuccuaacaacuuaaaugaaaauuacaaaauuuuugagacccuauuugggaauacaaaggguguuugacuuccaauuuccauucucuguagaccaagaacaggccauuccuuuauugacaugcauaaaauacaucacauuuucuguucugcugaugcuauaauucaauaccaauucuccagccacaucaauuauaagcauaaaguauaucaugugaccuuaaaucucuaacaguggaagguuuaaacaaguauggaugcugcuagaacaauguugcuucuuucagugugacagcugagcauccaucucccucccccucagauggcuucuucagcauguuagagcagugaggauugguuuagucucauaaccaaguuagagugaaaacauuagccacauaauacacaugcuccaguuuuuuaaaaauuuccgaaucuugggcaacugaucucguguaacuacuuuacaguuucuaaaagcaguuauuguccaaagcugaaagaacuuaagucuucucaaaugagcaugugaaugaauggagggugguaaacgaaaaagaaaauuaaaaaauaugaggucugauaggggagcaacuggauaagaaaaucaaaaaaggaacaguaauuuaaaguuuauuccagcuauaacgcagguuagucugacuguaagguagcaucauacggcauacuucugagaccauucccgagauauucuguuguacguaucucugucuguuuuauagauccaugcaaucucuggcacuagggggucaucuggguuuggaucacauaucagugaacaaauggauaaaagaacuuuggaaauaguuaaagcaggagaccacugugaucuuagaauaucaagacaaaugcugccauuacuguuacuauuuggaugauaaauucuuguuguaaaugcaaccuuaggugguuugaagggguagucuguaggaaaaugaauugucaaaaagaauacaccaccuugauaugggcugucauuagguccccuaauuguggcuugccaaugaaacaugucaucuccaacuggaccugcaggacacugugcuggagggucaagggccaaaucacuaaguuccuuauuaaucaguuucagcgccauagucugcuuuucuccgggcuccucacuaucccauuguguacucaaagguccggccaaaacucuugauuauccuggcgacagggaaggauugucucuucuucucacaccggcucugccagacacaggugcca

SEQ ID NO: 1687 - RNA, 33862 nt, Mus musculus
cgaguaacaacagaacucuguguugcagccucagcaucucugcagugagguuaaggguggcaccuaaauacgggguucauuucuggaagucacuuccacagugucugugguuaccucgcacaugcucaguaagcaacagcuacugucuagcaguaguauccucacuggucguuccacuucauagagcugcuggacuacacuugccaacgcugugagacacagacacugcaguaauauuaaaaggaacugaaaggaucugagggcugcucccgugaauauuccaacuccacacuaaaauacccagucuguuuccaugcuguccugaaccagcuccgucaucacacuugccacucccuguuuucucugcagugagaugaucacuguagggacagaaguucugugcagagcauccaagggaacagcagccacugagcagcacaguagccacacuaaagccgagggagcccgcaacagcagccagcacgggauaccucuuccacgccagccagcuucgccuuuagcucucggacagucgagucuccuuuauacuuccucucggugagcucuuuauuagcugccucuaacucggacaaucugcuuuguagcugguggauauuccguugauggaggguuuccaguuccuuuuucuguugcucgugcugcuguuggcacugaacuugggucuauuauagagcaguaugucaaaggagaaagagcagaaguauaaagaucagaaaaaacaaaacaucauuucuucauccuaauuucuucaucguuuuccaauuucccugcuuagaagaagucuaauuacagauuucacgaaagagcagguaagguaaacaaagguaauucccaacccugagaaggugugauccaaggaccagaacuucaaagucacucccugcuacacagcaagacugaggccagccugggcuacacaauacucugucuuaaaaaauagccuaaccagaguacaaguagacagucuuacuuggagggagcaaaaauauauaaaauccccagucacaaauauuauuuaauaaaaauguaaauaaaaaaaaaaaaaaaaaaaagaggggggcccaggcaugcggguaaacuccuuuaauccuagcacucggaagguagagggcagagaaucugaguuccaggacagccaggguuacacagagacccugucucaaaggaggaggggaaguaugcagcuacacucacuagagcccugugccacagaucucagucacucagaacucaucgcuggagugucauuuacccaauggcucacucuuguaccauguaguuuuaucuguauugugauguacagauuuuucugcuauuauucccuaaacaacacucuacaacugucugcaucacauauauauacacacacauacauauauguauauaguauacauacauauacuguauauaguauauauauguauaacauauauauauaguuauaguauuggacauuguaaauaaccuagagaugguccaaaguauagaugugcacaaguuauauguaaauaguaugccacuuugaauaagggacauuugagccucuguauacuucaguaucuugaaagagucucugcacucgggaggcaggggcagguagauuucuaaguucgaggccagccuggucuacaaagugaguuccaggacagccagggcuauacagagaaacccugucucgaaaaacaaaaacaaaaacaaaaaacaaacaaaaaaaagucucuggaauuauucguuguagauacuaagugauaucaguaccugacaaaaaauuauauuuagaauauauaaauaauuccuaaaaauagcaauagggauaauuuaacaaugagcauguugaaugggcauuaaauaaucacacugguuagcaugcacacaaaaaaauuucacuuucaugugggaggauuauaaucccagaacagcaguguaaaccuccacuggaaaacaggcaguuccugcuaaagcuacacacaugccuauauuagaacccagucauuucagcaguaaauugugcccaagacagagauuguauaccagcacaaaaagaaauggaguagguugcucauaucaguuuaauauauaacaacaaaauaucacaaauaauucaaaggcuagccaauaggaaaacaaauaagucacagucuagauauauaauaaaacacugcacaauaauaacaggaaaccauacaacugaauuccaaagcugucaagggaaggaaauaauacagagacaugcuauuugagucaauuuauguugaacaaacaaagccaagcaauaauggcagcagucagaaaggugaccucauauggcagucugagugaaauuguccuccauaggcuuauaagaaguagcaguauuugaaggauuaggagguggggucuuauggaauagauguggccuuuuuggcagaaaugcaucacugguucacucucucuugccgcugccuaugaauccagauguggaacucuuaguaugcagcaugucuuucuucaagcuaaugcugaugauaaacuaaacuaaacuaaaccugugaacuguaagccagacccaauuaaaugcuuuccuuuauaagaguugccauggucauggugucucuucacagcacagaaacccugacugggacacucccuaagaguagcacacagacuagaaggcacauaaggaagccuuaaagggugacacgauauucuaaauucuaauuugagugaaaguuaugcuuauuuuuaaaacccaguuaugcugaggguuggagguagcacaugccuuuaaucccagcacucaggaggcugaggcaggcaggucucugaguuugaggccuacagagugaccuccaugacagcagaggcugccacacaaagaaacccugccucaaacaaacaaccaguuauacccuuaacagcaaagagcuggcuaguauugagcgcaucgacauuuauuauuaaagcuauaaaacagaagguaagaaugacaucccucuacgaaacagcgaguggagcaaaggugaaggucauccauagaggaaaugaaaauggcaaaaagucacgugagaggaggcuuagcuucauguaaagaucguggaggaacugaggcaagcauccccuuagugccugucaggcggcaaacacuaagaugauucauaggaacacagggaaacaagaaccuuugggauuccaugucacauaaucuuuuuaggugacaaguauauugagaaaauuuuauauggauuugucacaauggaaacagaaagcucacugcacucugauguaguuggcccacagaaaccaaaauuucaaagccacuaguguggcuaaaaguuaaucuaaguuggaucugaaugacaaauaacagcuguguagcaucaaaaaaaaaaguauuugaacugauauagaauaguaucuuauguuaaguuuuuuaaaaaguuauaaucaauauaucuaauaaaauuuuauuagcauaggauaaaccccaaaugaacaucuauagucguaauuuacuuugcuacaaauuuaugaacaaauuauuuuuaaauugcguaucacuuauauauacacauagagaaaagucuacaaaacuguaucaaauuuucuacagaguugagcaucaauaugacgaccuuaagggaggacaaccuccaggcaaccacggagggcugauggcugggaaacagcagaacaggcugcccagacuguaggccuccccacacauauucacagaugugcagcuaggcuuucuuucaugugggccugaacaacccuugaagcaggggcuaucccaaaggcuguucccugacugugggauauguucuucuaccugggcugccuugucuggccucagugggagaggaugcaccuagcccugcaggagucuugaugugccagggucgggggcuacccccaccugcucagaggagaagggggugggggaugggaaaggauugugggaggggggcagugaaugggauguaaagugaauaaguuaaaaaaaauuacuaauuaggaaaaaaaugccaaugcugacuacauaaucuuugaguaguaagacugaagaauaagcuuuuaauuuugauuuuauauacugguuagauauuugaaaauuuuaaagcaagcauguauuacuuuuauaaucaauggaguaacuaagaaucauuuuaaaagugacauuuuccaguggccuguaguguucuuaccugcaaggccuucuccuucucagcuguuaacuccugagagugcuuauucgucagcgaugcugugugcgaggcccauucacuccgcagcuuaucuaauucuugcauuuuuuccgacaacgucuaaguuagaggucagcacaacauauuaggacagucucuugaguacacuacacucagacuagaacacaaagugcuuaacaagguacugcuaaggaaaucucagcucuuuaguacacacucgaggcuuuucccgcacaugagacucgacacaguucuagagcugcaauggcccacgguggaacuugaacuuuuaacuucaucuagcucugcagcagauccucuccucugacuuaagagacucgguauaguaagugucuccuaagucuacuucuuauacuucagcaccgcagcaugucccccaaaggaccauacuguacaggaggauuucugccuacagccauguugcuuauccauguugcuuaucaaguacuuucacccgagaugucaaaggugaagggcaaagguguaguggguaucgcaaaccacgauaaguccauugaaaggauuaauucuuuuuuuguuuugguuuuugguuuuuuuucaagacaggguuuccucugcguagcccuggcagucccggaacucacuuuguagaccaggcuggccucgaacucagaaauacgccugccucugccucccaaaugcugggauuaaaggcgugcaccaccacacccggcugaaaggauuaauucuuuugagagacagaaagagagagagagaagggaggaagggaguguacuggcuaguuuugugacaacuugacacagcuggaguuaucacagagaaaggagcuucaguuggggaaaugccuccaugagauccaacaguaaggcauuuucucaauuagugaucaagcagggagguccccuuguggguggugacaucucugggcugguagucuuggguucuauaagagagcaggcugagcaagccaggggaagcaagccaguaaguagcaucccuccauggccucugcaucagcuccuguuuucugaccugcuugaguuucaguccugacaaccuuuggugaucaacagcaaugugaaaguguaagcugaauaaacccuuuccuccccaacuucuucuuggucauguaugcacaggaauagaaacucugacuaagacagaagacuuaauaacuuuuaugcccauuguuguuuugccugcaauguauaucuggauccccuggaacauagcugggaacggccauguggguacuagaaauugaaccacgguccucuggaaggggagccaguguucucaacugcugagccaucucuccagcccccacaggauuaauucagucuuaacacaggaaggaagggaaaggaggcagcaacugaagagcauuuuaggccagacaaguaagaugaauaaaaugaaagggcugaugagagcuccugcuaugacuccauguacccaugggaggagaaaaccaaacccacaaguuguucucucaucucuacuugcaugccaugguacacacaugccuacacacacacauacagauacacacacacauacagauacacagagagagagagacacaugcacgcgugcacacacacauaaaauuuaaaagaguaauaauauuuuaaaggaaagagaguaagugauagaugcuaagcggugucuuaauaaugacuuuaaaaagguguuguauguuagggguagcagaaauguuuggguggaauuaaauaucuaaaagaaagcaucaauuuaagauaauuaacugugggggaagaggugcaaagaguggcgagccaucaacaaucuauuuugaaagaagauacacaaaggcuugguuugaauuguagaaagaauucaggaccaauuuuggauuauuuacaaagacaaaaugaaaacugaauuaccucuuguguaaugugcaguugccugguaacaucaucuagugaucuagucagugauaauuuuucuuccuauguauaaaaauaaaauuaugcagcuuacaauugaauacaaucguccauagccaaauaccagcagcaugcaaagagccugcugaaccugcaaaaccucaggccuucuaaacuagagccugugucuucacaaaaccccagaucugugugcccugagccccgagcucuuuauguaacuacuucagcaugcaacugacauggauuuucuuuucuuuuucuucuuuuuuuuuuuuuuuugguucuucgagacaagguuucucuguguagcccuggcuguccuggaacucacuuuguagaccaggcuggccuugaacucagaaauccgccugccucugccuccggaguucugggauuaaaggugugcgccaccacacucagcugacauggauuuucuuaagcagagacaccaugcuguucuuguaccacacccuuuagcauuuuauaauauucagaccauguucguauacuuauuuucaaugcacauacuauaauacacaauugaaaagaauaauaaguucuuuaaaggaaagagaguaagugauagaugcuaagcaguaucuuacuuaaugauggcuuagaaaaggugucguauguugggguggcagacuguguguucauauucuuaucugcuggcugaugaaauggcgaugugaaagguaggugccuaaggccagggacuguuaauaucuggaugcuaagcugcucaacugcuggucuaguucuagacugaguuauaggcaguagcuaaaugaaaaacagugaaauucacuacagaaaagcagcgggagugggggacucagggguggaggugugcgcgcauggauccacagugauuuauaaaguacuuaggucucaaguuuaaaagaggaacuuaaauuuaaaaacuuaccuugcuacauuucaaacauccugcuagaaauuucuuuauuucuacaucauuuccagguaaaagcuuuagugacaggugaauaagaugcuuaaaaggauuugucuccacuacguuuaaaaggaccggugaguucuccaaaagaguggcugaagaaagaagcugcagcaggaaccuuugaagagaaaagucacacuauaacacacuugcagaccugugaggcccugccacugggucacacaugccucgacucaagacagcgaaggggagaagagaaaaucacuagacaaagagaaacaggaguauguugggguguggaaugaagcaugguccuaauguucacaaugagagacaaaaagggaaagagggagagcaaaaccugaaaacauaaacucaucaaauaccauagggggaccggaguuccagcuccucacuccaacaacuuaccuuuaagcaacaauaagaauuacagauuuauccuuuucccuguaaaugcucauaacaauccuauagccuugauuccuaagagaaaguucuuuauaaagaauaauaacggggcuggagagauggcucagcggguaagagcacugacugcucuuccgaagguccugaguucaaaucccagcaaccacaugguggcucacaaccauccacaaugagaucugacgcccucuucuggugcaucugaagucagcuacagcauacuucuguauaauaagcaccuuuaaucccagcacucaggaggcagaggaagauggcucucuaugaguucgaggccagccuggucuagauaguacauucuaagacaaccagagcuacauagugagacccugucucaaaauaauaagauaaaauaaaaagggggaaauggggggcuggugagauggcucaguggguaagagcacccgacugcucuuccgaagguccagaguucaaaucccagcaaccacaugguggcucacaaccaucuguaaugagaucugacucccucuucuggaaugucugaagacagcuacaguguacuuacauauaauaaauaaauaaaucuugagagaaaaaaaaaaaaaaaggggaaaugguacagaaaacauuuaaguuucuaauaaaacaguauuuuaaacaauacccaucaguuguucaagccaaggaaaaguuccuggugaauuuuacaugagcaggugucagcagcgcgugaccaggaacauaaauaccaucaugaacggaaugaaucauaaaaacaaaaacuauuaaacaguugaacgagcuuggggcucaagauggcucagcaggugagcacaguugcugcucucggggacuugaguacaguucccagcucccagcucagagagcuaacaucuguccgagcuccaggagguuucacacacccaucuggccuccaagggugccaacaugagugcacacaaacacacacacacacacacacacacacacacacacacacacacacacacaaauaagaaauaaauccuaggaaaacaaauguuuuaauaccaauucacuuuaaaaacugcaucaagccauagaaauaugagaaauaagagucaaauauuucuuauuuuagucaagauuucuuaaaaguugggauuuaguugaacccuaaaucccaguuuaaaaauaauacacuggaguaucugcaggacauggaaaauaacguugucagcacuccuccucugaagggagacuaaugcuccggccugccagccucaccuuggagucucuuucgcguguucuugcauacacugcugaaggaggucuauaaacuucugugggaaagcuaagaaguccaccaggagaccuugcugcaauuuuaaacuacacagaaaacagaaagacagcuuuucagaaacuuaauuacuaucuuuaguuagaauucauaggauaaaauauuauuuacuaaugacacuauuuuaaagaaauaaacuagggagcuuuugacauauauuaacuuuaucuaacaggagucaugaaauuuagcuaaagcaucaaauuucugagcuccuuaaauggaagucugauaaucuauaaaacauucaacuuuaaaaauacccauuaaacaauuguagagcagucaguagucucagaauaacuuaccacgugaacaggcauguguuucaaaaaagaacaguguaaacacauuauaaaacucagaaaauuauuccuagacuauguguagggccagcaaaaaucuaaaauaauuuaccuuugaaaaucuuccucagauauaacaagguuauacagaaaaaacggaucuguaucaucagucagacggaugacuaaauccuaaagaaaagaucagacuuuuuaauauuucuaguaaagcuuuuauaagaguuaaauuacucaaaacaacaacauaucaguuauacuucagaguccugcguuagggugcugcucgguuuuauuagucuuuagagcgugagcaucuuuacuggggguagacauccugggguguguaggagcugacgaaaugcccaacguuaacaguaucuucuaugaggcucagagaaauauauacaccagcuuugcgccccguggcaucauggcaagauugaauacguguauuuuuggcuuuccucaaaucaacuagucugguauuucaaaagcagcaauauaaucagcaaaacugacagucaucuacaagaaaagggaggggcucucgucgcucagauagaagaugaaguaucaggugacgcggugaagcguuuccagggcuucccuggaggccuccuaccccagaugcuccaucuguuucuuuucuaaggaaguggguucuucucauaaagacacuugccaggcugucaaguuucaagugugacagagcaucauagauggcaguagguacacaaaaguuaugaacgucaaaguacaaagaaaacaggcauccuaugggaggagcagggacuaacaaggaacuugaagaaaaucuucucaucucuaaggagcuacuaggguaacuggaaacacagaagcauuuuaucagugaagcuaaaacauguagagaggccacauguaaaauuaacaaguaagaauguauacucuguucccggaaaucaaggaacugggggcucacuccaccucagagaagcccgugguucaguaacuucuacuuaaauacuucuuaaaacucaccucggaugcuacugaaaaccaacaacgaggcaaaaccuaaaguuacugccaacuacaagaugcuugcaugugcucugggaaagcugcaacgaggaaaccagaugcuacccuuaguccuaugucccguacuuuuaguguuguuauuauuauuauuauuauuauuauuauuauuaauagagagaguaucaauuauauagcucagguugcauuccaaagagcucucaaucuccucccuccucuugagugcugcugggauuacaagcauacaacaccauauccaacuuaauuuuuaagcugacauggaguuuaagcucuacaccgaaguguagaguaagguaaucuuuuaaauguugagggcaaacccagacuguuacaucaaccccuacaucuucuuggauuuacuaaugcacgguauaauuauauuuaaguugcugacuuagauuucaccaaccuagaauuacaaguuauaaaaugacccaaaauuuaaaaauuaaaacaauaaaggacuuaacaaaagaguaacccuuuaaaaauaauucagcaauuauacuucaguuccaaacagaucagggagaccacagucuaccgagaccacaagcuggacaguagaauuucuccuccuuuggggaaggaaacugcaagagucaccauguguggaauagaauggauaagcgucccugguaaacccaccuuagugauuauacuaugacuaagucuccguaagaaaagaucgaauuuucuuaaaacaaaacaaaaaaacaaaaccacaacaauaaucacgacacacacaaauggucauacuucaaaaaagaaguaaauacgaaccuuccuguguacuggauucgaaagggacugcagcucaaugcucacucuaacgcucccucuccuguaggaaaagacacggccaacucagaauguucaagcaacgugaaguuugcuaucuuuaacuuaaaauguugauccuaacccacaagacgccacaggugcccucaagcuuaugaacagguuuuuagaaaguacacuagacguaaguuuuaagucuguagugucccucuaauaaguuaccugguaguuuguaaugaaaggcaguuuguauuugucacuuguaaaaugaagaugcuguggacuaaauaugguaaacaaucaggguacccauugcuaguauucugguaaauaacuuuacugccagauucuaaaaagcaucuaccaagacauagaccaucaauucaguaacaacuuuuaggucuaaaaaauaccacuuaaaagcugggcgugguggcgcacgccuuuaaucccagcacuugggaggcagaggcaggcguauuucugaguucgaggccagccuggucuacagagugaguuccaggacagccagaccuacacagagaaacccugucuugaaaaaacaaacaaacaaacaaaaauuaccacuucaaugaucaaacugacuuacaaagauauauaccaucuuaaaaaguuaaaauauugggcuagagagauggcucagcaguuaagagcacugacuucucuuccagagguccugaguucaauucccugcaaccacaugguggcucacaaccaucuguaaugggaucugaugcccucuucugguugaagacagcuacaguguacucauauuaaauaaauauauaaauaaauaaauaaucuuuuuuuuuagaaguuaaaauauuaugauguuugcuuuugguugccucccacccccacaggguuucucuaugcagccccugcuguucuggaacucugucuauacuccaggcuggcuucaaacucacaggaacccaccugucuucagagcgcugggguuaaaagcaugugcuaccacugucuagcuguguuugcauuacuguuagagucaagaaaaugauaaucacuauccuguuacauauauuuuaauugcaaagccaaaucaacauaaaauauugucuagguaacuguaucucagaagcauugucaacaagcuuacucucucguucacaaguagcucuaauguccaaaaugucacagccuccacauucugugcagcagccauaacguuaaacugagaaacaaaauuaaugaaauuauugaagaaugucuaugcaucuccaaacuauucugcuaaguucaguaacaauggccauucucugacauguguguaugugugcccgugugcacacgugcgugugcauguuaagggggaggggggagauaaacaaauuuguguugguuugaauaccaaugccccccauaggcuucuauguuugaauauuuggucccagguugguggaugugagaaggacugaauuuggccuccaggaaggggugggcucugagguuuggaaggaccuagcccauucgcucacagugugcucugucuccugcugacucagcagcugcuucagcugccugcuaccgccauccacucugccuuucugccaccguggacccuaacucugaaauuuaaaccuaaaagaagccauuucuucuauaugucacauugucucugcaauaggaaaguaacaaaaacaaaauugagccugcucaaguuuaaauucuucuaaagauuugguuuaagcuguuuccagcuccuacuuagcuacaacagaaguaaaaaggacagacagcaaccaacuacugacgagcaaggugcggacagucgggcuagagucaaugcuaagaccuguuucuuaaacugggauuuacaauuuuauauuguuuuaauaugggucauuuuaauccauuuauuuguuuauuuuguuugucuguuuguuuguuugcuugagacaagguaucucuauguaguccuggcuguccuggaacucucuaugcagaucagccuggccugaaauucagagauccaacugccucugccuccuaagugcugggauuaaaguuguaugcuaccacaccuggcuuaacuaaacuucuuauugacccuacaauuggaugcuauaacuuaguucauaugcauccucccaccugcuagaugaaaaaggucaguuaaaaaaaaacacgaaaacuucuguuacccuuccucaaguauauuuguggugcuagggcuaacgcuggaggcuuaccugcuagauaggcacuggguuacacuggcacuccagugcccagagcagugcaugccagaccgaccgcagcagcacuccaacuuuacucacccucuuuagacagagauuaccacaacuuccuccuaauuuauaaaugacaacuaacagagggguuuguuuuguuuuguuuuguuucuuuuuuuuuuuuuuuuuuuuaaagauuuauuuauuuauuauauguaaguacacuguagcugucuucagacaccccagaagaggacgucagaucuuguuacagaugguuguuagccaccaugugguugcugggauuugaauuccggaccuucggaagagcagucaggugcucuuacccacugagccaucucaccagcccccuuguuucuuuuuucaucuuuaagguauuuuuuacuauauagugguauuugcuacagugguauauuuaaauugaaaucugauuguuuauuguguuuuacagcuugaaguccuauacuuuaauaccuuucauauauauauauauauguguguguguguguauguauauguauuuaugaaaagagaaacacacaaaaccaaagagaauuaaaaugccuaagucuaagagaauuauuugaccauggcaauuccacucauauuaauaauacugcugcacacauuugaagcacuuacauggauuagagguugagagaaaacuugaagaaggcacuaaaccaaauauauuacccauauuuacuuuaaaaacacaccuagaggggcuggugagauggcucagugguuaagagagccgacugcucuuccgaagguacugaguucaaaucccagcaaccacaugguagcucaacaaccaucuguaaggaaauaugaugccuucuucuggagugucugaagacagcuacaguguacuuacauauaauaaauaaauaaaucucaaaaacaaacaaacaaacaaaacauaccuagagacagaauucgggagguagagaagucagacuucugcguccaaagccagccuggacuacagagcaaguuccaggacauccaggaacuggcugguuucuacagagaaacucagucuccaaugaaugaaugaaugaaugaaugaaugaaaauaaaauaaaacguccuuacaaaugucacagaaaaaucugagauugcagguauauuacuuucucuauuagagaaaucuuuuauuuuuuccuauuagaaagauucaugauauaaaagcacugaaacaaaugaauaaaaucccaaucuuuaaacguuguuuguaacugaguaacacccaccagaggccagucacauauagcuagggagguuuauuucuuuguaaauagagaccuuggacauuagauauaagagcuggauuucaguccacugcugucauucagaggcggugaccuuacuauucucucuaugcaaacaaaaaaaagcuacuguaagccaggugcucugcugggugccaaggauacaaacagaaauaaacauccagggaagaaaaggaaaagaagagcagaagagcuacuauugucuacuaaguaccuacacuauuggcugccuguguguguguguguguguguguguguguguguguguguguguguuuauguguguaagagagagggagggaggggggagggagggagagagagagagagagagagagagaagagacuccauucagcaaucaucuuagcgacuguuucucuaaucagaggaagaacccgaggcacauuacaaagcccaaauuugaacuccucucuucccuacauaaugcuaccuaauacaugaucaaugaccguuaauuccaacuuaggcaccuacuuuuguugcuuuguuuuuugaggcaguaucucauuauguagcccuggauguccuggaacucacugcauagaccaggcuagacucaaagucaaagacagccaucugccucuaccuccugagugcuggacuuauaagguguaugucaccauaccuggcaucuugggcaacuuauggcaggguauuucagcuaugccuuggggggcuggggagauagcgcagucaguaaagugccugccgcguacacacgagcaucuuauuaggaucuguaacgaccacaugaaaagccagguggggaccaaguaguggugacucacacuuuuuaucccaacauugaaggggcagagucaggcagaucucugugagcucaaggccaguggucuacagagagaauuccagggcuacauaaagaaacccuugucucaaaaaacaaaacaaacaaaaaagcuggguguggaaugagagacagugguuaaaagcacauaucuguucucucagaguuuguaccccagcacccaugucaagcagucacaaagaccuauaauuccagcuccaaaggauuugauauccuuuucuggaggcacucacagguagacaggcagacagacagacagauagacacccccccacacacauacacaccacacacacacuccacacaugcuaaggcauaaacacacaaaaacaauuuuuaagccaauguguuuuaacucagggggugggagaaggugaugucuugagauuccccaggccaagcagccuaggcaauuagcuuaccaggcacugugcucaaugagacccugucucaaaaauuaaaguggagaguuggcaagauggcucagaggguaaaaacacuugcucccaagccugacaggcuaaauucaaucccuggaacucacacaacuccugaaaguuguccccugaccucuacaagcacaccaugacauacacauaaccccccccccauacacauaaaauauauguaauuuauaaaauaagaauuuuaagauggagaccaauuuuaaaaggauaccagaagccaaccuauggcuccacacccauucucacucacaugcacauauacacauauacacgcaugacauagacacauacacugcacacacacauacacaggauuggagaugcgcaccuuagucaugaaaaaaaaugagcaucugcggcagagggcacagcaggagaggagacacaguagauagagagaagucaaggaaccaggaggagcggaguucuugugugaugacugagagagaguuuaggaaucgaaacuuaagaacacgugguuauccaauccuggaagcucgcaccacuuccuucuagguaggguucccugcuaauuacccuaucgucuccccaaccgccuuccccucuacuaugccuuuacuauacuacuuauguggucacaccuuacuacuaauaauaacuacgauguagggaaucauuaacauauacuaguuacuaucuuaagcucuuuguaugcauuaaauaaucucauccucaauaauaaugccaugaaguaggcacuauuauucugaauuuaaagaugagaccaaaaaacaagugaaaguguaagcugggggcacaguguagugguagucgauaacagcauugaugacagcaugcugcaaggacaaagcuucaacccacagaaaugugcacgcaguaagcaaacuguccaagaucacccaggcaguggcagaacugggacuuuaaacccaggcaaucuggcuccagaucuaacccuggaaccugcauuacgcugcuucuccgagggggucuucucaauucugugucugggcguucccugagaaccaagauggcgacugguuuugauguugcuguucggaggugaaaggaaggaaaccucauggucucuguacccagaauaguuuaggguacacagcaggcaaguauuugcugggguaaacugcucuucaauaguuggcuaaggaaucuacguuguucuuccuauaggucagggguuagcaaaauuauucucuaggaggucagagagugaauauuuuagacuuugaagacuauggagcagugguucucaacuuacaggucuggucccccaugagagucaaacaaccuuuucacaggggucaccuuagacuaucauaaaaaacagauauuuacauuagaaguacaguuacaaaguagcaacaaaaauaauuuuaugguugggcgggucaccacaacauaaggaacuguauuaucaggaagaucagaagccacugcuauagagucucugucacaaucgugugugguuguguuccucuccgcuacccugcuagcccggccccuuuauuguugcuguugcagugcugaggagauauauacacauauauauacauauacauaaaaaauauauauauauauauauauauauauauauauauauauauacauauauauauauauacaaucuaccauaaaagccacgcaguaauuuuccagccaauacucccauacaauugcucauugauucugcaucgcacagaugcaaccacagacaguggguaagaaauaaggauggcugugcuccagaaaaaucugauuuaugaacagcugguugagccuugccaugggugauaggaauaucggguuucuaaacaagaguaauuuuuuuuucccaagacaggguuucucuguacagcccuggcuguccuggaacucacucuguagaccaggcuggccucgaaaucagaaauccgccugccucugccucccgagugcugggaucaaaggcgugcaccaccaugcccggcugaguaauuuuuaaaguugaaguuguguuuuaacacgauuaacugugauuacaauuuaaugugucgaagaagaguucagagugucaggcauggaaucacaaguaauggcccauauugcccaacagaaacaaaauggacaccacaaacuugagucaugugugucacuuuaaacuguuuagaaguuacuuaaaaaaaauaacucucaaaguaaaaauuaauuugaauacauuugaccccaauauacccuaaauaaagccgcaacagauaaucaacauaaaauugagacuuuuuacauuucuguuacuagcaggucuucaaaaucuaugaauuuuauacuuacagacaucaguuuggauuagcccgaauucaauaacuacaugucuauauauuaaacaucacaaaauaaucaccaaugagaggcuggggugggguggggguuacacaucagugguagagcaugcuaagugagggcaccacuucaacugucaaaaucaaacaaacaauaagacaauuaaauaaccuacagauuccuauauacggcugauguuuuaaguccauuuuucugacugcuuugcugguugauucuggaccuaauuuuaaaucgcauaccacaguuuaacaguccagcgacucaauacaucagugucuucuuuuuguuuuuguuguuuuuuaauucaacauuuuuuucaccguuuaguuucuacaaacauuuucacaccuggucuucauugcaaucaaaugaacagcuagacauauuaaaucaauuuagcaaaugagaaaauguaauguucacagaaacuaacaacuaaaaaguuauuaguaaaagagggaaaaaucagaucgccugugguuaguguggcaaguuugcauucaucugugcgauaagauacccuaguguaaacucugugaagaucaagguauccccagggguccgacgaagggcuuuacggguugacuuauguuuugaauguacagaauuccugauuuuuccaguuuugggaguugguuaaaugauugaaacugacgugcggaugaaccgaaauaugucacugaacguuuuguuuuguuuuuagauggaguucuaaagcuucacccccaguguucuucaaaggagagcaugagugaagggccgggcgaccugaauccuagugcggacagcucccugaagucaccgugaagcuuuuguggaaaugacagggagaaucagaguugccacccagaaaggacaggcugggcucugucccgcugagggccagaacacggacgugaaggagucggcuugccauuuccucauucccuuuccucgcguccccuccgcaacggccggcccggccacaaacaaagguauccauuaaguccgcagggucccuucccgauucccggugugacaguccgacacccgcggaccgaccgauccccacggaacccagccgccaucuuccccauuggcgcgaccccaaccgccacccgccggcuccgggagcucaccucuccucgcagucuuugcauuucacuagcaagggaacaagcugcuggaacagaacuugacucaugucggaccgcugccccgacgggagggugaagaagcccaguaggcccggccuucggucccggcugcaaagaagagccggucccgaugaguuugaguuuggcgcucagcucccgcggaggaggagggaaacgauaaacagagggaacgaaggagcuuuggaccucgucagccaccgucaccuuuuuccgguucgggcaccgaccgagccgggcugaugcgucauuuccguggacccaccccccucaggcggccacguuuguuaagggaagugggaccaaaggggacugacaacuuugggcugagccaggcuuucaaaaggacccagcguuauggaggcuccggcggcgacuucgcccucgaucggauuucccaucgacggcagaugcaacuacuucguagaaaagaagaagcgcuucugcaggaugguggcggccgcggggaaaagguucuguggcgaacacgcuggcuccgccgaggucagcuaucgcccucccuuccugggagucgcgggucugugggugcuggaccccagucucgccccuuugacagguuccugcuuccgucccauggauuuaaguaaaugcaguucugcccaccgcucggagccgcgaggagcccccgaggagcauugcuuucuuguacuaaaagcucccucugcugucucagagacccuuacacucauccuuccuuccgcuagucccccauccucaggggaagugauuauuuuuauaaaggagugcuugaaaaagaucacuagguuuuauuaacuggguucuaauuaauuauaguuauuguuuuugaacgauaaccacuugugaaugcauggggaagaaacuuagaaacaauuuuuguuuguuuguuuagacuuguagauuaguaauuugccuguucuuuauacauuaggagccacuaauacuuuugcacuuacaaccaaaaugucuuaugacauuaaugucuguugagagacaaaaaaaagaaaaaaacaaaacaaaacaaaacaaaaaacuuugcuuucaacuuugaaguuuguuauuuuacguuuauuuuuccuucuccgucccagaauaauaauuacaaguucauaagguguuuuccuggagaguuaagucuaaagucacaggaagccucauuacccucuacaccaaaaaagaaaacauuuuacuaaccugcuauacacuguuucuaaacucaaacaauagauuuuaaaaauguguguguguguguguguguguguguguguguguucugugauuacgcuuugaaaguuagaguacuauuucccuugaaagacaacuuucuguuuuugagauggggaucuugcugaauugcucauauuggucuugaacaucugaucccaggaauucuccugccuuagccucccaacuagcuggucuccaucaaagaaucacacuggaauuuaauuuaaaagucuauacaugaaauaauguuguuuuuuuuaauacugaaaauuccuuaacuuucucuaaaauucagugugcguaucuucaugaacauucugaaauaaauugaaauaaacaauugagaaaaauuaagaguaaauacuuggucagcuuuggcuguagggcuaguacuaaacguuauuuugcuuuuaaaaauucaauuuucacaaaccuuaggaagcaagucauacuauuauucuacuuaauaauauaguaagucuauacuuaauauagaaagucuauacuauuauuuacaugaagcagucaggauuauagaguuagcagcuaauagaaagagcugagaaucacaccuaaccacuggccucuggauuuaauaauugggccauccuguugcauccagguugauaggaucuguggggcagaccugccaacauuguuucccuugcuuuucucccagugccuauaauuaaaugcauaaaacauaaaagacuguaacuagcauuuagaaaaguugcaaagcuagugaauaugacccauucuaaauuguuaaagccaugccuuguuguuccuggcguauuuucuccuguacucuauucugagagagggucugagggucacccuggcuggccuuuggcucugucugcccuuccucuggagagcugauauucaaagcaugcuccaccacgcccaucauuuccccauauuugaacaccuuuagacaaauacgcauuuuaaaaucaauuuaaaugggcaacacuuuucaaaaagagcaaggaugcaaguaaugaguauuuuagucagcucaauuuagccacuuauacccaguauauauuuauuucaaaagaucauuuuguacaugaugaauauuguuguuaguuaauccaaaguacaugguuaacaucuuuucuuaauggugcauacaauuacuguacccauuuuuaggagguguuaucucugaugcaaaauuacauuagcaagccaaaacaguacuuauucauucauacagaagcgagcuacaaugaagacucuuauuaugcggcaugaccuaaucuugcuuauuuuucauuguauccuuuaaguuuucuuaccuuauuuuaggaauagaaacacacuguggguguaucuaacaucugaauguaauaaacuugacauuuaaauaaauguauccguuuuaauuuauuaggaagaaaauacucggaaaagaaucuuguguccuuuagauccaaaacaguuaaguauaaggucaaauaaguggguuuuugucauuuggggugcgugagugcauuagucuuuguguguguguguguguguguguguguguguguauguguguguguuuguauauauuuguuugugugauguacuagaaacgguuaaguuucacaagguucauuuacgauuuuucuaacucuuaaauuuucucuuuaaauuuagcacaguguaugaagaccaacuagcaaaacauuugaaaaaauguaauucaagagagaagccuaagccuguaaguauuugaaauguaugugugauaucuguauauaaauacuuaguauuauaagaugcagauugaauuuggcaaauguacuguacucacuugauagcuguacuuuucuucccuccucuuuucuguacuuguguuuuaucuguuggcuugguuagauaggaggcagguuacacuguguagcccaggcuaaccccaaacuugaggccgucuucccuuagcuucucuaguacuaagacuacuggugggugccaccuugaccagcccagaauaauuauuucauguuuucuuuuugcuugcuuuugagauagggugcugugcugcauuacuuaggcugcucuucagcacagcucaaauguuucuuaugcuuugcuuuccaaaugcuucgacgauagguacaugauaugccaacacacccaucgccauagcgggacagagaggggugauggugcagcaagagauuuccaaucagagauaagaauuuaggauuaaaguuguaaagaauaacuacugggcgucuuugagaugcagacucaguguagagauagugaaugugagcuagcaccaggccacauacaucuuaaacaguguccaucuaagccagagcuaaacauuuacagagauugauugauugauugauugaucuuugguuuuucgagacaggguuucucuguauagccuuggcuauccuggaacucacucuauagagcaggcuggccucgaacucagaaaucugccugccucugccucccaagugcuggaacuaaaggcgugcgccaccaccacucggcuagauuuauuuuuuuuaaauauuuauucauuuuauguauaugaguacacugucuucgugcauaccagaagagagcaucagaucucauuccagaugggcaaaaccaucccagaugauuuugagucaccaugcgguugcugggaauuaaacucaggaccucuagaagagcaguuagugcucuuaacuacugagccaucuuuccagcccaaaaauucauauuuauguuuggaaacaaaauacaauaauuugguagaaauugauaaguauguucauuugcuucaugauauggaccauuuuacagaauguaucucaagauauauugggguuuuuuuguugguggugggguuuauuuguguguuuggguuuuuuguuugguuggcuuuuugagacaggguuucucuuuauagcagccuuagguguccuggaacucacucuguagugcagguuagccucaagcucacagagaccaaccugucucagccucuugccuccugaguuccaggaucaaaggcuugcacuacugcccagcccucuucuuagucauuuugcgacagauacccuuccgcauuuucggaugccucucaguugagaaccacugccccagaugcuaugagcuaaaaguauguuagcugucuuugguggcacauaccuguaaucuuggcaccugggaggcuuaagcuagaggauuacccaaaauucagggcaagcuuggacagcauaaaacauuccaggcaagccuuggcuaccaauugagcuucaguguaagcugcuauaucaaaggaaaaacaugguauuguaacauuaaguuaaucuagaagaaaaacaguaaccucucacccacaccuucagugcucagcuccuuuaguaaagagagagauaagacugcgcccagaggccugacugugagcagucccaacggaccagacucagccauccaccagcaacagaggccaggcagcagcccggucacugugguugaggcugggaagucauauucgguggugagugagugugcagagggugauggugugggacggugagagacgggagcauucuucagccuaacuguuuucagcaucauauuaauacuauguuaugguuuuguuuugucaggauuucuuuauucaagauauaaaugcaggauuaaaggaugaaacagagauuccugagcaauuaguaaguguauuauuuaauacuuaacuccaagugguguuuauaaguuuccuguacagaccgugcuccaguuuguuuagaaagaugugugguuuugacuuucggauguauuuuccuacagaaguacauuguuagugaugauuaguuccaaggcaagcuugugucccauagcugcaacugcaaugacucuguugugagcugagcccagacccugagggagcagugagagcugcaguaucggggcagagauggaggagugcguucacaguugggcaguucugaagggccuagcagcaaagccuugccaggaagaagcugcuaaacugccaaggcaucugccuggcucguaagcuuuacgcagucucugccguaguacuuuacacauguuguggcuacauuauuuaguuuuauuuuuguauuuguauauagguuccauuuucuucucuaucugaagagcaguuggagaacuuaauuaagaaauugagaaaagcaagugaaggugagucugcuaaagucgcagguuuaauuauaugagaagcacuggguggcuuaugggcucccuuccguucugugguucagaggcucaguccauguuuugcugcuuaagcugucucucauguuucuuuuggacaaaggcuugaauucuacacaugaagaucacaucaugucccauccagcauugcaugaugcccuuaaugacccaaggaauggcgauugugcagucaaacaccugaaacagcagguauguuuagacacaaucacuaaacguuucuucauauguguagugcugacauuccaggcugaugagauggcucaucagauaaaggcacuugcugccaagccugaggacccgaauucagucaucugaguuuaaaaaauagccucugaauuuuaaaaaauagccucugacuucuacaugcaucauaaguauguaugcucaacaauaaauaaaaguaauuuuuuuaaagcuaacauucgccgggcaugguggcgcaugcccuuuaaucccagcacuugggaggcagaggcagucggauuucugaguuugaggccagccuggucuacagagugaguuccaggacagccagggcuacacagagaaacccuguccugaaaaaaaacaaaaacaaaaccaaaaaccaaaaaaaagcuaacauucuaguuaggugugguggcacaugccuuuaaugcaacacuugguagacagagcaagcagaucugaguuugagcuauucugaucugcggagugaguucuaggacaggguggguuacagagagaaaauuuauccugacaaaaacaaucuaaaaaaaaaaaaaaagcuaacauuugguucugaguauaauuauuuaguuucuguuagugaacaaaauacuuuuguucaaaauuauaugugaacauaaaauaaaaauuugggcauggcuauaacccugagcgcagaguauuaucuuaaagcaagcaaagggaaaaaaaaugucuuagccauucagacauuaucaguaaacugucugccuguguagagauugccuugcuguuuuccuauugaguugcauuccucugcucugguuuauaaaauaacccuaugaagucugcaggcuucuauucuaggcaacauugaaaaguuaaaguuacuuggcccaagaagaugcuuuguugaguuuggagcaggaaaggggaaauuaucucacuggguugauauugccuuaaaagaugcugaaaauguucacuucauccugguagaaagagugaccacaagauucaaggugaguaaauccauguaacaucucaauaaucaaacacaguguucuucuguaggaaaacaagaaaacgauaggagcaugucccuuaaaaugaguuuguuuuuuauauauuugauuguaauuuuuugcuauuauuauuuguuugguucuaauuguacuaauuaaacugaagguaaguuuuucagauuuaacuauugauaguccauaaucugaauuuauaaaauuguuugcagagacaagaaaaucugugaacagaacuaagcuucgacuagaaauuaagccccagccauguuuuaaccuuguauuugccacugcuaacagacucuuucuucauuaaauacuugagcaucuucuuggacagugugauaagcacacuguauguacagauagauagugauaaggcagcugugcucuuaccguccuuagaaaagagagcuagauacggauguaaggaacguguugagguggggaggaaguucugcagaauguggcacgcuagacuuuauuacagggaggcaauggcgaaugaccgagcagaaaagguggugccugugauggauccugaaagaucaacuagcauuugcuacauagauguccgaagcauuuugggaaacaagaacaguggaaccaaacccugaaauaacaagggauguguuucuauggaagugcaggcuuuuccuccugugcccaguuccugaaauaaaugccuaagccaauagcuuuggcucuguucccugacuaguuuuguaacuuauuuaacccaucuaaacuagucuaaaucacgcuacaggguuaguuaccucuccucagguuuaugcaacugcaacauccagaguuccuaggcaaauccccuucccaugccuaucucuagacccagaauugucucuaucccaggacguccaccucccuguuuccugcccaagcucauaagccaauagccuuuuacugacaggugaagcuuccauacaagugcaaaagguuucugugugauggaagucuauggccugagguagaacgugucagugugacccaggaaggagagcuggucuagaaaggccuccuguuguuugcucuggcuugguucugcgguguuagagacacuguggaagauuugguucuugcuuccaagaggcuucugucgaguauuuugguuuccugagugcugugccgguacacaguacccagggcugcaggaaccugaacauggagaacugaccucggucuuccagaguugucauggaggaaaguuuuuaaaaaaugauuuuuaaauucuuuguggagcuagaaacauggcucagugauuugagugcuuccugcucuuccaaaacaucauaguuugguucauagcaccaauauuagguagcucacaacuuccuacaguucuagcucuaggagauccaauacccaucuucugaccuccucacacacugcacacagguggcacauacgcacacacacacacacacacacacaggcucacgugcaaaaaaaaaaugcuuuuuagaagcuauccuagcaauacuguaaaacuauuucaaaagagauuuagacuaaauauaggaagauugaaaauaugaaaaucuaaaaaaaaagugaugguggggggagcuggagagauggcucagugguuaagagcacugacugcucuuccgaagguccugaguucugaguucaauuuccagcaaccacaugguagcucacaaccauccguaaugagaucugacacccucuccugguaugucugaagacagcuacaguguacuuacauauaauaaauaaaucuaaaaaaggaaaaugugaaaaucuuucuucaauaauacaaguaagaaauguccuggagagugaggguuauucaguggaauauagaagagaaugagaaaguucaaauguuggaagucguaagacgugcugauuuuaggagagcaucaaucuggggugguuucugacuuaacaggacaugggguauuccucagcaggaaaaacaggaguugcuguucacauguuucugagggcuuggggcuguagcuuagugguagcuauuuugcuuacuauucaugaggcccuggguucaagugcuagaaucauaaaaggaaacagaaacuuuuuagauggggcuguggcuguagcucuguggucaguugcuugcaugguauguauaagguccuggcuucaaucccuagcacugccaagaagaaaaacaaauggggugguggaaaagggcuuagugccucuaaugauuguuagagagucugcgccuguauucacaggcacgugcagauaaugguuacaacgguuguguuuaaagagagugagaagagugagccacaggagaaccagcggugacaaguaaccacacucgcuuaacaucuguggaccuugaggccuuugcgaaugggcugggaauuaugguuaaaagauggaagguguaauauaauuaguaauaaucaauacaauuucuggucuauaagaugguaguguuauuuuugaguuuucauccaaaauacuaaaacuuuacuuuuuuauucauucuccuuugaacuguaaaaauuaaguguauuugcucugaauuuugaaaacaaauagaaacauuuucauaaagcuuuuuuaacauuaagagugcugauucaguaacguucuauuucuacagguagaugguaaacacagaaaaaaggacucaguguuugaaaggcuucaaauugauauccagcacuuguguuugaguaaguuguguaacuuuccauugcucuacaacagcagacaugucagacucugggggcugcuuagaucuguccuugcagaccugugcuucaggaagaacuaacacuaaucuagucuggagaagcagccaagcauuugucuauaaaucacugcauuuucuaucacuuaacugaagccaggucugguauguacucuuguaaucccagcacuugggaagcugaggcaggaggaucacccagacuacauaguggaucccaggccagcaacucuuacauaaugagaaaggggggauuuguuuguuuagcugaauacuuucugugugaccccuaacacagacaucuuaggcggcauauuggagucuguagaauugcuuguuuucuaacuuucaucccuaaaauucaaagauucuagaaacccuccuuuuggaaggacacacuaguacuuuguauccuaaacaaacuaccgucuuaccuccucuccucucagacaggguuccugugcuaagagaaggaagacugcccgugguaggaauugggaagcaccugugugggguggcgacagguaaggcagcaggacacacaguaaccucugcgcuugcacagggagcuggagccugcauggccccaccacccagggcugucugugcucucauugaacuuacguaggagccuguuaaaguaaaccagguucgccugaggugagaaggaagcacacacuuggggcucuucccaucuaacccaugccucucaaaaccuuaccuguauagugagaguuauauccaauacgcucucaccucugugugcacugugugggucccuuucacucugcuaaaguuaccuucucuuugcgagugucagcauccuucuaucguaguacuucccccuuaucaguacccugccuuccauuucuuccaucacuuuuggcucccugugcuugaaguauuaauauucagacccauccaugacuugaaacucagucacucugccucuggguuuacuguugauuaguguggaccguguuuauuuuccuaaaugccauauugcuccagccauuccuagaauuccacugucacccauucgaagaacugguccagugucugcucaucccucagcucagcuuuacgcccuuagugucgucaggacaaacuccccguagcuuuugcuuguuuuuuuaauuaucugcuuguaugucuaaucacuacacugugcugggaguuuuuuccaagaaugaaguacaugcuaauauaacgcaauauagagggacucauugaauauuugaaugaccuuggccaccagcuugcugcuuccuuaugccuucuaagaagaaggucauaaggucacuaugaaagaguuugagcuugcuaauaaucuuuguuucugaaauaacuuaguccuucuaauauuuuuucugauuauucucacuucuuaaaauuauguuuaagucaaauguaaauuaaacagaaaauauauuuuguuagaaaauaguaguuaauagacgugggugaaguggcauacucagacucccagaugcucaggaagcugaagcaggaggaucagcugagcuaaaucagucacacuugagucccuccacagucugggcaacauaagguccacucucucaugacagagaagggaaaaaaaaagacagagacacagacagaccaugaaauuaccaaaucagcuaucacuuuaucaaauaauaguuaccaauaaugcuuguuggcaugauuaaaaaaucagguaagauacauccauuguauaucaugggguaagaaauuguagaacuacauuuguuuguagguaauugguaugauaugacaaucuaaucagagaaaauagaaguuuuacagcauacauuugcgaucuuuccaauauugccagcuauacugucuggaaguuuggaagccuuauuuuguuuuuaauauauauauuuauuuuuauuuuauguguauggguguuuuaucugcaugcauggaagugcaaugcgugcauaucuggugcccacagaggccagagugggugcuggauccccuggaacuagaaccccugagcagcuuuaagccacccugugugugcugggaaccaaaccuggcuguucugcaagagcagcaagagcuuucagccaccgccaucucuuccgccccuagcauggcaguuguagugcuugcagccuccguguuuuguguaugcaaggcauuuagcaaauacuugcugaacaaaugcuggugugcaggaaagcuauucagccuguuuuccacauuggaaucucccuuucucaacuuuucaauucaucacuauuuguugugaucagccugcauuucaagauuagcaucuuagacaggugugcuggcacacaucugcaaccccaacacaccaggagaugcacgcagaggaucaggaauuugagauccgcaucagcuauacagaaccuaucucaaaacaaaacagaaacaaaccaaaaaacuacccucuccagcccgggucaguguucuaagugaaauuaccuuccucauuucugucuuugggguuucuucacuguagcuagaauaggagaaaugcaagacaaugcaaauaguuggacagaaauuuuucaaaucauaagacuuaagcuuguuuuaauuuuauuuaaaauaauuuuauugggcaaauaaaucacuagaaaaauuaagauggaaaauuugagaaaaauguauaauaucugguagaauuguuacaguauauagcuaaguagauuuuugcugguuuguguguuaagaauguuuugcacuagccauacugcuuacugaacuuuaaagaugaugcgguuuggugggggcacaugauuguguuugcagauguugcauuacgauguuugguugaaaccuaugcugccaguuuugaggaaaaggaugaagaaccuuuagccaaacgcauaaagaaugauaagacagaaaaagaaaguaacacuuuggccaaggaaggaagugaaaaagaugucccagagacauggaccccgguggcuggcauugugauugcgcucuguugucaccacaggugugacuggagacauuaugugggcaaagaguauuucaaggcucuuggacuuggggcgguagaguucuacuauuuccagagaaugaguaguugggcaacguguggaaugaggacaucguuggaaggcucggauguuacuccagagagaaaagaugcucaaagggaugagaaugaagagcacgaugauggaggagacagacucacagauggcaacacugacaguuugccuggguaagugacgacagcuacaaacaccaugcuacagggagauacuuuauccccguaaacuaguccuccugugggugagacugcacagaugccucgaaccguagauaaaacagaaccccacacacuagcauugcacuuaccuacucuguccaucugguagucaagauggcugcacaacgucuagcaagugggcagcacgguguggcugugcuaaggaugcucaugugugaggcacagguucauuccccggauaggaaggaguggguggcccaugauucaccaugcuacucagaaugccacuaccaaugguucauuuucagaauuuuccauugaauauuuucacacugauugaccuuggccaggagaaaccauagcaaauaaaaccgaaugguuguuucuuagucuuuuggcugagaucaaguauacaaaguaaaacugaaggagaaggauucuuuuuuuuuuuccuuagaugacuguuaucaaaaauuuagaaaauauagcuuacauucuaauuuuagaauaaacuaaaacauauuuuaauugugaucauaaagaaaagucuuagauggggcuggagagaugacucaguggucaagagcaccgacuggucauccagaguuucugaguucaauucccagcaagcacaugguggcucacaaccaucuguaaugggaucugaugcccucuucuggugugucugaagacaguuauucauauaaacaaaauaaauaaauaaaucuuaaaaagaagaaaaggcgucuuagaagcaucagacauagcgccuaguacgugcuguuggcuaguuagcagcuucguaaauggcaguggccaaacuugguaugaacuuuuaccaaacuuuaaauuuuugugugcuuauuccauguaggauucuuacuguugaagaaaagaagaaaauaggacaucuuuguaaacugcugauugaccaaggcagacuccaguauuuacagcagaaaggcuucaguccugccuuacaguacuauacggacccauuggugucucuggaaaacguauuauuaacugccguaccagcucauccgucaucgcaggaaaaacaucaucaaugaaaggaaacaugaacgugacguuugucuuccacaaacaaaaaaauuuaaauuauuuuuaaauuauauuucgauauucacaaaaauauucaccaaguagucaaaguauuccuuuucagcagggcucuuucaauuacuuucuccaucagaauguauagagcuuggcauuugagucagacaguugacuuggucuucugaaagauauaacaccaguauauaauuauagugugaacucuguguauuaaucugguaaagguuuuauuugauuuuuuucauuuuuugagcuccaguuauaauaaacaguauaaauuuauaacaaggaucaaucugagugugaggcuuuuuuuuuuuucuuuuuuucuuuuuuucuuuuuucuuuuuuccccgagacaggguuucucuguguagcccucaauguccuggaacucacuuuguagaccagguuggccucaaacucagaaauccgccugccucuaccucccaagugcugggacuaaaggcgugcgccaccacgccugagugaggcuuuuuuuuuuuuucaauauaggucuagaaagaauaauuguaauuaucuugaacacagacaaauuuagaaauuuaagaauuggcagccgggcgugugugguggcacacgccuuuaauucuaaguguugaauaaaguccauguucucaguauuuuucaccccag

SEQ ID NO: 1688 - RNA, 974 nt, Mus musculus
cucugaccaccccaauuugaauucuaaguggcugaucuuuucauucuucagaacagccgugaauaaugcuuuaaauaaaauuauggcaaacaagcuugaaacaugauucugguuuucuacaauuuucacaaguucuuuuaaaugcaaacaauucuuuaccauuucuuuucuagugcaucugcauuaaggcuuugaauuauuugacccaagauuuuacaaugacucagguuuuacaagguuaaagcaaacagguccauaaccauccugccuagugucgcugagucagcacgagcagguaaaggcucaacaccuaaggaaauggcagagacggaguuacagauagagcuuuaauuaaagauguguaauaaaacaguuuaguggcaagagaguggugcuaauauaaacaaaagguuucuuuuugaaagaaaguguaacaucuuuggaaaacuguccgguucuuucuuuaguucccacggaguucaugcaaguauuucuuaagacagucuuaaaguacacugcagauggaaauggaauguacauccagagcuacaggugaaaacuaagaccugggugcugcgagagagagaagucuuccugauuuccgucacacauucguguccuggaguaaagguucuuuggccucuccuggcgcuuguguacugugaggauggcugugacugccacagugcuuccuccaacugcuggaccuuaaacuuaaauuaguguguuccggaauaaacaaggcaacgagcagagccagcaguaccgaacaggcuccaaagaggaaagggggaccagggaugauggaauucugaggaagaaacaauaguuaauguuuuuugcacaaauacuccccccagcccccguccccagccuccaaugucucagcaacugucugcucagauuuucuuuuuuuuuuuuuaaagucaaugccuuuauugaagcaauagcuauaaaaucacuuuucaggagaa

SEQ ID NO: 1689 - RNA, 4134 nt, Mus musculus
gugcgugugucagacauuuauuucauuuuaauauccgugcuuaaugucaguuuugaagaugcuaguagaaacaaggacagaagcucaggggcugccaagcgaagcucacguaccgaagaggagcagaugcauuaggcuuuauucuaauauaucaguaaaucuacuuaacuacacugugacaaaacagucaugcaaauaaaauuaaauaaaccuagaauaaacuuugacagaaccacauagcacaaaaugugaaggagagggaauaaaaauuaguguagaagcauaauauuuagauuucaagcaaauauauauguauaauuaugucucuaguguuaguuagaauaugauuauggaauauuccugggugcagaacauguauaaugauagaagaaaauauaaauuaagguucucucucucucucuguauguguguguguguguguguguguguguguguguuuugggaauuuuuaagccucucuaugaucaaucccauagacuuacacaauagugcauuugaggaaggagacuuugauggagguacaugggccauacacaagcaaagucugaaggcaaguggcagaguugcugucauaauccagacaaugaggccagcgagauucccagaagguaaaggugugcugggcaugcugaguccggcacugagucuaaucacuagaacugacaaaaagguggaaagagaaauauggccccauaaagcuguccuuugauguacacacauguaccuuggcaugcacaacucacauucaaaccauacacaggcacauacacacacauagcaauaauacacaaauucauuucauucacaaacacacacaaagagaaacaguuaagagucaggaagagcagaaugaauagaaagcaagaacuggaagauguggucagaaaugaaauacaauauuguauaagcaaaaccauuuucauacaggcaaaauaaaugcagccauuggcaucuacugucauuuguuuagauauuuuuacuucuuuauuuaugacugcuauugccugaggguuugaaucuuccauugcugucuucuaccuucugccuccucucuuugaggcucugcucuaguucucagacuggcauugaacauuuaggcugaggagauccucaugucuucugaguccccgagacugaaggcauguaccagugaucuaggcugcccugccuucugaaaucuucuuucauuucauuucauuguuugaugugaauaucugaacaacaccagucgaaugagcugggcuaaaacauuggguugaaaccauuucuugcuucuuccauguucuggaagaguuuauauagaauugguauuucugccuuggauauuuggaaggcuuuacaagugaugcauaaauugaagccuuauauagacacacaguuaugugaaucuauuuuugaauaagcucucauguuacauguuugaaagaauuuguaugguucaccauuuauuuaucaaccauuaguuguaguuuuuuagacuguucuaauaucuacaguauccacacugaugucccuuuucaauuucuaacaucagccaccaucugugucucuauuuuuuucucaauaggcuugacaacuugacaauaggcuuuucccaagucuaguaaucuuaccaaaaugucaauguugguuucuuugguuuucaucuacucuuuuccugugcuacauguuucuauugucauuuuuaaaguuuucuucuccucuucuuguuuugugguuaaauuaugauuuuugauuaauuaaagaagaagcuuggaauuuugauuggaggccuuugguuuuucuuucuuuuuuuccauuaguuauuuuuauuaauuaaguuauuuauuuacuuugcauccugcuugcaguuuccccuuuuucuuuuccuccaagucccucucucuuauuuccccuuccauuccauccacuccuuuucucauucuccucaguaagggaagucccucccaugaauaugaaccagccuuagcauauaaaguugcaguuagacugggcucaucuucugcuauugaagcuagaaaaggcagcccagguaggggaaagggauucaaaggccgggaauguagucagagauagccccggcuucugcuuuaggagucccacaugacaaccccacuucacaacuguuauauauguguagagggccuagaucuguuccaugcaugcucucuggaugacaguucugucgcuaugagccccugugaucccaaguuaguagauucugcagguuuucuuguugcugauccgguuccuucaauucuucccucucuuccacaggauuccucaaacucaaccugucuggcugugggucucagcaucaguuuccaucaguugcuggaugaagccucuaugaugacaguuaugcuaggcuccugucugaaaguauagcagaguaucauuaauaauguuggggugggcucccucucauggcauggguaucaagcugggccaguuggcguguccuucccuuaaauccugcucccuguuuuaccccuguaccucuugugggcaggacaaacucugaguacuucauugcucucugaauggucgcgaggaacuauggaagcuuugcuaugguacuucacuugccuuguguacaacuucagguuuuuuguuacuaauuaacacucccagaaaucuuugguggggaagauauagcuucaguacauuuggaagugaggaagugaagacagauaagcugaguguucugauugggauuugaaaacuagaguuugcuuuuaaauaucuuguucuucccacuacaccauauggauucuugggcuacuucacagauucucagauguagaagaguugaagaaacucauaaucaggcaucacauuggauauaggaguguuuugguuuucuuuauccaugaugaguuggaguucuaaguuuuauuucuuugaacagcuuaaaaauuaccccucaaggcuguuguaucuagaggaaaaucacuugcuauucuguuugccagcuacugugguggaauuggccuaaauauggcuuuguuuacuuaccacuuaggagucuccauagccaaguagacaggucugaccuaagaaaacaacugaaaaccaauggagcagugagguccuagaauguagaucucagaggaaacagcucugcaacuacauccugauugacagcuguggcauccagaacauguuuggaaacugaucaaucauaguauacaaaaaggcauuuguaugacuugagaguaccagaauguugucaugguuauacaaaacauacccucacaaguaaagcgagggauaagaggcaaaacuuggcagaaauugauaaauauauuaggaauacauuaaaggaccugaucaucagcauuacauugagaaaguucuuaaaauuacuauuguaugaugugcuggaacaagagauugugcuuacuaucuaaacugacacuggggagugugguuagugggaguguccugggaaauaauguaaaaauaaauaagaccaacccuguucuacuggcauguagaugcuaucccuccaaucaugaaacugauauuggagaauaaugagaucugggcuauccugggguauacaguaaaacucuuaacucaaaaauaaauaaauaaauaaauaaauaaauaacaaccaaaugaaccaaauaaaugacaaaagcaaaaaaaaaaaucuucucagaaaacucaaaccaaauaauuauuuuaaauacaaaauaaaugccaauguugagcauacaaaauaacuaucaaaaccaugagguggauuuggcagcugacugagauagccaggagcugugcuucacaaaacaagagauuauagaaacuagaaauaaaugcuagaaagaaauugauauucacaaaaguguucaaggaagcacuguucccuguaaaagagaaaauggaagcuaugugagagagcacuguucagaugcaagaagaaaaaugacuuaagagaagggggaaaugucaggaaacaaauuaucuaagaaugguaaaaugcauaaaugcuagaaaauguuugauggugacgugcaggaaaaacuugaaccaaacgggaucagaggaaaacaauacguugaagaacuucagucacaacuuuauuacuuagcauagaaguagauccag

SEQ ID NO: 1690 - RNA, 2624 nt, Mus musculus
uaagguuugaacucuccagaguuaauugccuuugacuuuauuauuaauuuuuuuuguuguuuuacuuaaaaauauuuuuauuuuuacguuuuccaggcugcugaaaaauggcagccgauuccagacuucugcuggacgcagcauggagaccuucucuucuaacccaggcagggcaccgacccucugagaguuuauagucuguaaagcuauuacuauuguuguuauuauuaauuguuuuaaaaagcuaaaauuucauucuugucuuggcuuccguuaaggaacccagacgcuccacucacacacuuuuaaauuuuuuuuuggcguauguaugaguguuuugcaugccuguauagaccuguaugcugagugugccugggaggccugaauaggacguucaggggcuaggaguuaccgaggguuugagagccuugccuuaaaggugcugagaacugaacccagggaauagucagugcucuuaaccacugagugcccccaauuucccccuuuugggaaaaugugcugaugcaaauuauucucacccucgcugagcugucaaauaugucauguacauuuugaggucagugagagccaucccucuacuguuacaauguaacuacgauuguaauggcuuuucugaccauaaauuggcuuagcucuaggaagacagugugagaugugcuagaccuaaggaagcuauaucuaugauuaggagggcuuuggguuuccauaagauaagucagugaccccuuucuccuaugccuucuugcaugcacacaucuacagaucuuuguggugauuugacguuucaggccaugugaacuuucuagaaaaauggaguugcucucuucuuaagugccuagaccugucuuguauauuuuugaaacuuccuuaagaccccuaugaaaggauuuauuguagggauuugccacccucuugugauuggguagcauccugaucgguuagcaucuccugucuccacaauucucucuauugguaauugcuucugccggaggcagcuauuuaaagggaucacucgugucuccgaguucuuguaucgugacuuacuugccaauaucugggagaaacgaaccugugauguccuaugacauuuuaaaaaaaugguggugguuugcauuaugaccaaucagauacuguugauaggucagagaaaccccccaaaaagaagugcugagagagagggggaggggguugucuuaauacucugaacacugcggcucuuuaucugcucuuaaauugagcaugacuucaagucaugccuccuaauuaauuuaauucaguguucuggcaucaauaaguaauugaauuauaaaggaauucaguguaacagcuucggacauuuuguuuucuagaagguucacugaagaguagaacaguucagcgauugaagcaggaaugauugacacacucgggagcugugagugaggcaaacaccaaguguagcaggcuucguggcuucuacccucgcugccagcggcaguucggguuucagggugucacucuguacccaucauuucuucccuggccuccaccagauaagucucuccugucuuaagugagauuagaagaauauugcagagggccuacauuucucuguaagacaggaagaccuggguugaccccaacggccagcucuugaggcccugagccgaaaagucuugaauagauggguucaguuuaguggggaguaauuucuuuuaagaguuuugagggaguuugcauccuggccacucauguuagaguaaguucaaaggaagaggcgcuguguguaacagucucuuagggcuggaaauaauguaaacaccauauucccagcuugggaaagcaguggaguagccaaaucagggauauucuguucuucuccaucccacgagucaguccaggugccaggguugguguggucaccuugaucuucacguggguuuuaaggagaggcuugcuuagcuuaguuugcauugaggaucacugauggucacauagauuacaucaccaccaagcuccacaggguuggguuuggcacugggucccacuccucuguaggaaaggggcuggugcaggaaacguucuuacaguaagacaauccaugaugcugagaaaaaaaaaaaacaaaacaguggcaauagugugggugggauccggcuuauauucagaacaaucgaguugguggugggagguccgcauuccccuucaagcauacacguguguggucccuucugaagguguuaucauccauuuuccggguagagacacggagaguauauggcugugcccagugccuguuauaaauggagucgcaguuuagaagcuaucucacaggauuaaaaguugaaaaagagaggacucgcauaacagcuuaacugcaucacacaauaggcuggcgauagcuucccaguggguuuuguguuuuauuaacacuguuguucagauuggacucugucccccugcaaaacuguuacagugacauauugacguuguuugccgauggucuuggcugaacucaucucucuaaaguccacauagucuuagacuuuauuuugaaagagugccaccuuuaccuuccagucuuucuaguuguuuuguuuccuucucuaagaacgaugaaagca

SEQ ID NO: 1691 - RNA, 4631 nt, Mus musculus
guaugagaaaccacagcaguuuaauagguuuugauggagcauacagcaaugaaguauauacauggaauguaaccugccuuaaaauuuuugaaauaauaauaauauuugauaggugaauaacaaaaaauguagauacaagagcagauaccuagagcagaagcaauggaaaaaaaaucuacuggcuuacagugccaucugcugcugggaagugguaacugcauuagcccucccuggcaggguuuuucaagguuggccuaggaaggaaucuuacucaugcuauauaauauagcuuguguuaaacaugaauauggacuaagggggaaauaaguauuguagaacuaagggaaaauaaacuguagagaaaaagcauaguacaccagaaauggcucugcugcccugugguaggaagccgccuagaaucuuucaaauaagaaagugugcauaguuuacuccuguucuguggaccuuacaagaguccuacggguuguuuguuuguuuguuuguuuguuuucuuuccuagucuuuuuucuucaaagaagaaguguuaucuuuaauugaucaucucucuccuacuuuucccccuuuuggcuaaaacucacuugcuuuggcaauuuagcuuucauacaaaugccauguguuuuuauaaaucguagguuuucagagcugggaaaagcccuccagccuagguuuucgcauucacaacaauuagcuacucuuucucuguguguaccaagauguacccugccuccuucuuucucuguuuucuuuuuggcuucacaagaacggggguggggguggggguggguaggaggaguuguuggauuacaaacuucaagauaaacucuccugagaagaucuccauguauuaauuucuaaaucagagccaaguggugagugggguuaguggcuugccuggcuuugcaacuguacacauuuucuccaaacagacaagguaacuguuggguggaagaggagaagaaggccuagguaagcugucacaguucaccuugccgccacauagaguggaaggacgccagggaggaggaaagcccuccucuggguuuaucugccugcagaaaggauuaacucugagggagcacccacuuugaauguagacuuucuccagccaaaggcagggggcucgggugagacaagcaggaggaaggagagagcccccugguucuuucucuuugcuuuccagccaucacagagaguuccuuagcucccuaaacccuccagccacgguagagugaagccucgagucaaaauaaaucuuugcuucucuaagucgauguuuguguggguaucuaucacagccaugaaaggcucagcgaaacauagcggaaugcagcaagacuuuaggaaaucaaucacaaguuguuuuuucuagaagcauuuguauacauuaauugcuaaugggauggguaugagauacuuggcaagaagcaaaagcagaugacauucuuguuuuucaguagucgugaagagcaaaucuacucucacauuucagaguagacaaaugagcucugccaaccgugacauuuacccaacuagacaaugaaagugcuagucucgggucaccaagaggcugacauuuguccuacaggucucuguccuaugccaucucccaaucuccaaacccccugcuucagcucuuccucgcucccaggccuuugauucaaauaggauccaguagugggcauucauagcuaaugacggaguuauuagucacaaguuuucuuucaggguguuuuaaguuuuccuucuguauauacucaaauuuuuauuuugguuugucuauuuaagacacuguagauaggguugaucagcggagaagauguagggaaggaauuuccaggugccuuggaauuauuucucccacucugacaccuuacauaagaaagggcacuaaaagcauucaguggcacuucuaaguguuacgacuugugucauauauaaggaaacacaucuaccacaugguauuuucuccaaugagcaucuccagauagcacccaucaggaccagguuucagggaaacacaaagaauugucuucacacuuugaaaggagaaaaugguuucugaagaccggugugcaccauaaaagacuugaguaagagacauauaagagacuggugcagauacgugguggaugaaaguaggagguuucuucaccaggucauucauauauccagaggccaagagaugugacaagaugugacaagagaugugauugucacgcaaacacugccguuccuucuuacucagcuucugccacaucucuuccauggcuuaauccacacuguuacuaaguggagccaaauaagcugucauucugaucauuuuauucuccaugucuaacagagcuuuuugguucugcuucaucuuuauuuuccggcuucaucgauacuaccguaaucaucacaguaaauauaaauauacaugcuguguguauuuaagccucuccauccaucgguucugguacuaauuuguuugagaugcuguggcuaaacugugcucuuucuguaguugugcaaaugucuacuugaaggggggacucuaggggaugaauucagggcccccuggaaauccagcuacucguucugagaagccugcauucaggaauguucugagagcuaagagugagaaggaagauaauuagccuggaagggauuccuccccgcacagcagagauccauuaaggaucauuacccucuaaccacucccugguuauuuuuuaauauaauauuuguacuaucuuuuacuauuucuauacauacaugcaauauauccugaugcuauucgccucuaacuuccaccgaauuacucacacaagucucugagaacaucccaaaagaggaagcagaaagauuguaauagccaaaggucggagaggaccagagcgaaauaauaucuucugaaacaugacgggaccucugcacuuagugggcuagcagccugacgguguggaggggcagguagauggguuggggcagagaaaggggaccgagaaggaaaguccuccgcagcccuuuuuaaaacuccucaccucagcagcgcuuuggugcccaccugaauguugaagagaaaacuguucuugccagggacauucacacuggaugugcuucaaagggugcccacuggaaaaucagaugaugaugcaaagaggagggaagugagcaccccacacacaaaagggagagaaagagaccuacugauagacagacagagagagagagaggagagaggagaaagacaggagagagagagagagagagagagagagagaaagagagagagagagagagagggagggagggagggagggagggagggagggggagaggaagagggagagggaaggagggaggaagagagagagaaaggagagagagagagacaggagagagagagagagagagagagagagagagagagagagagagagagagauauuaaaucaguccucugagggcuuuguguuccugggacucacgcuggagaagauucagccuuauagaaauagcagcuggaaugauagacacugagccccuugacagagugucgccauugcugucugaucuuagcucaaggaugacaacagauugcaacuugaugcgccuggaagagaacuggugaaccuuucagggcaggauucggcacacacaaagcaccacuuaccugugugugacacaccccugcaagcuccccgcccucaggaaugaucccugaggccucacuucuaacuccaggcgcuggcaacgggcccaggcgucgcacaguggucaggagcacuuccugggaaccggugcugcgcaggugccacccccgcucccagcagguccucccagccuaaagccaccacggaaagggcgugucuaggggaccagcgcccuggaccucuaggaggcgcugagcccugcucgcccugccgccccuccugggccacuuggcccggucgccgcaccucugucccgugugcaaggcgaccaccgccgccgccaaucccagaugccggguaccaugcagugcuugggcgccgaguaccugguaagagcgacaacuugaguccugagagaagcggccucugcgggcaccuaccugcacagacaggacgcuuccggcuccucuguccuuugggagauaaaccacuuucucucagugacaccgcuccuuuaaagacaccuggcacugaggacccaguaccugacacaaguguugggcugaggccaggaaggcgcaagggacuagggggugaggggugucuuaccucuaguaagaacuuggcccccggggggguuucacauccauccugcagagagcugaucuuccccagugauagaguugaguugcuuuagcagccuuuggagagguuucgguucgguugauuucaccuaacuguuucucuugcuuuucucaacucuccguuuuccuggaagguuucugcagagaaaacaaggcaaagagaauggcgaccccaaauuuauagaaaaugcaccgauacaccguggcuagucuuguucuuucucuuuuggacugguuugguaaguauggcugcuuggcaggccuaaaucccggguguguguccagauacaagugugucuuagacguuacugguuuaaaguuuaugcug

SEQ ID NO: 1692 - RNA, 2923 nt, Mus musculus
agggcugcacgguccagcuaauaaucccugccccgaguaucaacugggaugaacaucagucacugugaucaaaauagcugagcuucucacggggaugguaagauuccucugucugugugccucucuuuccaacacacacacacagacacacaaacacacugacacacagagauacacagagauacacacagauacacacagacacauacagacauacacacagacacacacauauacacacagacacacacagauacacacagacacacauacagacacacacacagacacacauacagacauacacacagacacacacauauacacacagacacacauggauacaaucagacagagagagacacacagacacacacagagauacacacagacacacauggauacaaucagacagagagagacacacacacacacagacaaacacacagacauacagacacacaaacagacacacacagauauacacacacacacauacacaccacugaaagucucuccuccugcacauaccaccaauccuuucuggcuugugguuucuuuuugguuuccaccaaguccuaguggccuggauuuuggugaacaaaggcaucuuuaaugagcuauggaauaaaaccaaagaaaccagcucucugccuuuggugucccuacaaaaagggaaagguaacuuggcuuugcaacgugacacucugcagugucacucccugaggaucuaucugugaggcacaugccugggaaauggagguaggccugcuucccaagaugucuggucugcaccugccugauucugaacagacgcaggagucuccaacuuccaaauuucccagggugagcauagacagcauccacucugcauuucacuuucaaaauaguugucaguuaauugcuugagacauuggacacauucuuauaaaacagucucugugucaaggauuucuccgugcuguaggcuaacugcucugaauauccagggcaggcuggacuaagcugggaugccuggaaggucagguauauuauuaauuuccucuucguguuagaauuguuucaauuucuggccagcucugucacccuguucagaguugaggagcaucuguagggcagaagaaacuguugugguugccacauacaccuccacacaaagagccacagggccugauggaacagagcuggucucagauaccaccgagaaaggcuaaagcuggagaagcagcuagacagagcagcuaagguuguugaagauaguccaacacauuacccacugggcaaaucacauucaguuuuugcuucaaaaagggauguaagccagacuaggugggcagagaguaggaugugcuguugagaucuuugccgcucuggguucacaagcaccugcugugcccuggcggaugcagagucucuagaagcaggcucuucagugugacagacacucaggcaucugcaucucagguugacaguuuccccagauuucucaagggggaugagggaugauggcuguuaaauggucucuuucaggaaacaacaucgaucugcccaacacaaagacuaaguacagucuucacaaauagauuccuuucuauuggacaucagaucccugcaccuccccccaacaaguuuaugauucuccaaacagcuauuaaaauugcauagcugaauaacaugaagcaauaggcagccuugaguuuucuuucauacuguuaugcuuuauaauucuacccuagauaucgcucuaucacaaacaccuaucaucucccaguauccccuuggaaaugcuguauuucacacgcuucuguuucuauaccauggcauuacaguaaaaauuaaaagaauaugcacauaggcuggggcuguaacucaguuggcaacguacuugccuagcacaaaugaagaccuggcuuccauaccccagcacugcauacacuauauaguauucuccuauacucccaacaccuaagaggauacgagugcaaggucaucggucuaggaucuuacguauccuaguuccugucucaaaaggaggaggaggaggaggaggaggaggaagaagaguauaagauguagggauuucaacuucucaguuagucucagacuaccuggcaggcuugggugggcaucuuuuaguagaaagccaugggccaucuucccaggucaagaggcagaaucaugauccuugauauaacauuucaggggacuccucuagauccccuguaagucccugggagucuaauccauccagggugguucagcaucuccuuugccaggcugccucccauuccacaguaaccaugcagacaucacaugcagagcaaagcuuguuuccaucaucucuccuucuggguuuucucugcuguacacacugccuuuucuuucccuccuacuuuuagugagaacaacauaaagagcugacaggcaacgacuacagaagaggcacagcggucccucugcagcggagccuucggggagugccccacccccaucaggaccaacugagcucuuucccaucuuacaggcaaucuuacaggcacuucugcaaauuggcaccuuccaaaacugagccuggagacagacauccacguggcucuaaagagacuccgaacauguuccaggcgucagugcugcgccaguagcuagcugaagugaccuugggagaugacuugaccucucaaaaccucaagcugcuccccaaacauaccaggugauuacaggcaacgaaugauaacauuauaaagccugauccccaauacaugcaaggcacagucugcaaaugugaguuuccauuccucuuugaagaaaggcacuagaaaccauccucugucgcugacaacucucagaugcugggcgacccggaccucuguccucagagaagguggacaaugacugagucacugccggacugcagcuggugcug

SEQ ID NO: 1693 - RNA, 25223 nt, Mus musculus
gaguaaaaagaaguuugaaagagaauguagagaagcggagaaagcacagcagaguuaugagagguuggauaaugacaccaaugccaccaaggcagauguugaaaagguaaggacucuaaacucgcuauaaaacaguauuacuacuggagcguagucauugcguacagccaacaauccuacuuugauaaccaaauauuacaugcauggaaagaaggcacaccuuuugcgucauuauuguaucuaaagcuaaaauaugcaaauguuguuuacuuggucugagaaggaaaaaaugauaacauaaugccuuaguugcauucauaaugcucaggauaaacuggcugcuagggguuuuuucuuccuuauuccuaaauugaauaaaaagacugagauacagcccgaguaugcuaauugggugugacucaguaguccucuucagcagcucuacagaauguaagcauugagcuaucaccaugguaccugguuacucaaugaaauucuugucacugauucugagcuggcuauucuguagcguaauuugcugagagauugauuggucuuguaacugcuguuuccuaguuucuccucuguuaguugauaggguucaguuagcucccaccccaccccaucuuuauuauuuccuuauauaggcuguacucaucucuguuucacauuuugaguuacauaaacaaaugucaaauacauuuuuaaauaauaguuuugaauaauaauucugaaacugacuguaacacuggugugucugaucuugauuaccucccuuaucugagcacugaguucuugcuaauaugacgugaguguuuaugaucuaggcaaccauguuugaacugacucccauggcugaguucaugauuaucuugucuuuacauguguauugguaugagaaugugccucuuauaacuuaaagacuguauuuaaaauuuguauggacaucuuuaucuauuaugagcuuugauccugcuauuuaaguuuuuauauccuaauuuugauuauaugauuuccuuuccagcauuaugccauauucauaauugaagaauguguuacucgauaguauugugaguaacagcacuauuuuguacaugggacaugucucaaaguugacauucaccuuuaaacacuucuuugagucauuaucaaauaaugguuauucaaauuugugucacaggcaauugaaaguuacuuguuuaguggauucacauuuaacccuuuaauuugucuacaaggauuagcuuuacauagucacuaagcaucgggaaaccgagauauaagacggcugcuaguuaguuuauccuaacuuucaagauuucaguguucaugguuuaauguucaguuauuugaaaucucuuuauuauuagaaaauuagacuaggcuucaauuguuugagcuuguagccuuauucuuuuuuauucgcugccgaaaccuccauccuagcugggaccuggaggaguguccccuggcaggucaggaggacuugaggcuaggacucggaaucuuugucccacuuuauaguuuaugguagaaggagaauguucuaggcuggaaccucagguuuugucucauuucauuuuuuuccucuguagaaauacuuuguacuuugacucauaguauuuaguuuccauaguauuuacuugcaggaacuugugaugugccguggauuaaauaagguuuugugggcuuaucuaugaucuuggcuacccugcuuccauagucaguuuauuucugaauuaacaagauagaguuauaaacuaguguuagaagcuaaguaacugcaucuguaaaagcuagcauccuaagagugagggauggauggauggauggauggauggauggauggauggauagauagauagauagauagauagauagauagauagauagauagauagauaggacugggaaugaggaucaaaccagagugcuugucagcaaggauaaagcccuuacguucaauccuuagcaaaagaaaggaaaaaaaaauagugugcuguguaacucauagcccugauguauacauagcacacacggcacucgcacuucuucccacccucccucucuuccuuuacuuuugccauguugugcucagguugugcugcaacucuguugccucucuggccucagccuuugcauguacaugagacugcuggugugcaguguugaaucuguggagaccaauucuuacuuccuaauuuagaucagagucuaauuaguuaguguuuuacucuugugaacagauacuaugaccaagacaaugcuuauaaggacauuuaauuggggcuggcauauagguuuggaaguucaauccauuaucaucaaggcaugagcuuggcagcuuccaggcagauguggggcuggaggagcuaagaguucuacauuuucauccaaaggcggacaggagaagacuggcuuccagggagcucggaugagggucuuaaagcccauguccauauugauagacuuccuccaacaaggccacaccuucucuaauagugccacuuccugggccaagcauauucaaaccaacccaaucaguuaggaaauuuguuuagcuuauacucacuguguuagaacuaacaguuuuacuuuuauucuugucagagaagauaauacuccuuugcccuugugcaagaaauuaaaggcagaacuauuuuaaauaaguaccucugguuucauagagauugaaacacuguugaguuuuacaguacccaacguuuuagucauuuacaucuauuaugauuuuaguuucauuuauuauuuucugugugaauuuuauaaguagacuauuuauauuauugaauagagcagagcucucauagggacagagggauugucauaaggagacuguaagaucuggaagcauuuucauuagcuguuggguuaucuauaacacaauuuagguuugguauaauuuucagaaaaaugaauuacuuuauuuuuggcaaucauuuggaccauuuuugccuguaggccaaacagcaguugaaccuucguacgcauauggcugaugagaauaaaaaugaauaugcugcacagcugcaaaauuuuaauggagaacagcacaaacauuuuuaugugguaauuccucagauuuacaagguaaguuuagucuaguugagaauuuuuuugagacaagguuccacuguuuaucuucccugguuggccugagcucacagaaacccaccugcuccuguuuucccagggcugggguuaaaggcaugcaccaccaugccuagcuaaagaguuaauuuuaaguuagaauuuuuuuuuucaguuuggaaauaaaaccuagcguuuuacaugacguaagaaagcauuuugcaugaugauacaguuccaguuccaaaacucaaguauuaaaccuuagaaaucagaauauuucugaauucacuagguauaaaauuuacuguugauaaauuuuguucuaauuguaugugaaaaguagauguuauuauuuuaaaaccacagacuuuucuguauucuggauucacuagguauaaaauuuacuuuugauaaauuuuguucuaauuguauaugaaaaguagauguuauuauuuuaaaaccacagacuuuucuguauguuuauuauuaguguuauugucuuaguuugggcuuuuauugcugugaagagauaccaugaccaaggcaacucuuauaaaagcaaauauuuaauugggguuggcuuacagguucagagauccaguccaauaucaugguaggaaguauggcaucaugcaggcagauuugguacuggaggagcuaggaguucuacaucuagaucugaaggcagccaggagacuaauugccacacuggauggagcuuauauauaagcucaugccuucagagccugugacgacuuucuccaacagggccacaccuccuccaacaaggccacaccuaauagugcagcucccuaugguacuauuaugacacaaaaauucaacuuauaaguaaauuaccuauuguguuugggggccacuuuggaauuugcuuagagcagucuaguuguuuugugaucaaacaaagaaauaaaaagcaaaggucucaaaauaagaccccagacuuuagaaaguaacaacaaaaagugaucugaaguagaguuugagaagcugaggagaaaggccaguacuggcugagagcaagggugcaaacaugacuuuuaacguacugaauguaccugucuuagcauauuuuccauagugaguuuggacgagggggaauuuggugaugugacuuacuguuugccuuucaugcccucaacucugagcugcagucuguaguaaggucuggguaccuguuuguaugccaucaauugugauccuucauccagcuaggucuuaacucaaguacucugaaccaguuuaaggaguacaucuuagacuugugucuuauggauaauugcuuuaaaagagggggcagggauuaaugcuagaguuugguguuuaaauggaacauuuccugaaagcauaaaacuacccaaauuuaagagaaaaggguaggggagguguggagcaaagaccugguugccaguuguugauguuuuagaugauuauuauuaauaucaguaauaaaagccuuguauuuuccuccuuuuauuauuuauuuaacaggcuuuagauuguaagaauuauuaagucuauauggcaccauugaaaggucuaaaauaaaaguguaauacggaagaaauauuuuuggggaggucacuaaugguucuacagaauagaaaauucaauuucccuccuuguuugaauucuggauuauuagcaacuacaagaaauggaugaacgaaggacaauuaaacucagugaauguuacagaggguuugcagacucagaacgcaaaguuauuccuaucaucucaaaauguuuagaaggaaugauucuugcagcaaaaucaguugaugaaagaagaguaaguacuguguagcugucucugaauuggugcguguggugaguugugcauuugaguuaaugagaugguuugggaaagaaguaaaguaaccuaaggaauacgugcuucuuaauuauacuuugugugagaaagccuugcguaagcuagacuccuacaauaagcucaacucuuauucuuuaaaagaaacuugcagcccuccccuuuccaauauuuuuuucuaauccaagauuaucaccuuugaacuauguguuuaaauuauauuauucuaaugaaaguugagagaaggaugugguuagaucgaucuaguguugucagaucaaucuuguguaguccaucuugaaugcaagaacuagugcuugagcugaucaagaaacaguguagaauagugaugaggaggaggaagaagagggcaucaggagucaaggacauagcguagucuuguucuugagagcauagagccagaagcaucacagcuuaggcaaagggcaacauagucuucgaucucauuaguucucaguaaaugcugaguuacuaagaagcauggacaaguagacucugccauccugaggggaaaacagagugucagauauuuaccauguacucaagucuucagagcaagcccuucagugaaagcuagcaacgagccugucuguaacugagucccuacauuuaauaauaauaaaaggagggccuuuuaguuucuuuaguugagaguuucaaaguauguguguguuauauuuuuucacuugggauugauacauugaaugcuuuuucuaacauugagggagaaauuauuuucuuuaagccuuuggugauuacuauagaacuuuuuuuaaaaauuuauuuaaaauuuuuuugaaagcuaauguacuguuaacaaaauuguuuuuaaaaaauuguuucuuauguauaggauucucaaaugguaguagacuccuucaagucuggcuuugaaccuccaggagacuuuccauuugaagauuacagucagcacauuuacagaaccauuucugacgggaccaucagugcagccaaacaggagaguggcaagauggauuccaaguccacaguggggaaggccaagggcaagcuguggcucuuuggaaagaagccaaagguaaaaaccauaaaaauccccauaugcuaaucaaacucuuacuuaguaaguugaaaaagacguugaauggauaauaauuuaugacugauagaggaguaauuucauucagcuugaaugauucaauuaaucuuucacuaauuagaaaacagucuuguaccuugagcacuuaauaauguggaagaauauuaacugaguuuuaauaucuaguuaaauuacauguuuuuacaauuuuauuuauauagagugucagaauucuaaggcaauguuuuauuguuacugcuuacuacaguggagauucuuaguugggauaaaugauaaucagcgucaaauuaccugcuauagcucauacuacuauaaccuuuuauuauccauaugcaacuuuaaugagaagggcuuaguguuuuugauuuaacuucagcuuuuaggaaccucuaguuuacuaagagaaucuugcucuucuugucaagccucagaucuugauguccuguuaauuuuuggaagcuaagcaaacauagcucaacacaagagcaaauaggauaaaccagcacuuugucuuucuugucgauuuagucguuguguuggaccaguaaggagagauguauuccuucugucugauacacuguaauuuuuaaagugugcuuaauuaauuuaauuuaguacuuagaucuuggcauaugaaaguauauaacauuuaacucaaauucucuaacugcuacugucuuuaaaaaacacauuuauugguaacucgggcuuuacuuaugcuuuuaauaauacuguccagugaagagguugaguggugagaccucucuuggucacagcagaggagccagagcuuacaaagaugagaauaccggugcuuauuuaagaggaaaugaccugagaggaaagcuagggauggugggaagauuugccuauuuauaguaaucagauacaguuuuagaaguauuuugugugauaacuuuaacuauaguugaugccuuuaucucuugacaaguacaaguuaaauauaaccuauauagaauccauuaugaugcuaacaugcugaaauccagaaaaaauuauuuuagucuagguuauauuguucuaauauaauuuguauacucuuuauuuuaaucuaucaguuuguaaaaaaaaaaaagugaaaugguauuguuuaaaaguaauuggcuuuuaaaagauaauagcuuuagcaaaacuuuguuuauucucuauuuucauagaaaacuuuaaaguguauuuugugaaaauauguugccagaaauagaauuuucauuuaggacaacaaacuaugcacauuuggcuuauugauuccuuucuuuauuuccauauuagccacaguccccacccuuaaccccuacuaguuuauucacauccaguacuccuaaugggucccaguuucucacacucuccauugagcccgugcauuauuguaugaaugaaauaaaaacagggaagcccagaauuccuucuuucagaagccucaaaagagggguaaguuuaauaauggguugaaaugcaugauggccuaauuguguguguaguguggcuuuucaauacucuccacccucauuauaaggcucuccuauaaagacacaguuuaaaaucaccacagaauuaaguauagcugcccucaaguaaaaacaacuccucuuuauaacauuugaaauguucaaccauaaaaaaugguauuauaaagagggugcuggguacagucauauuuuagcuuuuuuuguuuaugugaaaucauauguccaccauugucuuguaauguauuuacauuuuuaagacuuucaguaauuugucacuggaguugcuuuguaaugauuugucacuaaugcugacuucaacaacuuuauaaaaucuuguuuuguugacaguaaaaugucaagcuuguuuuuaugcccucuuauuuucagaugcauaaaauauaauuucuaauaccuuaauaaaaaacuaaaaagccgaugugagugaaacacagcuuuauaauuccaguaccuggaagacugaggcaggagaauagaauuugaagcuaaucuggguuacauaugaaguuuaaaagcagucuugguuauacagagaaaugauaucuccaaaagcaaaaauaauuuuaaaaagauuaaguauauuaaauacagaaucuuauauaucaaauuaauauacuaaaugguauuauuuaauuauaaggccuauaaaauacuuaguuauuauugagcaauauucauauggaauuuauuuucuuaaacuaaauauaaaccuuuuuacuggaguuuuccuuuugcuuuuuauuaauugaccagccuuagacaucuaguuuuuuaauaguacucugcaaaugaaaauguauagacuagaaaaauucaagugcauugucccuuagcaaugacuguuacacuacuaauaaauuaaugguacuucauuaugcuaauaacuuuuguuuuucuugguuuugaagauugaaccuagguccuuguguauacgaaauacuuaaucauaucacuaaacuacuugccuggccugcuacauuuucacuuuuauguuugaauuuuagguaaugcucuuaauuauacagcuacaauuuagauuaauuuauugaaguuuuuggccauuugaaagacaggugugcuaaccauacauagcaucagaucauuaacaguaauuaauauacgaauacuaacaguaauauacaaauauuaacaguaauacacaaauaguguguucuuucucuuuucuuuuuguagcuuuucccagaauuaaagugcauuuuagacaccugaugcuaguaauaacagaccagcccaguguauuagcaucuccuucaacuuuuuuaccauucagcuucacuagcugaguguggauaauagaggcaagucaugacccuuagaaaggcuccucacagagacguuuauucuugugugagagguuuauuugguaucucuuuugccuuaguuaugagguagaaguuuuaaguugcuucuuauagagagacauaguaaauuuaauuauauggaaaaaauaaugcaguuuaaaacuauaaggccuggagagagaaucuuaaaugugcaguauucuuauugaacaauuugcaguuagaauuuuacaacagcaauacuuaaaaaugguuagcuuacccauuauuagguuuauuuucauauguugcuuuaaauugucacacauuguuuuuauaauucuggaaaacuuaaauuuccaugucuuaguugccauaguaacugacuagcggcuuagaggacagaacagggaggaaaguguuuaucuuugggauugacauuuuuauauuuugauugauauuucaaaguuuacuggauaauauuugaaaacuaaugcuagagauagaaauguuuucuuggcauucaagaauuccacaaagaaaguaggccuuaauaaacuguuuucuuaacauauauuuacauggauuuuuuuaguccacuaagcuuacaguguaggucuuuggacagcuucuagcugcugaguuguacuuucaguucagaugcuauuuucugucuuguuggauauuauguuuccuaaguagcuucucuaaaacacauacauauaauaaacauauacauauguuuacuuuuaaagaaaaacugguauaugcagucuuauaauuacggauuugaaaaguguuccaucagaaggaugaguuugaguuugacagcugugccccuagaccuguuccaaggggaagguucuauaguugcccucugagcucaacuucuaagugggggugugggaaauacacccaaacuugacugcuuaauacacaaauuagccuuuuucuaaucucuauaacuacuuucuuuuguuuucguagccauuccuuuuuaaaguaauagaauuaccuagcuuauaauaggaguccauauuugugucuuaauuauacauaauccuacagaguucagaauacagcucccgggguuuuggccuuuguuaagaugacacaaccugaguguuuucauuccuuuacuuaauguuaguucuccuguauuuugcacgaccuuaagauguaaugguuauaugaaguuuucuaauuuguaaacuauuucuauaagaaagucugauacuuuuacauugaacauguauuaaaaccagauuuauguuguucuucuuauagagaacuuuuucagugaauuuaaauuuauuuucuacuuaguaaaacuagauaagcuaaaauagaaacauaugcuauuucagcuauaacuacccuauuuucucuaaaagauuaaaauacaaauuaggaaaguaauuauaucacucaguagugaaaauuaguguaaaagauaaggcaacucaguuaacuauuuuauuccuugucauauucaguuuuguuaguguuuaauaauacuauugauaucuuuccuuaauuaccugguuuucuuacuaugaauuuugugauagcaaaauaaaaugauuuuuucuucuuuaaaguacugacagucuaaagaauguuaagcguaguuuagaaagacaauggauagcaaaugucaucuuuuugucaugaucauuaauaaacauggccaacucaucagagauaagggguagauauuuuugcuagauauuaauuaaauuucuuuaaauuuuuuaugugaaaauuuuaucugacauauauuaucuuucuuuaaauaaauuaugauuuagaaaauagggacuguuuuauuuuuuuaugagggauacugaggauuaaacccauggccuugcacgugugaggcgaacguccaccccugacgugugucuccagagcucugcaugaaggcauuuuaagacuagcuaaaugugcugagugugaaaauuuguaaauuuugaugaauauucuaggccacuguguguaugugcacuugugugugugugguccugugugauacauucugggccauuugcagaauccuggugucagaauggugugugauauguugauucauaagaggacccauaguugaucucuucagacucugcucaugccgugucuucugaaaggguaacucuggauucugguugccaaagggugaaauuguaaauuuagggcaauuuuucaggcacguugauuucagaauaaaaccuaaaaaauagaaaacucaaagcaaaacucaauguuugagccuaauaauauagagagaauuugauacugaguaccucauuuguuauuuuuauuuuuuaaaaaacaacaccauaagaauguuaccguuaccaaacuuugauauauuuaaauccaaaauaguguuuagauaaugaaacuucaggaaaucaugcuuucugugaggcauugagaaggacauuuuggauuauaaagauuucauaaauuuccuuuuaaauggcuaacauacgaucuuuuucagucagcacauuucaaauaucagugcuucugaaaaugaacaaucugaguaagcaaacaccuucacaacagucuccuuaaagagaacacaggacggcaggagauggacuugguuuugaguuuuaguaaauuuagaaaauaucugcccauuaucagugugugcuuuccuuuuuucuucuucuuccuuuuuuuuuucuuuuuuuuuuuuuuuugcgugugugugugcaagcaauuugcuuucccaaaugugcuuacauuuuuuuuucuggcauaauuguuuggauuguaaaguguacauaauuuauuuuaauacuguaaaaaauauggguuauugcaucuucuguauuaugauuucaugugaauaauuuaccauuucuuucuguuuuccauugaacuauucaguggucgaugaagaugguaagcccugugugcugaucuauauacuauaccaacauuuaauauuccaaagacauuguuugauuuaauucagagcacguguuaaaguacauuccacauuucaacuuguaugauuuuuuucaaauaauuuaauccauaguccaacauaugccaauaccuuuggaugucauagauuagauaauaaugugcuuaacuaucaucaacccaucaaauucuuagauguuauuagauagagaccauguaauguuaaagagaauuaauuuuuuuaauuaaaauuuuaaacguacaugguagagcaaaaguugauguuuuacagaaguaaaauuuagaaauacacuuuuaaaaauuuacuuucuuuaaaaggucauacaaauuuaauguuuacuuuauuauaagaauuauuagguuuuuccagaaaagaaaaaaguuuugcuaauuuuauaauggguuuuguucuuuguugggaagcaaaaguauucuguuuugugugagagugugugugaguauuuguuucccaucccucuguguuugagguguuccuguaugccuuuauuucauacaaauggauggauuuacauuaugaagaacaacugggugcuugcauagcaagcuauguucacagauguagaaagcagauuacuguuguaaacauuucuaguugagacauuuauaagacagguuaagugccuugcauggcuuuuugaaguucuuaguaaauauaauggaauugcuucauguucuuauguaagaauguguuacaguguugaaaugagauguuaggggugcacgugucuugauuccuguuguuaaaauauuaggugucaguuauuagguaauaaacgcauuagcguuacacagauauuuggagauuuacccacugauaaugauaacuccccccccccaaagccuguuaaacugaaauauguuuucauuuccuuaaacuauuuucagaauuauuuuucaaaauaugaaguagguuaucuuuguacuguuacaugauaguguaaucucugggccccaaauuagaaugaaucugguaaauuacauuggucauuagcuaguaaguuuaaaggaauuuuauauaggaaauuuuguuguuccaucauuuaguuuagguuugguugauugacaguaccugauauaaaauaaaagccacuuaaacaguggccccacuuuuagucauuaugguuguugaaugcccauagucuaugggccacuguggaaagagucuuggagguacuuauuauuaauuaaugguaacauuugaucaugguuuuuccuguaaauggguuuucuuuuguuuaaaaguaaaugacacagguguggagagguggcuuggccauuaagaccauuagcugcucuuacagaggacccagguucaauugccagcacucacaugguagcucacaacugucuggaacuuaaguucuaguaaaagccuaugcucucuuuuggccucugcaggaacaagguguauagagauagauggaggugggaaaucacacauuacucaaauacaauaauuuaaaagugaacagaguguccuuguaacugguaaaaucaagcuauuaagcaucuguuaaagacguaaguagucaagaaagaaagaaugcauuuuauuuuguaggcuugucucaguagcacuuaaaaauugagaauaguauucauauucaaccauuuugagaaaaauaaagaauaaguauuauuuuggaauguaauauauuaauacagguuuuauuaaauggauucuguaguuaauaauauucuacuauaaucucuauagaauguagcugaauuaacaaugacuaacaugacauuuaagaagaaaaugggacugaguguggugauagugacacacuccuguaaccccaacaccuggaaacuaagaccagagcugggaguccagggcaaggcuacacagugaggcauggucuuuaggagaaagacaugauaguagaagacucugcaccuuuauacuaacuaacauuuaauucaccgagauugagaagauuaaaaccuuucugaugaggaauguucccuaaagcacugcaugcggccugggcauggugucaugcacuugcaagggcaguacuggggagacugaggcagagcaucugggcgugaguuacacacuguagcuagagccugcuguuucacccagagaggagggagacagacagacagacagagaaaacagggguuauagcuuucagaaacaccugaggucugucauuugguuucacauaagaccagaaguguauuccauguauguaauuucugauccguagacuauaccuuuaauuuuuuaaugaucagauuuuaauuuguuuccaaagaauggucuagaaaauauaaucauucaaaaacuaacugcaguauugaaauauauauuaauuaguugucuucaugcgguaaguugcuuauguugcucagcuaugaaucucguauuuuuauuuagcauauucauggcauucuaaaugucaugacuggauuuuuuuccuuaagaauucuauguaagaguacauacagaguaguucaauaauauaaaugagaaauguuguguguucccauuuuguuguugcuguaagaagacuuguguguauucauuuuaacugucaagacuugaaauaauguaauauaguucauaauuaccuguauuugguaagauuucuuuuuuuuuuccugccuauuuucauguuuuuauaaauaugaaauuuaagcuuugaauuuuacuaauacaucuguauagauuuuuuuuuaaguugaagcuaaauaaaaauugaaguuaguugcuucauuuauaaaaaagguaaaguuaagaaacaacauaucugaaagugucucaauaaugauuuaggcucucuuuucagggcccagcacuagaagauuucagucauuugccaccagagcagaggcggaagaaguuacagcagcgcauugacgagcuuaaccgagggcugcagaaggaagcagaccaaaaguagcguuuccuugagcccucccucauugcucucccuucuggaacuaaugagugcuguguacacugacacagagugcuuccagaucguugguucugggcuggggauaagucagugggaaaagugcuggccuagcauucaugaggacccgaguucaauccuaucauucccccaaaucauauaucccgauugaaacacuuuuugaaacauuugaaauuuuuuauuuuuauuucauuauguaugaguguuugaucugcauguauaucuauguaucaccugcaugccuggugccuguggaggccagcagaccccuggaacuggaguuagaaaugguugugagcuuccauguggaugcugggaauagaaccuggguccucugaaagaucagucagugauuuuaacuucugagucaucucuccagcccgugacacaccuuuguuuguuuguuuuagggaaaaguaaaaugaccuaaacuagaaaacauuauggcuuacauauuagauaaguaaaaaucaaaugucaggguuugguugguugguuuuuguuuuuuguuuucauuauagcauuuuguuagucccuguuagaauuccacaaauuuguaaaaacaaacaaacaaacaaacaaaaaacaaacagaaacccaaaucaugguaauugguugccaaaaguaguuuugccugcaccaaccaccucgucuauuuuauacacuuuuuaauguauaaauugaguucaguauugguugagggauuaucauacacaucaagcauuuuacaugaaacaugucauuaaauucuucagaauagccaucugagguugcucuugcuguauaaauggagagaaggaacuugguuagaaauuguguaagugaaguaauaggauaagggaaaaagaaugaguuaggaaaagucuuaacuacguguaccagucugcugguagugggggucggggucuuagcaauuucaacuaggugguagcaacuguucuaaaggucaccgagccucguaucuaaguagaucagagaucaggagaggaggcaaggaaguuguuguggaacuaacuuguagauacugagagagcuauaaaauuaauugaaaaagaaaaagaaguuugggugaaaguaaagauuuugcuuauguuuugugaaaaauccauauggaaagugucuaggugaguguggagcuauacaucuaggacuuaaaaaccuggagacagacacugcagaaucaucugaagaucaaaacauucuaaagaggaguguaggaugagaugagaaaaaccuugucauuuauauaacagacauuuaaaagucgaacaaagaagcagccagugaaugauugcuaagaaagcagaggcgaggaggagagaaggaaauggaggccucagguuaggcaggaacagacuacuaaggagcacuggucagcagggucgggcacuagcaucagagagagcugauuggcauaaucugaggaggcaggcuaccaggaacuggcaaauagcugaagggggugcaugguuaaaggugggguuacuauuuccggcacagaugaguaggaggacagugaugcuguggggaugagauaagggaugcuggcagaauaaugcuaauaaaguaauguuuccucuagagccagguaugguggcacagguuaggaggaucaagaguuaaaggccagccuggacuaucuagugagacccuguuucaaaacaaagcaaacuaaugaauuugguuugagaaacaaugaauguaagaacacuguagaauauucuaccagcuguuuacuaagcucauguauguauaaguaauaucucaagacaggacaaauguuucuuuccauuagaagucuuguaaauguaaacacucaagcaauacacauuuuaaaagucuuuccuuaaauuacugacuguauauacguagucacacacacacagccuugcacaaauugucuuuaauuaggauauauuuguccaaacuuagaagugugacuuuuuaagguucagauaaacuugacucucuaaagauaaacggaacucugaaaggacaugaaguggaugcuuaauuuugugguuuccuuuuguuucucagagaagcacucaacaaaaugaaggauguguaugagaaaaauccacagaugggggauccaggaagucugcagccuaaauuagcagagaccaugaauaacauugaccgcuuacgaauggaaauccacaagaaugagguacauuuguuaacucagcauuuggagaugaaagugcauuuuuaaauauuuuauaaacuuuauugcaauagauucgauuuugccagacuuacauaccaauauaaguuuaaaauuuaugaacugaaaguaucaucauuauaauauauaauuaucaaacuaacagccuacucauuuuguuauuugaacuuucauaugaaacuaaacauacuauuuuuaaaauucaacuauaaaaggccaggcagugguggcacacaccuuuaauuccagauugaggcagguggaucucugugaguuugaggccagucuggacuacagagcaaguuccaggacagacaagaguacacagagaaacucugucaacaaacaaacaaaaccaaaacaaaagaaaagaaacaaacaaaacacucaacuauaaaccuagucacuauauacauuggaauaaaauuucucuaagaaucauaaagucucucaaagugcauuuuaauucaggguuccuuaggaacuuucaaacuuacugaccugucugguguuuugguuuuuuucugaaggcauggcucucugaaguugaaggcaaaacagguauaagaggugacagaagacacagcagugacauaaaucaucuugugacacagggacgagaaaggucaggguuuguuuuguuucauuuuaauuuuuaacuucaguaaucauuuaauguccaucuuuuuucucaauuuucucuccauuacuaacuuuaucaaauaacuucagucuuuugaaacuguucuguauauuagguaauaguuguagguaaaauaggaaauuucguguucaauucuagucuaucacauccauuaguaccuaagaauaaaaacaacaacaauaucacaaagcagaacaaaaaaaauaccaaaaaacaccaaacccugcaggcuuaggaagcccagggaggggagagaucccacugagguguauguggagauggauaacuuaugacaaccccccccccaaaaaaaagugcugucaaauugcuuagaguuugaugaagaagaaaagaguuacaucuuacuaguuugcaguuuucaacuuagcuuuccgcaaggucugcuugugaauacuacuuguuacauuuccuccuuacuaugcuggauuugguuuuguuuuccugucauaagauaaucaguaaacugugcuucagcuuuaaaaaaauuugacuggcuuaauaucagauauuggucuaaucauuacagcauaauuugagcaggcucauuuuuuauauuuccugucucaauuuucuaaaaacacaaaauggaaguuagaaugccgguuguaucugguugucagugcugaaggaagugguguaagguguuuagagguaaaaacccuugaucgugugccuccuagccagcugcucugauuccaggaaggaagagagcuccaggucacuggacuuuguuacuagguuaaaaccccagguuaaauggguuuuuuugugcacauauaccacacacacacacacacacuccauucuuuuggauuuucuaacauacuaauuuccuuuaaucaauuagaauucauuuuauuagaauuuggagucuugguuuuaagcaaaaugaauucuuauacugucuuggaauaaaaauuugcuucauuaaauaauuuaagagguagccuagauaauauucauagaacucaauguuuuuucuaccucuuggcuguucuuccuccugugcuagauuuaaaguuacaucugauuuuuuuuuuuuaagcuugcaguuuuccuccagguuaaaggagaaaaggaagugagcuuuucuuagggcagucguccugggcagaggccuucaucugcccuguaggccaggagcugcucgccuccaugcacaugcugugcucauggcuucucaggagcugcggcacagccaaccuccccguggugccguaggccugggugauucugcucaggaaugucucugacaugagaaauuagugucuaccgcauuguuccauguccuccuuagguccuggaauagugagguguguuuacugaccauugcucuagacauugucaucuuugaaguguuuacuucaggaaagugagugaagaaucguuuugaauuaccacauucagucugcauaguuaauguuugaaaaucgcacucaauauagaaguauggcacugacaauuucucuugagaucaccuucuaaauaagacacaaagcagucucguguuugccagaccugaucagagauacuuuaaugguuuuuagcccugagggaaguuacacugaugaugcaaaccaagaaguucgugggccaccccaacaacauggccaccacagugaguuugaugaugaguucgaagaugaugauccccugccugcuauuggacacugcaaagcaaucuacccuuuugaugguaugaugcuugaugaugaugaugaugauguuguuuauuuacuuaacauccugauggcuuccucucuagucugucuucccuuucccucaccuuaccucacuucccaccccucccccuuccuccucagaaaaggagagucuucccauggcuauuaaccaaccuugacauaucaagauguagaaaaauuaggcaucuauucucuuguugagcuuagacaaggcagcacaguuaggggaagggauccaaaggcaggcaaaagucagagacagcccaggcucccucccguugcuagaacucccacaggccgagcuguacacgugguacauaugugcagaggguuuagguucaucccaugcaugcugucuggcuagcaguucagucucuuuggguccaaguuaguugauucuguagguuuuccugugguguccuugaccucucuggcaccuucaacccuuccuuccccucuucuagaggauucuccaagcugugccuaaugucugacugugggucucugcaucuguuucuaccauuugcugggugaagccucucuaaugacaguuaugcuaggcuccuuccugucuguaagcacagcagaguaucauuaaaaguaucagggauagaccccccucucauggcauggaucucaggcugccccucucccuccaacgugaucccuccucuucccauccucacccucuccccugcacaguccccucccuggugugauguucauaauauguaauauuugguaaaauugauucuucaaagucaaaaguaaaugauacuuuaguauccuuagcuaaguggcugagagauacauugucagaaaauuacauuccugguucaguaauuguauaguuuuguuuuaacuguguuauaaauauaucccccaacacacauuugcacacacaacugaauugaaaugcugccagauccuaacacagaugaugaccuacagcucuauguccuagaucuuacacucacaugugcauaacagagcuguggcagcuugagcauguggcccaagccaggagcaaagagcuuguagaugucauuugaugcucucuguugcuguuaaugguagagagaggcaggcauaaggcacagcugggugcuaucuaugcugauucugcgggcuucccggucaaaugagagcagaguaguggucagcggcugcuacugacuaucgugccuucuccuguaaugugguggcugcagacugggaagaggugguguggcucucucugcagucguuuaguuuuuuccuucucuaggacucuuaaaaaacaaaguccucuucagcuaacagaagaguagaguaacaccuccaucaacaguuauaaaaugcucuguaauuuaucaccuuucuccauguguuaguguuacaauugagugaaaucuuuaauuacucuucauuuuuagagaauauauuuaaagggauagggagaucucuuagugaguaaagacccuugcugccuuuacugaggaccuaaguuuguuccugggaauccacaugagaagagaagagauaccugaagguguccugacugccacacuuaugcccugucacaugcgcgcucucucucucucucucucucccucucccucucucucucucucucucucucucacacacacacacacacacacacaaaauaugguuucuguuuucauguguaugugugguauacauaugugcaaguuugcacauacauguacaugggugcuuguucaaauggaggccugaaaaugaugucaggauucauccucaauugcucuuugaccuuauucaagagucuuugaauagaacgcagagcuuccuaauacagccgaucuggcuagccagcuuccuccaaggaucucuucuguauaugcucuuucacccucucucaucgguacuauuuucugauucauacuucauuaaguuuuuagauaggaacacaaauuuggggaaagaauuagaauugugaaacagugauuagacuacccugucaaauuacauagugcucugccugguugcuuagucuauuaugcagccccgccucacaggcuuauuauguaguucagaugagaaugugugugaugagucgaguaaacuagaaagcaucacagauagggugccgcuguggcaauccgugggcucuugcaucuggguaugaugaaauguaguaguucauguuugguaguauguuguaucuauaacuuuuauuaacauugcagugcuuuaaugcugcguaugcuuugaaaacuuuucaccuagggcauaaugaagguacucuggcaaugaaagaaggugaaguucuguacauuauugaggaggacaaaggugauggauggacaagagcucggagacagaacggugaagaaggcuacguucccacaacauacauagauguuacucuagagaaaagcaguaaaggugcaguaacuuauaucuaacuaacaggcagugugugccauguacacguaaaacgacaacacagucaacagucagaaacgcaagcguuaaggcauccugaugcguuguucacuaugugagcugagugcaggcuggaucagagugugaauacugccaccagaaacucuuugacgccuuacuguucaagugaugcugguguggaagcuuaaucgaugccuuuugcuuucuguccugccuaaguguguguaaaggaugugugcuuuuucugccuuauaaauaauagauuugauuauuaggcgagaaucauagguagaauguuuccugcccccugcaccucagaagcaacagugacugaugaauuaaaauaagcaagccuguucugaacuguagaaagccgacucucaggagcugggacugacagcucagguucuagggcgagaaguaauaguuggauaguuagguaaaauaacagucuuuuuccuugcuauucccaacuugguuuccuaaagaaagaaagugaauaccuggcauauaaucuauuuaauaugagcucaucuagggaucgcaggauaagucaccugguagagcuuguaugcgaauaaaacagcauugagaccugaaaauauuuucagguuuacugguaauuuucaauguuguacaaaguucauucuaagcuaaucuuccacuuguaauacuucauuaguguucauuuauuugguuccuggcaguuacucauaggagagguugagucuaacucaguggagguaagggacagucuggaguggaggaagaaaguguggcaggcguguucuuagaggagaaacagaagacagguuuuuuacugagaugaaggaagaucucuaccaccguugagggcuucguuuuagcugaucgucgacugucagaguagguaccucuucuaauguauugccaaaagcaucuguuggaauguguccagucagcuguacaguguaguugucaugugaccacauccuuguuaguugagugaggagauaaagggaggaggcaguaacacuggccuuugaucaucuuguguuucagaguucucugguguguuuaguagccaacuauaaaaugauuuuagguacauuugggacagacacuuuaaacugaaugccccuuuuggucuuaccaaaggucuucaguaauuguuuuuuucuuuuuccuccuggacugcagguuccugaagaggguuucugaggaaaugggcaagauguugaaggagguuacaugcagcugcuuugggggaggguauuagaguugucaggcugaaagagagagugagagaagcaaguugcaugaaugcaugcagauuuuuuuuuacuaacuucauuagcauuuccauacauuaaaaagucauucuaguaccaguccuuaaauuccuaguccacaguuguucacauagaagaaggaaaagaaaagccagcaauggcugaccucuuuuuucauuuacugauaccaaaucagaaagaauacagagcugucuuaaaguuugucuuauuuugggcuguccguuaggacugucgucaucagcucuguugaauuggcuucuagacucgucgucugucaccauuugucacuguccgccugcaccaccccugcgcuugcuuaacacccuguugcaugucucgcgugaucugggcuuagaguuuucaggcaugucucuguaauccccuguucuugucaaagcuuuguuucauuuugcauuuguagugcaaaucacuuugucagacaccucagcacuaauguuuccaucuuaguaucuguguaugcugcuaaaacuucccuacugcaaacguuccaguuuugacaugaagacauagucugugaaccugaaguauuuacgauaagaaaaagaaaacaucucugcucuagccugcagcccaguuaccgacucugaaaugugacgcaucuucagcaccucagucugggagaaucuggucagcacugaaggccuggcauaauaacaccgaagggacuauugucaaaagucagcugcuuccauucaaaugcugccuuaaaaucgagugccuaaaucuguuuauugccaacacuaccacuacaguaucccacaaagggcuuuaugugccagcucagugcuccgccucuaacuguggcaccucgcagcugugauguagccucgguagguggcuucuagagcucuaccaugugcaguggugcaucuucaaauucauggaucaaacuaaagaccugugugaguccauuuuacuuucaucgguguauuuaugagacguuugauggaccuucccccuucaccuuuuaacgggguggugacgaucucccuugauuauuuuaaugauagucuguuuccaagugaugcuuuuguuugaaccagauaaaauucagugagacuuuguaaugaucuaugugcacuuuuacuuguaaaaugggaauuucuguauguuuauacuuguaaauacgauugucguuagugcccucauugcucauguguccugccgcgcguuugugauucugugacugacuuguaugggaacuaauuucuuaguggucuuguaacggggcggggggggggggggauuguuuguaccacugaagcuccauucguuugguucuuuacuguugugaggggagaaagagaaugugaaacguucuguguauuauuggauuucaagcaauauuuuagaaaccgugugacugcuuuaauaauuuuuuccaaugcuauuugaaucauacuaccaguuacgcuaaagcugaaugacaauugugugaacauuaaugccuucauaagaucaaguacaccacuguuaugcagcugacauauaguauauuacauuugaggcuaguaaacuauacaguuuuagauauuaaaucucguuacaggguuauuuauauaaugugacauuauucuauacugacagacuacaugaaguaguuuuaaaaaguagugcuauuuuuauuucaaaaguuagcaaugagaaggaaaugugaccuggcuguguuugucuucuguacagagacugaagugcuuauguuuuucugacuaacaaucacagagggcaaaguucaacgcuuucuuguacagacuguucuuuucaagcuacuguguguuuuucuaaagcugguguuugcuuccauaguaggcaaguuccuucauguggaguagugcaaccuguguauggguuauaacauuugaagacacuuggacuugcacaguuuuuaagucauucuuaaaccauucuuaaacuuugaacaugugagcugucuaaaagaaaucucuuaauuucauaguaauuuccacuuugugcacauauugauuucuuaaugguaauaagccuuguuuaugauaguguucucuguugagaauauuuucauggaauaaagcaaucuuuucauggucaguuaag

SEQ ID NO: 1694 - RNA, 9693 nt, Mus musculus
cuacauaacuaacugaaaguuuauuuuguacuuauguaguuugcuuuaagugcaugagacuguaggguaauucaggaauccagacuguuuccauauuggucucaucccaaggcuuguacaguugcuuuagcaggcaucaagagaacaagcuucagaugguaaauagaucagcgcucauggcccauuuuauagaauuggccaugucauccugaugagcuacaaaacaauaaaagagagaagaguaggaggaauauugaaaaauguagagagugauaaccaaauuuugccuuccugauucagauccuagguggaugguuguuuuauugaugugagaaaagaacaagguuugaaaagaagauaaauucuagucacugaauuugagguacccauugcaggugggcaucuacucaaauagucauuucuuucuuuuuauuuuuuuaaaacaacuguuauaacuaaguaggcuauuaaauauagcccauacgauagaauuuaucaguuaaaaauauacaauuuagugcuuuuuuguauaauuuuagaaccauuuguaucugugucucuccgauguaagucauucuaauaaauccccccccccugugugugugugugugugugugugugugugugugugugugugugugugcagggucucacuauguaucucuggcucgccuggaacucacuguguaugacaggcuggcucugccugagaccuaagggcuucccaucuuauuuuuuaagacaucucugacaaaaucuugcaguaagcuugcugauuugacuaaacagacuggcuggcuuccagcagcuucauauguuuucucugccuccauagcacugggauugcaggugugccuugcuccacaugccacuguuuacuuaagugcuugagaugaaauucuggucuccaugcuucacagcaaacacuucaggauucagccaucuccagagcccuauaauuuuagaacauuuuuaucaucacaaaaauaaacuuuguacccauccccaguaauuuccucuuuuuccugguuugggcagcuacuuaucuauuuuuguuucucuggauuugcuuauauaauuaacuccuagauuugucaucucuuccucauaucuuccccuuuuggguucccuuucagaaugacuguagguuugcauaacuacuagguugauaguuaggacucuuccaucaccucuaacccugaaauaaugauuagcacuuagcaucuuugcugguacuuaggugaauugugaaauuaaucuaggugcuacagugaguuuugguuauguuucuggcgcuuaaccgugguuaagaguauuaguggucauuaauaugacuaggguuuguuuuguuuuguuuuguuuuguuuuguuuuguuuucuguguuccuuuuuauccuuucuacccuagugccaaacauugucugguucauuuuuggugugccaucuacauagagcccacuuagaguucuucaugaauuuccuucuugcuucuuacucuuugcucauuguacuuagaauuccccucagggcuuuccaguuuccuaauuuuuauuuagcucuuuacacaaauagucagagaauuggaaauuuuagccuuucuuuacaaaaagcuguuuuaagagcuauguaaucucuucauguaauacuguucagaaacaucuauauuucgccagucuagaucaguaauauuuaauaaaaugugcuugaaccuguacaguugcuuaaaaauugugugugucggggggaggggaggagaaaauggugauguuuaauuucaguugucagcuuaacacaaucuggaauucccugagacgugagucucagugagcggcuguugccaucugguuggucugugggguugucugugagagguugucuuucuuacauuaguugaggcaagaaggccuggccaugguggguggcgucgucuccugagcuugggucuuagacuauggacuaguagaacugagugcaugugucccaugcucucuuugcucuugauuaggacucugucuagcugcugcaaguuuccgacuugacaggaucugcaguuguaaccugaauaaacccuuucucuccuaaguaauuuuucaguguguuuucuccuagcaacagaaauaagacuaaaaugaguaguaugucaucauuucuuaaauacucauauuuugauuaaaaucacacguaaguccuaguacuuugaaccugucaguacuuuauaaugcugacuguggugaacuuuuccccaguucuccccuugauugaugguagcuuuucuuuuuuguccaagcaccuucucuguacuucuucauccuagcccuugccaugccgcacuucguaauuacugcucugcagcugucuuauuucaagaaaguaucucuugagcauagauaucuuucauuuuaggcccuccugggagcuugcauaguagcuaguacauagcacauaauuauuuguggacucaauaagcuaaauuauaagaggaauuaauuuguucugaaaauaauugaaugauuauguuuaaaucaugaugauaggcuaguuucuucuuaguuuccauuccauuguauucuuagacuuuuggaaaauaucucaugagauuaaaaaaaaaaacaugucucaucuuuuuaauuuuugauuuaguagacacaaaauuacuccucaaaaagccugucagguuggagaggugguucaguggguaaagugcuuguuauucaagcuugagagccugaguuugaauuccaauguaucuggacauggcaucuccuggaugucauuaagcacuguggggcaagaugggcgauggaagcaaaagagucuccaggagaaguguggaggccgauagccucaggcacgguggagggcagggagagccugcuuguccuccacaggcgugcacacacacucacacacauuuucaaaacucugcaccuucagugagccauauauuguaaagaaaaccuauuauauguaaagcacuguggucaauguuuuaucucaguaacuuaucagaaaucuguaggguaggcgcuguugacaccauauaggaaucugaggaacagagaaauuaguguaaauugcuguggguuauauaaacauuauuuagccaggauucaggcccauauaucccaguguagcuccaaagucucuguacuagaauaucacuuauuucauauguaugaaauaagguaguauuauaguauaagaauguuauggauagauggggauuuaggcacacguaaucacaaguuaggaugugauuauuuaauuacagaaaggcaagcuagaggacaggggugugguugcuggucgagcaccuuuuaguauaaaagaggccccacaccuuaaaauggggagugauuuccauagaggagaagcacgguagaggaugguggccaguugcucuuuuauccccuuagucagcaucuguuuauauuuugccucaguuacuauuaaaaauaucugauuugucaaacaagacugaugaucuuugaaaugugucuuuguuccaucacucaguuucauauacuaaauauuguuuuccuauaauuccuuuuaguuuauauguaaucuaacugcacuuacaauaccauaaacagaaauaguguuacuauuuuaagaauaaaauauaaauagugaucauguguuguuauguuaauguuugaagaugaccauguuguuguucuuaguguuuuauauacaauagucuucucuuaaauccuuaaugaauuggcaaauuuuaggguaaaaacuuuuauuucaaaaguauuguuuauaaaaucaaaacuuuuuucuucuagaaaucugguuaagaaguacugucccaaacgcuccuccaaagaugaagagccaagguaaagcuaaucuguuagcuauugcacauuaacaguauucaggacaucauauauaaacuuuuacuuuguaaaauauacuaaauaaucucauuaaguuuuucuuuaaaguuguuuuaauaaaaacaucacuauuuauaaaaaaaagaagcuacuauuuaucuuuugaggguagauaauuuaaugaacucaaucaauagguuuuucuuuuuaaaaaauaaaugaaagugggauuuuuaaguaaaauuuagaccaggauuuggcuugccuuguuuauucuccagcagaaagguguuuucccacacuucauuucaggauaaugagaagugaugaaauuaggggaauaauuuuugaauccugaauaaaagaagagauugggggggacuuuuuggagaucuuaauaugcaggugguuguaaacuguagaaauuaaaugagauuaaauucaacagcuuuuuguauauguuauugcuucuuagcauucuuaagagagccagcccugucugagcccucaguuuaagaguguuccuugguguguuccaaguagauguauacauuuuaacacaguaauuuucuuugucucucuccuucccuucacacacauuuuuacccuuauuuuugcccccuuuaucccucuuuggugccaaccauaaugguacauuuccauucaggaugugggcaggcauacaggcagcuguauccagagcugauagcaaaguucuguagaucagcuaucaagaugcauuugagugguaugauuggcagguucuguccucgagaacaagcgcaccaucucugcaacaggcucagcugccaagccuaggaauccacccagugauucccaagcuaaggccagucaguuggcaaccuaaagauuccacuaugucaaaagagccugcagguaguauucuuacuauauuuugaccccaaauaccccuuuauuuauaaauuaaaggcuauguaaagauacuuaaauauguccaacuugagcuuaaugcagguuuucuuugcauacguaguuaauauagaaccaguagcugggauuagguugagcauauuaagcuuaucaacauccagacaccaaaaaaaccucaccaaaaaaaugguaauggagcaaaaauaaaucucaucauuuuuaauauguuuugucagguuuacuucauguaucgccuuuuuuaacauccuuaaugaguuaaacgacuaugcaggacagcgagagguaguagcagaagaaauggcgcacagaguauauggugaauuaaugagauaugcccaugaucugaaaacggaaagaaaaaugguaauauuuaugauuuucaucuaauuacaacagucuuaugaaauaguuucagaaaauaauuauuuuucuuuuuagaacuaaauguucaguuuaaaacugguuaucuauauuacuaaauuuccuugauuaaaaaucgugagaugagaauaugcugcgaaaaaaauuuucaguaaagaaaaacugugagauaugguuaucaguuuauaaucugaauuuaagaucagaauuuggcaacauugcagcccacagaccaaguacagccuaucacuuacuuuuguuuccuaggucccauaaauuaagaauacuucauauauuuaggucguugaaaaagaauuaacaaguaaagauucuguggcauauaaaauuuuauaaaauucgaauuugaguguccauagagucggauuuagucugcauucauugcuaaggcuacacaguugucgacagugcuguuugcugugcaagccuaaaauaugugaugcuuguuagccgacuuucuauagaagagugaguucugugaagaugaucauuauuuucuuuaacauuaugccuguuuuaaagguuauuuuaaaagcauuaaaguaaccuauaagauguauuuuaaauaaauuuuuuuacuuucuuuguaacucuaaagaugcauaacuauauauacaugucuauauuuuaucaccuuaauaaaaguuaagagccuuuugaggaugguggaauucccuuuguauauaaauguaauuauuuuuguuuguuuguucuguuuguuugcugaugguuauaaucuucagcaucuccaagaaggacgaaaagcucaacaauaccuugacauguguuggaaacagauggauaaugugaguaacaguguuuucauguuuaaugaaaaacgcacagacggacuuagcccuaagccccaugaagcgucacaucuuggucccaugauucucagugcauuagguuuagcagcagugccauugcccaccaagccgucccccguccccccacaccugcuccuggaggcuguguccaggucucaaucugugggcuguguaguaggugagcuauuauucauaaucugccaauuuuuuuuguuguauaauaacuaagaaauauaagggauugagcucauuucauuuuccuuuuuccuuauguaaauagugggacaaauucuuuagucuucauauccugguaaauacuagagauacuuauccaguaagugggguuuggagaauaaggaaacaguuaucuugggaaacuauuugcuugagaggagagaacuaagauugugguuuuugaauguuuuaauggacuggauuucucuggcccuccuuuuuuuaacauaugaauacagaagagcaaugacuacuuuauaggaaguauuucuucuaacucaguaguccaguaauucuguacgcuucuaacugcagaagaaaaagaaaaccuuauagaacagacuuagaaaacauacugcauacuguuuacuuaaaauucccuaagguccuuuauaauguggauuuuuuaaaagguucuguuauacauaaacaagguguccacauagacacuauagucuuguuuacuugauaugcucgauugaaagacuuugcaguauaagaugaacuuuuuaaauguucagguuuccaagugauuggcucuuagcuagcauuuuuuuuuuuuuuuuuacaauagauaacuguagucuuuaagaauugugcugaagaaaguuuuguguguguguguguguguguguguauuuaauaugucuaguugugcuugucagaaaggcuugaagacugaaaauguacaaguucaugcaagauacugugguguuucuucauacuaugcaaaucuuuggcauuuugaaagcucgugcauauauuugcuauguuuuuauguuuuccuguuaaagugaauauuuaaaacuuagauucuauuuuuauuuaagugucaaugauuuuuaaucaccaaugcugauuuagacuucgcagguauauuaauacucuguuuucauuuucuuuguaauugguuucaccaggacuuuaagggaggauuuuuaguuauuaaaauuuagucaguggcaucuuuaguaucugacaucuaauaaguaugcgagagagugucuauuuucauuugcacagaauaacauacuccuauacucaggaggugcugguuccucuagaaaugggugcugacauaaaucuguuuacaauaugugcugacucgccuuuagaacaauuggcaguuauuaagaaaaguuacaaagguuacaaaguaagacagaaccauuacaaaaguuagguauuucaaauaauguauuuuuuucagucaugaacaauauugugaaaaaguaaauucaacccuagucagcccuuuacuuuuccuggucccucuauguucauaaguagauaugacauggcuuuuauuuuuuguggagccuggaguccagugaaagagaccagcguuauuuauauuuaauauguagaagcaaauauagcacccuauuuccuaauucuuuuucuuuuuagucaaaacaaaauuauagaaaccuaauguguccgaaauaguuaaagggagcucuaacaaaugggaaaugaggaacgugaaacaauugaaggaagaaguuagaagaagucacuacucccaggaugaacagugacauuuaaaaggagggcaaaagagaguagcccaugagguagaucuugacagaguggucagaacuuaaggagauuaauguuagaugcgccauguugcagucaggaggcaccaggugacaacuuacaguuuccuaagagcagagcucagaaacagcagcucccuagucagucguggaguggcuucucuagugccccauguccucugugcuugcuucaucgcagugugcuguuuccuauucuucagcguggcugcacccaggggcaaggaaagaggaacauuucuuucucacuguucuuuuuuaaucaaggacauaaaacuggcagaagaccccagcagacuuccuccuaggugccuuugaugagcccauggcaggagacagggacagcaaaccacagcaauuaacagccucuguauugaaagcagguucugcuguggaagaagagggaauagaugucauuuucuauauuguauaauuauacauggggaaaggaauauuuuuaauucauuuguacuugugauugcuucacuguuccaagaaaaguguauguuuuucuacaaauaagauacauaauauaaaacaccuguuuguuacuauucucaauuugugucaacccauagccacuggaccgcagugggauuguguaaauacaaaauacucaagucuucugcuuccuuuuucugaguaauucucagaacacagaucauaaagcauuuuccaggcacagacuuaauagaggcuuucucuggggauucuuacaaacucgagucacagagacggggaauuacacaggguuuuuccaaggaaacuaccuggcugcuucacuccagagagaaagaccaggguuagccagccccaccuagaguguacuuaauggaaguuuaaaauaagaacauacaaacaaggauuccuagacagugaaagaaaauaucaguccagagaccacaauaauauauagaagaaaaaacaacuuagaagaaacagcaacuaugaaaggauaaagagauuaaaaaaaagaauauccaaaaaugguauuaauuuucucuguggaauagaggaaaugcuauauccauggaaauaaagguagcuacuauuaaaauugaggguguaaauaagaaaagaacuucauauagggagaaauaagaaguccaugagaaaaagacaaaauugaagacaucuuucagaaaguaaaaguaacagagguuagaaauacaaaacaacauaauaaaauuagaaauuuucaaauuuucaaaauaaccaugcuagauuuaaaaaaagauggauaaaaguaagucaaggaaaacaaugccuucaaauguaaagucaugaauuucuggaggaaagaauuugccagcuuccagugcugugagcuaucaacacuuauccucaugagagcuggcaagguggcugugagccgguagcuggcgguggaaggagcuggcuggcuccugcacgugcaccccugaccucugaggacacacccuucgauggauauguaaacaaugcugugaccucucuuaaagagccgugugcacggccucucuaaacucuuaggagagguuccagauuccuaggagagaaacagaguuagucacagcagcaaagcaaggcaauaacaaaauaaacaugucguuuacaaugaaucagggauuagagcaggauugaguguaucucagccuacuuauacacaaaccagaaaaacauagaguaguacuuuuacauuucugaaggaaacuguuuccaaccuuauacucagccacuuaaaaguggugguaaagggcugucccaguggcguggaguucagaaagcauagacaugguggccgaggaugggaugggaugggugguaacaauaaaaacauuucucaccucaaaaaugauauuuuacaaaccuucuugaaagcuacug

SEQ ID NO: 1695 - RNA, 799 nt, Mus musculus
gagggggacaaucaguucugugucuuuauuaacgagggcuagaaauggaccacaccuggcaaccaaggagugagguaccagccagggaugggaugggcucaggcucuugggauucaaaggaagacucauggccuggaagagcccaaggagaccuuguccuggcaguagcugagaaagugccuaagggaaagcuuuaggcacuacagccacaagcugguucugcaggcugaggggcugaggcuguagauucaaaauagguugggguggucuggaaucacucugaggcuaccuuggcuugucuaccuagauuauccacugguccugauccuguucguugccuuccauguccaccucauugaccucuccaucaucaggugacucauuauagucauucaucucauccaugucuugcauguccucaucaucuucugagucaucuucacuguccucaucaucuucaucauccucuucuuccucaucauuguagugcucugaggccggcuugccaauagguaccagguuguugucuuuuucugcgaugcuuuggagccagccugcugcugcugcuccugcugcugcagcucugucuccuccacacagggucgguccagauuaaaccacagcgucucagucacaugagggaagagugaagggaacaagguggacauggcuccugaguuugaguccuggcuccaucacuuacuagcucuuugauuuuagccaauacacuuaaccucucugggccucaguuuccucaucgcgccaagaacuggcagccagcggcgacccggaagugcuu

SEQ ID NO: 1696 - RNA, 1994 nt, Mus musculus
uggaacagagcgccugcgccaagagcagccggcccagcggagucugcgcguucccgggaaugccgaagaaggcgaauuccuagaaagggaggacgccugcgcaguccggaaggcggggacgcgggggcggggcggggcgcggcggcgggggcggggcgccuagucgauuggcgggguuacccggaauugguugcuagacugggcgcgaagcggucuucagguuuggucucaguugcgcggaagugaaacgacgcggagauggaggugagccaggcggcgucugguaccgacgguguccgggaacggaggggcucguucgaagcuggaaggaggaaccaagaugaggcaccucaguccgggaugaacgggcuuccgaaacacuccuacuggcuggaucucuggcucuucauccuuuucgaccuggccuuguucgucuucguguaccucuugcccuggugaguauccugaguugcagaguugaagagcuuaggaagcuggcggcugcuucagucuucucggagagggagggagggacggcagcuagagauggcggaguuggaagagcgaaaauggauuuccuugacaccccaguggcaagaggaguguggagaaaacuugacuucccauauuugucuguuucaucaccacaaacgaacuguuaaguguuagaaaccuauacccauaauuagaucuaucguaaauaauaaaaaauaauuacuaaaaacuaauaaaaauaaaaguaaauaaauaucguaaguaauaaaaaauagagcaugacagguuaaaugugauuauaucuaaagugauuugaguguugugcgccugcuuaaaaugcuuagcccaaagcaagccuuguaaacuuaacuuguccauaacuuaugcagauaaacgcguauuaucuuccagaguauccccaguccuacaucugucaaagaauggaguaucuuggguuucuuuggcucucauuuuuucgguuuuguggcaaauuagaaggcagagaaugggggggggguuugaaaagauaaacaguuuuuugauaaaaacucguuaagucauuuugguauagacauuucaagaacagugauuuauuauuuaguuauuuuuaaugaucucauuuucaccucuggguagaaaauucaugacuuaauaauguaggccuuuaguuuuccuuaucaauaguguaaauuauguagggauaggcuagcaguaucuauguucagcgucccacuaaaugucaaaauaagcagaugaaggaaacaaguauuugguuuuuacagaccgguuugcugagucaagaauggggcuucuggagugaaucuugaaaacgacuauagacucuugaaugaagaggacuccagcagcugacuucggcaccucuaucuaaccuuuucuucagcccuugaccucacuaaaguacuaucauauguuuaaaaccuguuuuucaugguugaaguaaugauuguagcuaaaugauagauaauauauauuuuuaauaaugucuguaacuuaaguacuuaugggaaauaaauguauguaaaaaaaaaaaguuaucuuugugaagcuuacuuucucaaauauuguuuuaaaacuaugcuauuauaaaauaauuaucuagaguugaauagguagcacuuacucagaaaggccacagucccaaagcagcuacuagaaacauuuuggaagcuguuccuugucaucuuaagaccugggugauuagaaauucuuuacuguugguuuuagugcuauucaguauaugagaacugucuaaaauacucagaggggguguucuucucccuuauaauucacacuauuuggugaacuguuuacaguugucuuaagauacuguugcauuugcuuggguaauuuuugugcaagguguaacugaaguaugcguauuagcacacagggccgaggugacucuugaguucaccacacucugggaccugcuuacuaauuuucucuaauaaauguuuaaucacugaauuuaguuucac

SEQ ID NO: 1697 - RNA, 53527 nt, Mus musculus
uaugaagacguucguuuuauuaguggucacgaaagccccacuuagggaaaauacauucgcgccaaaggacaccauucaacugcaaacagaccguaccgacucccuaaggggaccgccggggugccgacccagcaauggcugaaacccacagaaccccggcucagauccccgcgcauccgcacucaggcugcaaagccgccaaccaaggcggacgacggcgggacgcccgcgucugccguggaaauccgccgcaguccccagcccaccacgcagccgcucgccgauccgccacgucccgucucacagcccgccccgcgcgccacccccgcgucggggcagaagcccgagcccugcucucgcgggaucucgcgccucacacaagcccucggaaagggagcaucacccgcgggaaagccgggaacucacgugcgggggcggggcggggcggggcgagacgaggaggcgggcccggcgcaagggggcggggcguccugacgcgggggaaggcgggguccagagaccuguugaucgcaggugucacugcccagaccggccccugggucuugggcgugcgcgcaugcucugcgcgggucuggcggcugaaagcggcgguguggccgucugucccugugcgugucgcuuugccugucacgacguugugggugucggcgcgaggcggagccgggccagugggacuggaagggcuacggcgccgggagguagagcuuggggugagucgcgggagcccccgcugggcagagggcggaggacucucgguccccacggccuggccccgcucgggcgcgcuaacccggguggccgcaggcugagggcgggauugggccgggucgggaugcgcuggccaggcuccugcgguucccggugcagccccacagcugccggagcacugagccuucaccagggcuccagcgugauuggcguuccuccuuggcggagcagacuggauuggaugugauagaaucuuggcuugguugguuucucaguagcuggacagacggacggaguuaauguuuagcuucuaaacggcgguuuacgguacaauuaccaaacuacucgccggcggcgcgggggaacaggaagugccugcgcagguguaaccgggaggaugugaagcccugcaaucugagccuguuuugagguuuuguuauucuccugggguuuguuuucuccgugcagaucccgauaaaugcuugcaaaaacguacugcacguccuuaucugcuugcggucuuccauagcuggaaacauauucuuuccuccaaauauauuuucaaggcuacuuuugagguacaugggcaguaaaccuaaguucucuguggugagcccuggagcuuguuuaagaccaggcacgcugauuuucaccuuuaaaagguggagccagugcugacacgaaguuaugauagaauggauuggugacauugauaacuugucaguuuuauuuucuguuguuuucaauucugugucgaugauggucgaggcagagaucccucauccuauucuguuaaagaaaaaaggaaaaaaaaaauagugaagaaagggucuucaaaaguaaugugugauuuaucugcuauugucagaagaauuccuaauagauuuucugcgggcaagaguuguauggaaaauaagguuuuugacuuaucuuuuagagacuuuuaaagugagcuccuuuggacaacuugcuauaaacuuacagaagugauuuguuuaguuuguaaaucgaaucaauguauuaaguauuuuucccaaaggauaaaaaacaagagacccuccaaacaagccuuuuccuuaggauuuuuuuuuuuauuuauaaaguugucuaucgaacucaugauacguggcacuaacaguuuauuacuuuaaaggcgucacuuuuuuuuuuuaaauaaaagugccauuuuagugguaggacacauuuucuacuuauucuugcccuuuaguaagaaagcacccccccccacacacacacacaaugcccuuacaguuucacuaugugcucugauucaaaauauuucuuauauuguuuaauuucagaaguuuauuuucacuauguagugucgaaaaaugcaguuuugguguacaguggcuuagaaguuuguuuuaacagaauaaaguuuaaaaaugacaagaaaucugaucuauuuuaaggggugaugugcacuuuuagaugcuaacuucauuagacaccagcuccauuauguuggaagucuguaguuguagaaggaaugaaucaaggacuuugcuugacucuacaacuuucugaaaacucgucuucucuccguacaguggucguugaaguuagcuggcaaaggugaguuacugagauacuaagcagucuuguuauuucacagcuuuaacuauaaggugugaccuaauuacagacccuaacgacaaucuacagaaagcuugguagcuuauauauugcacaugccaacauuuugaacauagugcgcuaugguaugaggcucuuccugagauuuugugcuaaggauggacguguguugauuuguguccuccuggagaagcaggguagacauuagugacgauacacauguaguauugguaugguagauuauuaacuuuguguugcaacgauuauucaaaugcucauuuacaauguauguguauaauagaaacaagaaauagguguaacuacucgaccauucauaaaucuuuacaaguucuuggguuuuuuuguuuguuuguuuguuuuuuugguuuuuugagacaggguuucucuguguagcccuggcuguccuggaacucacucuguagaccaggcuggccuugaacucagaaauccaccugccucugccucccaagugcugggauuaaaggcaugcgccaccacgccaggcucaguucuuggaauuuuauuaaauaacuuuauauaccacucuaaucuuggcaaguaauugaguucuuucucuuuuuuuaauaagaaucacacacacucacacacacguauuuguaugccaauuucuuagugguccaugacaagaaauguaguguuugccuauaauuuuguuauuuauguacuugguugucuuccuguguagccuagguuaaccuccaguuuguaauccuccuccuucagucucccaagcccugagauuauagguguacuauauaaggcuuagaaucacaucuuaauuuaauugcuuuucuguguggcugauuuuuuuuuuuuguaacauuuuucuuuuuaaaaaaugcuaucagaggagccuguauugggccacaggaagaguccacagggcucaaauugccucauguauucauauuuguauucuggaaaguaaaauuuuauguaaaccuucacuguccuaccuuucaaagcuuuacgugugccaguguguguguguguguguguguguguguguguguguguuuuggugcuggucauugaauuuggucaugggccuugcccauaguauaguaggccagugcugugaccacagagcuaugagaaccucagcccuaacuuuaauuacacuaguaaauaaauaucugagauagcaugacaucuuugugauaguaugaaguuuaucauauugagcaguaaaaaaagaauuaaagguggggaaaguuuuaaggaacauuauuguauuuuguuguuuuuuucuuguuggauggguauuucgccuauaugucuguaccaucugugugccugcuacccauagaggccagaggcagaucaccugagacuggaguuacagacaauucugcacugcccugcgggugcuaggaaucaaauguggauccucugggaaaguaacaaccauucuuaacuucucagccaucucuagucccaagaauacuguuucuaacuuagcauuuguguucuuuggguuagcagguuuuucuuaguaaaccuuuuaaaacauauucuguguacuagauacuagagauucaaauauuaguaaaguguuagauaaucaugucagaaauuuuucuuuuuuggaugggucacguuuugagacaaaauuuuucuauaauucgguaugcucuggaauuugcucuguagccuaagcuggcuucaaacccaaugcuuuagccuccuuaguauauuuuagccuucuuagugcugaguuaguaggaaugagcagccacuuccaucugugaauucuuccuccucuaagcuucacuucuggcuauucugaaccaugaccagcaccccuacauugaguguccaaaggugaaagggugguggacgguuuccuucucuuacucucccuucuguaagauucugcuucuccucccuuucuccuaucaaucuccauccacaccacacugauggagucgcuucugacuugacagagggugguggcuuucuucauccugaacuacauccggagagcugcacuguguugcuguagaccacagacauuauaacuaagggaaugugaagauagguaagccaucaccuuaagauuaagaugaugacugagcagacaggagaugcuaaggcagacugguagcauuucagagacuaaagacaugagcauuagcaagaugccccuucuaugacuuccucuggcuagucccaggcuagcugugaguucaacugaacauguuuguagaugacaacaucaucuuucaaugucaaaaggaugaacucuuauagguagucuuuguuaggaacacuuguuauuuagaauuucagcuuucccucucagauucauccaauuaauauagaagaugcuugggacuugcuuuacauuugcagagaaucgagaggcggagauaguaaacaagacauccaauaggucaauuacauagugguuuagaagguaaaaagugccagggggaguugggacgguaagguggaggauggcuugcaacuuuacuuuuaggcuacauuuagaaggugaggcuuuggagagaacagaaggcaaagacaggaggaucaggggaaacauuaggauuccaggcacagggguaccacugcuaaggcucucaagaguaggaauuugcuugauacauguuugagaaugauaaggagucaguaugcuggaaugggaaaaggcaaagaucagguggcuagaggugagauuagaggguagguauaguuagaggguugcuguagugugaauguuugugaacccuuaaaauaccuaaguugauacauaaaccccagugcaguaguguuaacaggugagguuugggggaggucguuagguugugacagcaaaaccuucaugaaugaaaaggcuggaguaaucuugcucaucucucucccaugugugaauaccagaaggcaccaucuuugaagaagguaagcucuugccagccacugcuaccuuaguauucccagcccucagaacugugagagauagguaugggcauuuguguaauagcuaaagcaaacaaaaaauagauauaaaaucuaaaaaacuugauaaguuagauuucaucaaaacuuaauucaaaauuaaagaauucuuaaaggucaauaaggcauacaguaagauugugaccagaagauugaacauaauuucuuuuucuuuuuuuuuaaggauuuauuuuaugugaguacaccagaagagggcaucugauccuauuacagaugguugugagccaucaugugguugcuggaaauugaacucaggaccucuagaagaacagucagugcucuuaaccacugagccaucuguccagccccuugaaaguaauuucuuucccgagaggcaugaaggcaccuaagcaugugaaaagcugcugagcaucacuaguucuagaaauguguguuucagccacacaccaacacuacagaccacagcaucucuaaauagaagagauugaggcaacaauuguuggugaagaccuggugcagcugaagcuauagcucucaaaugcaaggguuugaaagcguaugaugcaucuggugguuuguuuguuuguuuguuuuaaugaaguggagcauaagcaaucauacaucccaguaaucccacucgguguauucccaagagaaauggggaacccagaccacggaaaguuguacucaacugcucgugcuuauuuacaguaacuguaaguuggaaacacuacagaaauauaaauuuggguguguuacuucacaacaacacaacuugcugaguugugcaguaaguugaugaaacuuaaaagcauucuuccaagagaauuaaacauuauaugauuucauuuguguggaauucuagaaaauugaaauccugggaacaaaagcagaaacauguuuguuuuaguuggguaucauaguucucuguuauaguauaauaaguuaccacaaguuuagcaacuuaaaauaauuucuguuaauuguuuuauaguuucauaauuuuagugagccaauccauaugggcucaacaaggucucugucauugguuucucaaggccaaggucagaguaucaaaugguggguagguuucuggcuggcagaguccucagcgaagaaucugcuaacaggcaaauucuuuuccuuguaggacuaaaauuucaauucucugguccuaaaagcuccccacacuccuuauguggacuccauccuuguuacccugcaggggugaaaucuguccaccucccuacgagcugaagaaagcuuucguugccuuuaaagacuucugucauuagauugcaccccccccaaaaaaaaaucuaucaccaucugugucagaaaacauagaugccaucaguggauuguauuuugccuaucuucagguuuuggacaguaggguauaaaguaugugaguauguguauguguaggugugcauuuuauucuacuucuuucuauacugaaaagaaaagguuauggcuauaaagaggcuugagagagcuuucaggagauuggagacaguuggcugugguaguaauuacaugucaaaacucauucagcuauacauuagaggaaugaauuuuguugaauaaccaugacucugaaaagcaggcuaguuuuuaaauccuggcuauaaaaauacagauaguaaaaaugaacugauacuaguaucucccaaacuguuuaauuuuuuucuuauuaaauauugacugaccacaauauaagcagaagagaaaaauagaguaagaaaucuauaguaguguguauaacauuaagaucaauacgagguaagaagagugaauggccagcccagccuaggucuuugagguuuggagucccuguaguuugccuuguuuuuugcugcucagccguuggacguggagacagaagagcaggacagugugagcaccuucauccuugguuuuauaucugacgggcuccucuauucuuccccucaucggugagacaucuccccuuaccuaggaccguuggguuucucacacauuccuggaccaggcuucugaucuacugcucucaugcaccaagcucacuuacccacccagcauuagucuaucacugaagaugcaucuauuauaaagagucacuuaccucaagccgcagcacagucugcugugaacuuugccagucugauggguauaugcuauuagguguuagcugugcauuccaaggcugaaguguuguuagcauuuagucuucucuuuugauuugcagucuuggcauguuuucugcuuguguaacuggucuugguuuuagccugcaguaguucucuguguaccagucauuccuuguugguuuuaguucuugcaaccuugucucauuucuauuugaagagaauuguuuucuuaaguuuugagcccuuugaauuguggugauuuguauucagucuuguuuucuguugcauccagaccuuugcauguuagcagcuucuuuaaagcuugauguguauugcuuugucacugaguucuauauauuaaccucacuuuuuuuuuaauuuuaaguuuugguuuguuguuuacuugugauuccuacagcagcuugauacugaauuuagagagauacccguuacucuugcaugauccuaacaguacugcauuaaauuucuuuagguuaaguuuccuugcuuauccuuuugcauugugaacacauguacauagauaacuuuauaaguuauaaaugugacuaguacaauucacaguuauuuuuggcauagguuuuucccuccuugucagcagguuaguugagcagccuuguuucaaauacaaaggaaauugcuuggauguucguauaaaacauacauguucccacaguucauugcuuuacagcaaaugggaucauuguuacauaaaaacacuguugcuuuuuuuuuuuuuuuuucccuccuuuaauuugauuccaaggugucucuggagaguggcuguaaacaagcccugcccugacagggcuuuaggcgauuugggucauggguucuuaugcauuuuucaugauguuuuuauucuggcauacaaccuagugccuaagcaucuaggaccugggugugauuaaauguccuuucucuuggaaguuacgguagugauacccuuguggucauugcucaaauuguguuacuuugagaucacaguucucuccuagagcucuuaacaagagaaacaagucagguuugaguguguuuagccagggagacuaaggaggcaucucaccacagcuuguggacuaauagaagcaguuuaucaguuucagacucagagaaagggcugggccagcaggaaggagagguaccccucaugagugaggaacaagaaggggagggcugguguauucaaaccuugaguggaaucuaggaugcuaucuagugguguguccaacagaguuccuccaggguuuugggagcagccugccacaagcuccauagagucacauagcugagaagugggugugugcuacuuggcugcucuguccuuucagagugugaggcuugagcaagucaaauacauuagaucuacccucaccauaagaaaguggucagcaugaggcaguguauaggacaguuaaggacuuguauuuacuauacugauaaggugggagaagguuagagaucuggagcuguggagcguaaacuagccacaccucucauaaugaaagagccucagcaaauaccuuguuaggcuggugugucucugcugauggugcaugcuuuguuuucuucaugauugacugcuggaacccaauacacauggacaacguaacguuuuuauucugcaguguucagcucucaauguuggguuugaaggggguguguuaguguguguguguguguguauuuuuagccuaucgacaauaaaagaaaguaccacuccucuuuuagucuaccaacaauacuacuuuuaaauuuuuuguaacguugguagcucuauacuguugcaucauuuugccucugaauugaagaaauugaaagcgcucuuuaauauuucagaguaggucucaggacucauguguagucuuguugcagugaaaaaauacaaagcaaaguaagcacaguuaagaugagguuucagggccuccugccagugagcucaugcaggacucuccuuccuccaguagagacuuaacgguggugugaaaauguugucugccaggaagcacacugaagacucugucguacauuuuuuguuggaggaugguuacauaguuguucucuacagagaaugcaccaaaauucuagccuuccagaaggcaauaaacauauaagucacauugucuguagcuuagugcauucucgcuccaguaagcaagaggggaagaagccucugagcucuugaaggccagccuuccaaacagaccagagaaagccagacugccaucguagguuuucuuuuugaaguguaagucauguauggucuaauucccuauuuaaaguacaugccaguaguuuuuagcuacuugcacaaguguacauccaucacugugauuuugcaguauuuuaucaccaaggaaaaagagaacaaccuuguaccccuuagcugccaccccuuuccaaacccaacccccauccccagaccuuucuucuccaguccuaagcaaccccugugauacugugugaacagaaucacaauaugcggccuucccuguagcaugugaccaguaguucauuucuucuuguggugauugauguuccauuguauggccacacacauuuuguuucuccaucuguccaucagucgguggaauuuggauuauuuccacuucuuggcuguuaugaacaguguuacuucuuuucaacaucgccuccccagugcuuucuaaagcaucuauauagacucccacugacagaagcuccacuuuccguucuuuugacacacuugcuuauaaagguuuagaagcugcagucuguguuauuggucugaggcuuaccauacuugaauaugaagaugauguugccuucauuuggggcauuuuguaguuuauuucccugugaucugugauaauuucauauugggaaauaaugguucuuugaagauuggguaacguuugacuuuccguccagcucuggugccacucucagugggagaaugcuuaucucuuuuuugucuuccccucaccuaccgaguagucuucuuguuuauacuuuugcuugaauuacuuuuaggacuguauuuuccuguguagucguguggaccuuuagauuuaaaaaaaaaauuuuuuuaaacaauguuuucacugcuuucauauggucuuuucuccuauaucaguucaaucgguuuucuaucucccuuuucuuuaaucagcccugugaagguuugucuaacaugauagcuuuugcagaaacuuaguuuuauucauccuuucacccgacaguuucuguucuacucccuuugucgucguguuauauucauguuauauuuggacuuuacaucauccauuuuacuuguuucaccucucaaguugagcucugaaguucuuaccucguucuagagguauuuacuuuuucuuuuuaggaaucauugauagaauuugaguguauucagaccucuuuuaaauaguauuuauggauguuuguguguguguguuuguauugcuuuuuuaguacuuuguucaagaacuuaagaauauuuuuaguaguacaaugaaaguuuuguacaauacccuccccccucaauucuuucuagaucaaugccuucccuauccaucuaacguuauguugcuuuuaaacccaucaagacagauuaguguaacccagauauucuuggguguguggccuuccuuuggaguguggucuacucaccaggggcuacauucuuagaagacacugacucuccuagaagccaucaguugucucaacuagggcugggacuuccugcccagcucuaaucuccauuucagauuugguguggcuugagcuugcagaggucuugugugggcucucgaguacugugaguucacauguguagcuucccugcagugucuagacacguuguuuccuuuaggucauagacggccucugguucuuacaccuuuuucugccucuucuacauugaccccuaagccucuggaagagggguacaguguaucuguuccauuuagggcugagcauuugcucucugauuuucuguaccuuggccaguugugggccucuguguuaauccuaucuacugcaaauugaagcugauaggucuugagagaugaaucaaucuaugguuauaaccucaauuuacugcucacaaauauuuuuuccuuuuuuuuuguuuucguuuuacacauuauugucaacuauguaguacuauguuauuugucuuuccucugcucuuuuauuuacuguguuauaaagaguucaauucauugccucuuuuugguucuuuguuauuuaucuugcuugcuugcuuauuuauuuauuuauuuauagcaagugagcaugcgauugauugcuuauaugugaacaucucagcacacauguagccgacagaugacaacuagcacaggaauugucuuuauuccaaggaucaaacauggacugucaggcuuguuggcaagcaccuuuaaccagugagccgcucaguggccugcauucucucuguguucacauuuucuaagacuccaguuauauuuaccagaggagucauaagcuagucccaauugugggaaagugaagcaagaugacagcucuaauauauguguaagcugauuucagagaauagagaggagguggggggcuucagugaugaagucugagaauuuauucuuguaaggaacauuuuuaaaaauaauucuuccuaucaaugauuuuacuuaucuuuauuuuauguacacugguguuugcugcauguguuagguugucacacuccuggaacuguaguuaaagacaaccaugaacugccaugugggugcuaggaauugagcccugguccucuggcagagagugcacugcugaaccauuucucccuuaaaaguagaaaugguuacaggaacaguaauguaaaguaaucuaaguaauggagaugaggacagggacagaggucacgccuguucucacuuccacuucccaaacugacuuuccuguacuacagauuggaugugaaaucuccucuacaccccagauggcacuggguagcuguucuuuccugucuuuguauuguguggauuagaguucucuggaauggaaagguuacaacuauaaaugucuuucuugggcuguaauauuuggcucuuuccaucucuuagcugcugucuccuuccuccuguaggagcuagucucuuugguauccccaggcuuucucuguuuuucauuagacuuuuuaaucuguguuuucuguugaucucaggcaaugccugugaaagggucauuugacacccccauccccaaaaggggucacgacccacauauggagaaacauuggguuagagggaagcagucgagagcacauacuugucugacauccuauguaggaauggaaggcauguauuuuaaaguuaucugucauuaccccucacaaaccugaguucuuaaaaggaaauaauuguuucacauauuuuauuucaugguguggaauuggugacaauuaaguuuuguugaaagaauauaauuguaaaaggauaucccauuaaaaaauagggauuuauggacuggggggaaggcuuagugauuaaaguacuuucugugcaagugugaggaccuaaaacccucuccaaaacucucauaaaaguugaacauagagcacaaguguuuaauccuaacauuucuacagagagcugagaagcagagacagggaauucccaggggcucacaggccagcuagucugucuccuuaacagagaaacaaugaagagacuuugucuugaacaagguagaaagcagagaccaccaagaccagagguuguccucucaccacaaugcugguauggcaugugaaugcccacauucacacacaaauaaaaauuuaaaauaaaaauagaacuuugcuacuguauuaguuacuuuccuauuacugagauaaaacaccaugaccugcagcuuuuagaaggaaauuuuauuuggggcuuacaguucuagagggauagggguucaucagcaucauggcgagcagcggcagcuaagagaggucaagucuugauccauuagcaggaggcagagaagugagccagcacauuuccaugcuagccccugcgcuguucuuuccaguuugcccugcuaugccugcuguguucccagcaguucuuguccgcuugucccuggagccacuaguucccucucugcuauaauccccuguaaugggugcucccacauuccaguaaccaaauagaacugccaaccucgagguuaaaaaucacaguacccaguauaaucaaaacucuuaagcuuauaguuagccaauuagauuuauguauccauaaaaucacaauuuacaagaugccaauacaauaauuucagagccaauugauaaugauaaaagcuuuaccucagcuaugcuaaccuuaucaaaucaucauguaggccuccauucuccuuccccucucuucugaaugcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccucacucuuagcucccagucucccuuuucucuguccagucacuggccuauugcugcccuaaugugauuggacagggaaaauccugcaacagguaugggcuuuugaaaccucaaagccccauccccugugauacaucucuuucaacaaguccacaucuccuccuccaucccaaacaguuguaccaacuggugaccaaguauucaaacaugcgagucuaugggaaccauucucuuucagucaccacauaaagagcuaccaauaaagagcucccuucauguuauacaaacauggaugaauuuauuauaaacuuaguguauaugaugcguuucaggauuauuuauaucucuuuaagagaagguugcaaauuauagaguuaaauagaagaaacggcuaacauacuuuauaauuuuaaaaauauuuuacuucauuaagcaggucaguuacaguuaccucauguaugaggugagcaguccuugacucugggaugggaagaauuuaucugagaccagacagcugauaagcuggccuggaaacaaggucuguugccugauucuuuagagacugauggcuuucuucuuucuucuuuagugcuuuguuuccgguggcuauuugaucaguggugguaggcugaccuaaugucucaucuuuuauguucugugaagauagaaugcggugacuuucaccuaaguguaccaaggcauuuguuaagacccuaugcgcucucuugccuggcaucccuucgcacgugcuuucuuccuuacugggcuucuuuguguuccuccaucacaccagauauggucuggauuuaguaucugaaguugcuguccacgcuaauugggauucuuccccucagguugcuuuaccuuucaaaucuugauguggagauaagcuucuuagugaguccuucucagcugucuugcuauccggcuuccucccccuucccucauugauacauaacagguaacucuucuaguuauuuaugauguugucaaaguaugaagcauugucugacuguuccucauugugcuaguuuaguguuugguauuuguaaguauuuguuaaaugaaagcgugcaagaaggaaauuuaguugauaauguugauagugagugaguccuugcuuuuaauucagcagaugaacauuuaaaguccauugaaacaggagcacacauuugcaaaaggaguggaauaccucacuagggauuuuuauuuagucuaguuccuuuaggaacuaguucaauuuauauaaaaucugucuugaaaaaagacagucuguuuauagaccauaaauuuauuuaauacaacagaauaccaccucagauuuaauguauuuuuucagaaaauauuuuucuuauaucuuucucugaacauugcaguguuggcauggguagugauuaauauccuaacaacuuaaaaaaaucuaaauguuuuuauuuucauauuucaaaugcuguucuaauccuuuugaugaugaauugugguuuauucaaugacugugugaaauaaguggaaaacucuugaucagcuuuuacuuaauuuuuuuccuuucuuuuuuuuuuguagauuuucuuugaggucaugcugaugaaauauggaguccucuuugcuaacuucaccugaaucagagaaaagcugcuucacuaaagaaacaaaggaaacaaguggccagaggaacccugcagaugccagcucuguaccuugaaucuucuguuuucagcccaacagacuaaugacucacauguuaacgaaaauggucuauucaucauagauuuuuagcaguuaaaguuauuuuuaucaguguguccaacuuaacagauuuuaagaauuauuaaaccuggaaggccuuguuuaaaaucaguugcuuuuuagcucucagcaauugaacguuuacuuugcuuuuacauaugaaaguccucagaacuguagcccaucaggaacaagauggacuuggaagcauacagcuuuauuguggacugcaguggaauuaaguggacagcucgacaucacccauuuucuuguccagaauaccacauaaacuaagcauauuacuuaacuuuaaugcaaaagaaguggcuugaaaauggccuggguaaaauuuuuacggaagccuagcggcaaucuuggcaaagcuuaucaagcuggaagccugcugucccuagccccuacugugggcuuguuaaacgagccagggcagaacagcugcuuucuaaacagugcuguacaggugagacaucaguuccucauuucagcucuuaaugugcuuuuaagagacucuuaugugaugauccuuuuaacacuucguugacuggaacgacuucucuguguguguagugucggugguauguaccucuuucuauaugcgugcgcauauagguuucugugugugugauacaugaagucagaagucagugccaggucguuccuccccucuuuccaccccgucuuuugaggcauggucucucacugagaaugcagcucauccauucagcucagcucaguggguugcacuccuccuuccccaccacuggguuacacucuuuaccauugcugguucuugcauggcccagggaucugaacucaggcccccaggcacgcacgaccaguacuuuaccacuaagccucugcccaguuuuccuguaccuucaugucgcuuuaauggggcagaagauacucugcugaauguuuucauuuuuauaauaauuaaaaaugauauuuucccauagaaugauacacugcuaugguuuaaagaacauuuuuauucaaaaugcuuaaaaauuaaaaauauguauaaaguaaacauuuuuuuuguuuuaauuagcuaacacucuucugcaugcuuuuuaaaaaauagucggguguaaaucccaguggaugggauaaaaacaaaugagcuagguugaaauaaugcaaacuuacgggggccaccgucucagagguaaaggggaggggagaugggggagagaacucugagaggggggaaccaggaagggggcaacauuugggguguaaauaaaauaauugauaaagaaugcaaauucauuuucuuucacuucacagugacccuuaacugcuauuuaauuauaauuugagugccacuguuuuagguugacugaagauuacuucgucaguuucacaccguuuugaaauuauuucaauaaauauguauauaaacauccuuuucuauuuuuaauaaucuucuguaaaauaugcuuugcucuuuuagcaguuucauguguuuucuucugaacacuaauguuagauagagcuguaucauugguuuaaugacuacacaucugugacaugccacaugccccagcaucugaacgcuugcucucaguuguucuccaucuggaacagaucuccuccugaaaggucuuuagcucccccaggaaagggagcauuaggaaaacacugacuccaguucacuuuggaccuuaaacaaauguuccaccuagcucagagagucuacugguauuaagagaaaaagagaauggcaguggauagcagggaauccaagcaccagauaguugaaguuaaaugcuuugauuggauccaacugucaauuuaggucuuuuccuguuuucuacuuuuacauuuucccuuuccuuuaguucucacaauguguguguguggugggggggggaaagaguuggggagacaaaacacguuauaacaucaaauuguaaguauggaaauguucacagucaagaaaguagaaauauucucuugguaauguuuuuuuagauggacauuccaguuuuaaauggauaugccauaaagacuauuuuucuauauaacauuuguuuaugguacuuccugcaacguuaaauagaaccaccuucaauguaacguauuuucuucuguuugaaggaccuuuacuaacuuuuuuauagugcuggccuauuaguaauauauuauucuagcuuuuguauguuugaaaaaaauccauuucacuccuuuguuugaaagaccaggaauuaaagcuagguguagagguguguuugccuuuaaucucaguucuugggagguugaggcaggaggaucaggacuucaacagccuuaggugcaucccaaauggggagaugggaccucccaggccuccugauggucucccuucuguacuaucauuguuucuaaugaaaacgugcauggucuucgcuuuccuuuggccacucuuaagguuuuuuucuuaguguuguucaugguugaguuuguugagucuuuugaagcugucaauuugacauuuuuccugucugucccuccuuuggaaaauuccauuuacauucaugguuguuccaaguggcaugaagucuuuacuuucuuucuuagucuuuuuuuuuuuuuuuuuuugcgucauucucuggauucuguuucugugucuuggaguuaguucuuuaccuuuucaaugucuuugugauaauuauauuuuucauaaugggugugguaguaugcaccuuuaaucccaguacuugggaggcagaggcaggcagaucccagacuucaaggccagccuguucucacugaguuccaggaacgucagggcaacaacaaaaauagauuuuuuuuuaaucuuagacagucugauuuucauuaguaaauauuugcuaugugucuuuguguucaaucuuagccuuuagucuaugaauuguucuccugugcuuaucuacucauuuuacccuuauacagaauuguagugcuccuuuuuuuucucccccgccaccuccacuccccgcccccccccccuuuuuuuuuuuuuugcuuuaauggucacuaauuuuuacuggcugucagaaguuuuaccuugugagguuauagauauuuuuaggauccuaaagauaaucuuaaacuuuauucuggaccaggauuaauuuaguuggagacaguuugguuauuuugauguucugguuucuugggcagggguaguuuuauuuacuuuuaagguuaguuuuuuucagacacuucuuuucuaccgccagugcucuugugaaccuaaguuuuccaccuugacuauugagaacgggucuccuccugguccuccaggagcuccgagcaugagcucuucaguucaugugaguguuucauucccggacacacgcugccguccugcuugugcucaguggcuacuuggagggagccugugcgaggccugguaaggccucugcagugcucugcccugccugcuacagcagccuccagugugcagauguugcuacaggcuaauuugaaaagccaguugaguuagaagcaaaguucuauuucauagcuaacauuugcugaguaguuacuauauauuagguccuugucugaugauuauacauaccauuucguuuaaucuuuaccacuccuggccauagacgcuauaguaagcauuuggcugucaguucaagaacugcucaauagaagagcuggagcugggacccaagccaucugccuucagagcuguguuguuagacauuugcuaucuuuaaucuucaucaucuuuguugaguccuuugaaaaggauuucaaucuuguauuuuuaugauaugcugagauaauauauaagaaguuaguaaauauuaccaaguacuuuacaaaacacucauuuuguuuuuauuauuuuuagcugagagaauuuagauguuuuaaguggguucuuccaagugauacuuuuucaagaaauuacugagaagauacagagaaucuugauaaacuugcuuguauaucaguuauaugucaaguccugcaguaugugcugugcauuuuguauguaucuucccccaaauggaggcauguaauaauauuauuccauuguguagaaugucggauuuuauaaaauggguuuuagguacuggacugauuuuuuuuuuucaacuuuuaaacuuuuuuaauaguuugacuuuuucucuuaguagcagaugucuaaggaguaauugcugcgaauauauucaggucauugcuuggcuaucaccacgcugugacuccuaucaccacaggagucuuacauuuagugugugugaucacacacaugcuggucagacauucuucuugcuaagacacacugacuacuauuuaguacauccuagcuuuaaagucuaauuauauuuccuuccuagguuucugguguuuccaaguauuauaaucucguccucuuucaugucucugccagauucuccauguaguauaugcuauauuuccugucugugugcagauacuuaacugaaagauuuuguuuuuuuguuuuuuuuguuuuuugguuuuuugguuuuugugcucuacucccaucacgacuuuucaugugaaugaauaggaauuuccucuauguaguguugugcuucccguuucuagugauuacgcaagcccaguuauguacaggagauuaaagaaguuacuuacuauuuuacugcuuuuaaaauguccaaauaugcuuuuuuuuuuuuuccauagagcaaucucaauucuguuuuucauucaaaucuuuuuuagguuuuauggcaauuagauauauuccgaagaagcuugagagcucugacuggacacauaugucagggagaugccuguauauuuugugcauugaagguaacuauuuaguaauuacuaucgauucuccaaaauuuuaauuuugauggugguuuaauuugguugugauugaaguucauugucaaauaacauaguuuugaagaugaaugcuuaaaacauggcaaguaucuccuacuuuuauguuagacaauuaaaacuuaauuuuuuaaguaacaugaaauugugagaauauucuucauuguuuuguaguuauuauuuauuuuaaugacuguucuuagcuacuacugaguucuagguucugcucuuauuauuggguuaaugcagugagcauaauuuguaacaaucucugcucuuccuaccacugggauguggaagaggguaaauuucaaguucagggcuguccugaggugagauccuguuaacauaaacaaaaccagcaacaaagccccauucucauggagcuuauauccuuuuguaguauaggagacaaugugcaagcugcauguagcauauguuaggugguaaaaguuauaugacuggccaaggaggaaauauuagccagggaaacccaggaaguauuaaggagggagaaaaacccucaccaaaugguuggcaauugacucaagaccuagaaaagauggucgaguuucaguaaagggcaacaacuucaacauguuguucagugaauaccaaaaacgucugggcaccagaaacauugugagcaagaaaguguugagagcuaggccucagagguaaggggaguucugauggcuucaagguaggucugucacagaggagugacaguguuuguaugaacauguggacuuaaacuuggauucuguaaccccagcucuggggguuagaggugagaagggugcuuuggcuguaggguguuugccucagucauucuccaugcuguguuuugagugggacucuagcugaggguggggcucagugaggggucaggccagccagccugcuccagagacgcccugucugccuucugauggugggguugcagucaggcucucugugcccaccuggcuuuuccaucauuucuggggguucagacuccagucuuuaagccagggcuuugccuucugagccaucuccccaguucuugaguaauuaacuuauauggaauuucagggccagacuguuguuuauucauuucuggguauggguugcuuuuuuuuuuuuaauguuguagugaaauuauuaaagugucuguaaaguugcucgcuuucgaccuacugauauacuuuugauuucuagacaauauuugcacaauuucaacacagucgagaaaaagcacuucccucagauaacauaaggcaugcucuugcagaaagcuucaaagaugagcagagauuucagcuuggccucauggaugaugcugccgagugcuuuguacguaucucugacagcccuuaaacacuuagaagaauaguuuuaaguccuuguaugaugcaaauuugaaaaaauauauaaaaaugaaaaaugucaggacuggucauuguuuauauaucuuauucauccuuccugauugaacuugaauuauucuguguuuuauguuguauaucagauuauuuaugcccugauuuuuacuguauguuaguuuacaaaaauauacauauaauuguuuuauaauacauuuuauauaauguauauauugagcccccaacuuuguguccuauuugguuuuuaaucuuccaacaccagucugugcuguccaaauacuuguggaugugucguuccacuggaacguggcugaccugccagaagcuacucucugggaggaaucugucucuuccucucccagcagcugacuggugccaaacacuauguggcuaagggugggauuuuaugcacaccuccccucucugugcugagauuugaucuggcuucaguuugcacagguuuugaguacacuaucaaaaucucugauuuuacauguauaacugcucugcuguguccaaaggacaauguuuucauguaguuauccacuacuuaacaccuuaucagugauccaugagccuucgagguggguguaugauauauauguauggagauauaacaucaaauauauauaguauauauauucauuagcuuaguuggaaagcuccaggccagugagagacauugucucaaaugauguugcugguguuccuaaguuugauacaugaaguugucuucuggccucuccaucauaugcaucugcauacacaagugcacacuuuuuaaaaaacauuaaccugauuuuacuuaauauaagaaugcugggaauggggagauggagagauggcucaguggcuaagagcacugacugcacuucagaagguccugaguucaaauccaagcacccacaugguggcucacaaccaucuguaaugggaucugaugcccucuucugguguaucugaagacagcuacaguguacuuagauauaauaaauaaaucuuugggcuggaucaaguggggcuaguugugucaggcaaauguaauucauuguauauacauguaauaguuuuaaaaaaaagaaugcugggaauguaagaaauucaguuucuaauacugaauucuauauauuaauuaguauuuaaaauaaggcuuuaaaguucuuuccuugauuuuuuuuuuuuuuaaaacuagcauugcaaaaggugaauacuugaacauuugcagugauuaaaggggaaaauugaaaagcuagcgguuauggcauuccugcauuuacacuuuggaaaauguucaguuaaagguaauuauaucuuaagguguucucugcaagaucaggaacuuacuucacuuguguuguuuuuuuuuuuguuuuuuuuuuuuuuuuuaaauuuuuuaauuaggaaaauauauuggcaagaauucauuuucaccuggugccaaacagggacgcagacaugugcaccucuaagucuugugugacucaucagaaguuugccaugacucuguaugagcaggugaggugccuggguugucuguguagacacuggacugcugucucgggagcgauggacucagcagcuuguguucuuccgcagugugugugccggagcuguggcgcuuccucagacccucugcccuuuaccgaacucgugagguacauuucuacaacagcccugugguaagcuucucaaagaauaguuagcaaagaggcuaggagcacacuuacacacauuaggcauuuauucugaaaaauuagaacauaguauagauuuuccuuucugacauuaucgaaugugcuuuaauaagagagcccaggaaguagcuuucucggcugaaggcuuagaauuuagcuuaauauagguuaccugaagugcuuggcuaaaguuucagauugcgguuuggaauacauauaaguaauauaguauguguuuugaggaagcuaaggcuauauauggaauucauuuguuuauauaacguauauauaaccugacagaaauuuuauauaguauuuguagugagccugcaucuuaaauggagcucaucacauaaacuuagguuuagaauuuaccauucauagcaauaauauuagcucucaaauuucagauuuuggagcauuucagacuaaauacauucuauaauaaaaugcaggauuuauaucuuuuauauuuauagcagaccuuuggacugggaaaaugaccuuaaagcaaggaacucauugguagaugaacugcacaagacaccuucaucuuuacuuagcugcuccccuuguauuggccuugucucuacccucgucuccuuuacagugauaaaagccgagauaaagggaaaagaaaggaaagcgcgaauuuaaccuuagguuauuguauuuuagaccucaggagucaacuguaaaaguuugccuugcuuacugccugccugucugccagcuccuucucucucccucucagaaacagcuagaaaugcaaacucuagccuuagaccuuaugcagcauuugucaucaaaguuccuuugaguccuuuaucaauuuagugagcuuaaucuaccucauagguggauggauuaagauggaaacccaagucugauuacaaaaugucucauuacuccaauacuggcaguuuuguuauuucaguguuuaucaggcugaguguguucuaguguacuugugcaguguguuagagaaguacucuugguuacugacuauuaguggcuuauuucaaccacgcaccuaugaagcguauaccagaauuagagcgucuggaauggacaguagugaugguguaacaguuucuguugaaaaugcuuauauaguuguuuuaagguaucacaugccuugauauuuuacagugugaaggauaauucccaguaaugucugucccaucucuaacaaagccauuaguauucacaauacaagcaaaaggcagaagucuaguacuuagguaacuuugcugguagagucugccaucuccuaacugaaaugcuugacuugaccucuggcaacuuuaagccaaagaaacgucuacaaauuuugcuuguuaggguagaauuuaaauucaaacuucuuauuaauuaguagaauaaaaaagaaauauuggaaguacuuccacauagaaccuuuacccucauccagggaaacaaaaguauagcuggacagggugacacugaccuguaggcuuaagugugugggaccugaggggagaacuucauuaaguuuaggccauccugggcuagauagaaggaugauaucuuaaaggguaaauaaguaaguaauuaaaaaggauacucuacucuugccuuccugcucccucucuguccucucaccucccccucccucgcccguuccuuccccccccccccaugugcucauggccagccucuauuccucuacucucucucucucucucucucucagccuuucucugucucuacuacccucuuaacuccccuccccaugcccugaauaaacgcuauucuauacuuuuuuuaaaaaaagacacucuaauaugauuuuauauuugucuuaauucuucauuuaucuuccaaauuaguaauuugucacuguaugguuaaguugaaaguaaugcauaccucucaguguauacucauacucaguuuuuucaagugaaauugauacaccuguuguaaguucauaggcgaggcuagauuaagauuccuaccuuuuuuuuuuuuuuuaaagcaaugaaguugaaagaaugauggaaaggcaugagcgaguuaaaccagagauguuugcggaacuguugcaagcugcaaacacagcagaugacuaucggaaguguccuguaaguagagucgcagagcaucaguguuccucuacguuuauaaacuugaaaauaggcacccaaaaauuaucauggaagcacugauugggcauguauaaaauuuaucuuuauuaaaugauauuggagaugacuuuacaucacauaagcuauuuauuuaucuuagugcuguuauuaugaaaacucuuucaccuaugcucacaucuguagcccuugcugcuugggagauuaaggcaagaucauuugaggccacagaucugugacaagcuugggcaacauagaagaaccaccauaaagaccaaacaaaaacuucuuagcuuugcaaaagugguuuuuuuuucuuuaaaaaauguucuauauuuaugauuuuuuuuuuuuuuuuuuuuugguuuuucgagacaggguuucucuguauaguccuggcuguccuggaacucacuuuguagaccaagcuggccucgaacucagaaauccgccugccucugccucccgagugcugggauuaaaggcgugcgccaccacacccggcauauuuaugauuuuuaaguauagccuaaguguacauggugcccacgagguuagaagagggcauucaguccuuggggacuggaguuacagaugauuguaaaccaccauguggguaugaagaauuuaaccuggguccucuacgagcaacaagugcucuuaacugcugagcuaacucuccaggccacccuacccccuuuuauuaugagacagucuuuuuccuggguggccuggaacucacuaaguagaccaggcuggcucaaacucacagagcccugccuacuucacuuuauuaaacaaugucaaguaucauguguugagugaagucuuucagaaaugugucucauggcugcacaggagucguguugucguucuuugaguaaaugugacaaaugauuuuuguuguuguugcugcuacauaaaacuauaaauggcuucauugauuuuuuuuggacagagucuaauaccaagcuggcucagccucccaaacacccaacuagcuauuaacaaccuuaagagauuuuggguuuuauuuucugccuuuuguuguuguuuucaggaugaauauuuguucuaacacaucuaaaaguaccaaaugaguuaaaaauaagaucuugcuuaaucaguaaagacaaacagcugaucagaaaucaauuucuaauaaacugaaaaaacaaacuucagauacacuuugauuuucauuguauaauauaaggcauauauaguaacuaauaguuuaaaaacuugccuuuuuuuuguuguuguuguucuucuguagaguaacuguggccaaaaaauaaaaauccgccguguuuuaaugaauugcccagagauuguuacaauuggauuagugugggacuccgagcacucagacuugacugaagauguuguucgaagucuagccacgcaucucuaccuuccugggguaucacaguugcuuucauucaaacguuaauaucaagauggucuuaguuuuguucaucugaaccuaaaucuuuuaagggaaauauugauauccagaugugcuuagaugaagauaauuuugccuaaaucagacuaaguggaauaccuuuuuccauagacuagaaaugacuuucaaucacagacuaacccgucucuugcccuuucacccuggagugaugauuggugauaaugaugguuaccacuugaugguucucacauaaaugugauaaauaauaaucuagagaggguuuaagguuuaaacuuaaucuguguauugauuucucugauacaugugcuuuuuaaaguugauuauuacuuucucaauuuacuuugaguuuguuacuguuauaauuacaaauaaaaauuauacuuuaagugauaauuuaauguuucuucaaauauguuaucuaaucaagaauauauaauucaucuuacauuuggaauauaaguaaagugucaauuguauguugcuagagaaacuuacugcacuaaugcauggugaauucaguguguggaacuuagagguuccgaggacuaaaaguugucuguugacaguuccauaucaacggcaccuucagucauaaugcuggaucaaagcuaaucuguaggugaaugauuuucauaucauuuagaugccugauucauagguucuaguucuaaagagacaauaguaaauauacguuaauauuuuuaaauagcuuuuuuauagggucacugaugagaaugccacagacagcgagcugcaccuuguggguaugaucuguuacaccagccgacacuacugugccuuugcuuuucacaccaagagcuccaaguggguguuuuuugaugaugcacacgugaaggagguaagaccugcacuaacugcaguaaucauugggacuuuucacacuguagaaguacauaacaaucuauacgguacuagcauaauuauuagaauaaugaauuaaaagauaagcuaccuauuacaauuuuuaaaauuuuagcauauuuuaaaacuuaaguuuuaaucuaguccaguuuuagaguaaugaguuuugggguagggacagaaugaggcaauguuuuuccaauuuuuguguauaugauaaggaauuggauauaaguucuuuugauaaaugauauguuugcuuuaugaaacagugucucacauuauagacuauucuaaccuagaauuaauguguaucccaaaauagccuuaaacucagagcaguccuccuaucucagcuucuuauguguuagaauuguagguguaacacgcuguaccuggcuuuuuaaaaauuacguguuauuuguuugguaugugugcugcagugugugggugcacaugugugugugugugugugugugugugugugugugcgugugcgugugcguguguguguguguguguguauguguguguauguguguguguauguguguguguauguguguguguauguguguguguguguguuuguguguguguguguguguguguguguguguguguguguguguaauccaacacuucugcucugcugaaaacgaguccacaugagacuuugaccugaauguucauuauagcuuuuuuccuaauagacaaaacuaaaaguaaaaucaaauaaugaguaauucgugaauggcagccagccacagcccuacaaugucauaaaaugcuuauuaauaaaaggaauacaauaucaauuaaugcauuaauuccgauuaaucucugggcauuacacuaaguugaugacguuauauauaagugucuauauacuauaacucuguuuauaugaaauuuaaaaaacuaagaacaaccauguagaaaguaaaugcaugguuuccagguacaaggagggaaggcuuuagagcaaugauuacguacugucgaggacacugacucacuugaggucagaccauuguuuugcauguucauguacuucagugaaacugauagaaaacauuugguauuuguaaaaaaaaaaaaaaaaaaaaaaaaaaaauuuggauaccuagugcuuuguuauagaaaauuaugaagauauuccacuuugaccuuuuagaguucauacugacuaaguauauaacacaaauugucaaaauuuggauuauuaucagguauuaaucaugugaagcuuuccuuucagauugguucauguuuaugagguugccaaguaaggagguaaccagaagucaugcaaaagcuugggguuccaguuacuagaaagccugggggguuguuuguguaauuuauaaacauuaaaauguacugaaauaagcacuuugaguuuugaggaaaaugcacacuuaaaauugacuauaaucagcuaccuguuuuuuaacguugcugggcuugaacaaaggagccucguaugugugggcagguacucugucacugugcuguccuuccugucuguauagagaauguuccaucacccuguagagguccggcaugccucuugcucucagucucccugcuucaucucaggcccgugacaucacggcgucacugacuccucuccauuagcuuugcccugucucauuuacauacaggguucuuaugcaguuagcauuccgucucacuccuuucccucagcaaaguguuauuaaauccauccgugcuguucgcaucaguccuucauucuuaacauguuucauuuaauagcuguacuacaaguuuuucucuaaccuguggugguuuaaauaucauuauguggauauuuuuucauugcucuuagauaauacccagaguggaauuuuugaguuacaugauaaauguaugcuaaguuuuaccaagaguuguuuaucacagauguauugguuuuguuccuacuagcagugugugaaaauccaucuuccacacccuacccagcauuccacauagguaguguuaguaauucuagcucuuguaaugcucuauaaaauaccuuacugugaugcuuaaacauuuuccugguuaaaguaguuugcacauccuuuccaugugcuuauugacagugcacuguguccugcgugugugugugugugugugugugugugugugugugugugucugugugugucugugucugugucugugucugugucugugagugcaugguaucuauuuaaauaugagggggagaggucuauucaaauguccuaccaauuuuucaaauuggaacaucuuuuuaaguucuaggacuuuuuuauucugcacacaaguccuuuauuauuuauauguuguuuacguucaguugcuucuugagacagagucuuguuguguagcacugacuggcccggaacuuacaauguagaucaugcuggccuuaagcuccgagagagccccuguguuggccuccugagugcugggauuaaaggugugugccaccacaccuggcuggccacuuucaauaucuuaguaacagcuucccaagagcaaauguuauuacuuaacuugaugaagucagauuuauaauuuguugcuucucugagcuugucucgugaagauuuucucugcauuuucugcaaagaugcuuugaugaugcuuccuugggggccaugggcaggaguuguuuucucuuuggcuguccagcuucccagcaccauuuguugaacaaauuccuuuauauuccucuaucaaauugucuuggacgcuuugucaaaagucacacaaccauguauaugaaaagcuguuuaaaauuuagugauuauuccaggcaugguggcuuaacaucuauauuugacaaguugaaauagggggauuccaugaguucaauaguugauauguguauacaaauaaaauuaauaauuaagucuuaguacagaaaguaucauuuuaccuguugauuuuuuuuuuuuuuuuuuacauuuguguauuguguguaugugggaagagggaauacacaucuaaagcucaugugugaggucagagcauagucagugaugucaggucucccaccguggguccugggaaucaagcucaggccaucagguuagcagcaagaggcuuuauccacugaacuaucucaucagaccuuuccugucaguuuguuuuuuuaaaugagaaucuaaaauuuguauuuggccuaguuauuaaaauuauucauaauaauuagacugcuagccccugaaagucuuugaaguacuuugaaauguaaaugaauccaguuucugccuauuaauauuacacauuucaggaauugguuuauauuuauuuauuaugauuuuucuuuuaaagaugggaaccagauggaaagauguggucuccaagugcauacgaugccacuuacagccccuuuugcuguuuuaugcaaacccggaugguacagcggucucuacugaggaugcacucaggcagguuguccacuggucacauuacagaucgggugaagaaaacauggguaauugcuuuuaaaaaguauuuuuugguauuuuucauuuauuauaauuaacuacugaauguaagaugaauguugagaaaauuuuaaaauugauuuucagucgaaugaaauuuaggauaauucuauauuuuguucaucuuuucaaagaaaccuuucccugccaguagccuuagaaguacuauugggaaucccccaguauggucaguguggugcacccagaacacagaagaggcuauggggagcucuuucugucagugaaucuugagauuguaaauguuuaguaaccagaaaagccugaagcagcaaaacaacgugggaugcauuacaaagcgaauccagcccugagugacaucagccccuuaaggaucaacuuacuuugucuaggguguuaaaaaugucuggaaaauuacuuaaguaucuuuucuuccaaugagagagaaggaaaugauuuguuuuuaaacugucuuuugaaggauguggaaagccuaucauuuauaaaccagauaauucaaaggaaaauggauuugguggucagacgaaacagaaagaaaaucacaaauuucaaacugauauuuccucacuuaaucggagccaaaugcagacaagugggaggagagcaccagguaugcuuuucugcucucuggugagcaguguguguaaacaguugagcagucugucugucucagugacugggccugcacugccuggggagaacugaacagaaaggcuaaacugccucgccuugcccacaaagagacaaggcuagguagauuuugucuuuuuugugaaugcauuucucagaguuaugauucuacugaccuacuugagauuguccgugcaguggaacaagacaacacaauuucacacagguuuuguaaacuuuggccagcuuuuaauuacuguaggcuuucuaucuacuacaugaguugaagauaguuacagugcucaccucagagacgucaguaaauaagaauacuuagagcacagcagucgccauucuuuuuuuuuuacaugugcuuuaggagcuguagaaaauguauuuaaagaaaguaugggucuccgaugucaagaaaaguccugcugagcauuaguuaagcauaaaaaugaguucacuauguucuuucuuuuuuuaaguuacauuugucucucucucucucugucucucucugucucucucugucucucucugucucucucugucucucucucucucucucucucucucuguguguguguguguguguguguaugaaagugagaggacaacuuugggaguuguuuuuuucuuucuauuagaugagucccaaggauugaguucagguuggcaggcuugcaacaagugcccccucacugagccauuucagugguccauggcuuuuuuuuuuuuuuuuuaauuagguacuuuauucauucacaucuccaaugcuaucccaaaagucccccacaccccuccccaacucccccacccacccacucccacuucccagcccuggcguuccccuauacugaggcauauaaagucugcaugaccaaugggccucucuuuccacugaugaccgaccaggccaucuuuugauacauaugcagcuagagacacgagcucagggguuacugguuaguucauuuuguuguuccaaccauaggguugcagauccccucagcuccuuggguacuuucucuagcuccuccauugggggcccugugauccauccaaaagaugacugugagcauccacuucuguguuugccaggccccagcauaggcuuuuuuuuaaguauagaauuuuuuuuuuuaguucaaaguuuacuuuuguugaacaacuugaaaaauaauguauaucauuaaaagaauguuuucuuuuauaguuaaguuaagccaugaucaaagagaaaagauaaaagacauuuccagagaaugugcucugaaagccauugaacagaaaaaugcacuuucuucucaacggaaagauuuagaaaagggacagaggaaagauacaggccgacacagggguaaguuaaguacuuagagcauuaacuuuaaaagaaccgguaagaauccuauuuuaaaauggaguuuucuaguuuacuguguauauucacauauuacauuuuagauaucuauguguuucuaguaugauuucuugaauaccucuauauuaauguaaacaugaaacuuuucccguucuuauuuaauuguaauuuugagcuguagcucaguuacuauucuguugcugugaagacaccauuuccaggcuucucuugucagcuaaagcuccagaaucugcuuacagcuuuagugaguaaauccaugauugucauagcaggaagcauacaggcauggcgcuggagcaggagaugcgaggagcuuuauguccugauccauaggcagcagagagacagaaacugggccauucacagugacaccuucucagacuguuccacucacugggaaccaggaguucaaacauaguagccuaugggagccguucucacagaaacaaacacaagauacuagaguuuauguuuucauguuuuuauuucuauuuauguuacuuaacaaugcagcucccucauacaguacaauaaccaagaaggaaggcccuggggaauaacucauugguagaaggaacaccugcccacaagcguggucaaggcuuuugauuuuaugcuguuuucauggauauaacaacuuugcugcuguauuuuaaaugcugaguucagagguuugcuacagugauauccugucacauauaccguuguauauauuuugguguguaggugugacaugacauuccuaagauggacucugcuucaggguguauuuguaucugguuugaacagaugcccucugcugaccuucuggaagacugacaguaucuuacaacccaagugacagugugccucauucuugaacuuaguuugaaaaucuuuaccaacauggggaauauauuuaugauuuuuguuaauuauaagugagccaaacgcuuaauucuuuuacaaaagaaaucccuuuuaugaucuacuuuauaggucuuuauaaagcccaguuaacuuuauaucucucauuuguaaguaaacaauaaagcauuguuuuuguauaguugguuggguuuuugauacaagaucuuacuacauagcccaggcuggcuucaaacucaugaucuucuugcuucguuguuuuagcgucccaaaugcugcugugacagguaugcacuaccacaccuaacuucagauaaugcacuuuuuaauccuaagucaguuuaugauguauuguaauuuguauuauuuucaugugugucuuauguacuguuauuguuuuuuaagauuugguugaugaagucuuggcaucuuucaaguccggaucaccuccugccucggauggcuuuagacagcaagggaauccccaucucuaccacagccaaggcaaaggaccuuguaaacaugaccgagccacccaugagagcuacaccucuggaaaagugauaaguucaagcaaaucccagaaucuucuuguuccuggagagaaaacaaccggcaaagcuaagagugacaguggcacuggauaugaaacagacagcagccaagauucaagggacaaaggaggcagcuacaguaguaagacuaaaagccgccaccguggcuggaaacccaugagagaaacccuaaacgucgauagcguuuuuagugagagcgagaagaggcagcacaguccgaggcggaagucggauaucgguagcaggccuagguguagcaaggaccagaguuuuaauaacuggccaaaggcaaacccaaagcaaaaaggcuuaaugaccauauacgaagaugaaaugaagcaagaggcaggaagcagaaguucccuugaaacuaauggaaaaggagcagagaaaaaucuaagugcugcagagagcagagguccugguaccagcuggcagaugcaaaggacagagucuggguaugagagcagcgaucaugucaguaacggaucugccagcuuggacucuccugguguggagggaaguggggcagucauggaugucgguggugggaaagccuucagguaaaacacaaucaacaguuucucccucguuauucauaucucuguguguguguguaggggggggggugucuaccauguuugugggggugccuguggaggccugaagaagucagugggucccuuggagcuagaguuacagacugggaacugugggugcugggaagagcaagaaguauaaacugcugugccaucucuccagacccuucuuuuucuuuuucaaaauauguuuuucugcuuugaagcuguuauguaaaagcuggacugaacuuggcaaaugagacuucugcuuucuuaaacagcauuuguuggcucacacuaggugagcagucagccuccucaccgcguccuccgugcucaccacccauucucccuaguuauuugaaguaauuacagguguggguacaaugaauuguuagggagacaucaugaaauuagagugaagagaaagaccugguauauuacagcuuacuugagauuucauauuuucaacuuacauaguuauuuccuaacuccgaaauaaugacuguccgguuuuaugaaaauugaaaaacacuaaaguagagccauuauuuucauuauaucaauuugauuuuuaaagauacauuuguuuuuuauguaugaguguuuggcuuguaucucuggcaccacauuugugccuggugccuacuggggccagaaggguauugauccucgugagugacagacaguugugagcugccaugcacuugcugggaauugaacucucagguccugcagaagagcagccagugcucuucccugcugagcccccucuccaguccucagcugcucauuguuugcaacaggcuuuaaagugcugaccuaaauugguaucuuaguuuuaagcugauuguuaaauucuuccauuuauacauauauaauauaaguuaucaucucugacauuuguaucucaaaacuggaguuguuucuguuauuacaaaucaauucuauggaaggaaauauaaaaaaauuuuaaccaaauaaguguguggucaggugauuaauucugaauacauacuuucauuagugauguuggcaacggugcguuuggcuuucucggucaacucucaaacgucuugaccucaguggcguagccaauugcuuaacuuuuacuacuuuucucuggcuguaauuuucagaagcauacauaauuuuacuuagaacuugacaacguugauucacuuuuaaaaaucaggcuuauaagaucagcugcuuaugcucuauuaagauaaucgauuccaucaugaauuaaagggaccuucuuccuaguguuauaaauuucaugauacuuuuugaaauguaguagcacacauuauaaaaagaacaggacucuguaaagacauaaacuugcauuuuaaugauugggcagauuaaugugacuuacaaagcaguuuccagucauaagaagagugugacaacguucagguguuguaagcuagaaauuaaguaguauauauuaaggcacgucacuaguuguagcacuuuggaggcaaaggauugcggauuguaggccaccuugaacuauauaaaaaagcaaaacaacagaaaguguaugcagagcccuugcagcagcacauaagaacauuuuuaacaaguguauucccuucuuagaauaaacuaacauaauccacaauaacugauaugcuugguguguguuuuauuuuucagugaacauauuaagaugaacagccauaauauggacaguauggaguauauaucucaucauugcaaagaccacccagaagguagaaauugcacuuaaauaugcuuugaugguugccgcaaagagugaauuacaguaauuuauugugugcuguuaugauagaccuucuaucuuggucaguguuucuguuguuuauuuggcuuacacuucuguaucacuauucaucaucaaaacuggcaggaaccuggaggccugagcugaugcagaggucaaggaggggugcugcuugaccccucccuguggcugcucagacagcuucauuacagaucccagggccaccagcucaggaauggcacugcccacaaugugcugggcccucccccaucaaucacuaagaaaaugcuguacagcccugccuacaaccugauuuuauggaggccuccucuuaauugagguuuccucuucucaaaugacuuuagcuuaugccaaguugacauaagacuaaccagaacaccuuagaaaauccuauauggccaaaauaauuauuuugacuugagucaggugauuugugccugaaaucccagcacugaggaauuuaaguaagacacaaggauuguaugucaacggccauccaauagaguaagacaaaacaaauggagaaaugcagauaacauuuuaaauaacuuuguaauuccaaaugcauuuucuuuugguaugcaugugucauaauaacaggauaaagaaaucaaacuuuuaugccuacugucuagucaugugugcuuuucacauuuguuucacaauagugauuuuaguucaucacucugaggagcugaauagccuguuaaaauacacucuaaaauugacuugguguguauguaugugcacacagagaguucauaauggcagcagcuguaucauauucaaaagaugucuaaagguauauaguuagguuguuuauuugagauauuucugauuuuuuuacuaucaguacuuagagcuauaaacuuuaggacuaucauguaucccauggguuuuaguauauugugucuucauuuuucauucaauucuaggaauuuuucaguuuccuucuugauuucuuuuauguuccauucauucaauauugugcuguuuauuuuacaugaauuuguguauuuucuauaauuucucuugcuaucgauuuguagucuuacuaccuugugaucucagauaaaauauaaaagagauugcuuuacuuucucuguauuaaggcuugcuuuguauccuaguuuguaauuccauuuuggagaagguaucauggaugucuaagaagaguuuguguucuguagaauuuuggugggauguucugaagugucucuuuguuccauuugauaugugguguggcuuuauuaucugaugacuguaauggugaaagucugagauagugaagucaccaacuauuacugcaguaugauaaauuuguguuuuuauuaaagaagcauauguuuaaugaaauuuggugagccuguauuuggugcauuuagaauuguaauauccuaguugggcuguuucuuuacagauuuugaacugucuuuauaucuucugguuagauuuaacucugaagucuuuuuuuauagguauuugaauagggaugucugcuuuuucucaguccuauuuguuucuaaaaacucccacccuuuuaccuuaagacaauguaucuuugauggcagaguauauuucuuagaagcaacaaaaggaaggguucuguuuucuaauccuaucugcuagauucucucugugccuaggacauaaaaguguauguugauucuuuucuuucuguugauuuuguaggguuuuuuuuuuuuguuuguuuguuuguuggguugguugcuugguuuuuuuguuuugguuuggcuuugguuuugguccucuuguauaacuugucuuucuuugacuauguuucuuuccuuuuaaucuuuccuuucugucugaaaaauuccucacaguagccucuauuaggcuaguuauuuggucauaaguuacauuuagcuugccuuuguaaugcuaaauuuuccuuucuccuucauuuaggauagauaguuuuguuggguauauugacaguugugguuuuuaagaauuugaguugcguauuuuuccaagucuucaagcuuuuaagguuuccucugagaaguuagcaauuauuuugaugggcuugucuuaguaugucacuugauccuuuuugcauauagcuuauaaugugcuaacuuuguuuuguauauuuaguguuuuaacucugugacauggcuguuucuuuucuaguccaacuugguccuuauugcuugcagcuuuuaauguacuuucuuuguucuauaaauuuaguguuuuaacucuguagcauggguguuucuuuuauuauccugucuguaugauguuuuuguaucuggauaggcauuucucuuccaagauuugggaaaugaucuucugugauuuuuacugaaaacauuuccuauucuucuccuuccaugcccauaauucauuaauuugccuuucauaguguccuaaagauuuucccuaaguauauaucugugugauccuauuccucuccuuugccuucauguccugaaguucugucccccaugugaucccuucuauuggcagggcuuuucacugcacuuugacuugaccuauuguguuuuucauuucuaucaguuuguuuuuucuucaauauuucuauuuccuuuugacuucuauuuucauaaucuaaacugacuuccuucuuuuauccaguuuguguucuugaauauaugcauguucucuuuagcuuguuaugaacuuauuuugaauugugugucaggaacuuuaucuagaucauggguacuauacugugggaguugugacaguuuggauacgauauggaggaaagaaaggaggacaugagcaccaggaaacagaguggccugccacaguuacuauuucucuauaaauaaggaagagcuguagagaauacaugcuggauuuucugcugauucccugaccuugugggaugaccuaggguggagacugaagucucugcacucccuaaccucagauggcaaaccauaacugaggccagaguauagagaggcucccuacuuuaaauugugaaccaaaagugagaccaaagugccagagcauccccuuaucccaaauggaaaacccgagcuggcuccuuuccauaggggaagaccaugccugagacuuuuaaaggagugagaaaaggaaacaucaucagccgggauauacagguucuagguuacaguauuaguuagguuuaguguugcugugauauaccugauaaggcagcuugaguuaccugggcuuauagcuugagaguauuaaauaccuguuacacugugaccauugugcaccuugaggauggagaggggauauaccaugaaacagcaaaauccuuuauuauucucaccagguaagugguugcugauuaaucaggacaccagacagggauuccaaaagcuuguuucuucugacagcccucgacuaggggcugaagcaggguuuauacacauaaaacccaugagcaucugggccaaguuacaguuguaauuuucaccagucagcacuucgggauuagggacuuucccaaguguuccaucauugucaagugacugaauauaagugguugugcccaaccaaucaaaucuauugguucuuucuguuguuaggaauaggcauuauguuuugaggaaccauuguugcuuagagagggaguuggucagcuuagguaaaacggagucugaaguaaaaugucaguacuuagucacauuccuuugcuuauucccaacaagcuccgcguggccagaauagcaugaccgugagaacuggagguagcugagucacacugcaucugcaguuaggaagcagggaaagaugaaugcucauacugagaccagggcugcagucuguggacugugcugccacaguuagcacgugucuucccaccucaguucagcaaccuucauguucaugucuagagaugaauuuccuaagugacucuuaacauauuaacugucauacuuacaagugguaauaucuucaagauuucagugucuugucacagucuauaccuuauucauacauguguacugagggucagcacaggguaucuuccuaggugccagugucucacagaagcaguguaguuguaggaaugaaaagaccauacaacacagaaucaucucugggcucuucaaacauuacacuagaaguggcacuucuagugccacuagaaguuggacuuauacccaccguccauggcaaugcuucaagcaauccuaguuuuaaggauggcaacaugaguuuucuaagugcuggaacugaacuaaguauguauaauaacugcaacaaugccagggacagugggagaguguggguuuacggaugccuguguaauagcuacaaugauaccauagguguuaagaaagauuaacaagugaucauuagaaaagcuuuaguuuggaaauuaugcagugauauggcauuguuacaggugauaugcuaaaaauauauaguagcuuguaagccaaacaaacaugagcgcuuguggugggagaagaggggcugugcuguuaaaauaaaggaaacuguucugaaguuuuagaacucaaagaaaggagguguaaauuuucacagugagcagccacaaaccaauuauaaaacauuuuaguccuuguuuguguuuguggagauuauuuuucagguuacaagccuugaaaaugauuauuugcuaauuuauuuuguuuucaucaaauguaugcuaucaggaggaaacacuauauuaaggaaauaacuuuccuuucccauaucaaaaugccuggcuuguuuuaaaagucugauaaaagucuaaguaaccaaguauuacaggaaacaguaaaaggcuggccagaaaucacagcaggacucagugaaaggaacaauuccugcaaguucaguaaaugcuccuugcuuccugauggcuacaaaacacaggccauagagaguuugaugaugaaaacuccauuguuuugcagugaguuuacacauuucauaugugugaguguguguuguugcacuacacacucacuuuuauuucaguaaagaacucuuuaaaaagcucaacauuguaauuguuuuuaugucauuaaguacuuuuacacuguacaauugucaccaccauccaucucccaaaugaccuuaucaagaccccaacucuacaggcuccccuccacccccaagaaacuggcagcuaucauuuugguuugguugguuuguuuugucaucaguuuggcuguucauggugccucguuuaaguaggcuuguguuuauccuuucauaaugaccacaaggguuaaccauguuguaacacauaaauaugucugucauuuuuucuuuuauuuuugagauaauaauauaauuacaucauuuuccguuucccuucccucccuccaggcccucacauguauccuuccuugcucucuuucaaauucauggaagcuuuuuuuuuuucauuaauugcuguuacaaaaauauauguguguacauauguguguuuuguauauguacauacauauauauucuuaaauacauauaauuuguugagccuagauuguuauuuguacauuuucagauauuaacauuugauauuggauaaccagcuaguguguuccucucuggacaagacuguuucuccugcucucaauauuccauaguugccugcgauucuuuguguagggcugaguacucccaaaccuuccccuauccaggauagcauucuauuguuauuuuguaaggacuucauuuucuuauagcuaauccauuccucucuuggugggcauuugagcuguugcuacacuuuagcuauugugaacacuguuacugugaacauugguuugcaaguguauguuccagucuuccuuaccaguguuuuagugccuauccaaaggacaauugccaaauccuccugugguagcucauuuucucucuucucuucucuucucuccccuccccuccucuccucuuuuuuccccuccccuccccuccccucuuccucccucccuuccuuccuuccuuucuucuuuuucuuuuuuuaaacuuauuuuuguggaugccguuuguguuucugugaaugucugccacgugugugggugcccagugagaccaguagaggccuuaacuuuguauuccuagagguauuauguagccuuaccuccauaugauaaguucugcaaaugcaaggguauucuugaaguugccauagugguauuugaaauuuuuagcuucaguuuaaaaauaaauuccuugugggauuuuaaauucuuucgaauacaauaaaagaaauacauuaaaagcauguugucaaaaauaaucauacacaaagaacauauuugauauaugcaaagcuggaaugguauagauguggcagucaugagauaauuguaauaagaaauaauagaacauaaaucauggugcagcuuugcuuucuuugguagauggguagaaggugaauuuugagcacugagaaaauuauuuggucauaaacuaaggcaguaccagugucuagaaagaugacuuaaguggguaggcauacauaauagagaaaaggaaggaagccauauuugggcacaaguagaugcaccacuuaacaaaaugggaaaauaaagggugaauggaagaagggauaacauguuaauuuuuaauucauugagcucaucaccuugauaaaugggcuuuauuuuucagugaagaacgaaguuuagaaacaagaaaaaaauguguguuuuguagccaucacuuauaggauugacuaccuuauguuugaacagaauauccaguaaaauuguaaguggcaaaauaagaauagauggaagcaaagaagcuggguaagagaacggugggagucgcaggcagagcaggagcaacugcuggaggucuggagucucggcaccugagaaggcagaggagaaagcagcagaggagcuagagggcuggggagcuucaaggaaggccacagacaaaacagagccuaaaaguaccagcuugggucugcaacaagucaccaguuagugauaaggaaguguuggcgacugugguacuguggagguagcagugaguuauguagaaauaaacaaccacucuguauauaacuuauuuucaagugucuaaaggagggggauuuaauguuugauuauuuagcggauguuuggguaagcuuuguaucucucuuaguuuuuaaaauuuuuucugaacuuucugaaauauaauuuguacauuuuuaaaaacuaaacuuguacuauuggaauuguuuuauaauaaauaaaaauaucuguuuuuuucuuuaaaauguaaucccagugaaaaaggaaguuacugauuccugucaguuuauaacaucacaaaauuuagguaucguagcacagauuacuguauacuaaguuccuuuugguauaugggaaaaauauuuuuagacaguuaguguuuaauaauauuucugaaauaauuuaauauuguuuuauuuguaaauuaagucagugguuagauuccuguucuugaaugcuuagcauuuguaauuauaaguugaaauaagucuguaaguugaaaacuauaauaauuaccauuauauauuuaaaucucacuacaauaaugagugaaaauugcacagucuaggcagauuuaaguuauauuucucugugagccuguucugaaaaugaaccauguuuucagauaaggcauauauuucaacuucuugaauauuguguuacggaguuuuuacaaaaucaaaauuaaccuuaguuaauuuguuugccuuaauauugaggucucuacuaugccaaguguuaaaaucggacuaucagauuuacaaagaacauggagccagaauucccugcaagacauguggaugucuaugucagcagcagagaaaaauaacacaccuauuuuuaaguuaguuggaauucugaagucagaccaguggguugaaugccagccauggugauauuaaauucucaaacauauuuauaaacccucugcugccuccugcugcuuagugugugaauaguuagugcaaggagagaauugaggcuuuaaaguaauuaauuuuugucuugaaaaauguuuauguuuacaaacuauauuuguauuuauuggguacgaagugaaaugaauuuuuaaucaauaugaaaguauuaaaucaugcuaaucuauagcuuuaaaauucuaaaucauuucuaaaauuuaacuuucugaucauauugauuuuuuuuuuuucuuuagaguaacaguuuucuuaauuguaguuuccaguugaauuuugaaagaucaggauuguuuguuuuuaauauaacaaaacgaucuauuuagggauaaaaaaaggcgccuaaguuaaaguaacucgguuuauaaccgucauuuuucuguuuucauuuguuuucuuuguaggcuucaauucauagaucugauguucagauaaauuuagaaccaggggaauaaagggaaacagauaaaauggcugaugaaaaagucagcuaaaguacaaaaggaagcaaaaauuuucaauuguacaauguauugguaacucuuaaguauuuggguauuuuuccuuggcauuaacuuguuaaagaauaucguuaugugguauguacuggugggcuauguuuaggcugcaggggcaggaaggucaugaauucuaggccugccugaacugcaccuaaaaaaacguagguagacagacagacagacagacagaucaaugaugucaucugcuguuuaaacuaauggcuuuguuucaucugcaugacaggugguuagggcuuguauguuaauaguacgugcaaaugcaagcugagagaugccuuucagcuaaccuuggauaagcuagcauugguuacguuuccuaacuucccacaaccugcuuccucaaguuugaaagggaaauugauuuugcaaaauacuuaaggcugacauuuuaaaaaaaacgaacacuauugcuaguuaacuggaguuggcagucaacauuucaaaggaauugugggaaauguauuuuggaacaucuuuauacccuuagaaaaggauugaucugcaacgggguuuuguuucugaggauuauaucagcauuuccuaugcuggugguagagaaaaauuauuuuuaaauauuuauucacuuagagaaaaaucuaaugcauggugacauaaacaaaacuucuuugggguagaaauccaaagucuugaaagaauaguaaaggcaaaccuagguaaugggaugagggauguucgauuuuaaacauugcuuccagaacagauagugaaaggaguaagggguugaaaugccuggcugcaucuuaaugguuuguguucagacugucauguuaauggucuuuucauaucuugcuugacacagauagcaguuggaaaaugucagaauuuguuuguucuaaaaauaaccagcacuucuuugacccuacacacauaugugauaguuucuccaaauauaauugcaauauaaaauaugacuuaggcauaaauuuuuugcaaccuauuuuuauuaaggguucaaccucuccucuagcccaccacccagcagagguagugcaagagaaaagauauucggaugugggggaaguggaccuguucagcaauaguucuuuagggggugaccuccaucuucuuuggcagcugcuaccuuguauacgguauaauauucgcuucuagauacuaaauauuuuuuaaaaaggaaaaugugauuugggauuuuaaauucacaauguuacuuaggaauaacaaguuggauuguaaaguuauuuuucacaagccuuuaacauucaaaaaaccuugauucuaucauuguuagaauugaggguaaauuaagucccacaggacacaguaugagucaugguaaaggugagcaugacuugggcauggucggugguagagcacuuacguaauuauuguguagaaggcccucauucuguccccagcacuggagaggagaagcacagggccugacuuacacagaucuggcuuugcaucugcuaccuaaguaaucaggaagucguguagugccucagacccucugggucccuugucugcguagaacguagaacgggucucugguugcagauggacaaggagucggcgaaugaauggcagacagacgcaacacaggagauuguguagaaucugaauguaauuugucaagucgagcaucgaacuuuuuauacagaagaauaacaagaaaccaggcgagauacauccuccgaguuauuacagugacacaaaacauaaggaauguauacaucaaaagaaggcgggaaccaggccucugccucuaagaagggagccagguguaaugccagucuauuguuaagcccaccaccagggguucuuaguaaaugccugauuuaugcuguuucuuugggccuagugaagaaacacgucucagggggauucccuaacucuuucaugguaaacucaccuauucgcuaggccauugugaauuuccuugucuggguaagacuggcuauugucccaaguaaacacucugcagaccagcccagagcuauuccugcucuuuucuuuguaaugccuaauuaguuucacccucucuacuagaaguaaauuugaauguuacugaauagauaaccuucuuacuaaauuccuacuuaauuccaaguuuguaggcuucaaggauuuucuuaggacauuggaacacuggugaaggcuuagcuaugucagaaugcaaucuuuaaaggcacuuauaauaaaauaauacuaaaagagagcacguggauccauacaccagaguaacucggggauaggguaugaguauacagguuaugagaacgccaagguuccaggagguugaguuuccaugaaacucuuugccucgugagugcuuccaggccucucggccugccaagcaggcuucacuggagugugcauaucaguguagccuugccaagucuguuuccauacaaagauaauaauuucuuaauaagauuggugcacaucccuugauaaauagaagcugucuucugugcugcuauaccaucccauuauuuaacucaauugaugucauuaaacauuccugugagguagguaaaauggauucuuaccucggcucauagaggaggcagguguacaugguuaagaggccugcuuaaaguuaccacgucuucaggugcaggauuuucccacuguaacauuuccucaguaaugcuuaugcaggagggagguacacauggcccagaacaacagaccuguucugggacugaugacccucagaacgaggaacgagugcaauagaguguauaagaucauuuaaaaauuuuuguuuuccuucucuguuuuccccaggcuuuaggaaagaacuccaggacuuggaagcagaugauaaaauucaugagcuccacccagaaucacaugugcaaauaaaaagccauuugauaaaaagguaaucauagauauuuagaaauaggaaauuuucaguuccuaaauucauauaaugggagcucuugcagaagggaguagauguguauuuucaaucugaaagcauuacaaugcugauuuuauugggauuauuucauaacauguagaccuaagggcaaagaaaugccugcaaacuauuugguacaguaguugacuacuuuauuauacucucauacacagcuggcauacagaagugcugauaucuuuuccuuauacuuaccuacagaugccuaaugccuguuccaccuuaacuacccaguugucuacccuggaacacucacuuuuucaguuugagguguaaacaaaaccagcacaacuuuaauuuuucuucuucauggucucggguucuuacuguucuccaauuucccugagucuagaacuuaaaggaacuuuuuaaagcacuuccuuuauggcuggcagaguugacaucaucagucacuauggacuaggugaccacaagcaugggauaggccacaacagcaaccuauguaauagccuauaggugcguggguaggacucagacagccuaucgggagugcuauucagaggucuguacagcugaaaacugaacuaaugaucgcacaaguuuucacugagugguuugcacugcaguugacauuggguaacuaaaaccccuacuguggagggccuaguauaaaaacaaucugcaguuuugauggugaugugagaagcuauggagcugggauuccaucauaguugugucugcugagccaugccacacugcuguuucaguuccaaauaacuaaggaaaaaucgcuuuacuacagagaaaauaauuuaauuauuccucuuacuaccucaagucagucuugauuaagauuaggacacugucucauguuauauauuagaauuuaaguauuucuacugccuauaaacauuguaaucuugguaggaaauguuuuaagccauugaauuguuugcuuuucuaacaauucccuuaaauuguauauuuuaucauaaauaaauguaauuucaguguuuuaaauuucuaauuauuaggaaugugauuuggggacuggauauauaguggcaugguagagcgcaugauuagcguggacaggcccuggguucagccucuugcugccacugcuauccgucguacagugaagauacugauucuuaaagugauggauguuucuggcaggcauguauguacuauccuggcauauagauucagggucagagagaauugaaaauguuaacagcuacaaaguaguccccauuucuacugcuaugcuguaaaaauauaaaccauaauugggaaauuaaaaugacaagacaaauacuuaguuuccucugugguuauuuggcuuuuauuuuuauuuuuaaauuccaggucacagauuggugaaaccaaugacaaguuguuuccuucagccagcccacaaacacuugcaagagagcauguuuaccagacaaaugaacacaaaguagaaagaccagauaggagcaaauguucagagaggcauaauacagaaaacucugagggaacaggcuugccauuucacguugaugagaguucuguggcugggaagagagucgacaguaacgaaacagucucgccaucuucacugccuucaucugugagaacugcugggcuaaagcccgaaacuggaccccucauguuuuggucacagcaaaauaucacagaacaggguuacucugacaacucucuguccagagaacuuacacuucugucugccugcaaugcugauaguugucagaugccaaaacuccacugccaccguucaccacccccuuugccaccaaagaaauacucuacagccagugcaccaagguuagagagaguuggacuuagcccugaugucgggguuaccgaggcguuuaacacuaaucccuccagccuuccaaaacacagcuugaguccagccucaggaccaaguuuagaagggaguccaugcaugacccaggaaagagauaaagaaacuauucaagugaagcaacuugcugccaacagcuacccguccaguuguucaacuaacaguuuucagccagaucaagacucuacuucuguguguccaaaugaaacaauuucauuaacuaccuauuucucaguugauaguugcaugacugauaccuacagauugaaauaccaucaaagaccuaagcucuauuuuccagagagcaguggccaucauaguaauaauucacucucucaaacugagcaaguagagggauccauuacauaauggucaucuuucgucaacuguccuucugaacaaagaccuuuauccauguaagauaaaugaaccagccauuaaaaauaccaacugauaaaaucuaacuguauaaaauaaaaaucaggauaacauauuuuaugauaaacuuacuaaauauuuuagaaauuuccuuugugugaucuuggcgugccuugaaaaauaaggaagucuauaauuacuuugcuauauaacaguuaaguaagcaccgugucuccuauuugguuaguaaauguguaacuauuguacuuccaguauucauauguaggcugguguauuuugcuaauuaagaaauacaaagugucuaggaaagcaauauuugcuuuugcagagcacuuucuaguggguaaccaaagauggcuauacccacaugcuuuugacuucugugauagucuaauacaugugauccuucaagugucuuaaaaauacccauggauuuacgugaucaucuggaaagccuuugccuuaaugaugaacaauuuuuaauaaucucaaagucauauaaaauuuacuuuauuccuagaacuuuucagaauaucuauuuaucuuuauaacuuguaucuaaaaauauuucagucauguaaguuaaaaauaaaaauuugguaguauauuauuuauuaaauuauuuucuagcuuuauaugaaaugugaaaggucuucccucugguuuaauuuacuuuaggcugcuaauaaccaauguuacaaguuaacauugggccucuuauugggauggucacugcugcuuugaucacuuaaagauugcuagauugucagagcuuuuacuauugaggcuuccagguuaaauuucugccuuuauauaaagguuuauuccuaaugaaauguccuuuuauuuauuuuuuucacuuaaacagugauuuuuguauccacaaccaucauggaguagaguuuauuuauuuaauauuuuucauuauuuugaaaguaagcugaauugccuuauuaguuuugauuuuauuuuguaacaggcugaaaaacuaacuaguuguagaauaguuucaaaaugacuacuccagagaauugaaagcuacaaaauuaguugucuuuaucaucucucuaaauggaggagacucacaaucauuacuuuaaaacuuguaacuugacgagucccacaaauuaguaaaacccaaacccaacauuuguuuaagaaaaagcacuuuuagcuaaacugaacauugcuuauaaaaguguugucaauucuuagccaaacccuguuuuuguucuuuuccagcauaauugaugaucauuacuuucuauucucuuaaggaacacuugaauauaaaauuaaaauucauccuuaaagauuauuuuuaacagcuuuuaguacggagaguuuguaaauaguguaaacuuuguaaauuguauugaguuaucaguguugauaauucuugcuuuuauaacauuguaaaauacuagcaaagaucuuguuauuuuuaauaguuuuuaaaagauuuuuaaguuuaaaaaaaaauuccuauuuggucuauauucccuguugggaauguaucauuugaaacacuaacuaauuucuguauuuuacagcaguuucauagauguaccuuuucaacucaguggaguuugcaaagagaaaugucauuucuccuuuuaauugaugcacuucucaguuauguaagacugacugaaauagaaacugaucauuuguugauucaacacagaauagauucaguauguauuggcuaauuaauuauauguauuucuuuucuggugccuguuuuuaaccaauguuucuguguuaaaagcuuguaacuucuuaaauaauguaaucauguuucaaauaguuaucuucagaauguuauauuuucaugugaaaucaauuucuuuuggcucaaaacaaugagagaaacucaauuuuaagcaguauagcuggucuuuucuuugcauuuaugaacugugguccccuucuccacauuacucaauuuaugggaaacauuuuaaaaaaaaaauuaaagcucacaaauauuagccuaggauguuccugagauuuacaucccggagucagaaccauagcucuuggcagccacucuauagagggcaagacgucaaugguuugacuguggacaggcgaucccuggaacagaguuauggauugaaaacagccauaagcaaauuguaauggguguuagggcuguuuuucuuuucuuuuuaaaauaaacaucaauacuauuuauuaugga

SEQ ID NO: 1698 - RNA, 29054 nt, Mus musculus
agcacuaagaagauagccaaaagcggcuccucgcccucaaccaccacuacauccccauugggucucgucgugugacaucauaucuucggcguccuggaggcgggacuuccuguucaggcauagccuguuucaggcgcgccggaaacuuccuccugagggacgugaaagucuccgggucagaaucucugcggggcgggacccgguguuuccugguuuggcagguggauuugcauuuuggcgggcgcggagucugucgggguggugagcagccgaagcuggggcauggauagccgccugcaggagauccgggagcggcagaaguuacggcggcagcuccuagcucagcaggugugcggcgggugggagggagcauuagugcgcgugcgcggccgccucuuuuaaaaaaaauuuuuuuuuuuuuuuuuuuuuuuuuuuuuuggugaacucucacaucagcaucugucaaggucuuugucccgggacuuuuauucccuagucuacucgagugccugucagagucauuacguagaaaaccaaccgcugccaggcuugggcuuucuguccccaccguggcgggcacggacuugagugguggggguagacuugggaauugucgaugagugcagugcuaguaguugcuacaagagcaaguggcaguuuuagcccuuacauuucaccgucacuguugaagcaguguuucaugucuugccuuucucccgcgucagcuucagauucuuuauuuuuuuuaagauuaguuuuuauuuuaaauuaugugggguuugucucucuguguguauauauauaugugcacgugagcacagcgccagagguguuggaucuuucuggagcuggaacuacagguaguugugagccuccuggugugggugcuugggacuugaacucagguccuuuggaagagcagugcauguucuuaaucuuuucuugauauugguuuugaaggaaguuugauuauuuucuugagauccugucgaaagacucauuggaagccaccuaaguuagagcaaauuuuagauucugcacuuagaacacagucuaccuucaaccaaacguuugaauccuuacuugguaauuuauuagagacaggagguguuacguucacuaguacauuaggacuagguuuccaaauuuuaacguuuuucccuagccagcccucaccagagaauucucuaagauuccucucucuagagauuacuuuucaaaccuuucgcuuucauugaagcuagugaaugaagaugugagugcuugccguuuaguagaccauucaugcagggaauacauacuacaaguuguuuuacuuaaaaaucucaggcuguuuucauuacaccauacaaaucaauauaaguaauggagggaaaugcucaaagcuugagugaguaaauuuuagauuuccaaugagucuuucucgccaggaucucaagaaaauaauacaaacuuccuucgacaccagucucgagaaugugaaggugggcuagagagagagguggcucagugguuaagguagagcgcugucauuucucauugcuaaaucuuggguuccucaaagaacuuucugaaggaaugacucguauucugagaugagaauuacaaauagagaaucagacaaugcucuaacuaucggaagugaguguucuguccucugaccaagaagucgagaagauuuuucuggaggaggugaaccugaugagcauuucauuauuggaagagaguuuucacugaagaaaugagggcggccaugugaaguggugcagaguauuuuguuguuuaugccgcuaacuggcagcacugauauuuugaauaccugcuugcucuggggcuaaagcgaccacuaacugcagauuuucuuaugccguguuuguaccuaauacugcagcguuccuccuguguccucagucugacuuggaagguuuucugugaaucggcucuauucagcucagccuuugucuacauuuauugcauucgacagaauuccuccagcggccacuuacaguugacauuacuggguuuaagcuguuaguagauuuuauuaaaagcuuagcuuuaaugaagcugagugcaucucugugagagcaggagauacauguaguacauaaagugguucacaugaagggcuuugcuuucuguguuacugcuucugaugccaacuuguauuucauucaccauuggcgacagggaaucauccuaauuucaaauuuaaccaaaugcguaaaauacuuuccgucugacaaagucauucuuaauuaaaaugauuuucuuaccauucacuuagaguugaucuugcaagccuauugauagugugcuaagggugguguugcuuuuauaaaauacuugauuuguugaaauuagcaacacauuuugggcgugugaacaaugcguugugaccuaacuuuggguucuugcuuccuaguugggagcugagagugcggauagcauuggugcuguguuaaauagcaaagaugaacagagggagauugcugaaaccagagaaaccugcagguaugcggaguaaccuugcuaguguguguucauggugggaaaggaucauuuguuucaguuucuguugugacuuaugggggagcuucgggggaaugagacagucaugcuauguagcccauguuggccucaaacuuggagcaccucugccugaaccucuugagaacugaaaucucccauaaaggguugauuuuuaauaagcaauuguagauugaguguguucuuaagaaaacugaaaauggaaauuucggaaacaguuuuaaugucagguugaaauuaugaaauauuuucugaaaacacugggcuccuauuuauaaaguggguggaagugaaguguuacacuaagaauuagcuuacauaucauaaauaaugucgaaucauaauuuuaagaaaauauacuucaaaaguaguauuuaucugauaauucaaaaaacauuucauaauuuuaauuuucuagauuaccaguuguaucaguuuagcuaguauaaaauauauguaaacuaguauaaaugauacauaguuucagaguuucuuucauaauacagucuucauacuugcuuauuuccucacuugucugcuugcuuauaaauaaagcuacagauuauugccucugacucuuggcuguguuguaagcugaguaaauagauacuuaaucaggaaacauuuggcuuuguuucuauaacuuguuaauaauacaggcagacccauguacaccuuuuguauucucuggugagauagcugcaguuuaauuuucagggcuuccuaugauacaucugcuccaaacucaaaacggaagugucuggaugaaggagagacugaugaagacaaaguagaagaauauaaggcaaguggaaaugagauaguuuuacgcauggcugagaaaaaaaaauuaaucauucuaauagauuaaucucauuuagagggcuggauguuaagaugugcuaaaauccuuaugaguaacguuuauguuuucaguuaaagaccuguaucaguuugcucauuuuauguaaguguaugugacuuacauaugauuauuuauauaaaacacaguauagcuauuaguaaauauuggcaauaauacucuuucagaacaucaaaaagauacauauauuauaaacuuuagguaguagaauuguaguagauuuugggaggcugcaacagucacuuuugagugacauuguucuauuaacagcacaagauaguauaauuaaaguauuuugacagcucaugggcuccacagcaguuguauaaccauuuccaaaagaacccaagcuaaacuugacuuuuaaaaauagaaucuuguauuaauucuuuagaacccagagucuaaugugugcugcccauagacaguguguagcuauucacugggucaggguuaucuaccaggaaccauaucccuaaagagaggguccucccuaacaaagcagcacucagcucuuaauaguuccucagcuagggauagggggacucaggagcccuuuccccuaccuucuacgguggagugcuguguagcuugaucuuuuguaagccaccagaauuguuguaaguucauggauauagcagucuugucauguccggaagauacugauucaucuagacccuccacaaccucucucucuuacaggcuuguuaccccucuccccuuuucuccuauguucccuaagccuugggggcaggcuguaauauagauguccauuuaugacugaguauuccacguaauauagauguccauuuaugacugaguauuccacggacacuacacuuagaucaguugagucuguauuaacugccauuaacuacacaaagaaguuucuuuaaugauagugagagcuacacuaaucuaugaggguagaaauaaccuauuuagagggcaguuugauacgguguccacuuggcucaucugugggguuuaugagcuccccagacauuaagucauggucagauuuacaguagcagacuuucauuuccucuuguggaguaggccacaagaaauuucagucagaaauugguuguuuacccucauaauagucaugccaugauugcaccacaugcauaccuagccaggccauguuacaugaugagguucacagcuguauaaagguuuugguguguuuucuuucccugcagcugagaguucuacaucuucaucugaaggcugcuagcagaacacugguuuucaggcagccagggugagggucuuaagcccacacccacagugacacaacuacuccaacaaggccacaguuacuccaauagggccacaucuucuaaaagugccacuuccuaggccgagcauguacaaaccaucacaccguauaaccccuucccagcgcccuacccacuuagcaaaaccuaaguuugguuuccaacacccaucuauauguacagcacucauguguucauaucaugagcucuugcagagugccugaauucaguucuccucacccacauggugccugacaaccaucugugacuccaguuccaggggauccgaggccgccugcugaccucugagggcaaagcacugauacccacaaaauaaacaagucacaauguuaauauaaacauaucugaggggauuaaagcacacuuaaggugcaguaauuuaauauauauacauaaauguauauguaaaauauaaaauauauaaacaagaauauguauaugguguguguguguguguguguguguguacguacauauacacgcacacacauauaaaacauauauauccugaaacuugcucuguagaccaggcuagccuugaacucagccaucugucuccccugccuccuggugcuggcauuagagaagcaccagcaugccuaagugcguguauuuuacaucuuuucuugaucuuccuuuucaaggaugaacuggaaaugcagcaggaggaagagaauuugccauaugaagaagagauuuacaaagauuccaguaccuuucuuaagguaaaauaaagaguuuucaggucuuagagcuuucacauuugagcucugugcuguaaaggaccucauuuucuuuaggaguuuuucaguuuuugagagauccauguaugaaagcaaagaucuuaaauuacucauaaaauauucuucugauuauuuggauauuuagcuuauaauaaugguguauucaugucaauaucuguugauaauguuuuuuuuaauguuauuuuuaguguuuucaaauauuagugcuuuuuuuuauuucauacuuuguacagcuucauaacaaagucagugucuaucauaagaguacauacugcuuauuuaauuuugaccauuucuuuagggaacgcagagcuuaaauccccauaaugauuacugccaacauuuuguagacacuggacacagaccucagaauuucaucagggauguagguaugucagcuuuauuuggacuauccugcugucaaguguugcuacaugcaugugauuuacgcaguuuguagauuauuuauaaccaaaccuuuuucaggcuggacuuucacccuugggucucaauguuucuagucuaccucccuugccuuuaagcaaugcuaugccucucuguacguuuuuaaacauaauuuauauaccuuauaauuaacccauuaaaagaauauaauucaguguucuuugaaugcauacagagccuucuuagcaaucauuagcagucuguuuuagaacguuugcuucucaaagggagcucuguacccauuagcagugggaccacauuccuuccucuaaccugccccucccucgggcguaaccaugaaucuguuuucuuucuuuguaugucuggccauccuggacauuucauguaauugaacucauauauaacaggaggcuuuuugugauggcuucuuuagcacaguguuuucaaggguuguuaauacuguagcauauucaauacaucuuuucauucucaaauaauagaccaugugaaagugaauauauacacauauacauggguuuuauuuaaucacuuagguuugugguuauagauuuuguuguaggcacccauguaugacauguacucauuuuucuuugacaaacaccaggggguggaauugaugggucauguaauucucuaaaguguguugauucuguguuugacuuuuggcaguaccacugccacaccauuucgcuucccuaagaguaaaguaugcagauucaagucucuccaccuucuguguugcugugcaugguuuuuaccauagccuuucgagugaaugcuaaguauggcaguguagauuugguuuuuguuuuguuuuggugguguuguuuguuguguuguuguugugauuuuuuuuuuuuuuuuuuuuuuuaguuuuauggacaggaguguuuggugcauuuguguauuuacuuguaugccuggugccauugaaggccagaagagggcuucaggcccccuguacuggagucauaauugguuauggaugugagccgccauaugggggcugggaccacaugcuuccucuacaagaguagcaaguguucuuaaccacugagccaucucuccagcccccuguguuuuuaaaauacaguuuuauuugagaacuucaguuaugagcacuguauauacaccccucaagcuccuccuguaacccccauucauguucucuuuagucauuguuauaaguauaugcguguguagucauuuaguguugccuuuacgugcuugugaccagagcuaagcacauaagugguagcucacuucuagaggaaacuaauucuuucugucucaggcacggguaccaaguaccgaguagacucucccauguccacgucagcuuguauugucauuaugcuagucuuguucaggcagccagaguguugagauuuuccaggugcaccuuucccuauugccuaacaguaggugaacagccuggucaggugugcugacccucuggcuguccaugauuuuuuuuggaguuggagccuuagauguaaugguuguauuguagauauauccauuggaguugggcaccccuuaguccccucuucucugccauuugaccaguuguagaucucugucauagucuccauuuguuuaaaaaaaaguucguuugauaugggggugaaagccacucuuaccugugaguauaggauaguuuagaauacagcuagaaauuauauuaguuuaggaaaaugacaauaccccuggucacaguaguugauuagguuuacaguacuaggcaagcaagaauucccuccuagcaagaaggccuuaaguccaacuagauggcuguucauuauucccugcaugucaggucaucacuguaccacugggaaguuguugucagccagucauuguugugguucagaggcuuuaaggcuggguagcacugcucuuugcuccucucucucggcaggcagcuugaauagcaccuuugaggacagggaggaagcguccagcucagguccagcucagguccagcuugaugcucccaaguccuguguccugaguggguggugucaguaaggucuuaacuguagauagguggguacacaggaucugcuugugcuuguuuuuugucuuaguuugauuugauuugguuuuggcuuuuaagauagucuuacuguauagcucaaguuagccuaaaaacuuuguccuaaagugaacauccuuuugccuuagccugucaggaccaaugauuauaagucucugccaucaggcccauauucuauugagguuuugauuuauauuuucuugacaauaagcuuagcauccuauagacauauuggcccacuuaaauaucuucuaagaaauaacugccgggugugguggcacacgccuuuaaucccagcacucgggaggcagaggcaggcggguuucugaguucgaggccagccuggucuacaaagugaguuccaggacagccagggcuauacagagaaacccugucucaaaaaaaaaaaaaaaaaaaagaaauaaccaaauaguuugcuuauauuguaccuuuuuucucuuacugaauuuaaaaagcuguuuguauuuuuuguacacacacacgauuuauaaauauuaucucucauucugcuaauuaucuuuuuagauucuuaauagugucauuguagcacaaaaauuuaaaugugauacaauuaaauuuugucaucuguaagcauuaucacuccugaagaaugaauuuaagugugauuuuuaauguacuguuuuucuuaguacuagggcgugaacacagggcccuuguguaugcuaagcaagugucaagcccuauuuuauuuuauuuuaucauuugcaacagggucuauguauguugccuagacugacagugaacuugcuauguggcccaggcaagccuccaacuuaugauccuuugguuucagccuguucaguggcugggauuacacaaauaaaccaccacaccaggcucugauuuuaauguuuuuauaaguagaauaagagauagcauuaaaaaguuaggauauauuacauacuuauauuugaauauaaacucauuucuuaagauaccuguuuuuucccaagauaaauaaguauauauauguaaaauuauuauaaauugagaacagguuguauugauguauugugaguuaaauggagauuugaauuaacuauaaugccuuauguuguagcagcaaaaaaaaucaaauacaaaacaaaaaaaaguuacugaauacuuuuuaugguaacaugauaaaaaguucugguuuuuccaagaucuuaaugcuaaggaacaaggcugauuguaaauucccauguaccaaacaguaugccacagaucuguucaucagaucaucagggaagauagacuucaggacugcaguucuaccuucuguuuuguagaugauaagagauugacgguuauauucaaaccugacagcucugcagccuucaaauguuuuuauuuuaaaugugaucuaaaucaccacuugagggggcuuuaugauuuguuucuauuuuuacucuuccuguuaacggcuuugagcuuuucaaaguauauuuauuauuuuuaauucgguguauaugccugaguguguucacaugggugcaugugcccucagaggccagaagagggugucagauccucuggaccuggaguuacaggaagucaugagccauacgaugugagugcugagaaccaaacuuggguccuuuggaagagcagcagugggcucuuacagcugauccgucuccccugcucccauacuuuuaguuuuuaaguuaagguauuuauaucauuuaucuucuuaucaguguuuguuauguguggaaagcaaguaaaagugaacuacuaauucuaauuuaaagugauggcaaaggagacucauagcuuuguguucauuaguguuaaccucaguugaacuaaaguugagaauugacuauuuuuuccuccuuagguuuagcugacagauuugaagaauacccuaaacuuagggaacucaucagacuaaaggaugaguuaauagcuaagucaaacacuccucccauguaaguaguucagugccuuuucuuuccaacucugacuuacaugaucagucucuuuacgcuguuauuuuauucuuucuuauuuuuaguaaaauacauuauuuuggaacuggugcuaagucuauaguggcuugucauugaacuuucuagguaguuuaggagguuugugaauucugacgcacagucuauaaaguagagaugcccucuucuggggcuggggguucuugaaacagccuugcaaaugccugggacugggaacacuugaaacugccuugcaaacgccugucucauggugcuuugcuauacgugucuugcauuuuucuucagcguuagggagucacuauacuuccugggcacucaguagagcuugcugggggcaagucuggugcucucccugugagcuggaugacaggaaaauucuugccuucagagaugacgaugacuucauuauagccugugacuuuucaguuuaagcauuaaaagcccccaagccuuaaaaacaaaagaaaaaaguaucuuggauugguucuggugagauagccggcugugagaaagcuucuuguccagggcugcaugccugaugauaugaguucaaagcccacagccuggauagagguggaaggagagagcucacugcacaaaguugcucucugaccaccacaugcauaucauggccuguacaccacccaguaauaauaaauguuuucuuccaaagugucuuugaacuuaaaacuuccauacugugugaaaauaacuucaucaaaggcuaguaguaaaucucauuagguaguguaaaaacacugucaauauaaauauuuuuauuaaugaacaagcuaauaaagugaaaucggguccauauuuagaaauucuguauuccuaaaggaggaauuuggaacuuagaugucauuuuucuaaccuaauuaaauaaugauauucuuuucauaauaauaauauauaauauaaaaguuaaaauagguuagauaucgcaugaguguagauuuucaguguaaauauaagugaagaauuuauucuggguauacauguuuuuuuccuuuguuguaaauaucuccauguccuaaggaagacauuagugauauaaagucugcaguaaacaaaagauguacuagaaaaaaacuaacuaguaauuagaucaugacuaucuugaaaauaauguuuagcaauaauuaucaaauaauauuggguaaugaauuuccuucauuaccaccagagauauuucaaaauccuuucccccuuuuacuagguacuuacaagcagacauagaagccuuugacaucagagaauugacacccaaauuugaugugauucuccuggagcccccucuggaagaauacuauagagagacuggcaucacugcgaaugagaaaugcuggaccugggaugauguacggugaaacgcuacacacuguaauggcguauuuaccucccagagaguacacgcuuauuuguccagaaagcgggguuaugaguacacuucacugugguuucuuaggagcuuagucuucuguuugacagccauuaauuaagguuuugaagguuuuaaugagauuagugagaucaucugauuggcaagagggcuggacuagaggacaguaagugugaaccgugggaaggcaggagacuuggggauacucacgggucagagaagaguugugcagauaccuggacaaaagugguccuccuaccucagucaccccaaacugucuguggcuauaggcauaugacauuucauuuugucuguaccuuugggcucuaauaaccucuuacuaucucugcuuuuauuagcucuguagaaaauuccaucauucuguaaauguacuuuuuuuugaacgccuaagaaaacaaguauauguauaugucuuuuuguacauguauguguguugauuguugauagaauaacaaacagcauaucuaaauaacuucaggcauagaguuuauuuucuaugcuauuuccuagaauaucugaagaauacauuuguagagacccuauuaagucucaacaguuauuguuuggauuuaugauaagugggacacauuuggugcuauauuauuuugaucuucuucuagauuaugaaguuagaaaucgaugagauugcagcaccucggucauuuauauuucucuggugcgguucuggggaaggauuggaccuugggagaguaguaaguugauguuuguguuuuguucuuaauuuuuuuuucagguggauucuuaaguuaauuaggaaaagaacauaaaggcuacaaagauuagugugcuuuugccuccuucauuuuuuugacuagcuuaaaaauaccaagaauuauauaacacugaggugauauaacauuauaucugauauuuagucacagugacaagaaaaguaacaugcaaauaacuaaaugauguauuuaacaucuguauuaugcuuauauuucuuauuuaacaucuguauuaugcuuauauuucuuauuuaacaucuguauuaugcuuauauuucuuauuuaacaucuguauuaugcuuauauuucuuauuuaacaucuguauuaugcuuauauuucuuauuuaacaucuguauuaugcuuauauuucuuauuuaacaucuguauuaugcuuauauuucuuauuuaacauuucuuauuuaacaucuguauuaugcuuauauuucuuauuuaacauuucuuauuuaacaucuguauuaugcuuauauuucuuauuuaacauuucuuauuuaacaucuguauuaugcuuauauuucuuauuuaacaucuguauuaugcuuauauuucuuauuuaacauuucuuauuuaacaucuguauuaugcuuauauuucuuauuuaacauuucuuauuuaacaucuguauuaugcuuauauuucuuauuuaacauuucuuauuuaacaucuguauuaugccuauauuucuuuugugucugcucugaaauuguugguuccccucuauaaaacuuuuauucuaguuuauuuuauuucuuuuauuggauauuuucuuuauuuacauuucaaauguuauccccuuuccaggucuccccuccagagccccccgucccauauccccaaccccugccucugugagggugcucccccacccacccaccuucccgcccuggaauucccuucaccugggcauugaaucccaacaggacuaagggcugcuccuccuccugauguccaacaaggccauccucugccacauauguggccagagccaugagucccuccauguguacucuuugguugguguucuaguccccgggagcucuagguucuagccuguugacacuguuucuucccuacaugggcugcaaaccccucagcugcuucagucccuucuccaacuccucugucugugacccuguucuuaguccaaugguuggcgcuauagaacuucuuaauucugguuauauuaaguuuuuguuuuguuuuauuuuuuuaagauuuaauuuugaaauuauuucuagugcuugcgaaagugggguuacagaagaugugaagauauuuguuggauuaaaaccaauaaaaacaauccuggaaagacaaagacucuagauccaaaggcaguuuuccagagaacaaagguauugucuuuuuuaucuuguuuucuuuauuauuauucucuuaaacuuuucuauauuacuauauacugugaaauuuauuucagcaauaaugcuuuuaugcuaguaaaguagugugagcauuacagaaguauacccaagauaccuuaaaagugucuccuucccaguccugggccagugcacacugugcuagacaguggcuuucuguauauuguaagcugacauaauuccaaguuaguuagcucugguccaccugacgcucagaagcuucccuucugcacgcuuaggaggaagaacugacagcggaacucaguagccgaccauuagagucaugcuugccugcucucaccuugucuucccaugcaagaaccacuaagggcuucugcugcacaugacugucucacuaguguaagcugaaagagcuuuugcacauuacaccuuggaagccacuagagggcgcgucugucuuccuaaguuuuccuuggacucgaucauuuacaugacagcauguaggaaauccccgguugguggagcuggaauugcucugagagaggugugccuggagccagccucgaaucccauccuccuuucccugcagcuuacucaccacguguguccuuccugucggccuuuuauaaacaugcuagagucagcaccuguccuaacugugugagcccaggagggccauugcagccccacaauuauagcugcuuggugauaaguguaugcccugaaggugggguggguagauugugucauagcugagcccauguggaacagaacuacagugggaagugcaacauuacguggugugggaaauccugcauaccugcguuggaagugaaguaggauuuuaaaaguauuugagugacuguagaagggaaaaauguuuuucccauuuucuuggcaguugucugaaagccagagaucuaggauuuccugucauaguuuuaucacuaaacuauaucccgacaauccauagaaguaaggauuguuuuagaacuguuuagaguugguaaaugcugugagauccugauuguugguaaugagagccaucggugugcuuugucacaggagcauugccugauggggaucaaaggaaccgugaagcgaagcacagacggggacuucauucaugcuaauguugacauugacuuaauuaucacagaagaaccugagauuggcaauauagaaaaaccaguagaaauuuuucauauaauagaacauuuuugucuugguagaagacgccuucaucucuuugggagagauagcacuaucaggccaggugagaccucaguuuugauaaaagacaguuuuuuccuugagauguggauuuuaaguuauaggacguagccuguguaaaauagaagucuuauguauuuaauuccucuuuuuucuagcucacaugugagcaauuuuaucuuagcaaacugagaaggcaaagaauucccaugcacucucugccccacacaugcauuaccccccauuaucauuguuucucacauaacuauacaaagucuaucuuagaauugacauuggcggugucuguggauuuauauaaguugguuauaguguauccaaccguuguaauaguacacugaaaacguuuucugccuaaaaguccucccuacuccacuuaguuuuuggcaccuccuaauuauccgaauuuugggguacauugugauguuucuuugccuguguauaguaacgucaggguaauguugacuaugucaccucaguucuuuguauuggggacauuuaaaaaucuaugcuuuuugaaguauucaguuauuacucagcuaagcugugcauugcuguuuccuggauuccucacugucuggucugcggccuucuuccccucacucuuaccuggccucuuguaaccagugcuguagucucugcauccuucauaugcacguuuuguuucuaccuguaaaugaggauuugugguguguguucuuugccugacuuauuucaguuaacauaaagccuucuagucccauuacagucaauaacagaauauaugacauucaguuuauccauuccuccaucaguggacaccuaggucauuuccguagccugcuugugugaauaguacuacaggcugcuuuuaguuccuuuagauauguaccccaggcguagggucucugaaucguaugaaguccucuuucuaguccuuugagagccuccguaauguguuccauaguaaguguugaucggccuucccaucaguagcugugggagcuccccuuccucagccucuccagccauacuaguucuuuuuccugugaucauagccauucugacugcagcggaugauaccucauugugcuuuuguuugcuuaguuauuaaugguggugugcauuuuuuuucauagccuuagcugugaguguuaucuucuugugagaaaagccauugcccacggaaagauggcaugaggagggcaacauggcuauuuggauauuuguauaagagaaaagcacauuuuuuccucaaaugagaaaugagaaaaacagucgucccauuuucuuaaguagggaagauauauguauauacuuuauuaacccaacccaaacauuguguauuaaaauaucuuuucuaagugguauucuaacaacacaauacauagaugaggaacaauaaggaugauauguaacaaaagcuauaaucuagaacgagaaacaagguaugugcauauggaccuuuuacaauaggacaugcauguuguauguucuacaccagaggugauggcuguguguguaacugagccaucuuugagaguguguuaaggauuugaacuagccccuaaagaccaccaaaagaggaaggagauggaaaauauuuucuguuuuccccgcuuuauuucaggcuggcucacaguuggaccaacgcuuacaaacaguaacuacaaugcagaaacauaugcaucguauuucagugcccccaacucauacuugaccggauguacagaggaaaucgagaggcuucgaccgaagucaccuccucccaaguccaagucugaccguggggguggagcucccagagguggaggaagggggggaacaucugcuggccguggucgggaaagaaaccgauccaauuuccgaggagagagagguggcuuuagggggggccguggaggcacgcacagaggcggcuuuacuccucgguagcucuuacacuugcaucuuuaucacaguggagacuugcuucagagcucacucccagcuuguacuuugcuuuaguuucucaugcugccagaaagaucuuagccaccccaccccaccccagggacuggcaguugucacagacugagcuuuugcucagggugggugagucacgugugcgcaacaccccgaccugacuugacugauuccagucaaggcuuuggcuuccuggaaauggcugcgcagaggcuucggcaucucagaggaguggcaggagugggugcuguguucccugucauggcugcacggcagcaggaggcugggaacccggguagaacagaauuagagagguggucacuguguugggccuuuaauguuuucuuguugaaacacuaaaaagagaagaguuuuuccccuuacuuuuaaauucuaaaaaauaacaugaaguaucauuugaguucccagaacucgggaggggaaaugaaaucucguucuuccagaucagaaucugaggugguugcagucgucaggguagguaacgggagaggcaggcagagcaugggauauuucaaacaaaaccaagcuuaucauaauguaaauuagcggcuacagauggcuccugaccaugugucuucagaagcaagacaaggcauguaugucuccaggucggagugugaaccugaucuugggcuaaccuaagauaauucagauuucuuagcaaaggcaaaaacagauuuggggaggggcugguuuaaacgguugagaaaauaaaaucuugaugaugaggaaaugacaaacaucuuuaaaguuguuacuaaagaaaauuuagguaaaagcaauuccagaaaacccuuacgaauacagcguggaagaggaccugcaguguccuuugauuagaacuauguggugcagaagucgccgcagggcugaugggcagaucucuuggcugugggaagcuucgugcuguugccuuucuacaccuuaaguccuauuugauggauuuggauaugccagaugagauaaugccaauauuguucuggguaacuccuuuuuuauuuugcuauaacuuuucuaauaaaaauuuaaaccuuugaauuaaguuuguuuuccuuagaugcaguugcuauuguuaccaaaugaaaaggggccaaccuaaggugacacuccucccucggguugcauuugaguggcuguucuguucuacuggucaguuaugggcaugacagccaugaaacauacggcucgaaagacuuacacuuuaaaugcuucaugaauuuggcucuccaaccaauuggugcuuucuaguacagacaaccuuuagguaucacaggugguuagaauauuugcugugauguuguuuuuaauuucaguaauuauaaauuaucuaaaaagcaaaacuaugggccagauuugaccuguaaggugaagguaggaacucccacuuguucagugacggcuucuucagagcucuaaggaaugucccuuccaucagaccaaauaguuuucacugaauuaccaucuuccagaggucugagagccaacuuuuguuuguucuuuuucaaaauugauaaagaauagugguuuaacuaacucucuggccauuuauuuaauaguagccuaaaugggaaaggaagugugcauuaggaauacagggacagucgagugucagagaggauggugaggaaugcuaaaugagcagggaacugacauacagaaaccauucuuucuauuauuguuguuauuauuauugauuuucuucauuuacauuucaaaugcuauccuaaaaguccccuaugccccacccccgcccugcuccccaacccaccaacuccugcuuccuggccuuggcauuccccuguacuggggcauauaaucuucacaagaccaugggccucuccucccauugauggccaacuaggccaucuucugcuacauaugcagcuagagacaugagcucuggggggugcugguuaguucauauugucguuccuccuauaggauugcagaccacuuuagcuccuuggguacuuucucuagcuccuccauugggggcccuguguuccauccaauagcugacugugagcauccacuucuguauuugccaggcacuggcauagccucacaagagacagcuauaucaggguccuaucagcaaaaucuugcuggcauaugcaauagugucuguguuugguggcugauuauggaaaucaccaugccugaccucaagcuguacuauagagcaauugugauaaaaaacagcaugguacugguacagcaauagacagguagaccaauggaauagaauugacccagaaaugaacccacacaccuauggucacuuguucuuugacaaaggaacugaaaccauccaguggaaaaaaagacagcauucucaauaaauggugcuggcucaaccggugguuaucauguagaagaaugcaaauugauccauucuuaucuccuuguacaaagcucaagucuuaaguggaucaaggaauuccacauaaaaccagagacacugaaacuuauagaggagaaagugggggaaagccucgaagauaugggcacaggagaaaaaugccugaacagaacagcaauggcuugugcuguaagaucaagaaucggcaaauggaaccucauagaauugcaaagcuucuguaaggcaaaagacacugucaguaagacaaaaaggccaccaacagauugggaaaggaucuuuaccaauccuaaaucugauaggggacuaauauccaauauauacaaagaacucaagaaacuggacuccagaaaccauucuuaccccagugucacagccgcuguagaagcagugcggaguucguguuggcuccagauccugugccuagucuccacgcugggcugcagcauggucccucgguccuugugucccucgguccuugugucccucggucuuugugcuucugcacugaggccacacuugcuuucacccccuuucucuuaauggcaaacuccuuucaaauaaccagcuuuccacagaugccuccgucacucuuaguuuuuuggaccuucagcucuugugaaacuccaagucaauccgagcgucccacuagucggcuagcacaagugcauuuuccuaggucuguauauguaucugcuggucuaaauuuucugguacccaccaaccuacagaugcugugcugagcugcuguaaggcgucuucauauguaaaggaagcuaacaagaggaagucugcugcuaggaacaagcauagaaagagcuguaagccugaggaucaggggaggugcuacauacuccacucugcugcagcaauuaacauguaucgugucugugaugaagcugaggaaggcacccauggaagaguugccauucuccucccuuuacauauauauucauuaaucauggucucaugugaucaguuuccauuuacuuuuuuuacaaggacauaguuaaccauuuuuuuuuaaaguuuuugagagaacuauuuauuacuuuguauacugaaggaaauguaacaccaggagccaagagcagaguccccagguacaagcagcucagcuggcggugucuguauugaggaucuuauaaacacucuuuucaaggaguguuucugacagccugacacuauacuacuaaacccuuuacaaagcuccagcuucguucucagccauccagugggauuuuuuugcuauguacuuuccgugauauccuuauuucuguuuaaauuuucaaaagacauaaaacacaguaagccagaguacaugaaguaauuuauugauauugguuaagauccauuauauacagguagaaaccaucaaaauuguacaaagaaccauuaagaauauagauaccguuuuauagacaaaacaacuggaaaauauuuuaaacagacaauauauaauuaugaaaaaaggagaacacaaauuguucuaccagacagauuucaggcuuuuuaaaagucugcugugcagaucuuauguuggaaaaaaaauucuguuuaaugucaucacgggguuuuaaaaaaauuagguauaagauaaaaaugaagucuuuuccucucacgguaaaagagagaggaaccaagauaauuuuaucaugaaucuauacaguuugaaaaauaauuuauauaacaagcacaaagaaaauugaggcugcaaaugguucuguaaacuauguauuuaugaaaugcaaauugugucagcuuuagaaauuagaagcuggacagccaguaauggacucuucccuuuacaguacccccacaccuccacgggcuugccaccugagcacuccgagcugaaggucugugugcuguccaggcaagcuguccugaaagugaucaagaaauuaaaacuagccuacuaucaucagaaaauuaggcaccaaguuggagacugucuccucaggaaugugaccucagagggagagccgagggcucaguuaagcaguugacagaucuccuugugaacacagcagaggaaauccacguacgaagauccuccauagagcccuuuaucuuccaccaggaacugucggaaagccaucucccgcugcucucgcuguuuaaccacgaugagcuaggagaacggacaacagcugguuaggaacacacugugggugaggugcagcagucucguugcuucaaucccaccaaaugugguagcaguguggggccuggaugaugugagcaugucuguuuccguggguuuuuaaaagguguguguguguuuguguguguguguguguguguguguguaugugugugugugugugugugugugugugugugugugugugucccuggagccaggacuacagucacccgaugugggugcagagaacagaauucagucuucugaaagggcaguguguaccaucucuccagcucugugccuauuacuuggaagaggaaagagacacuggcauuuaaaccccagagacaauauuaaguggcaaauuaacaugaaaacaucauaaauagaaugcuaugggacaaaacacuucacacuggcaaucacugucaccuaugucucaaaggacagggcaggucagagaacauuccagacugguacacagugugcgguauaacagcgauauagagacagucggcauguaacuuauuacagacauuuaaaagggugggaagggauuagagacaauccccauaauagugagucugggcccuuugcaggacaugggauaugcgugcagcagaggaaaugggagccaacaaguagcaguggguacauuagugagaagaaaggaacuaaacguggaguggccacaagucuaggugggugguggcucuuggugcagccacagcuccucggacuacugugugcuuauagcucuaauuggcaugugauguaaaaaaagcaagaaacaacagauauguaagauguaauaugaaaauguagaaucucuccauauaguguauauugaguccauguggaaaugcuaacaccgcucccuauauauggaagaagacccugggcccugauaucuuccauugcugagaccauaaggagugccuacacaagaagagcugcaguuagcacccgcaucaucuguacaguaggagagaugugcggcauggccaggaggccaugggucauagagagaaugcccaugcuucagguuuacacagacacacacacacguauaauuuuaaguuuaauuuaaaaagagagauugaaaauugacuaaggcaagaacuugugcagaugaauuuccagagaccggagcucuaauucaggacuaacacucccccagcauguguggaguacuugggcuucucuccagccccagccccagccccagccccugccccugccugugcacugagcccauacuggauggaaacaguucuugaaugucaacuauucacccagaugucuagagacugugaggcuguuauauuuccgcuaccucagcucuaccgagagcugaugucugcacgcaagaguuacuucuauggugaagauuaguaauugagauuagcauccaguuugcacuucaagagaaaacaguagccugggccaugcagaggcaggcaucuaaagugucucauacuuuagaguaaggaguucaacaguguccccaccugaaagcuccuaaccccggagacuccagcacacagcuuacagaggagaugggugcagaguagcuggggcuccagcacagcuuacagagaugggugcagagcagcuggggcuccagcacacagcuuacagagauguauggagagaagcuccaacuuggcaacaaagucuaacuuuggauucaggacauuauucaaacaaaauaauaaaaugguuuaggguaauuauaauugcaaacucuuccagauauaaaagaaaccacuuuggaaauguucugaaggauauuucuaugacuacauagaaugaggcacuaaaggaaagcuaaggacaucgaugacagcaguuacuuccgcacuacaaggaaggacgacgucaggauccggaagcuggugucuaauaagaaagcccacggucauagcuguugauguuuaugcuugugcuuaagaaguauauagacauacucagagguggacauuuucuaucaaagaucaugagauauaacaacuaugaacaugcauuaaaagguuucugaagaaauaagucuugaaggaagaggggagauuuucauuuuaccuucauugaguauggcuucuuuugcuggauauuauucauuaucauucugaguuguugagaguguggacuucccaccucaggcagcgaugucuaaauguaagagcaccacaauuucaguacaacuugagacacuuagaacaaaagcagcaauaugagacccauggaauguuagaggcaucucucaugugccacguagacuacuuauuggcucaguucauuuaccugaaaacugaaaacauggaaaacuaaacuauaaaccacucauuuuuauuagcacacaugaacgaguuaucucuuucagagacacaggucauggcugugguguauuuuaggaagagauggucuaaagacgaaggugacuaagcucuuucaaugccauaucgggagugaaaagaaugucucuuucccuucuuuaccaaauucuacaguguuccacgguuaaagaaaccacaagggcugauuccuccaagaguuucugcccuuuucauuucuacgacaucuguuucgcuuguaaacaucacagcugcauuuggaguucuucagguaagacagacaggaugcuaaugcugccuucucagugagaagauaccaagaugcagucaacacucugccugugaguuagccaccauggugaggaagcagcccauacaguaaggcuucaagucuuagggaaaacuacagccacuguaucucauaguucugaggagggcagaauauuuaucacugaugcuccaucccuuguguagauuuuauggcaucaucgugaaucauuugauucaagaaauaauauuaugcaucacacauauaucccagagugccaaaugagucuauuagggucucaguuuuguuucauuuucuugaaaacuagugaggagguguguuaauacaagcccaggcccaggauucccuguggcugagagacccacgaucucaugugcacugagggcuuacagggaagucugcgccaauguuagcucugacauuagugccaaguuuccuaagauauuuugaaaacagauauguguauucacuucuuuaucaacaugauuucuuuugucaugacuaacagaagagaggguuuagggugggguuuuuauuuugugccucauuaaucuuaguaugaagcaaaauaucuaugaaggauucugaauguccucaaacaggcggcucaucagcaaggaugaagagaccugaguugaaaacuaaaugcagguucuaccccugaccucaucacccacaagaaccugccucuggcuucacuaguucaucaggagcacacugcugccgcagcuaccucacugaugugucaggaaaaugaagcaggauggcgggcuuaaacugcaugcagagaacagccacuggugaacagcagggugugcgaguguguguguguucaugcaugugugcaaggcuauguucaugcauguguguucaugcgagugugugugugugugucagguccucugcaaggacagcaaacauucuuaacuacaagccaucucuccaucucugcauuaucaguuucuagugaagccauguuuaaguuaaaacuucaguauauuacuuuacccuuucucauuuuuauucaucaaaauacgauucucauauugagcuauauaaacacacacuguuauucuccuuuguaucauaaaacugcacauaaaaucaaaauuuauauuugaggguuaucacaaaaacugaagaauacuugccauaucuguguugauaugugcaaacgauggcacauuaaauauucccugaaucagcucuggugggcugcccacuccaaaccauaagaacauguucagaccguuagccagcaggaauauuccuucuucagagagucgggacucggagcagcggacggcugguggcagcgcugcacucuucacaucuaacgugugcuguuugggcaaagucaagacacucagaacuuguuccucuguuccucuuucuucuccuuccuuccuuucucuccccccucccccauuaagaacauagcuaauuaaagccuacaagaaucucugccuugugcaccuaauggucuuuuugagggagaaaggccuguugcauaaaauagaacaugcauacuuguaggcgcuguuaagagcugugcaggaaaugaaugguaacaaggauaaguaucacuguggggcggggcuaugaaggcagcugacaaagguagucgugaguaagacuaccuaaggaggugagaagagguuaggaguugagccuggagaaaugaaaagaacauuccagacacacagaaacacguaugcgcagauccugagguaagagcccgacuaggguguuugaggaucugcaaagagaccuguauggcugucacuauauaagaggacagagcucagaaagggggagagaaggcuaacacugggccagugaugcccuggacuggccugagggauggaacgcaggcaaggaggugcuucucacaggcugggcucaguuucuaacccauuggcucauccgcuguugacaauccaauuuuauguggcaaccgaucauuugaaauaauucauuucuuacccucacauccgucguaauaauauccuucguuucuaacacaauuuaucacuggccacaucacugcuuguggcaggauuuucucuauccaauuaauuuaacuauuagugcagcaggaggccugugauuggacagggaaaagggagguggagcuaagaguuguaagccagggagcuacacagaaggaaaaggaagcaagauggaggacgaacaggaugacucagauuccacgugguuuuauauagccacagauagauauaauaucauauaggaauagaauaauuggcguaacuugucuaaacuaggugggcagcuuguauguaccauuaucaacuggcccugaauuuauugugugggcaucuuguauauugagaauuuauugauauauaaaucugacugauuaauuauaagcuucuagaguuuuguuuuacuggguuaguggaaugugggacuggugaccacaggggguuuuugguugagaagguacaggcaguacugagacaagcgaacuggagcugggaacuagcuuagaggcagaggcuuagagacaggggcagagagaagcuggguguagcgcgggaacuugcuguucuuuuuaauauuuccagcaacaagugccuacuaucuguuagcacuaugaucaaggaggaguuguacacaucccaccaggcagagugcaggguuuucaagacguuaacaacaccucaacagagagaaauguguugccaugggagacacugaggacucuugcauggcaugaguacccucaaguacgaguucaucuguuagccucugacugcacauggugacucuuagucacacauuauaggaagacagaccacacacgcccacacaagauucccccagcauauguagaagugaguggucuucuaagauguggaauucgauugaagucuucuggcaccaacuuguuuauagacuucuaaaggggccuacuuaauggguuacuaccaccuugagaguaaugcagaagggaaagcgaccugaacaagccagugaagcaggacuccuuacaccuuccacugccacgcugagcacaugagcaugcugcaugccagagagcuucugcuacgggccuaggcugcacagugcugacuccaacacacgcuucccucccagacaucuccagggcccaugcuuacgauuggcaggagcaguggauagaagaagagcugggagucagccacgcccauggucaugaccagcugccgcugguaagcccgcucaucaggggagaucuccgaucugcugagcagcacacaguuuuucaacaaacuguucauguacacaggcagcaccuucauggaaucuggcaguauaagcugaaagagaaaacacuuguuucaugacuguuuccuauuuuuaccuuucucucucuuuguauaccugugugugugugugugugugugugugugugugugugugugugugugugguguguguguuaucagaauccuccaauccucaaugacaagaaaagcuacccucaggacccugacaggaugcauuccacaucuuauaccccguacaccuucauaucagaagucucuucucauauucugcugaguaagaaguauaacaguaucagaaaauuguugcugauuuaggcaagcacauuccacaauguuucaccucaacaucugaucucacuucaaggcaccagagugaguaaacagaagaugcaggaacugggacacggucauguuccagagccagcggccccagugccauuucuaagcaacuuauaacacaguaugaagaauacauucucuuggcuucacagacagaagugcauauucacccucccaacauccuggaauuuuacucacugccucaaguuaaccaggaauauucagguuauuuauauauccaucauuuuaagugccacagcggggugagcuuggcacuuaugaagacagcucuacagaggcugacagagaaggcuggguuguauggaccagagggaagaaaggaagagaaacaggaaagaaggcugauggaggaaagcaucauuagaguggaagaaagcaagaaggaaguguuacuaaugucccugagguuagaaggaaaguguguaggcacagauuguuacuguaaaaucuccccugagcauuccugacuccuccauagugaaauuacccuggagagcaagcaaggguuaggggagagccaaaauucauccaacccugauuugaccaaguuuggaaaauguuuuugcguuuucuaacaacaaagcagucaugaacaaaaacauuggcaauuuuguaguuaaagucucugucuuuuuuuuuuuuaagaggacuucacuggcauuuuaaauaaaagauuuacuuuaucucaagugugcaaauguuuugcuccaauguaugugugugcgguacaugaauuccuaguguucucagaggucagaagagacuacaggaucccuuggaacuggagucccagaugguugugagccaccauguggcugcuggagaucaagcgcagcaccaaguguucuaaacugcugaggcagcucuucagccccucguuugccuugugaggaacauuucacucucaaauauaugaguggcuuauuagcacucauaaaguuaacgagcccacggauguaaaccagaacaguuacuguagcguucuccugaugcuucucacggcggagccccugagucugagugguuccuccuuaaaugucauagcccaguggcuucucuugcuuugguaacugcaaaagcaguccacacagguccguuacacaaucaaaguaugugucuugauggucuggccuggauauggaaaguguucuacagaugcaguauugaaggcuugguccucaggguaccaguguauggagguggguguuggagaagacuggauugccaggacccuagcuucauuggugguugaagggugccaugaaaggcucaaauggaaaaggaaaaaucucauuuucaaagagcaggaauccgcucuauugacuuguucugaguaaaacaagugucucaaugguuugcucuacauuuaagccauaaaagcaggugauuggguguagauacaagucuucuagcuuuuaaaccagaacgagaugguaaguuuuacuuuucuc

SEQ ID NO: 1699 - RNA, 851 nt, Mus musculus
cuuauuacacaccaaacaucuuuuauuuaauauaaaauauucaauuuucaaaaauuaaaagcgaagauucccuguaaguugaccagagacgaucucaaccacuacaguaccugcaagaaaaaaaaaaaggcccauuacagaauauccgugacuauacuacgggcuguuuacuuauguuaaugucagcacaagagcaaacuucacccuaacaguaaaggcccacucacuacccagaaccgcgaaaacaccacaaaaaugaaucuuaccuuaacacuuccuccacuguucaacagcaacgggucccggcguuuccuagaaauauuucaauacuaguuuagaaaacugaaguccauuuuucuagcgucguguagacucuuacaaucuuagaaugucacuugcucaagucagaaucugguaccaaugaaauggugacagcuuugccaauaacaagaacaugcucuuccauggcuaggaagggagacugccacaggcggcaggucccaaagauacauggaguuucacagcccaaaaaucuaguguaaccccagaggugucacucaccauccgacccagcgguggcgaacuugcgucacgccgcccaacaccguaucggcuuuacaugguggucgucgcgcuaaccuucacggcgcucuugcagaguugauggcuuucggccagcaccauagccaccuugugucucccgcaucucggccacucacaaauaaggcccaagauaucauccccaccauacaacuacauacucguaggcggaucgcagccaaagagacuucugaacggugcgcgcacgcuuuuauagcccgggugacgcucucccaagagccugcgcgcga

SEQ ID NO: 1700 - RNA, 3476 nt, Mus musculus
ugcaugcgaugccaccaccacaccagaagagggcgucagaucucauuacggaugguugugagccaccaugugguugcugggauuuaaacucaggaccucuggaagugcaggcaguuuucuuaaccacugagccaucuccccagcccaggauauccuuucuuuacccugcaccuugaaaucaagucaugaaacaacccaauaugaaacuggugcugcaauccaggagagggaugagacuccaccuucuggagaaaauuacuuuugcuguuguuuccuuguggugcuggagauuguacacagagccuugugauuaccaaacaaacacucaucacuaagcuacauuuccagcccccuaucccaaagguuuuaaacuaaaaaaauaaauaaaaauagugguuuugaaguagggucucauguacccuaaauuguccauuaacuuaauagguagucaaacaaaacuccaacccgaaagccacuaguugcugggguuacaggcccgugccaccgugcccacuguaugccuugcugggguuacaggcacgugccaccgugcccacuguaugccuugcugggguuacaggcgcgugccaccgugcccacuguaugccuugcugggguuacaggcgcgugccaucaugugccaccgugcccacuguaugccuugcugggguuacaggcccguaccaccgugcccacuguaugccuugcugggguuacaggcccgugccaccgugcccacuguaugccuugcugggguuacaggcccguaccaccgugcccacuguaugccuugcugggguuacaggcccgugccaccgugcccacuguaugccuugcugggguuacaggcccguaccaccgugcccacuguaugccuugcugggguuacaggcccgugccaccgugcccacuguaugccuugcugggcgcuggucccagggcuucgugcugcuagguaagcacucagaaaugaaguaacaucucaaacccuaaaaacaaaucuuuuuuccguuucagaaauacguacugugcucuucaaagcacuuugccaugaccacaagugcucacuggagucuucccuccaagcacuuccccaggagaaaaugcaaacaucaaaaucacuuguacggaugaagguuuucauaacaacacuugaccaaaacgcugaaagcugaaaagaacuuccacagaugauaagagauguggugaggggagagcaacaaggacagaaaagaacacaaacagaaggacaugccaaaggcagguuuuaaaaguuccauuucagacaaaacaaguuuggccaaaagacaggaauauacaaggacauaaacuaucacuauuccauuccagcuaccuagcccaaugguuaacgucugguucauuaaaaauguucaguaagacaugaugugcugccaaaacuuauguugaaaucguagccccuacucucugaacaugguaguauuuggaaugagguuacuagaccgugcuguugguggccuacaagaacgugguugagggccgcaggucugccuggauggucaucucgagcauugagaagaagaccgacaccuccaacaagaaguugcagcugaccaaggacugucaggagaaaguggaguuggaacugagguccaucugcaucacgguucuggaauuguuggguaaguauuuaauagccaaugcaauuaauccagagaguaaggucuucuaucugaaaaugaauggagauuauuuccaggaucuugcugaaguagcuuguggcgaugauggaaaacaaaugauagaaaauucccaaagagccuaccaagaggcauuugauauaagcaagaaagagaugcaaccuacacauccaauccgccuggggcuggcucuuaaccuuccuguauuuuacucugugauccuuaauaauccagagcuugccuacacacuggcuaaaacggcuuuugaugaggcuaucacagagcuugguacacugaacaaagacuccuacaaagacagcacccuuaucaugcaguugcuuagagacaacuuaacauuauggacaucagacagugcagaagaaugugaugcagcagagggggccgaaaacuaaaggcauccagggcaccaacccccuuccccucaagaagaccuuuuuacaucuccauuccuuauuccacuuggauuuccucuagcaagaaagcccauucguguguaugggaucaacuguuuauauagucuuuucacacugcagcuuuggggaaacuccaucccuugguuuguguugucuccuccuuccuggugugcaguuacugcuguagaaaaguaucaauagcuucauuucauguaaacacgaguaacuuccagacacgugaguagaggacugacagcacacuugguauuuaaguaaucugaaccgguucuacaagcgacuguguuuuguauuacugcgaagauauggaaaauguagugcauugcaauuuaaaguaauguuaguacuuuuccaugcaaauuuguguacaugugagaggguauccauuugguucagugauuguucuuuagagaguuguuugcuaaucauugacuguaguccccaaaaaagccuuaugaaaauguuaugcccuguguaacagcagaguaacauaaaaacaaaacuacauuuuguaaaauaaaaaaccugacaggugcagacaggcacaaaagaaaaacccacggaaagaugcaggcuaccaucuacuggccagagaaggaaggcccuuaaucucggacuucucagcucaggacuaauacagaccauucuuaaggacacccucagaagaccauccagaauguaaaugaaauguuugggcaacgcgccgcgguuacuugagccuuaugaugaacuaguucuuucaauucaguagugauuauuuuaaguaaaaugagauagugggugagcgagcugagguucacgaaccccucuagguccuucaaaugcgaguauugucuccaaugaauucguuccuacugacuccugcacgguguugcccuaaccgcacccuucccagccuguaaugaucacagcuuucuaacuaacauucuccaugacgacaacugucaucuccauacuccaucacuaaaggcccucuauucugucucauagcgggcugcacgcgggagugagauaugccuuccucccggaaaagccgagggccgggcgggucugcucgcacugcccaggcuucccguucucccgguucgagaaaccuuccggcgcgcugugucgggcaaaagugagaucagaucaaaagggcaagcggaagggcgcaagcggaaccaucaaccccgaugggggcagaggagccgccaacagcucucggggacaaagggccggcgccauaggaagugaugccgggggaggcggcaacgaagggaccuuagacuuugggucccagagaagaacgcagccaagaagagaaaacgcgcgcaccgccagagcuucagccacgagacuucug

SEQ ID NO: 1701 - RNA, 3891 nt, Mus musculus
cuguguugccauggugaugauggcaauggcaaugacaguggcaccagauuucccaguuccugggaagccccuccggcuccugugggugggcggcggcgaucggugcagcaaauccgcgcucgcacccgggccugcggggcaggggcgcggcgcucgauuuccuuuccugccuccgcagccccugugcgcaugcucggccuacgcggccccagccuuugauugaucggucggcagcggcugcgacccugggcgucagacgggcggugauggggagcccggcgcugggagcggcucagugaucagcgguggaggccggugacuacuggugaguaccgcggcauggggcuccgcaagaagaacgccaggaaccccccgguguugagccacgaauucauggugcagaaccacgcggauauggucuccugcgugggcauguucuucgugcuggggcuuauguucgagggcaccuccgagaugucgaucgcguuccucacucugcagcauggagucguugucccagcggaagggcugcccuccggguccaggacccuguaccauuauggggucaaagaucuggccacaguguucuucuacaugcugguggccaucaucauccacgccaccauucaggaguacgugcuagauaagcucagcaggagacugcagcucaccaaaggcaaacaaaacaaacugaaugaggccgggcagcugaguguguucuauauaguguccgggaucuggggcaugaucauucuggccucugagaacugccugucagacccuacacucuuguggaagucucagccccacaacaugaugacauuucagaugaaauuuuucuacauuucacaguuggcuuacugguuucauagcuuuccggagcuuuacuuccagaaagucaggaagcaagauaucccgggucagcucaucuacauuggccuccaccucuuccacauuggaggggccuaucucuuguacuugaaccacuugggccugcugcugcugaugcugcacuacgccguagagcuccucuccagcgugugcagccugcuuuacuuuggugaugagcgguaccagaaaggguugucucuguggccuaucguguuuauauccgggagacucgugacauugauugucucggugguuacaguagggcuucaccuggccgggacaaaucggaauggcaaugcacucucugguaaugucaaugugcuggcagcuaaaaucgcuguucuguccucgaguugcaguauccagguguacauaacauggaccuugacuacugucuggcuucagagaugguuagaagacgcgaaccuucauguuuguggaaggaagagacgguccagggcgagaaaaggcacagaaaauggaguggagaauccgaauagaauagacucuccaccaaagaagaaagagaaggcuccuuaagcagcuucaagcuaauugauucuuaccuccaagggaauccacuccuugcuauguggugucucugugcuagagaguuucuguuuuucagaacgggucgugcuuuuuuaaauauugcuauuguuauugucuaauguguuuuuaaggguuggcagcgguaugagugguggugggaauuaagauuaaaccacucagccucuaaauccugucagaauaguuaacagaccaacaucguauuuaguuuagauuguuaccucaacgauuguccaaacguuucguggugaugacugcagaauuguguguauaaauaauaguuuccugcuuccaguguucuuuaucgcauuaacaagucuggcagcaaagugguuuucuccauguucucuugcaggauaaaguggaaaaucugauaaagguggaacuuaaaucaguauuauguaaucguugggauuccuuuuuaaaguuguuuuaaauuuacaauggaaaguauuugucaaacccccaaaguauguguuuaauuuuguaauuagugacugcuagugcuaugcccccauuaaagcaucaaacuccgaauagaugacauguguggugauauugacauuuaucgaaucaaaauaccuuuaauaaauaucauggguuacugaagaggugaacaacuucuuccuguuuauuuuaaacacuuguccaggaaaacucacaaaauucaaccuuacugaaaaaaaaucguaucuacucaauauuuacuaagaaugguuuuggcagauucauaaaauuuggugaaagcaguguaucagaagaauauuauuuaauauauaaacaauuuuaaagauaaggcuaugguuaaacgugucuauacauauacacuguuuaaauaauauauaaauauauauuuguguauguguguguaugugugcauguguguguauguguguacagcuaauuauaucugggaaauauuugacauauuaaacuccauuuaaagaugaaguggcccaauaaaauuuaugaauggauuuuagaauggugcuguuaguguagcuucugcccuucauugggaaacauugauacaaggugaucuuguucauuauacauguguacauaugaauauaguuuguauccuuuacagaagccaagacaaacaauggacucugagguaaguauuuacaccuggcucaauccccaugcugaguuccuuuccacaguguggguguuuuugcuuuucagggauaggguaguggacagcacccugggugaagccuguaugcucccugcauuuccugguuuucuacaguuucuucucaugccucucaucucugcuugugauggcaucuuagguguaugaaugauucagguuucccaaaaacugaggcuccuaaaacuuuaugcuuaccuagcagaguacagccugaaaagccaagaaaacaaacaaacaaacaaacaaacaaaaccaaaaaccaacaacaacaaccaaaaauaaaaacacuuuucuacccugucuucuuucaaagguaaguaacaaagauuucuuucuuucuggacauggaagugguuuucccaccccuuuuguuaucauuugccuaaugugguauugcuauucuaugcucugaguuguaaagucuugcacauuuugccaccugguaugcaguuguaaagccaaauuucaacuuuucauaugacucagaacucucacacauauuucuuacuucuaagaaucugaacuguuauuuguaaucaaacacaugguaacaauuuucuuaucuauuaggcacuucagauaauccaugcaaaucuaauugaacucacuguaagauuagaggacagcuuccaaguuauuucacaaguguuaacuugaacuuaacaauauguuggauuaggaucuggaucaauaucugugagauucuuuuagcucucuaccccucaaauuaacuuccgacauggcaucugcuugaucccugcuccugguuugauuucuucaguguucuggcaagaagaagcaaaccugaaacccaaagcaacgcgucuccuuaacucaucugcugacacgauacuccuggggucggugccuggcuucagcugugcuguuugcuucgcugguggaaaagggaaacuacuuuucuaaauaaaauauaacuccacaagaaauaacaguuuggugaaaaguugggaagauccuagcuauaacucucagugaguucaggagauaaugucaagaaauaagugugugcccauauguuauucaaaaaaacaaaccaaaccaaaccaaccaaacaaacaaacaaacaaccacuacauauuuaauucagcuagguaugaauuguugagucucuuuaaaauuguccugcaagaagcgcaggaugaagggcagcacuggugcuaguuaaccacgggacauuuuagauuuaucauuauaggcuggaaaauucuuaagaugugucugauaauaaaauccaaagguucuccacugug

SEQ ID NO: 1702 - RNA, 349 nt, Mus musculus
agaaguggcucuccuccgccagaucgccgccaucauggacacgaguugcgugcagccuaucaagcuggcuaggguaaccaaagugcugggcaggaccgguucgcagggacagugcacgcaggugcgaguggaauucauggaugacaccagccgcucuaucaucugaaaugucaaaggccccguucgagagggugacaugcucacccuauuguagucagaaagagaagcucgaagguugcguuaaucuugcagcuggugggguucuggauauccacuacuuagcccauggaaugaucugcaacuguuaaauaaagcauuuauauuuaaaaaaaaaaagaaguggcucucu

SEQ ID NO: 1703 - RNA, 349 nt, Mus musculus
agagagccacuucuuuuuuuuuuuaaauauaaaugcuuuauuuaacaguugcagaucauuccaugggcuaaguaguggauauccagaaccccaccagcugcaagauuaacgcaaccuucgagcuucucuuucugacuacaauagggugagcaugucacccucucgaacggggccuuugacauuucagaugauagagcggcuggugucauccaugaauuccacucgcaccugcgugcacugucccugcgaaccgguccugcccagcacuuugguuacccuagccagcuugauaggcugcacgcaacucguguccaugauggcggcgaucuggcggaggagagccacuucu

SEQ ID NO: 1704 - RNA, 2506 nt, Mus musculus
ugccagacacgcagccacugaaccacaagcagcucggcuuuaacuggagugccuuggagucgcgugccagcagccacacggccagggacugacugacagacaaccacgcacgagaacgacaacacacgagacucgggcgagcugccgcggucguccgggcucuuggcaaagucgcccagccgagaggcccccccgcggaggugcgccuaggaagcgccaagcccgcggcgcggaggacaccgugcucgguuccgggcugcggggacauucccggacacacaccggagcagcagcugcgccgcgacacaucuggagccgcguagguaagugugcaugccgcggcucuccacuucgcaggcaguguccccacgcaggcucacgccgcccacgcuaacuccaucgcucuagacgcagugacuucugugaccggcagaagguggcucgagcccggggcgcuccuccccagcucuguccucgccaucuucgcgaaugcacauugagggagauggagggggggggggcggggcgcggcgccagcgacacuuuacccuguccauucugggaauaaauuucaucugccucuucuuucucaggauguucgucaaaucugagacucuggaguugaaggaggaagaggagguacugaugcugcugggcucggcuuccccggccucggcgacccugaccccgauguccuccagcgcggacgaggaggaggacgaggagcugcgccggccgggcuccgcgcgugggcagcguggagcggaagccgggcagggggugcagggcaguccggcgucgggugccggggguugccggccagggcggcugcugggccugaugcacgagugcaagcgucgcccgucgcgcucacgggccgucucccgaggugccaagacggcggagacggugcagcgcaucaagaagacccgcaggcucaaggccaacaaccgcgagcgcaaccgcaugcacaaccuaaacgccgcgcuggacgcgcugcgcgaggugcugcccaccuuccccgaggaugccaagcucacgaagaucgagacgcugcgcuucgcccacaauuacaucugggcgcucaccgagacucugcgccuggcggaccacugcgccggcgccgguggccuccagggggcgcucuucacggaggcggugcuccugagcccgggagcugcgcucggcgccagcggggacagcccuucuccaccuuccuccuggagcugcaccaacagcccggcgucauccuccaacuccacguccccauacagcugcacuuuaucgcccgcuagccccgggucagacguggacuacuggcagcccccaccuccggagaagcaucguuaugcgccucaccugccccucgccagggacuguaucuagagcugcgggucucccucucucguccucuacccggcccucuucccauccuucucccgccccucacccuccacgccccggacuccacuucacagagcagagguggcccuugcaauccccucggcggcuggugcauucggggguggagaccagcucugguuuauugaagaugugaggauuuauggucaaagaggacuauggcgugugggagugggggcuggcguggggaaccucguaagacuguaaaagacacugagaaaaaguaccauaacuaacgagugugcagagcagacugacgcuccuccccucucucagagcugcuggaggagaacuccgggcaggcaguucgugugaaucucucagagggaaugcaacuggucccugugaucuuuucaccuucguuucuacauagagauguuaaugucagucgaaagaaauguauuuuagcaucugaaugaauuuacugguaauaauauuauccacacauuugcaauggcuggcaucugcucuauucccauugcugucugcaggcugugggaauuucaccugucaaaccaaacuuucccucucugaugugcacuuuguuuuuuucccagauucgucacaaugccuauugucccgcccuucuuuuugcuuuuuuucuccauuuugccaucugucucuuaugauuuauaagggggaaaaacuuguuuuguuagagggccagguuagaagucauuguauaauuuguaggcuuuuguaaggguugaaugcaagcguggaaauuuaggcugaauucucuaucaaaagaaaaaaugugaaggaaaaaggaaaaaucaggagggaggauugcuucaugcauuauuuaucucgaccuuuuaggggagaaggaacucccccauccuuucaagagauuaaaaauaaaucaacagucugaaaaccuaagcagacacggggcauugccaggaucagccacacacguguuuccuucuauuuauuuugaagaaaaauuucaugggaaaguauguauuuuuuuguauauucuacagaguuuauucuaguauguauuuacaucccgaagaauaagaaaauuguuuugugauuaagcuauaaauaaaguaucuaauuuucauaaguuuguauu

SEQ ID NO: 1705 - RNA, 2506 nt, Mus musculus
aauacaaacuuaugaaaauuagauacuuuauuuauagcuuaaucacaaaacaauuuucuuauucuucgggauguaaauacauacuagaauaaacucuguagaauauacaaaaaaauacauacuuucccaugaaauuuuucuucaaaauaaauagaaggaaacacguguguggcugauccuggcaaugccccgugucugcuuagguuuucagacuguugauuuauuuuuaaucucuugaaaggaugggggaguuccuucuccccuaaaaggucgagauaaauaaugcaugaagcaauccucccuccugauuuuuccuuuuuccuucacauuuuuucuuuugauagagaauucagccuaaauuuccacgcuugcauucaacccuuacaaaagccuacaaauuauacaaugacuucuaaccuggcccucuaacaaaacaaguuuuucccccuuauaaaucauaagagacagauggcaaaauggagaaaaaaagcaaaaagaagggcgggacaauaggcauugugacgaaucugggaaaaaaacaaagugcacaucagagagggaaaguuugguuugacaggugaaauucccacagccugcagacagcaaugggaauagagcagaugccagccauugcaaauguguggauaauauuauuaccaguaaauucauucagaugcuaaaauacauuucuuucgacugacauuaacaucucuauguagaaacgaaggugaaaagaucacagggaccaguugcauucccucugagagauucacacgaacugccugcccggaguucuccuccagcagcucugagagaggggaggagcgucagucugcucugcacacucguuaguuaugguacuuuuucucagugucuuuuacagucuuacgagguuccccacgccagcccccacucccacacgccauaguccucuuugaccauaaauccucacaucuucaauaaaccagagcuggucuccacccccgaaugcaccagccgccgaggggauugcaagggccaccucugcucugugaaguggaguccggggcguggagggugaggggcgggagaaggaugggaagagggccggguagaggacgagagagggagacccgcagcucuagauacagucccuggcgaggggcaggugaggcgcauaacgaugcuucuccggaggugggggcugccaguaguccacgucugacccggggcuagcgggcgauaaagugcagcuguauggggacguggaguuggaggaugacgccgggcuguuggugcagcuccaggaggaagguggagaagggcuguccccgcuggcgccgagcgcagcucccgggcucaggagcaccgccuccgugaagagcgcccccuggaggccaccggcgccggcgcagugguccgccaggcgcagagucucggugagcgcccagauguaauugugggcgaagcgcagcgucucgaucuucgugagcuuggcauccucggggaaggugggcagcaccucgcgcagcgcguccagcgcggcguuuagguugugcaugcgguugcgcucgcgguuguuggccuugagccugcgggucuucuugaugcgcugcaccgucuccgccgucuuggcaccucgggagacggcccgugagcgcgacgggcgacgcuugcacucgugcaucaggcccagcagccgcccuggccggcaacccccggcacccgacgccggacugcccugcacccccugcccggcuuccgcuccacgcugcccacgcgcggagcccggccggcgcagcuccucguccuccuccucguccgcgcuggaggacaucggggucagggucgccgaggccggggaagccgagcccagcagcaucaguaccuccucuuccuccuucaacuccagagucucagauuugacgaacauccugagaaagaagaggcagaugaaauuuauucccagaauggacaggguaaagugucgcuggcgccgcgccccgcccccccccccuccaucucccucaaugugcauucgcgaagauggcgaggacagagcuggggaggagcgccccgggcucgagccaccuucugccggucacagaagucacugcgucuagagcgauggaguuagcgugggcggcgugagccugcguggggacacugccugcgaaguggagagccgcggcaugcacacuuaccuacgcggcuccagaugugucgcggcgcagcugcugcuccgguguguguccgggaauguccccgcagcccggaaccgagcacgguguccuccgcgccgcgggcuuggcgcuuccuaggcgcaccuccgcgggggggccucucggcugggcgacuuugccaagagcccggacgaccgcggcagcucgcccgagucucguguguugucguucucgugcgugguugucugucagucagucccuggccguguggcugcuggcacgcgacuccaaggcacuccaguuaaagccgagcugcuugugguucaguggcugcgugucuggca

SEQ ID NO: 1706 - RNA, 578 nt, Mus musculus
cagauuuucaccuguucugucaaggcccaaaaggaagaccaaacacagagacagaagcuuuggcguuaagucaaagcaggguguguccaggaggcagugccgggugcuuacaggagaucguaccucccgagguaaguccucagggacagggagccugcacgggggcggcgggcaccaccaccaccgccgauccccggccgcgcaucccgggcaucccgggccugcgcugccgcuuacccuccgcccgcucgcugcagccgacccgcuucccggcggagcagcccgaagcauugcguccagcagcaguuccccaucgcaugccgcccggagccgccgcuccuccuccugccccgagcgcgagcccaggcggagcagcugcauccgcgccggccggagcucggcagacggcgacgccgggaacaaaggccgccgcuaggcccgcgggcuccgggcuaccgcggcgcgagggacgagcgcagggccguggggucccgggucuccagccguccgcauggcccgcucgccacccgcccggccgcccgcgcccgucaccgccccggcagccgcgggaggcccgc

SEQ ID NO: 1707 - RNA, 19719 nt, Mus musculus
cacggagucggagcggagggaagagagagggaugagagcgagggaggggagagagagugcgagaccgagagagaaagccggagagcagcagacagaaacugccggcgcccgcuagcuuuagcagccccccgcguggacccucucggaacuuggcacccucaagauccccgcaguuccacccagacccgcuccacggcgcuggcugugcagcccgagccucggccgccuggcagucacccugggaagcggugggacggggagacagccguucucucuccgguagccgguaaguggaggcccucucucccacagagcugugagauaaugcgagucuggaaauuuguuccacucuggagaaccuccgccguguaugauuuguggcucgccgggcuuguuucuccagauucagcgcaguuggcaaacagaucuuacagagccccuguuccguucgcccucaaucgcagacacuagaacaguccuacccggcguugaagucgacuggaagccaggcauggcuggcaguuaaaacgaggcaucuucccugaaauuucgaugccaacaggguagggagaaauccuccagcugaggauuagcccagucaagauaaagggccagcuacaaaguuucagcuacuggaauagauuagccccuucccaucauuacccauuggaaaaaaaaggagauuccaucuuaaccggcgguuagugaccucucaggcccaagcgaauuaccugagagccaggccuagaugccaacccgcacaauuacuucggauuauaaauccuuuaaauugaucaucagucaacuccaaucuuguacugagggagaugcauuuuaaacggaugcggagaggccacuauuuugcaacugguaacuaaguaaaaacaugcgauuccaaaccagcgaaauacaguccuuuuauuccaauuaaaucaccuucccuaaacaauuuagaaaucaaacuauccuaggaggcugggauauuuuuguuuuuauucuauuuuguaggacuaccguauuuuuuugagguaaauuaaaauggggagagagucuuuuacuauuaugaauuacaauaauaugcauucauacauucuaaacgauuuaacgaacaaguaauuugauuuuuaagagaucucugcauccuuuucagaccauuaguuacaauuaaagauauuuuauucucaugcaguaucauuuagaggagacuccaccuaaaaccaauaauuucacagaaacaaagauuguuacugaagugaauugaggacuuguuguuguuguuguuguuguuguuguuguuguuguuuggggggcguugaaaaugagcacaguauuccaauaaucaaaguuuaguuucaaaacaaaguagcuacuucacuuauggaauguuuugcuuugccucagcaaaacuacgccuaaguuacugcccugcuuuguccuguaagcugagcacuguagcuccaaagcuccagaagcacacauuccacagagcuuuaaagaaagcuugcucauggugaagcacggggcugugcuaaagugguaucuuaauuuccuuaaaugauuacccacugcaaauuaauuugcuggcuaaucacaccaauuuaguucauuuaaaacauauggccucaugcuuuuuauuuuucagcuuuccaugaaugguucugcugugggauaagaaaggaaaugaaaagggugaaaugggaaagaauuuuuguuuuuuuguuuuuuguuuuuuguguuuucuuggacugauuagaacucguagcuucuucuacaauuccauccuuguacugcuugggcagaaaucauuuuugaaacaaacugcucuguuucuuagggcuugccuaucugccuggccggaguggcacugugcaugcuaauugcuggauagugcuucauuaacacaauauggaauggaagcugacccaaaccagauugcuugguauauacauuccaaccaggaugggaacuuuuggcaugagaauaacuucuaaucaggaaacgucuccuaucuaaaauguugagauuagccaucaaaaccaguguuguaaucuggcagugaaauuugucugucacacguuagccaccuugauaggacaaguuuaaguaucaucagauaagacuugaaggucucucuuuaaagaaaaaaaucuuccucaguuaguuagacuggacccauuuauuaggccuggucguucuauggagcauaaagucucaggauucacauuacugcgaaauaaaauacaucucaaagucacaaggacguguagcaaggagcuaaggaacacgucuugaucuuuucacuccuugggccgaaaccuacggggucuugaagcguugcuucuuacugcuuugauuggucuucagcaccaaagcguggggggaugggggugggaggaaauguguagcaacugacuuuacaggucaggucuuucucuucuguauauuucaguccuugaaaauaaauaaauaaauaaaacuauuugcaguagccaucugcaauguuggggcuaccggcuaauaaugcagccaguucagacauauaaaaaaaaaaaagauuaucgaaaugaugaugccaugcaaauuucccccgaaauuaucauaaguaaacauuuggagucuggacuaauaaaaucccaucuguguuacuucauaucgaguuaguagaaagcugugauaaugaauuuuguaauaucucccgaacagacaucucaaucagacacuaauccugugauuuuacugcagaaucgcuaaaucuggagccgccaaacugcuacuucugggcccacggguccacaaggaucggcagaaucccuacccgggucucauuagcugggggaggggggaccugcuuguggcuccccagucuuggauccccaggccaccacaccaggcggccccuccuccaggcagcacgaccuuggccagaguccccuggagcuuggauugcuccagaagagacugaggagcgcgugaaaaugcuccugaggccaaaacucggcccacuggccuggcaaugcccgcucucaccuccagcccuggucucuaagagaaaaggauccuccgaucgcaggcauacccuguuagcaagagucaggagccaagauucagggggccugagaaucccuucuucccuuucuugucuugaaagcaaccauuccaucuagcccuccgccacccaccucucccgguuugccuguggcaaagaaaaggggccgcgucaaaagcuuggcugucugaguugcgguuggaaauuugaaaaggaucuagcuugccugggacggcaaaggccgaaacuggaggagcagccuccucggugcuguuugggcuuggcggccccuccagaaacgcuugcccgggucuccugucucgcuccagcccgucguguaacucggcucuacgaucuuaaaucauacuuuaggguaaauaaauggcuggaugaguaucuccagggaaaaguauggcuaaauauggaaacgcggcuccugguggaugagcggcccuaacucagcucgcuccuggagcacccuuggccgagaguucccucccuuucagaauaacagaaaagcggagggaaaguugcuuugugcgacccggcaugcuguuucuggccuucugcaaauguuugcugagcucaaauugacugacaccguauugaauggcgaucuuuccaaagagaaguccauucucuccacccccaaaucguguaucagcuuaagguggcuccucggccuaggcgcccuugaacguaguccccgcagcuucuccagaagcuuguggguucacuggccuccuaaccucugggcccuuuccccuucaacuggggacuuaauuccuccagguaaacaucucggugggaguccuggauuuagagcccggaagacguugcuggacuccguggggcucuccggcccgagaggcgugccugaaucccccagcaccuagcagcacacuucacaccuagagucgauccugaccuccgcgcaaguagcuagcugccuuugagccuccaacucccuacagcugccacuucucaaagucccacuucucuucuguuuugcagauaaccgggaauggagaccaauugucgcaaacuagugucggccugcgugcaauuagguaagaagcucacuucuccugcccgggucccuagaagggagucaggcugcgucuugagagagaggagaaggcuccggcucgacagcgaggcccccagcaacuggaacuuucuccagggggggguuaggcgaaaaggaaaucaaacuaguacagccguggccuugcccuuucggggagguuugggcucaggcgaacuagcaaggacugcucugacacuccucuaagcuucccgucggguggcccagggacagaucacugcccucacuggguugccaaggggccggagggcugggaguguggucuguccuuccucuaacgggcucuuugcucucugucccucuucccccuccgucccgccucgcccccuaacccugguccggggcuccuucccuccgcccuuuggcauccgcugccaccgcacguggggcgggcgcacuaacggcccaggcgugcagccggcagccguugaaugucucuucuccaaagacuccgaaaucaaaaaggucgaguucacggacucucccaagagccggaaagagucggccagcagcaagcuguucccgcggcagcaccccggcgccaaugguaaggggggagggaagcgcaggccgcgcgccgggcuccugccuccgggacuccgggcugccggugaagcacgggcgggcgaagcugccaaagccgguguccccugcugcagaacuuagacuauuggccucuggguagagcgcgaagcagccgucccagggacuuuaauuccuuuccacaaauuauacugcacuccugagacccaacaccucucccuuuucucucucccuguggucugauccccugcgcacgccccagccuacuacggccgcugcuucuggugugcaaagugguccaacagcgaccucugucgcucuccuggucccacugcacguugcaccaucagggcccacccggucccugaagcucacagccaagccucgcccaggcggcugggugcaguuuaucgcgccaggcgaacgcuggaaagucgugcugaaggcucgcuuugaagggucuggguuuggaccacagcccuaaagagcaggagacagaacgaugcacagcacaugagggccgcagcgauugggugcuccuguugaagagccccugcugcuguguuagcuguuaggccuugggcuugaauaauguaguuucuucguuguuugauuucacccuagaccaguccauaggcuugugcaaaaggugaaaaugucucucacgcacagcaaaggcccuggagaaauacaaacucauccuuagauaauguauguguguguauaagagauggaggggccuucauuuggaauagguguagaauucuaauuuacauauuuuuuucuagucuccggguuuucccagcuucaaaauaaguaagugccggaccuuaggagguuguugaccuuugauugugugaggagauaaaacuccccacagcccucgaccccaaccccuacacaaauauaauauugccagaggggguaauuuggaacugcagucaaguaaauaaaaaguauuacuaaggaaaaaaagacuuucugcggguaucugagcagaaagcagcauuuguugaaucaaaaacgcuuaaagcaaccugcagcuuucccauccugaguccuccugcugggucaguuaaaugcucacuuguccgggauuaaccccaagggguuaaaugggggcaaugcagagauaaugucgguugauuucugucauuaagauuguguuaaauucuucuucuguuugauaaucggucguaaaaauaaauuauuagaccggagaauguuugggauaugguuaaaaaucaagaguagcgaugaaucccagggagaaggcuuugugcaagcccggccuaggcccaggggugggggugggggggcagccgccgcccagcggagggcaaguuacauccuguggcuugugacccuagaacucgaccccaccucuaacccugauuucguugacccaaagaauuguuucugaggcuagguggccugcuuuggggcuaauagacgcagaccccgucaaggagucugcagugggaugauguccuuguagguaggcaggaugugucugagagccuacagaguuuaguccccgcugucaaguguccuggcauucgcuuuuaauaauaggagaaagaaaggaaaaagaaaaugguggggagagagagagagcgaauaugaauaugaauaugaauaugaagaauuguggcguuuacuugaaggacggauuauuuuaaagaguguaugaaagguucucccccuauauugccaaaaaugucuguuuuucuaucuuuuggacuuaaguuuuaaaaagcuguccaaauguguuuaauagcauucauuuuaaaaaggcauguagugggacaagauacugaaaaccuuggguuuuagcugguuugugguguguguguguguguguguguguguguguguguguguguacugauaaaucaaaaugaugaugaugacgaugaugaugaugaugacgaugaugauaacaauaauaauaauaauaauaauaauaauaauaauaauaauaauaauaauaugcaccaguaagguaaaaccucuaaucacugcgggaagaucaccagaguuaaguaccuuuuggagauuacagaaaauaauuuauagacuauacaaacuucugacuugaauuuaguuuuuguacuuuuaagguuuccuauacuuuaaaaaaugcauguuuuuaaauaucauguagugaaaaagaugaagccaguacacucccgugacggcgcccaccucuucuuccucaaauagccucagaugcagacucucuaagggagacuccccagauccguauucgggcuaaggcgggcuccauauaccaccacuaagcucaaaacuugaaacuggaggcaguguaggggcugagagaguuaaucgagccuccaggccuggcacuuggagggaggcauuuuggccaguccuauagaaaggagcaaaguccagcuaaagacuucacguauggcuacguuuuuaggaacucucaaauggucuugaccuucaggaagagaagagagugcagaauguuugggcgccguugcuauagaguagggcauaaagcccacagcacugccgggcuuggccucaaagucuguccgguuugcccugcgacaggcgcccaguacuucgcccgcuuucccuacccccagccaugccauuaauuuuuaaaaagcuuugagagacuggcugggcugaaaguauucugauugccccaaguccuagauuuuccccgccucagaagaaaacuccuaggucccucccgacacucugggucccuaaacaucccuucucccucggggguugggggucgcagcuuaaucgccuucggagaacgcgaguaaacucuggcccucgcuaaggcccuguuuuccucuugggcucccauucacuuaaucagcaaauguuggcgaaacucgaacgaugugaacuccuauucuacccacaaaagcaaaacgaucugguuuccauuaugaagccgcuuaaagcggaggccuucuaacauucaaaccuucuggagcaaaaggcaaaaugguggugucuggaggagggaucugagcccugaggaagaagguugugggggaaaguggagcgaucuuggauguaacuggaaggcaaggugcaggugcuagcuggaggagaucugaagcuugcaaaggcaaagagacaggagaacuggguggugacaguuaucuauuuucuuuuccccacuggacaccaccuccgccauuaaaccugcaguuuucuuggcagaagccuccucucuuccugugguuuccaaccacccccaccccagugggaaauuguaccagauguccagguagucagucccugaaggucgguggcaagcauucuuugcagguggcgacucucccaacccguuccauucucacucaaaguuucuuuaggcugcuuaggcgguuacuccgcacagacugcuguuaauauaugcagcaguuguuagagcgacuccggggaaaaggaaauguauaacgaaagcuuauucgugagcaggaauauacuaauggaacaaucugaugucuucuuaauccuauguaaaaagcuuugucgucuuccuaauauugacugaauggguaauuaauggcucuucaucuaggcgaauacccuguaauccaagauaggcaaaagacaacagcccaaguuagaagacaaaaggcacggcugcagccacacaacccuccccagggacucccacugggaaaguuucuuccccugggaaagaaagaaggggugggggacaagccccauccuuccugggcuucacuaaccauagaacuugaccauggauggguuccgugcuccaaaacgcagcuuuucucucuccaacucuucucuuuuucuucuuaacuucuuuaagaucuccccaucucaaagccaucuaagaauccacacacacacacacaaaaggucccuuaaaagccucaacacuggucaaggccucuuuuggcuccaggacacucccuucuuuuacaaaccuggcuuagaguccgucaggacuaaagcaucggagguaaagggaagaaaagccuggaucugagcaaaggcacgcgcgcacacguacaugcacacgcacgugcacacacacacaagugugucugugugcugaagaaccauuaggagugauggagucaacgucuuugugagagccugacauggagugcccaagauucucccaacguguuuugaacaggcugacauuuuaauuuaaaccuuuagaguaauacauuacuaagguuacuacaaugaggugggcuccuuuuuuuuuuuuuuuuugucagcugacagcuuuuaaaauauuauuucgcuagggaaauaaaagcuucaucucagauuauagguggguauuuuuggauuuaugugauuuauggucaccauggcaacuaaugccgaauguuagcuaccagcaugucugggaaagaaagaaaggagaaugggagaaauaggaaaaggaggugaacaugaguuggagagaggggauugauuuaauccaauuauuuuuuuaagugacuucaguuagccccugcaccuccuccucuccaaaccuggauaccugaauuuauuuucauuuucauucucuuccuguuggggcuguucucagcuuuccucuccucuccugaaucuaucuaucucucucucucucucucucucucucucucucucucucucucucucucucucucucucucuuucuuugccccucuuuucuccauaccgcaaagucacauuuaacuacaccaaucucacaggucagugaauugaugaucuccagaaacaagugugugucuaauaaaccugcccugcucaggugcaaauacaggaggggcacuggcugcucuuagguuaguagguguuaacaccagccucccugcccaucacugagcagugggggguaccucccacuggcacccucacaacuccuuugacugucagaguugagcuuuuccacaggggcucuggcaagggcagagaaacacagcucuguuuuuauggggcugcaguggaugagugucaguuaaucucugaccuucggaaacccaacagaaucguuaacaagcccaaccauuuuuguuuuguuuuguuuugucuuuuguuuucauuuacggaacaagcaaaaucauccacagggaagcuuuuuauuugggagggaggucacucuugugagugggaggggaaggucaagccugguuuguguccaaacaguugaaagaggggauaagaggccacuucuuuggguauggugccaggucuccucuuccaccaacacacacacacacacacacacacacacacacacacacacacacacacacauuacccaucacguggcugaguccuggccaggcagaauccuugagccaccugggaauaagcugugcacacaccccuuuaugaccuaacaguucagggagaccucuaauugagccaucuuccaggugaguucugagggcagagucuuuacaaaauuuaaagacugauugauugggucccagcucauacuccacaacuaccaaaacggacugcccagaccuacccagaccuaccgcuuaccgggauggcuggagggaguuugcccaacuaacacuaaagagugugaaauuaaauaagacuuuaagaccuguaaucgguggcaaacaccagcugaagacaugccugacccugcguuccauacuucccucccggagggucuuucuuugaagggguaagcaagaaaagaaaacccaauuaaggugaccacgggugccuccuaacaccaagcuuccuuuccuuggccucagagaagauauauagcacaguccaagccucuccaaucucucucucucucucucucucucucucucucucucucucucucucucucucuccucccucccuccgucccuuccuuccuuucuuucccaaccuuucuuucuuuuuuaaccuugaauagaaaacucuaaugauggcuuaaguugccgucauuucuagagacaaucaagaagaguccauguggguucacaguacuacuaaacucccuucagguaugauuugacuuacaagaccuucuucaucuaugccaccuaugacaucauugcagagcauaguuuggucuccaucacacacacccacaccuacucuuccuugaaaggcagacauccuaucaggacugcuuggcaaguauaaagcaaguuaggagagggucaguuaagugaaaaaauauuuuuaagaaauacauauuuuaaucaguugugugugcgcacgugugcucaaauguauauaugcacacaucacugauaugcaauucugucuuugcucuaaucaauguggaugucuuuauucuccaccucggugguuccacacaaucuaaauuucucucuauuugucuuggcugucugugcaucugugucuuuccaaaaaaaucuccccuacuuuggcacuauggggaacuaccacuuaaccuugaguuuuccauccaucugggggacuacuugagccccuccucauguguaguuuuccauaugaacauccugcugcaggaguggagcuggcagagcucaagcugagaaucucuacguugaaugagagaugaccuugaaaaucuguacgacucuuugcaacuccucaguuuuucugaaaaggacaguuaaaaagaaaagaagagaagagaagagaagagaagagaagagaagagaagagaagagaagagaagagaagagaagagauaagaaaaaagaaaccuagccucaaaaauagacaaauaucauuagcaacaacucuugccacuccagaauucaaaucuugagacaaggacgccuguaaucuagagaaccuucuaucuuugaugcaaacgagucuacaguaaaaugaggcauugugggagauggcacugggaugcccacaguuauacugagguuuaaaaggagaaacuagaauaggauuaguaaacacguuggguagaaagaucuggauuccuauugacuuuaguuauaggucauuggcuggcaagugccaggagaaaauauuuacucuacacauauacuuuacgaacuugagggaauuaaaggaaauucaauaagaaaauggcuagaaacauugaaaacccuuauuuaagagacuuaagcaaauuagagucuuaucagauuaaaaaccacuacaaauguaagaacauugucuucaagcaaacgcuguggggucugaggagauucucccgcccccgccaaaucucagggauaaaaugcgucauuuaagcaccagauaaugaguagaauguaaauuaauuuaaccuucuuuaccaacaggcugcugguguaauguguauaauuuagugauaagguuggaagaccuaauguagcuggauguaugagccucaguuaauucaggccugccacacgggcugguguucugcugagcaggugcauguguguguguguuguguagaacagggugaggcagaauaaagguuaaaacucagaaugcugaccuaaagcuuagaaagaaaugucuaaaugucuaaaaaaucuaaauucuuaaaguggaacgguaguauugugaaaagacugaaaacaauucucauuuguuucuuugaaaggucuugggugucuuuaagaugagagggauugauuguugguaguguuggggguaagggaaaagagagacagauguuauaucuguagucagcuucaugugcuuagugccuggcuaaguuccccagucuugugagcaagagcuaggaaggaguuugcugaagauuccuuaugcugggccugcaaaucauugacuauaacgucaaacaaauuacauucagggaagauaacacuaaguccaccgugaaacaaucgcaaacgcagaaaucuggggaggggaguagauuacucuggguucuucagcugaccuaggcuggggggacaaaagagguguguguguguguguguguguguguugccagaucucaaacccagaaccuccugggugcuagggaagugugccaacaccgagcagaauaccccccccccucccccagucccacaaaggacuuagaacaauuaucuugaauguguuugaauuuauaccuuuggaacuuaaauuuccuucggacuaaugcugcacagggcuggccccuccgugggugaucuguuuuguuuuauacaaaugaaaaagauuuugcuuuuccuacuuggccaguucgcuaggcuccccaccccacccccacccccagugcaaaucuacuguuucugccuacuugugcuuuaaugauucaaggcagccuugagcucccuaggaaaagaaaaugacuguuaaagaaucauccuugaaauuggucauuuggcaacguucuuaauuguauggaaauucauuaaggcauauuuucuauauaauuagcucaagguuguugauucuaccggcuaaagccuggauuugaaucugauugauaauaaaguaaacaagagagucgaauuuaaagcguagcuucucucuggcuaggacgagcuuaauacagugugcaaggaauuugaaagacguagguugugucuuaaucaacguuaaguagaauggauaagcuuucggcauuuugaaaacgcuggguuaggguuucuacucuauugugaguuuucugucuggggacuaauaagcauuacagaggacgugaugugaggcgacuuauuuuauucauguauaaauccagagugaaccaccaagcaguuguucgacuaaagucaagguaauuuucuuuugacggguccauuuucuucucgauuucuaauuuauuagccugccuuuucaagacucugucuucuuugcaauuaaaguaaagcuuccucagauuagcgcgacauucaccugacaggcgaaugggagggagggcggaauuaagaugagaaaggugauuugcugauguuuuuaacuuuagcuuuagguagcacaucgccuuucuguccugaccugggguguggaaguuggggggggggggggcuggucuagaaauggauguagugagacacaaaaggaagagagggggugcuugcuggcuaaaccuauaccucucagucuuagacuuucuugcuucuuuacccuaacccucugauuccaagucuccucucccccaccuuauaguccuaaccaaaagccgaauagccuuuggcugggcaggagcagaauucccaggagcgcgccuguguagaccgggugggcacagcaaggaauuaguugggccucgcacugcugauaggugcagacagaaccaucccucugccgcggcucggggccucgugauugguguggagccacgucacuccgacccgaagaagggucugggaggaggcggaggcggggagagcuggggagggccgccgcagagugacgucuugccaccaggaagcccgccucugguuuuaagauguuaggccaacagggaagcgcggagccgcagaucuugccggucucucgcuggggugucuggaacugagcugcggcagggucuggcuccagcucgacugcccgagggggugugcgugcgagccgcggagggugugcucggaggcccgcgccguggcuguggccguggccguggcggcugcagccgccucggggaaucuaauaucagcuaccugucccugucacucuugacacuucgcugucagggcugcagcgcggggggcgggcaaagcgcucucguagcuguccuuauuggagggguaucaaggggagggagggaggcaagaaaagggucuuugcccauucuuguuucgcuuuggaucguggaagucggcucccuaaagaggcucgcagcgguucccuccugcccacguccccacgucugcguuggccccccugccuuucggcugccgaacucuuuuuggcuggagucugaagcuagaggagacagggcuggaggauucggcaguuugcguucccuggcucuuucaagucucggcuaacacggggacacuuggcgccuagagcgcuaccgagaaccggcggccaccggggcuccacuggcgguagcccuggacucauagggcuccgcacucccucguccaugaacugcaugaaaggcccgcugcccuuggagcaccgagcagccgggacuaagcugucggccgccuccucacccuucugucaccauccccaggcguuagccauggcuucgguccuagcuccuggccagccccgcuccuuggacuccuccaaacauagacuggaggugcauacaaucuccgauacuuccagcccugaagucgcagguaaggcgccgcgcugccccucggacacuugagcgcagcccccuggcgccucccggcccgcucgacccucgaggaagucgcccccuccuagggaaggcguggucggaguggucguucuguuaacucaagggagaacuuccgggauucuggauucuggugaccccgucccuuccauucaguccccugccgacuugguucccucccacgccgccgagucuaccuuggucuuccuucaguuucuugggucacggaugccucggcauuucuauucaagggcguucagaggccgccccaacucugccccccuccucuuguuagcuuuuaccacccggggagccucacgccuuuaaaaaguauuucuaaaauuacuuagaaaggccccuggcaacgaagcaaaucuccccaccccgcgaggagcuggaggacuugcguuccuaacucuauccuaacaucuacuuuccuaguccuccaaagccucauggaaaucugagguuugggguggggugggggugucuguaaaacacgcgcauguucgugucuuaaaaggauguguuucuucucaacgguguauacuuuugagcaaaggcuauaaaaaaaugaauguaccgccucagugagauaaacguguaaauaaaacgugcggcgcugggggaggggaagaaauggggcgcacacacccacacuuucaccgcucacccccagacacagcgcucccuaaggaacggaggugccgagcacagaccuuuccccggccagcagccgggcucuuugccgccucugccacccgguccgguagagagguuguagaugggagucugacccgaaacuauguguuucuuucugcuuugcuuuuucagagaaagauaagggccagcaaggaaagaaugaggaugugggcgccgaggacccguccaagaagaagcggcaacgccggcagaggacucauuucacuagccagcagcugcaggagcuggaagccacuuuccagagaaaccgcuacccagacauguccacucgcgaagaaaucgccguguggaccaaccuuacggaagcccgaguccggguaggagccagcacccaaucugggaaaacgagggggccgaggccuugccaagaaucagagccugcagaucauggguggcgguaggagugguggguggaaggcagggucaccccuuaaggacgugggugggaagucgcuuuagaagaagaaagggccgaaggccuccagggagcgagugugcccgagguuacugcucccgguucccaggcagagcugccgccuggcgcaggcgccuacaaccucagcggcucucugccggcccauccggcgcccucccaagcuaagcugcgcgggcauuccucagcaaagggcauuguguucccggcuuaccgucgccagacaagcgccaauaaaaucccuccccgccaggagcugugaacaggcuccaaccugugcuccuagaacaagaaaacccuccagaaacacgcaaggcuuggcuucacuggagaaccuucgcgccuagcccggcccagccuuuucucccuugacuagcaagaguugcucgcuggucuuuaccggggcggguuuuucagccauucagauuucucucacagucuauuaccuaguuuuguaaaucuggaaguaacgacuauucuguuagcgcuuuucgaaaaaaaggagaagaaagacguuucaauuugguuuauuuaucuucucaagaaaguucagcucagugaaggcugugcucacaccccuugcuuaauuauagucauagauuuauaaagacagcuuaccuuuacuuuguagcaaaucugccccuuuauggacuggccaaaaagaaaaaagaaaaaaaaaugagcuuaaacacauuacccaguagcaguauccugguuuaacgccggucgguuggaauguucaagauuauuaagauucugaaagagggacucagcagacuccagaaccgccuguuuuagaaaacacguucuguguagaagaaagaaagaaaaggugggggaggaaaaauaaaaagaaaaauaaagaaauugucaggcaacgacgaaaauuaaaacugaagagaauucccaacgcaaagagaaggaagacgcagucaguguagcucugaggcuggcuaggaaaugcggguugauaaaggagccgggaagccgcggagagugguuuuaguuuaacugcccggagccagcgcucgugcaggggccgcgugguuuugagcaaggucagucuuucauuagcuuucuuuagcaucagggaacgaugggacuugcacguacucuucucgccugggcaaaguuuagaaggccuggaguagaaaugacaaguaauuaaaauaaagacacaauuugucuuucacugaaaucccuggggagagcccucccaccccacccgcuuuuccucggcccuguuccucugcagcgggugcgcgcuccaaaggccuacuuccaaacgcuuacuuuuuagccaagugcgugaggcuugcuucuuauagcaaucagguguaaagaggaaggggggcggaauaggaaaucaagaaugaaugggaaaagaggggaaaaaagcggauuagauggcugggcgcgacggagauguguaaugugaaacaucaccguugucagcccugggcuguugagccaggccucucuccaauacacaaaagcugcucucuggggcgacuggcgggccgaguguggauuggaagagggguuguggcggggccacgggacgcggguggggggugggggucggccagccucccgcaaauccacaagacagacuggacccgugcuaagcugaguccagaagcuggcuagguuuggguaagaggaaggugauacagaucaaaacgaaggaagguagagggcuaugcucacugguucagaaaucccaguuuaccguucuuggcuccuggaauuuaacaggcaaacgacgagguggucuuuugcuuuuuauuugguuauuuuucuagggcauccggguccuagcgcuuucggggaggugcgggguaggggguggggggggugaguuuggacguacuggagggaagggaggggcugugugggaggagagucgguacccucccaaggcccugguccucauuacuggaucggugguuuuggaauagaagcaaguuugcaagguucgggaagggucccguguauuuuacacuguuuuuggacccccaaagagggccuagaggaucaaggggcacccuaggccgccaggcauucugugaaguugauggcuucuguggcucccagaacugccagcccagacuccuggguuggagagggugaggccucuagagcuauacuaaggcuugugacaagcaccagggccuuuuagcuauugucagugccuuccacgccgcgugguguagacugcauggaccugggacagcaagaguccaugugcaugcuugcaagguccaguguggcccagguuggguucugguacuuuguuuugagacgauuuuuacgaguuuuaaacucauugucccugugcccucugucucaucccuaucugcacuaccccagguuugguucaagaaucgccgggccaaauggagaaagcgggaacgcaaccagcaggccgagcugugcaagaauggcuuugggccgcaguucaacgggcucaugcagcccuacgaugacauguaccccggcuauucguacaacaauugggcugccaagggccucacgucagcgucucuguccaccaagagcuuccccuucuucaacuccaugaacgucaauccccuguccucucagaguauguuuuccccgcccaacuccaucucaucuaugaguaugucguccagcauggugcccuccgcggugaccggcgucccgggcuccagccucaauagccugaauaacuugaacaaccugagcagcccgucgcugaauuccgcggugcccacgcccgccuguccuuacgcgccgccgacuccuccguacguuuauagggacacauguaacucgagccuggccagccugagacugaaagcaaagcagcacuccagcuucggcuacgccagcgugcagaacccggccuccaaccugagugcuugccaguaugcagucgaccggccggugugaaccgcgcccagggcgcggggauccgaggacugucggagugggcaacucugccccagaaagacugagaauugugcuagaaggucgugcgcacuaugggaaggaagaggggggaaaaaagaucagaggaaaagaaaccacugaauucaaagagagagcgccuuugauuucaaaggaauguccccaagugucuacgucuuucgcuaagaguauucccaacaguuggaggacgcguacgcccacaaauguuugacuggauaugacauuuuaacauuacuauaagcuuguuauuuuuuaaguuuagcauuguuaacauuaaaaugacugaaaggauguauauauaucgaaaugucaaauuaauuuuauaaaagcaguuguuaguacuaucacgacaguguuuuuaaaggcuaggcuuuaaaauaaagcauguuauacagaaucaguuaggauuuuucgcuugcgagcaaaggaauguauauacuaaaugccacacuguauguuucuaacauauuauuauuauaaaaaugugugaauauaaguuuuagaguaguuucucugguggaugccuuguuucugaaacugcuauguacgacccauccuguguauaacauuucguacgauauuauuguuuuacuuuucagcaaauaugaaaaaaaauguguuuuauuucuugggaguaaaauauacugcauacaaauugg

SEQ ID NO: 1708 - RNA, 2769 nt, Mus musculus
caagguauauggucgcucgggagcgaagaagcagaggccaggagagggugagaagggaugugaaggggaggagggcuccuacugcccagggacuacagccgcugggauagcugcuaugaggucgcgcccugacuguguugggaccgggaccgccggccaggcugaggucccggucccuauuggugcuuguagggccacccaggggcgcaagcgcuagguuccgcgcaacuucacugcugggcccugcguccauccaaacugccccgcccaaggguguuggacuccguauucggggcuacuggcugcaggcgcuggcaggaagcagggggguuuguccagcugcugauuaggauagauuauguuguuugugagacacggaaaaaccaugcugagacccuggacuugcguaggugucccgcgggcuuccauauucuucuacuguaucagaaaaguacgguuagauugaagagagcuccgacccauuaccaccgcccauuaaccuccagacaaaaaccaaaaacgguaaaacaaaaaagucaggauauucaggugaagcggcuucggggaucggugggcagucacagagcugggcuguaccgagccaccaggucuagcggcccuaggaggagcugcuggcuugagggcacgcucagguggagccgcgguaucuggacaauccgagaagcuaagcucugugggccggguggaacggaacuccaagguccaaaagguccuucccagcuacccgggaccugguguuugguaacuggcaaaccagaucagcuaugcuggagaaggggaucgaagcuugggaaccuccggacggggaagcuggagucuggaagggcggcccagcagucgcagccgggauccacccuuuugaaacagauaaaacacuaccucgucagauaagaucaacugccuccauuucuggauuuaagcagggaccccaggggcugcggcuggugaagcccugggaaugaagacucaccuggggcccagagcccgcggagagacuuuauuucacuuucuuuuguuugauauuacuuuauuuucaaagagaucuguagccuugggcucuggcaggcaaagccguguccugaggacagccugcaggauccccaccucuguccgaagacuucuccucccccucccccgugcccgcacgcagcgaggugaagccagcugcuugggagacaggcgguccagcaaacgcaggcuucagugcgaagggacucccgugaaaguccugccucuucauccggaagaacaggaaaggauuccaucaaaguguccucuuuuuucccucccucccucuccuuccgugcagaaaucaacccaugggugauagcuaccccagagacagaguugcagggacuguagacaagaggcagagcaggacaaauggacugucacuugaaugaguucugaaucaagacagaaacccugcccuacuguucuuucgcggacaguucaaaggguccuaggugcuaccaucucaaacggaccuugggggcugcaaccagcugcuggcugaaggaagcaaaggggcuuuucuaguucuugaacaaggaagcuguggccaggacucuaagaaaaacaacccccaagacuuaaucuuggugcaucagccuucagcgcuacaggccauuuucuaaauugcuaggauugagaacaggaggaagaaaacagcaaaagaaaacaaaguaaaaccuuggcuggguacaaagaagacaguaagggggcgggggggggggaagaggagagagaaaaccgaaggagaccuuaaacuuuuuaaccagaagauuagguuagcuggaugggaagggauccaucaaaaucgcagggcgccucccccuccuacacguacacacagugauuggggagcaacuaauuagucucaacuucauuuauccucuuuuaaaaaggaagggggaagacaagcaaucccccaacacuaucaccuuaaaguaaauacuucuccauccagucauugaauguuuucaaagaguguuuuaaauuaaaaggaagcuagaugguucuauuaggcauccuucagcuaaguagcuuagucgucaagugucucccccuuuucuacaacuacuacaguacaucaccacaaaaggguuaacugugauuuuuuuggagcaauuaaguagaauuaacuacuuuaauggggguacuuuauuucuugcaggacuuccuuaguccccaaacaaaaucuaaaagcaacauuuacauaaaacauaaaguacucaguacagaaaugaaguuauguuuccccgaacacaauaaauccuacuucuaaucuucucagauagaaaaaucagcaaugaaaaggucucccuuuguggggaggcaggagaaaggaagaggggacaacuuugaagauuaacauaaaaccuccucgguuucaucugcuaaagucuguauagguaaaucagccacgugcucacagugacuuuaaaaacaucucuagaauuauuguucuuuucagauuaaauucaaacacaaugguuugggaggaugggugaggaaagauguucgcuuucuaauuucuccugaaaaaaaaaucggcuaccagagauaucuuuuuauuucuuuucagaccugcuucacugaccgagcgaguccaccagugucucuugcaugucagugugcuugcuuacauuaacugccguucgcggaggguuuauaaaucaaucagugggagucuauauucauaaagacacugaucugguuacaugccccccuuucuccucagcucua

SEQ ID NO: 1709 - RNA, 2303 nt, Mus musculus
ggaacuuucuuuguagucuaggcugcccuugaacucacagcaauugccucugccucugaagugccgagaugaaaggugucccuggugacacccaguuuggcaguaugcuuugaagugaacacauuguaaaguugguguugaggccagccugcaagagaguagagaagucugagaggucuaugaauuacaaacuucaucccacuaaaguucuuucuuggauuaagguagaggggagccauaguuugguguuguauucaagaucuuucucuaguaauaaguuccauagucauuuuauuuguuuguuuguaggaaagggucauauuccauauuaagguuaaaagacauuaauuaaccuuaauauuuuugugcaccgacucaggaauggaucaaguggggcuaaagcucccgagggauagaauuaucuaaucuaauagagaugagagguuggacauaaaccucucccuagagagaaagagugaauagcguaauuagccgagggaccuuguggcaccuuggcaugcuguacacacuuccugggauagcucauuagcaaauaugucucacuguagggcaucaauggagccuggaucuagggcagcugaaauauaaggucuuguuguugaggugagggcugucuauggguugccuggugugucucaggguauggauccgugcuguguggucugggugggacaaggugcucagcuucuucgugggacugccuggggggggggggggcaaauuguucuaggcguuguucuggcaucugcuugcuucuagacucccaacccccaccuggcgggcagauggagugucaauuuugagaguacagaguacgguugguuuagguucugauuuuuuugucuuacaaaguuagccggaagcuaugcuaaguccagggcucuccuuuccguccuaguccuuggcugucucauggccaugccaagaaacaaaauggaaggagaaggaaagagacacuagaaagcugcucuaagucaucuggguucaguuucaaaaaaccugaaagaagccgagugacacucagcacucugccccuugucuuaauuagaugaaauacccuuauuagauuacacaccaaguuaaacgcucuugagcgcaaagagcaagccguagguuaggaaggagagugcuguuuuaguauagauuuguugucaaaaauaaaugcugugaagauucaguauuaaggugaauuacuaggcuaaugauucauauacuaauugaauuaagauaauuaauguuucaggcauaguagacuuggcuuuuuaagaacagcuuaaaacauuguuuccucacaggcuaauuuauccugcaguacuauaaucauuuaaucuguucaacauuguggcuucuuuuauguuauuaaacgaaagggcaggauucuuuuucaaguaauuuuuaagggaaacauucuuauuauaggaauucauuauuaagauucauuuuuuaacaguuagcuaccccagaauaaaugauuaaaaacuuacacauugcuucauguucuaucaccacauuugucaguauuaaaacuaccgcuuauuaaacuuaagguuuucuaacuggaguaaagcuccgaacugaaguaaagugccaugugcccucuaucuaccucuuuagaaacuucuuccaucuagauuaaaaaaauaaaauuuucucuuuguuucuuucaguuuuucaagacaguguuucucuauguaguccuggauuuccuggaacuagcucuguagaccaggcuggccucaaacuugagaaugccucuaccucugccucugcugugcugggaucaaagguguuaaagucacuuccagcuugcuuguuuguuuguuuaugugaucacaacauaauuacaucuuuccccucaucucuucccuuccuccaaaccuuuccucuuugcuuucuuucaaauucaugacuuuuuuuucaauuguuauacacacaucuaugugcaugugcauuccuaaauacauaaauacagccuguucagucuauauaaugugcccuguguguuuucagggcugacccgauuggugugcccuuccccagggaagacuaucgcuccuacuugcagcguuccuuuauuuaguucuuuguguaggguugagaggccuuccuggcuuuucacacuuucuaucgaguaagauuaagcuucuuucauuuuaaaaauaaauuucaaugccguugucauuuaagaugaguacuguaauuaaaaauaaacuucacuaaugaugagguuuaccuccugaguucagcaaccaugcauggauggaaaccucuaguuuagcuga

SEQ ID NO: 1710 - RNA, 2303 nt, Mus musculus
ucagcuaaacuagagguuuccauccaugcaugguugcugaacucaggagguaaaccucaucauuagugaaguuuauuuuuaauuacaguacucaucuuaaaugacaacggcauugaaauuuauuuuuaaaaugaaagaagcuuaaucuuacucgauagaaagugugaaaagccaggaaggccucucaacccuacacaaagaacuaaauaaaggaacgcugcaaguaggagcgauagucuucccuggggaagggcacaccaaucgggucagcccugaaaacacacagggcacauuauauagacugaacaggcuguauuuauguauuuaggaaugcacaugcacauagauguguguauaacaauugaaaaaaaagucaugaauuugaaagaaagcaaagaggaaagguuuggaggaagggaagagaugaggggaaagauguaauuauguugugaucacauaaacaaacaaacaagcaagcuggaagugacuuuaacaccuuugaucccagcacagcagaggcagagguagaggcauucucaaguuugaggccagccuggucuacagagcuaguuccaggaaauccaggacuacauagagaaacacugucuugaaaaacugaaagaaacaaagagaaaauuuuauuuuuuuaaucuagauggaagaaguuucuaaagagguagauagagggcacauggcacuuuacuucaguucggagcuuuacuccaguuagaaaaccuuaaguuuaauaagcgguaguuuuaauacugacaaauguggugauagaacaugaagcaauguguaaguuuuuaaucauuuauucugggguagcuaacuguuaaaaaaugaaucuuaauaaugaauuccuauaauaagaauguuucccuuaaaaauuacuugaaaaagaauccugcccuuucguuuaauaacauaaaagaagccacaauguugaacagauuaaaugauuauaguacugcaggauaaauuagccugugaggaaacaauguuuuaagcuguucuuaaaaagccaagucuacuaugccugaaacauuaauuaucuuaauucaauuaguauaugaaucauuagccuaguaauucaccuuaauacugaaucuucacagcauuuauuuuugacaacaaaucuauacuaaaacagcacucuccuuccuaaccuacggcuugcucuuugcgcucaagagcguuuaacuugguguguaaucuaauaaggguauuucaucuaauuaagacaaggggcagagugcugagugucacucggcuucuuucagguuuuuugaaacugaacccagaugacuuagagcagcuuucuagugucucuuuccuucuccuuccauuuuguuucuuggcauggccaugagacagccaaggacuaggacggaaaggagagcccuggacuuagcauagcuuccggcuaacuuuguaagacaaaaaaaucagaaccuaaaccaaccguacucuguacucucaaaauugacacuccaucugcccgccagguggggguugggagucuagaagcaagcagaugccagaacaacgccuagaacaauuugccccccccccccccaggcagucccacgaagaagcugagcaccuugucccacccagaccacacagcacggauccauacccugagacacaccaggcaacccauagacagcccucaccucaacaacaagaccuuauauuucagcugcccuagauccaggcuccauugaugcccuacagugagacauauuugcuaaugagcuaucccaggaaguguguacagcaugccaaggugccacaaggucccucggcuaauuacgcuauucacucuuucucucuagggagagguuuauguccaaccucucaucucuauuagauuagauaauucuaucccucgggagcuuuagccccacuugauccauuccugagucggugcacaaaaauauuaagguuaauuaaugucuuuuaaccuuaauauggaauaugacccuuuccuacaaacaaacaaauaaaaugacuauggaacuuauuacuagagaaagaucuugaauacaacaccaaacuauggcuccccucuaccuuaauccaagaaagaacuuuagugggaugaaguuuguaauucauagaccucucagacuucucuacucucuugcaggcuggccucaacaccaacuuuacaauguguucacuucaaagcauacugccaaacugggugucaccagggacaccuuucaucucggcacuucagaggcagaggcaauugcugugaguucaagggcagccuagacuacaaagaaaguucc

SEQ ID NO: 1711 - RNA, 3786 nt, Mus musculus
aggggccucucugcucucuccuagaaacgugauuucaaaaggaacacuugacuuuccucaaaacuuuacuguuugaaauuucaaaaauuaaccuuuuuccucgaaaaaugaagcuguacaaccccuggugcaccucauguuugaaugcucgcucaugugcgcagaaauaagcggugcacagccuccuguucccucgacccaggcugcugguagaaagcaacaacugacagacagaaggaagcaacgucagucagaaugcaggccggggcaacuuucugucaucacgguaaguucagcaguaagcagggugggaaaggaauugcauuauaagacuguagcaagcacaguauccuaucaggaggccuuacaugucuuucugauuuuaauuucuuuuccuucuuuguuuguuuguuuguuguuuugagacaauguuucucuguguagcccuggcuuggcuguucuggaacuagcucuauacaucaggcaggccucaaucucagaguacugggauucaaggugugugugcaucaccagcucucagugugacuuaguuuccugcuggaagcuuuugcaauaacagcauuuacuucuuagccuaucugagaguuuguuuucuuugacuuuugguguuuugagauagggugucugguuccuauguagcccagguugcccuagaauacacaggguacauuaggcaagccucaacuugaagggacuagccugccucuuccucucaaugcugggaucgggcacgcaccaccacaccccccagcucuucuuaagagcuuucaacuuuaauauagugaacaauuaauuacuaacuauuaaacagagggggaaugccuccagugacggugggacaaauuaagaucuuuucuguuacagaggaugagaaauucacucacuaaaugaaaucaagaguggucagaugucauacacaauaaagaaggaaagaccacauuccuaaacaaguaaauaaacacucguaagauuuaugaacuauaaacugacacauuuuauccucauguaaauaacauucuuaaaaguagcuuucaaaugucaugguuucauucuaaucagaaacauuauuauaaucuauaaaaauguuuaaguuuggaacaacaauaugaacuagccaguacccucagagcuccugucucuagcuguauauguagcagaagauggccuagucagccaucauugggaagagaggccccuuggacuugcaaacuuuauaugccccaguacaggggaacggcagggccaagaagugggaguguguggguaggggagucgaggggagguucugggggacuuuugggauagcauuugaaauguaaaugaagaaaauaucuaauaaaaaauacuuuuaaaaaaaguuuaaguuuuaauuuaacaaguuacauauuuuuuaaaccuuaauacuucaaguguuaugaucugaaauguuuaaagaauuuaaaucaggccucacagagcagagccgagcuuuacagauaguuguuuaaagcaagguccuccagagccguccagucauuccugaaauaacucucagagggaauagugggcuuuucuuacuggggcuuuucucucugcaaauguaagcggcuuucagaggcucagccagcccugcugaccuaacggcauuccagaccuuacccacgagggaacagaaccggcuuuuucuccccaguuuucuagcaaagcgcagacuuuuuaauaaaagucuaauaaaaauaaugaccauugaaaucucagcccuuggcaagcugaggcaggaggaugaggggugaggacagccugggcuaacaaugaagcuaaccuaaaagcaacagaaccucuuuuauuuggugaugccagcagcucucucucucacgauccugucuccaggccgccuacuggguagagucucccuucacuguaagccaaagcacacacuuccuccuuuauguugcuucuuuauagguauuugaucacagcaaaugagaagugucacuaacaccaggacacaaagcuggucugggacauccaucuccgcauggacuccugaauagagcccauaaauucacauagagaagaaaugcuacgcuugccguaaagccagagaaaaauauggaaacauugauaggaguagggccuuucuagagagagagcagacaaugcucgugacaaucaauuauuuacucugagaccgagccccucccacuucccaugaagccaccccuuucuuggacauuacugugaacauuaggagaguugaagcagguuaagcauuugucauaugcuugcuuagcuccaguacgguuuuaguuuuagcaaauauaagguacaacugguaauauaucuuuuuaaagguuccauaaaacuauaauuuugaaguauacacugaccauauaggaaaaacaaaaacccucccuuucaguuaaaacuuucagguuaccgguuauuauguugguuuuucuaggcugaaauccugaccgugacuuuaaacgucuucucaauugugauaacagguuauagugcuagagacugggagcgugacaacucaccuagucuacagccaaacacauauacaucagaaaaaccuuuguuuuuguuuucauucccaugcucccaucuagcaaaaugcaacuacauccuacuucaaagugaguaugcuacaagauuaaaguuuguaacacaaacuuagcaauuuguacuacaaauguaggugcuuaaugaugcuacuggauuuggaugcaauacuuauuuuuacuugaacacaauucuagucuauccagauagaagagcccccaaauuaucuagcagacagcucaauaggccaugccagaauggcuacacaaugcaagggcauuuguuuaagcaaucacugaaaugucuacgcagauaaagagguccuucauuucuauuauuucuuuaauaacugguucucuucacauacccaggaucacccuuugcagagauuugaagauuuuugucuugguggcuggaaaaccuucccaggaaauuuccagguaagacguacaaaucaccaucucaaaugguguuuguuacaaagagcauagggcuaauaaaguuauuauuagaaaguuguuuggcugggagauggcucaauggauaaaggugcuugcugccaaggcugaaggccugacuucuaucccuagcacccacauggaggaaagagagaacgaguuguccucuggccuccacacauccucggggacaugugugugcacaaauaaaaaccauacaagguuuuucaaaaagcugucguacaaacacacgcuucccucccuuaaaguagggccuuggcagacagcacuuagcagcugccuugcucugccuauucaaaggcaagaaaggcagaauuaaaauagagagcacacucaggaaucagacacaggaggaccaaagucccaggcuagcagaagcuacacgucaagacaagccuaacucuuucaaaacacaaacaaaagggcagggggacaaccccaaaguugggagagauagcaaggcuaaggagcggccacccugaccgaacaaggacccagcagucguaaugacccugccagggucgaguaagaucuaaaacauucaugaaguuaaaauaucuucuggaacgggagguuuugaagcaaaggauuagauaacaagcgaaaaugguucucccccaaagggcugcgguacagugaugaaccacuaagggcuuucccaaggagacuuccaugcuugacuggcaguaggccuucaucuaccugcuauuccauggacaucagcagaaaacca

SEQ ID NO: 1712 - RNA, 1341 nt, Mus musculus
auugaaagucacauccaugugccagguuuaccuagggcuuugggcugcaagugauggaaagaagguuuacaaauugauuucugcaauacaagaagucuugagccaaggggaacuggaacguagucucgcucgccaccucagccacauccagaccaacuauuuugcucuccuggcuugacuugguccucggagcugccaaaggccugcugaauugucggacaguguguauuagagagcggagaaaccuuucccaacccaucacauuggcuagaacggaccacauggacuuuccuaagagaagucucuccugagucgggguccuagaacugguuuauacgcuugauugcuccuauacuauacagaaaggguuugauuuucuuagaagaguaagacccugggucacccugaacaaaggaugaggagugggggaggggaguucuugauucuuccucagccacuggaugacauaucugugguuuuuuuccaaagcagcagacuaagaucuaaaaccuuaauuuggaaaaguuggaaacuuucauguuaaaguugguggaccaucaucccaggaagcaaggggagagggacucaaguuaagagugaacauuuccauuauccaacuuguccaaugaaaucgagaucacugccucuacuuucgggcuguagaggcauccucaccaggaguuaaaccuguucgagauuugaaagggacaaagagccagccuuggggugaauaagcuuccagagggaagaguacucaaaagcccugaggcagagaaugugaugugcccagcagugcuggcacacugagcagaacaucaggaggugaaggugaucgagcaguaaagaagccacucagaguugugcgaucccuggucaggaauguggggguaggggcguugucuagaugcagagagccacugaaggauaaauuucaucacuaaccaaaaagugacagugccuauugaaaugagggacacuauccuuagagaugcugcuucccgucccgauuuagacauuaaucaggaagucaucuuuaauuccuuaagucucagcaaagucaacuuuuaaguucucuguauguaguggacaaaguuccuggucggauuagcugagugacuuguaacucuuacgcaggaaaaguguuuucucuaacuccucuuggaaaauuccauuacccaaccuggugagggugccacuucaucccauagugggucguauauguagcucccacugacuguaggaaggcugugguaucuuauggagaagagaagggaaggccaggacaucucuccguggagccagccaucucucucugcauagagacuguagaugccauccugg

SEQ ID NO: 1713 - RNA, 17222 nt, Mus musculus
cguucggcgcagcucagugacggggcgcgagcucgcgagcgcggaggaggccgggggccugagccggagccggagcgcgcgccgcugcccagccccgccgcgccggccccgcagauggugacuccgcggcccgcgcccgcccggagccccgcgcuccuccuccuccugcugcuggccacugcgcgugggcaggaacaggaccagaccaccgacuggagggccacccucaagaccauccgcaacggcauccacaagauagacacguaccucaacgccgcgcuggaccugcugggcggggaggacgggcucugccaguacaagugcagcgacggugagccgcgacaagggggcgcgggguggcaggggguuggaggcgggacaguccccggaggcugggggguuggggggaaaugcgagaauccgagccaggcaaguggauggggacggguaugaagcgagaaaauaaagggacuggugccaggcagggggauguguguguguggaguguggaacagguagaugaacaaguguggagcagguggauggggcacaaguggggggcuagaagauggagggguacguguggggcagguuguggggcgggggacacuugcggagcaggggggcggggacagggaagcgggauggaaggacgagugcgggacagggggauuaggggaacagacgccagacaggcauugacugcguccucggguguggaaagaaugagcagcgcuuggagcgugcuguccuugggauugagcaagcugggaacaaaugugagaggucaccugagugcgcgcucugcacucugcucuccuuugcaucugagcuucucgcccucucuccccgccauugcacaaaguugccuaagaacuuucugauguacggggcgggguggggguggggggcgggaaaggugggagggaagugggacagacugaguuuagcacgugcggucaugcacaggcgcgcgcacacacaucauguaauugguucagcuaaacauagaaagccaaacgacaauuuaaaagccaucaguugguguuaagugccauuuuguuuguuuaccugcaaagcuagguaaaauaaauuguggcuuuuguauagauuucugauguacuugguuuuugagggagguauacugcauugaaaaaguucccuaacuucuggaaaacaaucuaagacuugcaguuuugucuugauuugauuuuugagacagggucucagguagcccaugcuggcauugaaguugguauguagcugagacugaccuuaaacuccuguuccuuggccacccagguuuuggaugacagacacaagccaucuuguccgccuuguagcuuucuuggguaucacuggccucucuuccuuauucucugucaauauuagaguuugucugcucauuccuuucauuguuuuuaaacauucuguuugaaucugagaacuuguuucauggcagcgugaauagucauaaaaucagcacuuaaggcagugauuugagugaggguuuuuuguuguuuuaguguuuuguuuuauuuuaaagcauucuguguguguguguguguguguguguguguguguguguguguguguguguguuuugaggggugggaugaggcuucuguuuggcaauucagaauguuaggauauagaacuuguaaaaucaagcuucuuaugagauuagccaaggcuaccagcugaaaauaauagggaaauucaugacuuuagugagaaacccugauugcagaguugguaaacuuaauuuuaaaaaagucucuccuguaaaccugugacgucccugcagcuuauaagucuacagauagccuccaucuuuaugauaauauaaagaacauuccauugaauucauucuagggaucuccauuugccuccaaaacuuaggccuaaaaccuuccaccgauacacaccaaaaagaauauuuucuuccuguacaauauuuuguuuuugugagcuguauuaguggggugucguggguaacaaggaguaaaugauaacuuugcuaaggcacaaguucuauuuuuuuuauuagauauuuucuuuauuuacauuuuaaauguuauccccuuuccuaguuuccccucccaaaacccccuauccccucccuccucucccuaacccaucuacuccugcuuccugguccaggccuuccccuacacuggggcaucgagccuucacaggaccaagggccucuccucccauugaugaccaacuaggccauccucugcuacauaugcagcuggagacacgagucccaccauguguuuucuuuggcuggugguuuagucccugggagcucugaggguacugguugguucauauuguuguuccuccuauggggcugcaaaaccccuucagccccuuggguccuuccuguaguuccuucauuggggacccuggaggcacaaguucuaacuucauuccugaccauuaugcaaacauuagucuugacggugugucaaucgugugccagccguuggaagguggggugauucugcagugguagauaagaucccugucccuggagcuuguguucugaugcagagaagcagccagcgcaucuagacacaagaaaugaaagacuaccacagugguccugggaaguacugggagccauuugccuuuccuguaggcuguuccgggacagaagaagaagaaggucucaggauuggaaguaagaggagugcucugugguaaucagggaaagaaugucccagcacggaacagugaggacacauuuccugagggcacgcacgggcucacaggaagccagucagggugacugaggguuucugccuguggcaguggaaagaugcagcuguuauuuacagacacaagggugacuugaaaugugcagucuuuauagacagcuugugagcaccagcuguagaguuguuaacacugagaacaucucagagcuauguuguucccaugagaagguuucaaaccucccuucacuugcuacucuuuguuaccaaucuccuggggaaggcaagagcugcugaaggcaacaaaugucugcacuuccuauaaccucccuucccugagccugguguucuggguacuuguucccuuugggucaucuuuccucugaugggaaaagaugccuuaaugagaguuaucugaaguuuuggcuuuuuuaaaaagaauuauuuauuguaugcauacguguacacuguagcugucuucagacacaccagaagggggcaucuuaaccuauuacagaugguugugagccaccauguggcugcugggaauugaacucaggacuucuggaagagcagucagugcucuuaaccacugagccaucucuccagccccucccugaaggguuuuuuuuuuuuuuaauuuguuuuguuuuuuuguuuugguuuuugguuuuccgagacaggguuucucugcguagcccuggcuguccuggaacucacucuguagaucaggcugaccucuaacucagaaauccaccugccucugccucccaagugcuaggacuaaaggcaugcgccaccacugccuggcuuccagaaauuuuuaugggaacacauuuuauguuuggcauuuagccagcucucucucucucucucucucucucucucucucugucugucugucugucuggugagagaggcaugcauguggguguggguguuugguugaugggcccauauguacacauacagaggccaagagagaaugcugagugacuuuuucuucuguucucuauauuacucccuuaagaaagcgaaagcucacugaucuggcuggccacugagcuccugggaucugccugucucucuugccucccaacacugggguuauaagcacacacucaucuuccucagcucuuuaucugggugcuagggauuugaacucagguuaucguggcauaaccgucaucauuacucaccugggccagcuucgcuuccuuccucccugaucucaaaggaaaggaagugagacacgauuuucauuucuguugaaaaauagaagaaaguagguucugaaguguuuuuagaauucugaauaaguuguuccuuccucuagugauguauguguuagcaggagggucuaagugcuauauugagaauugagcauuaguggaaguaggguagccagaauggagccaggcugcuguguucaagagcccagacaagggcuggagagguggcucagugguuaagagcacugacugaucuuucagaggcccugaguucaauucccagcaaugacuugguggcucacaaccaucuauaauccugucuguagugggaugcccucuucuguugggucuggagacagcuacaguguacucauaaaucaaucaaucaaucaaucaaucucuggagacagcuacaguguacuuauauaaauaaguaaauaaauaaaucuuaggaguccagacagaaagguggcacugauuuugcguugaguuggcaggaguuggggugaugagagaugguuggauuugacguaugacgugaaugaaugaagauuuugucaguaauugucacuaaggcagagucgguaguggaggugauaggaggaggggauacuggagucguguccuuucguaccugagaaguguaguuucuaagugugcaaagggaggggcuggccaggagcagguagcacacccuguuacuaggguagagguaggaugugggcaccggcguuagguggguggguuuugauuaacuauuuuucagugaagagggaaggaagccaucagcuucuagaaauccuaagaaugaagaugcugggacaucugaggaaaacaggaaaugaaugaccuagagcagagguucucaaccugugggucucaaccccacaggggucacauaucagauauccugccuaucagauauucacauuacaguucacaacaguagcaaaaguacaguuaugaaguagcaacgaaaauaauuuuaugguugggggucaccacagcaugaagggucacagcauuaggaagguugagaaccacuggucuaagggaaacaguuauucucagagccacauggagaugaauggguuaagucucaaguguuaaguuuagugguaccacuaguugaugcccuacauacacagugguaagaucuuugcaugacacugccgccacccucugagagucucaccugcugcauguucuuccaggugaaaugacagaguauuugauauaaauaccuuugagaguauuuauaucaaauucagaaaaacucaguuugaaggggagagggaggggaaagaggauaauaaccgugucucaauuccugcaaaugcuuagguuuugacugcagagcgagaggagaagacacuaagaagccagccacuuuugucagugguucuuaugugcugugaccacagcacaucaugauauugugguuugacuccuaauuguguuucuuccaaaugagcuccuguuugcuugguaaaggcugguaauagcagaaauguuaaaaguuuuaauguugagcgucucuuaacaccacuuaaacaccacguauaacguauaacaauauuuuaaauaaugucaguacauaauuuggcaccugaaucagcugaguauuuacgaauguggcgaacauacguacgugcaggcaaaacacacaaacacuuauaaaauaaauacuuauucaggugccaaauuauguacuaacauuauuuaaaauauuguuauacgugcuguuaagagacgcuggacauuaaaacuuuaacauuuuuucuuaaauaagcagcuuuauauaugauuucuucuaaguaauuauguuuuaagguuaaucuuacuuauugagugugcguccauguauuuaguuuuauuagggugggggcagagagacgaagagggggaaaguacacauggccaugccguggccugcaugugugguuggucaguggacagcuuuugggaaguaguucucuuuuuucacugcggaaucuggggcccaaacucagguuuucagguuuguagggcaagagcuuuugccugaggagccagccuggagaugauauuucaguauaaaggugaguuuagaacuuuaaaacccugagcuguuucagcaaagcaguuacuucugcuguucgugguggguuuauuugcucauucuaucgaaagagaacaucuuaauuuuggcagaguauuucucguuuuucucauaccuaguaauuucuugggcgcucacugugugcuaggcaucuucuagggaagggagacaaaacaguccucauagagucuugcuaaugugguucauaaccauuagaaaaacagccaagcuuggugucagaagggaagaugcucuuucuacauggggcgagcuuggaggaguuugagaggagagacaucaguugguuguucuaaaggaaccccaaacugauaaaaccuaccagcccaugccccuugcagugcgaugguagggaguccguuaccagcguuuauuucaacauucuuuccaguguuucauaaaagguagggcuggaucuuguuuucccuauuaauuuauguauuuaucgcuuuacaucccacucacaguccccccuccucccaguacaucccccacccccgucacuuggccccuccccagcccucccuccccuucaucuuuaagaagggugagguucccucuggcuaccaacccagcuugacaccucaacucacugcaggacuaggcacauucucucccacugaggccagaccagacagcccaguuaaggggcagaucuuuguuacucagugucaccacccucccucugcaggacacacgugcacgccucauggcugcucuacaucuucacucucuccuuuuaccuguggacuuucucuaccguauuugcccccaguccucugcgucuccauggugcccaugguuacuugguaucuuuuucugacuucauuugcuuagcaguaucuccuaugaagaaagugucugugccugugguggaugcucucaucccuacguuauggcacuguuacuccagucacgaugccagggagcauaucuacagcuuggaaaugaagagagaucagguacaaaggggagggaagauggaagagcuguuguaugaacaggaaaagaaauacauuccuaguuuuaaaaagaaaaaaaaaaacccagacagauaagcggcuauuagaagcgcacacaccuccuugcuuuguaucagcugucugggggugauaacguuuggauaugaauggcgccagaagucugcagacuuguaggugggaaggggaaugugccugucaucgagcgagcagaaacacugggcaagcugucguuuuaaaauaauaauaauaauaauaauaauaauguccaccagcuuccugacggguuuucaggugauaugguucugaauuuaaaacaauugcuaaccugaaacacuauauauaguacauacccucguuccagguuugaacacgcgauaguguauuuguagugcuuuuaaaaagacgauuaauggucuggcucguugauuugugagcaucccuagagccauaguucuugaccuuccuaaugcugcgacucuuuaaugcaguuccucagguugggaugaccccaaccauaagggguuuuuuguaauuuugccacuguuaugcaucauaaugugaaugucugauaugaagacuaccugaugugugacccccguggaaaagccagucagccccaaaggagucgaggcgcacaguuugaggaccgcugaacuagagguuugugauuguuugaaaucacucucuguuuaaaccggcucaagagacagcuuuauacuaaugcguaaggaacugagaguuucccaagaacgcuuugccaguuuagccuuucuuccugcuaugguuugaguauggcuucuccccuccaaaacugaagcuucaucuccauuaaaagaugcaguacuaagaggugcaaccuucaggaggugcagaggacucugcccucaugaauugaucauugucugaaaugugucuacuucauggaucaauaggguuaucuugugacugaguuugcaggaaagccaguuuggcugcuuucucucacgcuggucucuacucacgugacgcuuugaucuuugagaggaugaagccagcgagaaagccacagccagauucaacuccuggacuuuggauccgaaguaugagcccaaauaaaccaaaaaagcuggcuuuguccuugugauauuagcaacaggaaucagccugggcuagggguguagccuagugcuagaggucugcccucacauugcaaggcccugaguuuagucauuccccagcaccacaaaacacacaaacaaacaaacaauaaacuaaggcaucugccuucuuacucagggcuuuaaacuauagacaaaaauguguauuucucaugacaguccugugagaacaguaagcuagcuaacacuucacuuaaacagagucacagcuggccgagugggcucccaaaggcuggguuaacaccaugccugcugcuagaggggacucaucuacagcaaggugcugcuugccuccguucagauuaauaucugugcucaaguguaugauuccaggucauacugggcagauagcucuagauguaaagcuuauuaaacaguggcagaugaugaaguaacucugacaaaauagaacucaacaauccuguaauaagucuaaaaacuuaauaacagaaaugcggaaaugcugaaauucuauauguagguauauauuuauauuuauauuuauauuuauauuuauauuuauauuuuuugagacagggucuuucuguguagcccugacuguccuggaacucacaaugucgaugaggcuggacuugaacucagaucuaucugccucugucuccugagugcugagauuaaaggccuguaacaccacacccagcuaggaguagauauuuuaaaagcuccauguuaggaaguccuuuuuuuuuuucuugcugccauuugauaguuuagcccugacauacagcuuccaugaacuguguuaaaaugaaucuucuguugccucaaucaucauauuuaaugauuaaguuuuauaguuuauuuauucauguguauaugauguauguauaugggugggggugggggagucgagaggacaauucucgggaacugguucucuuuaucauguggguuggggguggaguugaacucugguagcuagacuugguaacagaugcuugaccagcuaagccaucuggauggucuggaugggcccuggcugccacauuuuaaaacacuguaacacucuagaaguggucauuguuuguaggucaguaaaugaaggcccaggaaacuccaaagauggaagaguaaacagugguaguguuuauuuguaacacaugugacagaugucauagggagcaaccuucuaugucugcccagugcccauugaucugaccauuugucaacagcauucaucgaaaauggaacuacggguagaagccacacuaggcaggggcaugugcaacagagaaaggcgugucucaguuuacauuucacuacggagaaccaaacaguaaacgaaguaggcagacuaauagcaugguguguuagaaaccaugcuggucacaaguaucaccaggaaaagccuugcugaagugugaguguucuucugcucgggugauucucacagaaugccaugaccugggugugccaugaagagacuuucuuuauucgcugcauuccugagagaguuggcugcagggaauggaggcagacucucugguccuaccuugcccugcggugucuuaaaaguguuagauaguuauugcguaaccuuagcuuucuuaggcuaggcuuuagcuaacgccuccugguugguggguauugagcuuucugaggacacagcgcgugccuagcagguuuucaccugcgagacuccagcauuggaugugcaggaggcagggcugcucucucauacgugugaugcaguaucgugugcacccuugcaauccucugagguccaggauaagcuuuggccuguucugacaguguauguuaauacauugugaagacuucaugaaugcuucacaucuguguaugcgcugcacauuuguguguguccugcauucugcacaaacugaaaauaaccccaugaucaagcacucuagugcucagcaaaauaaauacacaaaauaaauuaauucuuuauguuuuguccaauaaauauuaaacaucuucagggcuacucaagcauguugcauaccuuuacauauauguauauuauuucuuucauuuuuaaaaaaacuaauuaugacaucauuuguauuuuauauaggaucgaagccuguuccacgcuauggauauaaaccaucuccaccaaauggcuguggcucgccacuguuuggcguucauguaaauauuuuuuuccccuuugauaagcuuugugacuguuagucuaauauuuuuaguaauguuuccucaggcucacaaauaucuuuauuagaaugauugcauuuauuauuguuuucugauaaagcacauuuaacaacuaaacaauauuaaauggguuuaaaauaaugacuuaaguuuuauuuuguaaaguaucacauaaaugauauuuucuacuuaucgcaaacauaacuugaacuuuuaaaguacaaaguaauacuggcuagggaggggaaaagugggugaggcugguuuucuguuugauccagggcugagugaggcacaguguggugaucgcagcaguuguucuuggguagacagacaagccaggagccacaggcggagggggguuuauacagacaguuccugcccaccaggcuugugugaguuaauuaaaacaacuaaagcuaaguuauagauucaaaguaaugguaucucuugaaaauggaaaaauauuuaaaguuaaaagacaaaccaccauuugaauuauaauuguuuaugaauuuccugcagcauuucacagaaagcacauuuauuuggaggaagggucauaaaauaauuugaaaauccaaagaucauaaaaguccuagagauuucuuuuaauguucuuaggcuuguuauuugucaaacuaugcuuugguggcuaaagggauggcucaguggguaggagugcuuuuguguaggcaugagcccuugaguuugaguccccaauguccacauacaagccaggcauggcugcauuuaucugugacccuaguguugggggauggagacaggcagagccucagagcucucuagauaauccguguagccaaaacaguggucuucaggcucagugagaaacuuugucucaggguagugaggcugacagcaauagaggaagacaccuuccucuggcugccuuccuguggccgcuauuacacacacacacacacacacacacacacacacacacacacacaugauuaauuaaauaaagcaaaaaagaaagccaguugugcauuguguuuucagauaguuaaaaaguugugaaaguuacugccauaacuuuaacacugcaaaauugaggaguggguauggcuaacacaguuacauggcugggaaucgguagaagaacaggaagauucuaacacaggaaacauuuauaggcagcuguggguuuggggauugucuacagcaguugucauuuacuucuauggaguccauuugaaugugucacuuaugccaggagcuuugcaucuuacugacagcaaucuacccacugcaucucacagcugaacauagguaucccuucccugaccaagugcugcaaccagcacgacagaugcuacgagaccugcgggaaaagcaagaacgacugugacgaggaguuccaguacugccucuccaagaucugcagagacgugcagaagacgcucggacuaucucagaacguccaggguaaggguggccugcuggcugggcucggauggcuucuaauagugcagcgaacacaucaggagagaaggugugcuucucacaggcauucacuggcaugauccagcugugccgcuugccugcagggaggagcgggcugaccaucuuuguaaucuaaaauuauacacggccacaaaagcaaaguguuccgaaggagaaucugaggcagagaagggaagaauucaucucccuuagauauguagagcuacucguucagaaacuaaaugccgaagccuggaagcaagcugucauaguccgcuugggaugcuguaguaaaguguaacaagcugagguugguuauagacgacaaauacuucaggagguagggguuacaugcugaaggcagaaauagccaucaucuggcaaguuucucugcuugguuuauagaccacaccuucgagcuguaucaugagacauggggaaaggacuaggcaggucucugggauuccguuuugucugcacuucuguuguguugcaguacugaggauuacagaagugucuugaguguuagacaagcccuucacuguugagcuaugucuggaaguuauaccguuuuuaaugugacuuaucccguucaugagggcacugccccggugacccaguuauuucccagaguccuuccuacccuaauuucuuuaccuuggagguuaagacuucaacagauaauucuuagaggaacauagauauucguauagacagacaguuguagcaccagugacuuuuagcguguagugcagcugcuacguugauggcucaugugccucuaaccccagaucaggaggcugcacguugcuuggcuuuuccuggggauguguaaagaagugauguucauacuagauugagcaccaguaacagcccaaagaaacaaucacaucaaaguccagcaccagugaggucaucgaggagccuacaggagcucaagcaacgcagaaucagcuacaucaccucagguuccacucuggcaugggugacaaggacuugaggagguugcuucauuagagcccugccuuaguuaggguuuccagugcugugaagagacaccauggccaaggaaacucuuaaaacagacaucauuugucuuagucaggguuucuauuccugcacaaacaucaugaccaagaagcaaguuggggaggaaaggguuuauucagcuuauauuucuacauugcuguucaucacugaaagaagucaggacuggaacucaagcaggucaggaagcagaagcugaugcagaggccaugaagggauguucuuuacuagcuugccuccccuggcuuacucagccugcuuucuuauagaacccaagacuaccagcccagagauggcaccacccacaaggggccuuucccacuugaucacuaauugagaaaaugucuuacaguuguaucucauggaggcauuuccucaucugaagcuccuuucucugugauaacuccagcugugucaaguugacacaaaacuagccaguacaacauuuaauuggggcuggcuuacagguucagagauucaguccauugucaucauagcaggaagcaaggaaagcaagguaguguuuaggccgaccuggugcuggagaaggagacgagcucuucuacaucuuguuccuaaggcaaacaggagaagagugacuuccaggcagcuaggaggagggucucaaugccugccccacagugacauacuuccuccaaccgggccacaccuauuucaauaaggccacaccuccuaaucuugccacucccuggacugagcauuuccaaccaccagaagccccagccuccugcccaccugugcacacguacaaccuuagcacaagagcagccgggaagcacaugggaaagguggcuggagccucagggaggggacacugacagccccucuccugugaccucagaccuggcuaacacuauauuguuuugcuuauuuauggucaugacuuuaaugccagugcauucugugggucacuacaguggccucucuccaugaggauggucuggucagaggaaauggcuucuacuacacuccacccuuuuuuagugcuuacguucuuucuauucuuuuuuccucuuuuuuuuuugauauucccugagccuuggagaggugaaugugaguguauauguguaaguacguacacacaccugacuauuucugagcaacgagucucuuugccaugacagcagagacuuauccucaguguuuggccagcuaugagacucugagacucaacaguaagcaguacucacuguaaaaugagccuuucuccaagacggaagcagacagcagcaaaaauaugugggaauaaacaagaacgaacauuuaauuggcaguuuaacaaaacagucacuacacucucccaaguacagccugcaguuuccccagggcuuugccaugucuuaaauacuaagcauugguacccucgcauguaacaggccuuaagucugaccagaaaguaguuggcucuccccauaacaagugucccauagugcaccaugggcacgucuugcauggcauguugauggcauuaacaccaagaggcacagccaagcagaaaucagugacaauaguuccccagcaagcuaucgccuucuggcacggggaagaagccucagacugcugucagccugauuucaucauguccuacaaccccagcaauggggacucacucuacaguuacggugugugacaagggcaaugguaauagaaaugaugccauccagggccagcuuggugagcugguaaauuuacaggcacaucuuacagaauauggaugauggcuggaaaguaccgguuguacugaaagucccacccuagagcaggugaugauucacaaaagcuaagucacuggagccccaacugccaguuaaccgugucauagcggaacugagaucucuguggaaauauaagucacuagucaguaugaguauguauaagacuuuuucuucuaugaagcaaagacuaaaguuagaagauaaguggcaaagauaaagccaggaaagaaaacuaacauuuuuuuuuuuuugcauuuuccuuaaaauacugugcuagauaauaaaguuuucuuuugaugcuaacaaaagccccgagugccagaugggaucccagugucucucagggaagggaagugaggaaggcaacuugucucaggucacucucucacucuggagccugugcucugucuguugacugcuccagacggccucaugcugcagcucugacucugacacccaggaagcccugaccaggaggagcucgccucagaugagccaggggucacugcuuacacccaccagggugcuuauggcuacagucgccaccugaggcacagccggauggauuucuugucuucuuagguaaacuagacacagaagaacggccaggugcuguucuccagagaugacggugcgcuguaauggcgcaguguuuuggagaacuuggaaaggauggguuuuagaguaagauuguuccuuaaugugaauauuugaaaaaagcaucuugguugcuggaagcuauuuuuugguucagcucugugaaccaagguaguaugucuggaguucuuuagaauaggagaaauaaguugauaaccuuuguuuaguuuuaauuuuuaaaaagccuaccaggaguaacuacuuuugauucccaugagcauccaucccaaagcccaaauuuagaauuggucaaagaaagagaauggguuccauuuagcaugagcaucuguaaugacaugcgaccaguucuuagaagccaccggucauagugaugccaugagguuuccaaagguuuucuuuuucuuuuuucuuuugggggggggggcuuguuuuaauuauguuuguaugugugugcauaccacaacacacaagcagcgguuacaggauguagcuuguguguguguguguguguguguguguguguguguguguguaggaugguucucuccuucaccagggggggguggaauucagagcaucaugcuugcagcaggugccuuugugcacugagccauaucuugagcccugauguuaaugaaaaccaagggugcagccucacucugcagcaacagauuacuuccugccauguaagcauggugguugucagacaucuuuauugucauugcaucuuuaagcuaaaaggaaacuuaacacugaugacacaauuuguguuucauaaagauuauguaucuauaaaaaauuauuugaauagucaaaacugagugcaugcacguacacacacaugcacacacacacacauugaccugcugcauguuuuugugccugcugccauauguguggccgugugcucuggcaggugauagaggagggagcugagugaugccugacaccugcccaguggugacgacacaucuuuacucugcagcaugugagacaacgguggagcuccucuuugacagcgucauccauuuaggcugcaagccauaccuggacagccagcgggcugcaugcuggugucguuaugaagaaaaaacagaucuauaaagacccugacugcuggagagcaggcgagaauggaggaccauccuugccaaagauccgaugcuuuaacagccuaauguugccuuaguuuuguguugacgggucauuuugagaccuuucuauacugugucuuuuuuuagaaccucaaagugaaaaugguggggggccaggcagaaacagagagcaugcuugggauggggagcgagcaggacauccaagagcaugccuuccugagacucgcugucgugguggcucccccaaacugggaagaaaagcuuaagcccgugugacuugguguucauaguuguacuuaacaauaaaaaugaaagcaaauguaaaauucauuguaaggacuuuucagcauuauuuuauuuugaaauacaggccaaucuucccuuagaacuauuauuuauuuugaaauuucagauguacauuuauaccuggaaaaacuauuaauucuccauuuuuauuauacauaacguguuguuucucugaagcccacuaagauagguauaaauauguuacucacaacuacaagguuuccaagugugcaucucuuguacaguuggaaucacgguugauacuucucuggagagacgccccaggacaucugaguguugggaugugcacagaauucagaagcccagcuuccucaaaccgcuuagagcaaauguccuuccucuccugcugugagcucuaggaaugacggguuuaacgggccaagccgagcucugaaucugugcgcuaucugcugcugagguugugguuacucccucauccccguuuuccaucuucuauccuggaguaguguuaaaagucugacauuuucuaauggaggucuuaauaaacgcuauuuacuucuuaguaaucucc

SEQ ID NO: 1714 - RNA, 13535 nt, Mus musculus
caguaggcgggcguguuuccgggcggugcgggaggcuggaggccagagggcuggcccuaccgccggggacauggagacucuguaccgagucccauucuuagugcucgaaugccccaaccugaagcugaagaaaccgcccugggugcacaugccgucggcuaugacgguguacgcccugguagugguaucuuacuuccucauuaccggagguaacucggccgugaugggucgggugggcgcgcaggcugcucgcuccggaggcgcguggcccccgagccgggccccguaggcucacgccuuucacuggaaagagauggucuccucucugcccgcuuuuuccuucgagcgcugaguuggauauaauugucaaguccagcuaguuguuauuucuugcugugcauuguuugaccagggucuugggaacaucauuuuugaaucacuguguuuccuugguuggucgagagagugugggacuuuuauuaaacuaaucgugaggacccugaaaucguggaagagaucugauaaccuuugaguuuguuaguucagaccccaggggcuuggauugcuuuaugucaaaucacaggaaugagaagggaacuuaccgaagccacgguuuuuuugagaaauacgugagauuggaauugaggcuugcaaaaagaugguguaucucagagggcagaaaaugggacucagaaaauagaagggaagcagugcuuuuuagauaucugucaccaaaucccuuaaguggaaaaugcagagggguguggcuuugccuauuggugaguuggcaguccgucugcaggcucuagagcacccuuuggagcgacaguuccaggauguauccaggacugggcuucaggaauuuaggaaguaguguacuacuuaauucagaaaauuaaaaagauuuuugguuagcaaaagugguucaacuuuuuuuaggguguguguagacauauugcuauugcuuaacugcuuucugaggcuacuuggcauauuugaagagguagaagacaguauuuaacuguagaguuggcauucuacggagugcacauuaacggaaaugcuaaaggccacuuuaaacauuguuguuguuguuuaagaaaaaaaaaaaaaaagacauuaccugguguguguggcguuaacauucacuuuugcucagcacagugaaucgugaauaugacaccuaaugccuugggcuuuaagaacuuaguguucauucuugccagcuuguuucuugacuuuugcuuccuuuggagacaguuuuugugagaagccucagcuuucuauugggccacaguuuuggugguuuuagaaugggguuuggggggaauuucgcugccccaaccacugggucaaaauggaagggcgcauuuuguacauuuaccguuuggcuucuggaauggcuucuucucagcauggcgagaagcauggcagucgugugcaggcagacguggugcugggagagcugaaaauucuaauggacagcuuucuaaaaacugaguguaccuguaccuaagcaauguugcugggaaggacaggcgacacugacuuucuguuaacucagugcugggauaacagcaaagaaaauauaaugacucugcccuccauagaagguaguggagacaugcuaacuaccgcacaauugcuuucugcuacacaguagaguuuagaagcauugauuuaauuccaguauguuuccuggagaaaugaucuguuagucugaguuugaaugguuagaagggucauacuagaaaagaaaaaaaaaaaaaguguggaccaacguggaccaggagacuagugagguguuuuguucacuuagaccagcacuucuggcauuuuuccuccuauguguccccauuuuuccugacagauuuuugcacaaccuuggguaaauaggcauauguaauagguauaaggucaaacuuuuacuaguaaaaguaacuaguaagcuuacuuuacaacaacaauuugcuagauacacaauuuaugcuaguuuuuucuuaucauguauacauguacauaugcaugcaugccugccacucagaaggggacacuagauuucaucauagaugguucagagcuaccaugugguuucugggaguugaacuuaggaccucugaaagagcaguuaauacucuuaaccucugaaccuucucuccagccccuguugugguauuuuuuaaagcugaaagcaaauucacauacuaaugagacaaugugccucuguauuuuccauagagaauggaaucuuagcugcauauuugauacugcaggauguagagcagccucaguguucaucagagccuuguuacucuguuucuuugguaaacuuggcaccucuuugagagauaauguugucuagaugucauucuaaacauugcuguaaagagacaccaugaccaaggcaacucuuauaaaagaaaacauuuaacuggggcuggcuuauaguuucaaagguucaauccauuagcaucauggcaggaaacauggcagugcccaggcagacauggugcuggaggggcugaauauucuacaacuugaucagcaggcagcagaaggcaacugugugugucuguuuuacacugggcguagcuugaacauuuaagaccucaaagcccaccuccaccgugacacacuuccuuugacaaggccacacuuccuccaguaagcauaccuccuaauaacaccacuuccuauggccaaacauuuuaacauacgaaucuaugggguucauaacuauugaaaccaccucaccaaaaaucagauuagcuggaucuucuuugauuauaauaauacaaucaaagaagccuucuuuuuuuuguuuuguuuuguuuuuuguuuuuucgagauaggguuucucugucuagcccuggcuguccuggaacucaacuuuguagaccaggcuggccucgaacucagaaaucugccugccugugccuccaaagugcugguauuaaaggcaugugccaccaccgcccgaccuucuucuuuuuuauuuauuuauuuauuuauuuuauguauguuagcauacacuauagcuguacagauauuugugagccuucaucugguuguuggaccucugcucacuccaguuggccccauucacuccagcccaaagauuuauuuauuauuauaaauaaguacacuguagcugucuucagacacaccaggagagggcaucagaucucauuacagaugguugugaggcaccaugugguugcugggauuugaacucaggaccuuuggaagaguagucagugcucuuacccacuaagccaucucccagcccagaagccuucuuuauguauggauaagucccacuuaaauguaauuagaggcaauuaaaacuggagaucuacuuuucaaacuaagaucuaguauguauuguugucuuucauuuaggaauaaucuaugauguuaucguugaaccuccaaguguuggcucaaugaccgaugaacaugggcaucagagaccaguagcuuucuuggcuuacagguaaaagauagcguuuuguacaacuuggugaugggaaagaagguuguuggcaugccuuauuauucaaagcuggaaagcagagugugguggguggcacaugacuguaacucuagcaggagggucucugguuuuagguagucugggccacauagugauguuaaggcaucucaaaugcaauacuguaaaaaugcuauggggcuuauuugcauuuagaaucauuuguuuuaaaauguagcauucuuauaaaacaaagcaagaacauaacagaaguagaaccguauuauuaggcaguaagauauaucuuagugauugguguaucaccaaccuaaagguugauuuaaaaugaaguugacagacuguucuggggucagcaaacuauagccauucuuaguaacauuuuaugggaauuagcaaaucaauuuagauuaccauauaaauaccagacacuauugguugugccacucgagugccuaauugauuaauuauagcuguucuuaagcuggggugaguuacaucuacaggcccaagugaucuacaggcccaagguauuugguuauuuagguccuggacagcaacucuggggucucauguauaggcaagaacccuuuaugauaacuauguggacacuuugcaaaacaaguuaugggcccccaaauacuguuacuguuaaauaggcaauuuugagaccuuacgaauuccauuucaucaaggaaacacguuuuaacgugguuugacuaaccugagcagugcugagcccauugcuuuccagagucuacuugauauguagccgucuaaagucaggucuauuuauauuaucauauacauagccuguuccuggggagguuuauugugcuucccugggguagcaguuaaacugacaaauaagaucuuaggggaacuuuuuaaaguagcuuuuuacuuuuuaacauuuuaaaaauuacauuguguguguguguguguguguauguguguguauacacaccauauaauaguggaggucagagacaaccugcaaguuuguucuugccuuccaccauguagaguguagggauugaacucaggucuucaggcguggcaucaagugucccucccuggugagcuaucuugauggugccauaguuuuuuuccugcacuguugaauuugaacaugguaucauguuuuguuuuauuuuuuuuuuaauauuauguuuucaaugaaaucaauuaguuaaugaaaaugucacauaccuucuuuauuaauagcaguugauaacuaucucuuucacagaaauuggcuuucucuaagaauugagcauacuauauuccugaaaacucagauauggguuguugagauggcucagcaggggagggcacucgaugccaauuugaaagcccgagcucauccccagaaccuccauaugcaugugguacauguguguccccccacucccaaaacacauacagauaggcaugaaacaauaaaaacuaauaaaauuuuaaagaaaggaaaaucagauucuugcauacacagcuuuacacuaaggguuugcagacugcuggagauacuguggggucacggggucuuuguuacaaaugcaugcuuuaaaauacuuuacuuugaaaugaaaaauuuauuaauuauuaugacuucaagaaacacagcuaguucaaauuucuuugcagcugauagaauauuuauuuaugaauagguagggucucacuacagagcucuggcucuuuugaagcgcacucuguaggccugagugcugagauuaaaggcgaaugccaccaugcuuggcaagauguucaacuuuuuauuuucuuuaaagauuuguuuauuuguucuauguaugugaguacagugccgcuaucuucagacacagaagaggacaucagaucccaauacaugugauugugagccacuauguggaugcugggaauugaacucaggaccucuggaagaggagucagugcuuuuaaccacaucucuccagcuccaaaauguucagcguuuagaauaacuaaaauguguauugucuuuuucuggacagcuuuguuaguugaugcuuuaaaacucuuuuuuaaagugagcuacacgaugaccagguuucauuauuuuauuuuuuguagagcuugggcuaaaccuugaguguguuugugcuggguaaguucucccagugaacuguauccccaggcaagacaggcuuuuaccuguuuuguucauugucauauaccuagaaccugcgcuugcugugucacauacuucucagugaaugucugcuggaugaaugagcaggugacugucuaaaagcguaauuaauaguuguaagggugagaauaaaaugucagcauagauugucuuaacauaaaguagaagcaaggauuucaacccaaagggaaaaaaaaaguuaauuuuuuaguaacguucauuugcuuugcugugcuucuguuuuucagaguaaacggacaguauaucauggaagggcuugcguccagcuuucucuuuacaaugggagguuuagguuucauaauccuggaccgauccaaugcaccaaacauaccgaaacucaacagguuucuucuucuguucaucggcuucgucuguguucuccugaguuucuucauggccagaguguucaugagaaugaaauugccguaaguaaaauacuuuguauaauaagcaauuuaacuuuuguuaugaauuggcagaacaauuacuugggcaacauaaauucauagauuuaauuuaacacucauuuaaaugugaaaaauauccaagaacuaaggaaaucugugacuugccucagguuaugacuacaguuacaacaaagcuacggccaguaggucucccggcuugcuccccaugcgaguuucugagaguuuaguucugcugccuccgccucacugauggagggaacuuguuucucugucaugggcuuucugguguuacuuaucagauuccaguaauaaaaaugagagcaaagaggagcuuucaagccaugggcugcugcugcgacuucaucauugcuauaaguugcucauuccuaacugaaaggcuaaauauuuuggcagcuaguaugaugccacagaggaaaaugcuacugcgugaaaccuuguuucauguacagaacugcugggugcauggacaggauccauaaaacacaaaugauuccucugguuugguuugugauuggaguuuuucagugcugggaagcucagagccauugugcauauuaggcacugucuagaguuacuguggcuuugauaaaccaucuugccaaaagcaacuugagguugaaaggggguauuuaauuauauaucacaguccacugaggggaaccaagguagaaacugaaaccaugcaggaaccuggaggcaggagcugaugcagaggccacggagggugcugcuuacuguccagucccucauggcucucacucagacugcuuuucuacagaacccaggaccacacccacaaggggcugaacccgcccacaucaaucacuaauuaagacaauucccuagucuugccuccgcgccgaccuugggaggcauucuuuucaguugagguucccuccuuucagaugacuuacucuaguuugugucaaggggauauaaaacaagucaggacaggcagguccugccacugugcuauaugcccggcucuuaagaaugaauguuuacauggaggucccaucccuccaguaucuuccuaucuacgcagauauuagaagguaaagaaauguccguuaggaagagggcucuguagguaaagcgcugcugcccagcgugaacaaaugugcauauguauacacaggugccauacacaccaaacaaagaaggaagaaauaacaaacaaauaacaaacacaucuggccccaggcauuuuggauauggauuucagccugcaugaagagaacugaaacaggaaaacuuagacaggaaagaacuacugucaccuaagauaggaggaaggauugcauuuuguauuguuuuguuuuugagacagaguuucucuguguauccccuguuuguccuggaacuuuagacuaagcuggccuugaacucaaagggauccugucguccuuugccuucugaguguuggaucaaaggugugggccuggccuggauugcauuguuuuccuauuuauuuauuuaacaucccgauuuccuccccaccccaaucuuacucuuuuaagucccuccccccauuacccuuucccuucucagaguaggcgagacccccccccccccccaccaggguaccaccccagcuugggacaucuaguagccacagaccuaaguuuauccuuucccacgaggcccaucuagguaguucaguuaggggaaggggauccagugucaggcaacugagucagagacagccucugcuccaguuagggggcccacaggaagaccaagguacacaucugcuacagcuguguagcgugucuagguccagccucuguacgcucuugguugucuagauugcauguuuuaauguaauauuuuuaaagauuuuuuccuuuuuauugaaaauagauucuuuucucaaauaauauauccugauaacaguuuucccacccucuguuccucccaauuccucccacaucccccccuaacuggagucucuccccuucugucuucauuagaaaagaacaggcuucuacgagauaauuuuaaaauaaaauauaagauaaaccccauuacacugaagucgcacagacaaacccacagaaggaagagagcccaagagaagcacaagagucagacccacucaggagucccgggaaaacaguaaacuggaagccagaaagauaauuggaauccagaaaauuuuaaauguuuuuagaaggaaggaaggugauuuguagaaauacaugguuccaauugagguucagaauaauuugaaauucagaaacguuugcuaaagaaacaaguagcucuggcuuaauuugaaggugauagaauuuuuauguauucugauuuuaccucugucaagccaacauacuaagauucacuuaguaaccuaaucuauuuuuaaagaacucuauuaagcaucuauguuaguuccuauucugcugcugugauaaaacaccacgaccggcugagggcuccagagccaucacuguccaugaugguggaucacgguggcaggacaggaagcugaggacucacgcagaccgagcagcugggagugcugugggucccgaacucccaaagccucccucagugucacuuccuccagcaaggccacgugucccagguaguguccaaaguguugaaaugcccgagacucugggguacguuguccuccagacucucacagcgccguguaccauccaugcuaaucuuuuaguguuuuacaugucccguggauuagucuguccacugcuugugcuagugaggcgcugguccuggugucauaucccagcuuaguccuggcagcaugggcaggucucacaacgggucucugucagcuaaguguuguguggcuguguaguccuguagacuucugugacuuuugucagagggaacacgcgcaaccacccuuguaugaaaacuugaacacuccagcuuuuuauucccuucuuuaccccuguuagaaauagucacuguagccugauagagucugcuagugugggagagacgggcgguucccguagcauugggacauuuucauuucuaagcuauguuguauuuuacacaccuauaauccuagcacuugagagguggagggagcaggaauugaaggccagcuucaaguugagaccaccuggaauaccugggagccuguuuuaaaaaacagaaaacaaacaaaaaucucaaaaucucuuccaaagggcuuaaguuuuauugucauuuuaaacauuuacacucagaaaauauaucuauuuuucauuucugagcuauaagcucagugugugaacccaggugguuauaagcucaugaccuugagugaccuccugcuucagucuucugagggaccgagagugcuggcaccugcuccaugcucagggagucccugcugcagcagggcggugugagcaugaaguguaaauugggugauuucuacuuguauuuacacguaauccuccuucuuggauuuucuuuaugcuucaguguuacugacgcuuuucuugguugucagugugcgccuauuuuaggauauuuucucucuugggacuuggcugguuauucuguauuuugagaaaauagccucuuuuaauaaguuuuauuguauuugagacaguaauuguacauauuuacagaauacagagacauacaccuacagaucacaugcugaguaguauuaagaguuauccaggugcacccuguauuuauuggcuguauccucuuccuccuccucacucccaccaaucagauugccuuucaguuuaguccuggacuacagagagcuugaggggucuguagucagccuuuggguaugugaggguccauuucauuuguuuccaugauuagaacuguauuccaaacacugugucuguagagagucuggcacgugggucauuucagugaguagacucuugaguccagugcucaggaucugcaaaugagagacaccagugacacaagauguuugcauggcugcuggugacaaugugugguagaggaaguggcuggagaauucgccuccaggugcucucagauuuuggauugguucuaugagcuucuugcagauuccagaucuacucaguaaaguuaacaguguacuucucuagaaacuggcagguuaagggagauaguguuuuauuggccaccaaggauaauguguucugugguugggaacaaucuuaaaaguucuguuuugaguuggaguuugaucacagugucagaaagagacaagugaccacugcugcuucugaaagugaggugggacuguuucuaggacccuggagaagauggggagacugcuuaaugccgcugcuguucuuuucuggucuaguguuguggaucagugaauggccccauauagucucggacucuuaguuguaaaaugagaguagggcuggcaggacggcucagcagguaaaggcuccucuggugugugaugaacuaggcuccauccuggaaacucacuccguagaaggagauagcucgcuccucugaguuuccucucaccaugacauauaugcacacaugcacacacacacacuuucuuaaaauguaaagugagaagccauuuacuuuaucucacaugugcuucugccuucuuuuggggaguacuggggcuggagcccaaagccucucucaucuaggcagaugcucuccacugagcuacacccaagcccaaggauuacaugugaucaugucacacucuuagaaacuccugccagggcuaagccagcccaguuccugucuuacuguguauagaagagacuuagugauugucgguaaacggcugccugaagagaaaggcaguacuccaugguuuuugugaaccagguuguuuuuuuaaauuuacuuaugugugugcauguguagggggcaugugccauggcacauguauagucacaggauaguuuguggaguugacccuccccuucuaccauguuggucccuggucucaggagaucauuuugggcagcaaacagucuuaccuacuaggcugauuuugcuggcuccaguuguuucuuugaauucuugguuuguuuugauuguauuuaucuguagaauucucauuagcuugaguauaauaacuaaggauuacaaaauuggucuauaagaaagggccaaaugauucuaggaguggccauaauaaauacauucuaagguauuuacuuugauucgcuaccaaaaguaguuuauauuucuuaauguuccccccuuuaauuaaaaauguauuauuucauuuugugcgaaaggacguuuugccuuugucuguaucugugcgacaugugugccugugaaggccaguggcgggcauuggauuccuggaaaguggaauuccacggugguugugagccaccauguagguucuggggauugaacccagguccucgaagagcagccugugcucuuaacugcugagucaucucuaguccaguccccuucccauccccacuguuucuuaagguugauaguccacaagaguaggucacacacugcuuucaagaaggacuagaacaggguuuaacugucaccagauggggcuuugaagugcauauucacaucacacagcagaugacagggaccugucccuaaagagcccccuaguguaagccggugucaaggugccugccuuguuuggcugauguggccgcuugcugacagugauccagagccugucuaugcugggaaauugcuuucuuguucuguuuuuguuugaaugcaucagaccuuaugauagggaaugucuaagucuguguguacauacucagggcucuuuuuuauguuauucagucugagcauguguggggagggcagcuugaagugaaaguucucggagcagaugucuggguagauagugcaggagcagagagugaagugugggcagguugcauuggcugagcauugauuuagaguuaucaagggucuagaagcuggaaaggaggaaaaccaagccauuaaguguugguugugccacucgaagucucggggaaaucuacuuccuacuuuacaggugaaaaagcuugacacacuagaugcuaccagacaguuaacaagacuaacgugcuauauaaaaacagucugagagacuuuucaggccucauggaguaacuccauuuuauaguugagaaaacggagugagguuugaccagccucacccagugaauaguaagggugcaucagagggggcacucugggggccucagugaguucccguguauucagucauuugguaguguggguaguaaguaguacagcauuuuucagaguuuuguucugauccugaucaugccuccaugguauuagaucucaggugcuuauggcagaagggaggguugggaccugaguaccucauucaguuccuuaaaggggcuucggagcgucagugaaagcagcuugaucuuuggugucaucugugggcacugcugaagccugcaacugcuuucuggacacuugcaauggaggcagauaccuuugcaguuuggggacucagggucagcuccaggcauguauuccuggcuuucccaugccuccucuaguaugacgaggggcuuugaaauccaagcuaguuuccauaaaaagguuuaauuuuuguuauaauuuugagagcccaaagauugcuucuguuaagcuuagcuuuauagucuucauuuuucugcccuucugugucuaauuguauguuaguuugcauugcuuugugauguuuugggaggaaggagaccaggaagccugguuauguguuaucacgaaccaggggugaugcugaggaagagcugugacgucaucagauucauagucgccaggcacucuugaauggcugcuuccuggucgccuuuucugauaugaauucucuuucugcaggggcuaccugaugggcuagugucuuuugagaggaaaucaguggaucccggauuugcuccuguuaaugaaguuuuaaaggcugacccacucccuccugcaauguggaaaagaaagaagagcaguguaaacgcugcacugagcgacacccuagcaagcacagcagagcuaggaccggaagucacgggaucagagacaaguucauuacaguauuucccuugaugaccuaccccaguguaccagcuauguuaaacggcauuuuuucuuaguuuuuuauuucuuaaagaaaauauacuccuccuaaaacuuugguauugaauaaagugauuauuuuuuacaaacccaucaucagcuuuuggacaugauauuucugauuuucagaaauuaacgcaaauugagaaguauauugugagagcugagauauuuggacgauuggccaguuccugcaguggugcuuuaaauggugugugugcuacucugcaauuucagaugcauacgggagacuuguuuccugaacaacaugauguaugaaaggagcagaaauaaaugauuuuucuaauuaacauuuuag

SEQ ID NO: 1715 - RNA, 3574 nt, Mus musculus
uacuuccuguccggcgccgucacacuugaccccugaacucacccgccccuuccuuuuccucuuccggggacggugcucagagguaugguggccuucuucugcucuguguuuuuuuaccguuuacgauccguagccauccgaggcgucaggcgggcgggacgcccuuggggucgggacugucgcuggggucgguggugagggacgaggagaggugcguaccggccgaggccucggcucguagacucgggaagcccgagaucaaacccggcuuccgaagcggugaguggccggagcugcgcgcacccuggccgucggcuacggcgagcgagagaccgagucguggucgugaagcgcagagcgagcggagcgcggccuccggcugcuccccuggugcugucugccaugguggcuagucagcgagcgggacgcggcggcggcggcuggcuugguuaggaagauacgaaucaagcaguggcggcucaggguccuuagcacugguccgggucgcgcuuggcguuugggcuccuuuuacguaaaguggguguugggaagguguggaagacaggucaccuguagcgcuuauuaaucaacuccagccauucgucccagggcuugagauuuaaacgaagucgccugugugugaagcucucggguagaauguuugucuggcacguugacggucuggaguccaaaaugcagcaucgcugcugcgggcuggagaguccuuuaguagcuggucugcuaaggaacgaacgaaguuggauuugaaacagcacgaaacccggcccuaguaguaaacaagacuucuccaggacgcuguuuugggacaagaccuagauugucaugacgccuuaccagcugccgccacugggguaguucggugucuucauccuacugguagcuguauaaauuaggggggaauacugucuuagagcccaggagcucuucaucucuaguuuaaaugugggauucuuuagaaccgggccuuuguaagagcacggugugaaugaguguguauaugaauguaagauauuuuauguggugacgcuuuggccuuuauuauggugaaaggugauuguguucucucuaaauuguaggcacucaggaugguccagcguuugacauaccgccguaggcuuuccuacaacacagccucuaacaaaacuaggcuguaaguaucugcaaguuugaaauaacuuucaaaucgcuuucucuaguaugcugagcuacuuacaaucucccuuccuaggucucgaaccccuggcaacaggauuguuuaccucuacaccaagaagguugggaaagcaccuaaaucugcauguggcgugugcccaggcagacuucgaggggugaguguccuuuugauagaguuuuaaucccucaguaggcggacuugauaucucuaguccgaaguagccaaugugagaaaugaccaaaauggcuucccaguaaaagcagacuucccuuuguaacccaguucccaguuacuaggaaauaaaugucuuucuccuugagcaucuuaagguaaucacggucuuuguucuacagguucgugcugugcggcccaaaguccuuaugagacugucuaagacacagaagcacgucagcagggccuauggcggcuccaugugugccaaguguguccgugacaggugagugagugagggccgaggcaagcuggguguuugucacacggcaugugagcuuggagucgccccuugacaccugcuaggugcuccuguugugucagaauuugggggugucuuuaaaguagcuuugguuuacagagagcagacaggaaagagaugcugaguuaguguuugaucgcucguaggcagcuggggaggagacggucuuggaggguuagggaacaguguugguuuggguggcugauugaggaggugacagacaaagguagaaaagauugugaagggcuuuagucuuggaugguagaaccaggugacucgaagcaaaacugaggguccggcuugacaagaugaaggucugggauauacagaugcuuuuaggcagcaagcccuugccuuacuggccuagagaggguuuggugguuuaaaucuuuuggaaucugggaagagugcaaggaugguuguggcuuauuugcagagcaccagauaacauuucagaacuucuggguggacuuucuggcuaggugggguuguuuaggggggaaaccagcacuuccaguuucauacucauaguuaguacagugcagugcucagugucuaaggggagaauucagaagccgggcuggacucugguuuguuugguaguuuuacagaaugcucugaccaaguggguuuuuuguuuugugucuugacaacaauaaucugccugcccuguuugugguaguuguucacuaaaaggaggaaggccuaguaccuuaauacaggcacggggcagauguucuaaugcaggccaucuggacucauaacauagagcagagaaaugucaugcaguuguagaagcugggcuggcauuugaggccaaaccugaaugaugcaaacggaaaagauuuccaggcucugguguuugaccuuaagguggugacuuuugagcuacggggauuugcuuggcauauuugauucauccccuacagaaucuagauuugggccuaacaagauggggggaggcagaggcaggcggauuucugaguuugaggccagccuggucuacaaagugaguuccaggacagccagcagccaagacuauacaaagaaaccccgucucgaaaaaaaaagagaugguguccuugucuuuaacacuaacacacaacacacacacacguuccaguucacagcugguagcuagguuuuauggaaaauaauaaagugaauaaaacauuucaauaauauguccuggauccuggugcaagaaauaacguuagucagaaacuauuuaagugauggucuugucuuggguguugucuguuaaguuucuauuacugugauaacugugaccagaggugacuugggguggauguuauuuugcacuuggaggugcuagucccaucacugagggaagucagggcaggagcugaagcagaggccauggggaaugcugcuugcuggcuuguucuccuuggccuucucagacugccuuccuaaagcacacauucaaggcccaguguggugcugcgcacaggccaaucuuggaggcauuuccugauugauggucccucuuccuguaugacucuagcuugugccuaguugacagaaaacuuggccagcacagccaguuuauuuuaugagugaucaugaagcagucaagauuacuuggauuggagaaguccuccacaaauauucauguaacuucauaagcuuugugacauuuuuuguguauuuuucuaggcccuugauugcuuugcuucaucuuacaagguaacguucccauguuaauaacugguuuguuuuucuuucuaggaucaagcgggcuuuccuuauugaggagcagaaaaucguugugaaagucuugaaggcacaagcacagagucagaaagcaaaauagauaugcacauuuuuuaaguaauaaaaaucaagacuugaucuacgcuucc

SEQ ID NO: 1716 - RNA, 1126 nt, Mus musculus
cuuuucuuuucuuuucuuuucuuuucuuuucuuuucuuuucuuuucucuucuuuucucuucuuuucucuucuuuucuuuuuguuuuuaauguggauuugauguuuauauaguuugugugguuaaucugagguuacaugcguggugcaugcaugcacgcgcuuuugcgcgcgcgcacacacacacacacacacacacauuuguccagagauaaauaaaucuagauggcuagauugguuaauaaucuucacuuuuuuaaauaguuuuaacacugagaacugaagacaaagaucuccuuacaggcacacaaccagcaucauguaucuuuccguuuagcagggagggcagcauuauuuggucaaauguuuuuauuuuugucuccuuaauacuuaagacauuuguuucugaaacacuaggcauccuagcaaguguccuuuucuccuuuccugaugaaacaaacaaacaaacagagaauguuuuucuugugaaauuaggcuuuuacucuaaagcagauuggaaagaaaaaccucucguaggcagguccagggugguugcugagauacaucguuagcuguucucgcagggcaguuucuuccuuugccauggcugcugguggauuggcuaacuuuuugaaugcuacauucuccaugcccaggagaaaggcauuagcagguggagaugcugcccggguacagaaucucccugccuuaaauuuaacccuugcccuuaaguccagagucagcucuuccucaggccccaucugagacgcaaacguugcuccuguauagacgaucaucuugggcagugagagcaaaaaccuuagaaacgagggucugugaggucucuucucacccguucugcccauugcucccucugaauuugcugccacagccggcaguaugagaacacucugugugcgauuuugaaaugugaugccuuugguugaaucugaguaaagugucauguuuuccaguaauuucucucaaaauuaaauugaaaauuuuguuggaaaauugcuuuucgaggaaaaugauccaauucccuuaucuugggccugcugcccucccgaggaagaacgccacuuugaaaagcuacagggaauaauuauauuuuccagcugaauauuga

SEQ ID NO: 1717 - RNA, 12757 nt, Mus musculus
cggguggacaacaaccucaagaggaugcuuuucauuuucucaacauacugggcaaggggacauuucauccuagcucuauaaaagggacacaucccuaaaaaaaaaaaacaaaaaaaacaacaaaaaaaaacaaacaaacaaaaaaaaccaacaacaacacucauaagacaaacccaaagaaacugacauugaaucuaugccagaaaaaaaaaauacaaaagaaaaaaaaaguaugggggaaaaaaaaggucuacuucaauauaaccuagaccuacaucccucucugaccgaguguccgugcugacacuagauguugcagggaggggccuugggagguccgaaggcagaucuacugauuugcccagcaucugccaccagcacagacuucaugaagcauccaguuccucucagaguugagagacguuucauuaccucauuuuaccaugggaugacggaggcugagagaugagaagcacugcuuucugauggaauccacacaacuaaaccgaguguccaugcuuccccguggccagugggcaccacucagccucuccuggcugugccgaacugcgaggcccaugcucagcagcaauaggaaggcugucuaggaccgaccaguacauggagucugcccgcgccucucuucucggggcuucuucaucucuuugagaugguuacauuaaaagggugcggggccaguguuagaccaaaucucccagucaugacaggcuucucggaacccucagguaacgcaaaggugaaagucugcaucaggcucacgaacaucaggaauaacuccaucuuggccagcugcucucccauacacacccgcuucccuacaagugagaucagacaaggaacaguuaggacacacccuguucuuuuguagcaaguggcuacccggucuguagaguuuuaaaguaaaaucaccaccuaagccagugcccuucaguuuaucuguccacaguugguucacccuugagcuccuagucauggagacaggaacuaggcauggacccggagaggcagccacccugcccuugucuuccuaccuaccucaccuggaggacuaaggggaaggaagugagagcaaaguuucuggaaacuucuguuuccacagaaggagccuugugggccuuaaucugggaacuuaaagaaagacccgagagagagagagagagagagagagagagagagagagagagagagagagagagagagagcuucacucccagccuagcagaucgggagcugcucucaggccuguaacauggccgaggcucucgcucaggccucacaaccuacauucaaucccugggacacacaugguggaaggagagagccaacuguuuuaacauagcaugcaugcuauaguaucugucuuccucccuagcgcguucgcgcgcgcgcacgcgcacacacacacacacacacacacacacacacacacacuccugugcacaaaaacaaauaaguaauuaaacugaaaguuggcaggggccaugcaggaagggcuguggcaagcaagaaggcuucguugagauggcccauccuuuugcacagcugugaagggugagcucugaagaggcauggaccccagggacuuugucccaggacuguucuugcugcugugcacguccaugcuggccacugccgcgucccucaugaaccugacaaagccuguuguuuccugggguuuuaccuacucuguugagcagauuucuuacagaaucaauauaaaaauguacuuucuuguauuaauacuuuuuagaugaauuagugacuuuuauagaauuccugauuugauucaaauaauuuuaggaaguuacaauaauugauagaaagucuaaggagaugguuugacuuguuuugccagaaagaugauaaaguuagaaucaagaguagaaugugcccccuucucuuagaauaucacaaaaaggaguacagcgagcuuucacacacuacaagcaugugaacugcacuaggaagagaaguaggcuugggacagauuugugaucaaggaaaaacauucauucuaggucagguccaaggaugaggccacaggugugcacuaugauaaagcaaggccauaaauauauaaaacgauugcucugcacuuacagugaguuuauagaauaagucacagauaagacaacugcuuugaauuuauuaucaacaucauccugcugucacccccucuuuguaacauuuuaucuaugagguaaucuuuucuuacauagagaacuguuagcugaaaagcuauaaaaagcuagaagcaaaaauaaaccguguuagagccagcucuuuagaacuuugcucuacccaucaacuguaaauauguauauaugucuaugucuguccauauguacauauguauguguguguauauaugaaugaauuuauguguguguguguuguauauguguuauguguauguauguacguaugcagugugugugugugaaacuguuggaacuugcuuauuggaacucgauuuuuagagccuguuuuucuuuuuccaguguuaguaugugcguguacaauuuugcucucuuuccuuuucuuucuugcuggccucuuaagaguuaaaagaguucagaguuucuugcaagcagcuaauuaaccuuugauaguuccuuagccuucccacuucucaggccccaaagagcuuaagcaaccaggaaggcaagauuuccaguuauaaagauuaagcccaucucccucccucccuccuuucuuugucugcucgggauggaacuuaggacucaugcaugcaaggcaaacagacaccaagucacugcuguccauagccaugcuuuuguuuuuuuuuuuuuuauuuauuugaaacaaacaaacaaacaaaaagguugggucagcaaggcaacucaguagcaagaacugauuccuugacauuguccucugaacccgguaccuacacucacacauacacaucucaaacaugccuguauacacacacacacacacacacacacacacacaccaaugauaaagugaaaaacaaauuaaaaccaagcuuuaacugaccuaucccaaaaggaauaaaaguuucucuuuucaaaaguuguccuuggucauccagaaaucgaugaggacagaagucgucuggcuucucccagauggcugggucucuguguacugaccacagguugauuaggaccacugugccuuugggaauggugaacccuuggaggacugcagacaacagacaagaacggagucaguacuguacguccacuaaaaguucucuuccaacaucacuguuuccagggaggaaauggucaccuacuaacacaguagcuggcugagacuaaauucugaggucucugaggggagggacaagauccuaucaaagaucucugauccugucucucugcuccagcccagacccagccugagacaggaguggcaggacuagguguugaaucaaugagccaagucaggccacuaaaacuuacgaggaaacacuaaagcauucuagguuaacauuccccaagauuuauauauucuuaacauuuacauagacugugaccuagcuagggcugcuacugcuguguagacacagcaugaacaacaaggagggaaggguuuauuucccuuauacuucaucauggaagaaagucagggcaggaacuccggagaggcaggagcugaugcagaggccauggagggguguuguucucuggcuugucuccccuggcuugcucagcuuucuuauagaacccagggccaccggcccagggauggcaccgcccaccacgggcugggugccccccaucaaucacugauuaagaauaugcucuggcugggcggugguggcacacgccuuuaaucccagcacuugggaggcagaggcaggcggauuucugaguucgaggccagccuggucuacagagugaguuccaggacaucagaaauaucaggacuuuuuauuaccuuaucuuuauuuauagccauaucgcaauuacaguuaugaaguagcgacaaauauaguuuuaguuccacaacacgaggaacugcauuaaagggucccagcauuaggaagccugagacccacugcccuacaggcuugcccacagcccaaucccacagaggcaucuccuuaauucaggcucccuccucucagaugacuuuagccugugguaaguugacauaaaacugcccagcacagaagggagccaccuacaggccuuuguguccacacugcaugaaggagauggcgaauuaagagaaaagagcucugcuuccccaucaccagcaucguuggacaggcuaaccaauauccccaggggcugggcucuucucagagcaucuacuuugcauacugggcugucucuagaagccuuaaacuucacccuccccaucagccucuuaucucugucucucugaaacagaguuaccucugaaggcacgauucuccugcugaaguuucccaagugcuaggaugacagcuggguagcacucugccuuaugaaggggcgcuuuagcgacauccuggacucaccacauacauggacaucuuucucagcagcugauagguuagagcuggugaccccuagaaucaggcuggagcguuccaguuuuuaaauaauuacauuuugccugcagaauuuuuaaaaaaaaccaaagggccuaagcucuagcuaacaugcuuaaguccacauuuagucuggaucuuccaagucucuucugcgggacagcugacuagaaggacaacaucguuugcgcugugguauaaguguguggauacuggaggccagagggcuacugguaaggacuauagucccugaaccagugauaagguagaaacaacccaggaccuuucugauguggccacaccccucuccacucggaggauucccucagggaucugcagagaagggaggcuccggacuugccuguuuucuccgaggucaugugaggaauggcgagcggcaccaccauggacagccgcugcaccuccaugaugguggccucuguguauggcaucugggccuuguccgugagggaaggugcacggucacagccaaugacccuuucaauuucuucaugaaccuuuucugugcaggaagggaagaauaaaccagagauaaggcugggagaguugagccagcgcuguuuauacagacucuccccaucaaggcauccguuggcgcgguggcuggaugcaggcuuggcagagacagcaagccacuggggguggggcccugccacacuggagcuuugauggacagcagaagagauugugcaaaagaaacagcccucuggauuccagggcacgcagcguuccgugcucaugugacucucuacgcuguaacacccugcaaaaguccaaaaucauagccagcaaaccagaccuuugggguugcugcaguugagcaugacccucuaaagccugugguugcaggucuguucucuacaguggugacauuaugaggggggacccugugggagaaccgaggagaaagcgcacuucccccuuccuucucuuuugcauccacccugaggaaauucccuaccacaauccacugccuuaccacaggccccacugucaccgagacagcuggcuaugagcugcaaccaccagacaacauacuucucuugucaguuaauuaucaaucacgcauuguuacagcauugaaaaacugguuaacacuggguucauguacauguaccccucaaagacuuucuaaaaucauaaagcuggugugauuaagcagcaaauuuuuggggauaauguguugcuuaguaguagcuacuuaaagcagauggccacaaugaggucugugguaagaaaagaaaaguggacgcuucaagaaguucguaacuccauccucuggcgccuugcaaauaagauaucuucaagugucuuuguuuccaaucucuacaacugaaaacaaagcugggugcuacacacacacacacacacacacacacacacaaaaccuuaacucacuguuucagaaaccccucuuggguuacaucagaguguggcagacaccauggugacaccaugugugugagagagauguuacauggcaaacaagaauccagaggcacucaggggcccaggcugccccuuuucugcuaacucccucuuaugggcaugaacucaguuccuggaagcacuacaucaaccugauugaggaugcgagggacacucaaacuccucaagaaucuuggucucgagagugagcucuaaaaaguccuaugacaaacaaucuugcuguggguaccucaaaggcacaaacuuguagcacaugaaccuuuggggggauacuugaaaaucauauccaacugacacacauagcugaagggacuguacuaagcauggggacauauccuggacuauugagugcaucuccauccaagcacaguuauaugcuauauggugacacuuuagucaaccacugaccacaucaacaagauggcccugugagguuauauugccuagugacacuacgguuaugucaguuuaaguguacucugugaugcuugcacauagugaaaccaucuagugacauauucuuaggacaugcgccuaucaccaaaccgcaugggcuuuaaaaucagauggccuugccuaaccgacuucagucagaagaagaugugaauacggaagcauggccugagggcuacagcucugcuggcucugaagauggagagaggaccaccaggucaaagaagcugaaaauagcaaggagagaauuccccuuuggggccuccagcgggcaacgcaagccuggcucacaccccagucuucaguucagugaagcauuugucacacuucuaauauagauuuguuauaaauucggguuugcuuaagugacuaaguuuguagugaauaaauagcuagagcugcugcugaaagcaauauaccacguucccuuacucagcccccgccacuggcuguccacugugguggcacuggcugugacuucugcugacucuugggcuugcguucucuguguucaaaacgagaugaagguauggaugagcaauagacucccuuagcccucucuacacgccacuucucuaacggccuucacuuucacagguuucaaagggaacuggacagggagauuaaacaggggugggcaagcuaugacgcuagucugucuagaaacccgaggcuucgccgcuguucaccucucgaacucccuauagaauacaaguguuuacugcguuuuuccaaccuggacacaugggugcuccggggccagcagaucacagaguccgugacuggguucaaagaaccugccuuuacccugaguuaagaacaaaugcaccaauuacuuugcacgucgggguucagugacauguacagcaggcaccagagcagagaguuggucguggugucagugccggcgaugaagagguccccaaugauguagaacagguaguccucgucgaagcugcugcgccugcuggcucccugcucuuccuccaugugcagaagguacaugucuaugaaguccugaggguugcuggcauccagagacucuugaugcucucggaugauguuuuucaggaagcaggauaugucccuuucgauuugccuuagcuccuuaaauggaccaaaggggagguaguaaaaccaggggcauauguugaucaggaagagcuggcugugcaggcagauuuccaacccccgggacaugaaauccaacaccuuuuuaaacuccuuguugguguaaucgaagcgcuggccgaagcacagggagcagaugauguuggagacggcauugcugaugauugggaaggggcugaagggggccuccccgugcuucugcauggcuucuuucacguaugcaaacuccucgaugauccugggcuccaggcugagcuugcccagaccgaaaugacgaagcgucgagugggagaaucuccucugcuguuuccaaauuggaccauagugugcaaacacgauuccugcaaggacagaggggagggagggugagagcaaggccuggguauagcgaaugggagccaccggggaggcauagucuguauuuucaagucucuaggccaauguucagaugcagauagaggcagugccuaaaauucuugugcacuuaaguaucuuucgauuucacaacaguagauucaggcuuagaaaaccuucaaagcccagcuccuggcacagugcugcacacaguaggagccuggacucauccggauucccgauggcugcguccuauuugaccccaacgcauacaucgaccaccaugggggucggaugaaguccugagcaagccugugcugcugacaugaacauggccguguuaagggucccucaagcuaagugauagcaaggcccucacccccacaucagauucaaagaaaggcagaaccuuccucugguccacguguggaugcugacagcgcgugcagaaagcacugagcgcagcuuccuccuuccugagguuuauagccugagcuugcaccucuguagagaccucuccuaccaagaagagcugauccugccucccuugcucaacuguagacaguaacccggccuccucgguccacgugcauacaauaaacgugcguggaguuguuucuaggcugccgcuugagcauccccaucagacugugcugcccagcgggucccagcuuugcucuacaugucuguccuuucuuccuuccccaguggcccgaggcaggucaacuccaaagcuguguaggucacacaucucccguccccuccacacuggauacuuugcuuuuugcugugaauaaacaccuaauaggaaacugcucacgccuuugccaggaagcacaaaguuuggaccacagccagggcucggcuauaauccacacacaaggcccagggaccagcuuccucuagcugggucugaccuucuaagaguucuacaauuucccaaacuacuaucacaaguuaggaccaaauauugaaacacaugagcccacgggggucagucaacauucaaacugccgacgccauguucugaauccuuagcguguggugugcaauauucaguugggaaugaaagauggagccgggcagcgguggcgcacgccuuuaaucccagaacuuggaaggcagaagcaggcagauuucugaguucgaggccagccuggucuacagagugaguuccaggacagccagagcuauacagagaaacccugucucaaaaaacaacaaaaaauuuaaauaaauaaaaauaaaauuaaaaaaaaaaaaagaaagagagaaagaccaguucuguuguugguucuuuuauacuguaaguuccucuguaaucaagggucaggggucagcucagcaguacagcacaaacuacuacuacuagcauucacaaagcccuggguucaauccccagcaacaggggaaaagagaucauuucaaaauaaacaucucuauggauggacccaggguugaauauggacuuucuucacauuuuacagacaucacuaagggcgcagugacgagccauaaaauauggguaucaucacaugaauagucacugccaaauuacugucuuaaguagauuuagaauggagaaaaaggacggccacgaguauaugaacaucaccauguuuugaacggcugccucuugauacuuguaauauucuaguuuggccacuagagggagaaacuguaucucaagugauuuucauucacacuuccgugauugucaguguaggucagaguggcuuuacccaggucacugauggggcucuuauuccagaugucacacuuaccuuaccuaaugugugcuguguggagauuuucuuucuauauaguguaagugcauaggugaaaccuccucucucucucauuacaugaguuaguuuuugcuuuuaauaguauuacuugauaagcauaaguuuuaaagauaccacaaguagauuaaaaaacacugauuuaucacgagugugugugugcgcgcgugugcacgcacucccacaugcacacagaagccagaagagggcauuggauuccuugcagcuggagcuaaaggugguuggaggcaccuaucuuggaagcugagaucugaacucaggaccucugaaagagcaguaugugcuaacccgagccaucucuccaguccacaugaagacuucucucgcuuuuuaaaagauagaguguuauuuugaagucuaugcuguccuugaaguuguggcaauccuccugccucaaccccuccaagugcugcugugccacugugccugucuacagguccuuuucuuuaugauuuaugcuacaggucuuauuuuagaaaucccuuccuaccaaggauucagaaacacaccauuuucuuauaaaaauuuaaaaugcugacuuugaaaacauuuuuuaagauuuauuuuuacuuuguauguuuuuaaaaaauauuuacuuacuuauuuuaugaauaugaguacaccauugcucucuucagacacaccagaagagggcaucggaucccauuacagaugguugugagccaucauguggguuauuggcucuugaacucaggaccucuggaagaacagccagugcucuuaaccacugagccaucuugccagccccaucucugcauguuuuaucugaauguauguauguguacuauaugugugccuggugccuacagagaccagaagagucugcuggaucccccagaacuggaguuacagaaaguuaggcagggccuuguggaugcugggaacugaaccuaggcccucuggacgaauagcaaaugcucucaaucacaugagccauuucuccaggccccagauuuuuuauuuucuucauuuuuaauuaauucucuaugacuuaccuauaauuccagugagauaaaaauacauuuuuuuucauauagauaacuggggugggguugaggguguauaacccauaggcaggugcaugaggaggccagagaagggccuccaugugucccgaucugucacucucggccuuacucugucgacugccucuuacugaaucagcucgcugcuaggcugguagccagaaugccaaggugauucuccugccuuggggucugaacacgacccagaacacugguagucuguuuacuguggccgauggcuauaaacuugaguugucacuuaaaucagaugaagagagggcagaacgcuggagguuuaagccaagagagauuuccuggucuuccuucaccaguggccagauuaguuguguauccuuacucuaaauuucauucagagugaacguuuacagaucccugucuuaaaucagaagcaucuuacacaguggcugucauacacccuucaucuugaacccaacucuagccaagaggccacuaaggugcacgcaauucagcgcauccaacuucuguuuucugcagaggcuggaguggccuuaggaacaagaacuaacuacccuugauauagcagucaagcucuccgugcuccagcccagugcucacaccugcccuccccauuacaggugccuccaauuccagagcuuucugaggccuuacauggggaguuuccaaggcaaaauuagaaauggggugagggaggggauaucaaaguaugaagucagggggccacucuccugaaccgaagcauauauaugccacccacaauggauucagucuuguacuucagugucugaagacagaacacaggauugacagguggcuggagaauaggagaucgagacccugugucugccgagggagauauacacgggcucugggaacagacuggcuaucuugaaauauucucucaaaaaaauuagucacuuucucuuaaauuuaaccucaggcaaguucuuuagucacccgcggggagcagccacauucuuugccaaaauauuagaggcuaugaacacauccgguucaccagucuccuagcuuggauucuggccauuccuaagggggaaaaaaauaucuucuuauacuuuugcaacugaaugauacucggugaaaugaaucccccucccccuuuuccuaacacagccaauguuuagaaacguugagaucagaccuaugcgugagaaggccucacuugggacaaaggaaggcuuccggggugggugguccuuauuuuacaguuuggugcccacaccucccucacuuuccagugugucucccacuuuaaucgcacacuagaaagccacgccuccguccucuauccccuaugcuggucaugacgcagguccugccgccuggggauccugagcccgcggcgcgcucacccuucuccuuggucaugauggagaugagcggcauccgcgggcggucacugaacacuucagccugcugcacuagcgccucgcgcacgcuguggaagucgcugaggaccaccaccagacgguggccgaugaagaagcugaagauguugccauagacacgggccauccuggccagguacacaugcuggcccaccguguccgucuggcugcccgagcccagccagaacugcggucguagaaagcgcggcaccagcaagugcccgaaguuacccacgaguggccgaggcuugggccccggagggaugccgcaggcgcguugccgccgcagccaaacccagccuagcagcaccgccagcaggcaaaguagcagcgcgccuccugucgcccgcacgugcagucuagcucccggcugcuccccugccgcgggacgcugguccccgagcgaggacaugucccagguaccgccugcaucuagcuccgcugcagacgcgccggcaccgcgacaguagccggcuacaugacucaaggucaaccgcgaggcagggcaaggca

SEQ ID NO: 1718 - RNA, 157547 nt, Mus musculus
cgacccgaggcggcggcgggggagggggugcugggcgcugucaguggagcgaggugcgcgcucacccucggguucugagccggggacccgggaggcccgcgcggacggaggcgugucgcuccggcugucaccuucccuaggcggccucuuguagacgcgccugaaaugcaggacacggcccacuaagcacugccaggcauagcuuccgcgcuuaggagcucaaccccccaaucucugcguccccagauucaggcagguauucuggugucgccgcuugccuggcguuagugggugggacuugugggacaaucagguacugugagugacccggccauucugcaggaacccauagaaccaaucuguggagcugcuugcuguuguguuugucuccaaacuuccuucucccugaagcccaaguucaccgagucuuagaaaugcaaauacgauuuuacucuggauaaaauccacgucuccccacuaccccucuuuuuuccccccuuuucuccuccuccuccucuucuucuucuacauuuucgacucacgugagucaucuccaaucucuuuaagaguuuacauugugucuuguucauuauaggugcaggccauguuugugguuuucaguguucuggcuacagaaacgucagacuuaacguagaaguuucaaaguauucccugaguaaauuuuccaagccaacuaccugccuacauggcuuucucuuguaaucucugacuucaucguuuucauuuuucacucucuucuaguuaccaagugugagcaccugugugugugugugugugucaauuuuuuguucgugagcuucaugcacaccagagagauagacugauacugaaauuuguuuucuugcuugugguuuaucuuuuugagucauaaacacuugucugauuuuucaguuguauguuauuuaaugucuauaacggaaaaucuaauauaucauuguaaaaguuaaauauuaaaaugcugagguuaugucucaccuuuccuaugacuucaagccugcuauguagauauaacuuucuguaauuuugcaucuacucauugaauaagaaguuaagauucaaguagacuuaagcuagcucacaguaucgacaagauucagaauaguggucauaacuauuuucacaugaacuuuugaguauguguuuugacuccucuauuaugaugagaauagcacuggcucucuccauuuaucaccaagaaaacaaauucgccuguguuaccaaguuuucagguccauuaauucugaaagccuaugggagacuuuauuuggcucccaaugaacagaggagccuugugcucuacaggcuucuuguagagcaagucugaggugugcauuggauaugaagugguuugcaucaaaacuuuucguaaaaacaggaugggcauaaccgaucugugguggaacuaauguguauauccuuuuuauuauaaagagcacacauuaauuucaauugucaaaccagauugaggcagucuaggguuucucuccuggucagucaucaaaugcauauggcuauuaguacuuggcuuuuuauguuuugaaagcaaguaguaucuuuaaacaaaaaguuaugacuaauuagcugaugaagucuagcaaauagugcuaucauuaauuccuaguguagucuagggacaccugcauuuuuuccuuagcaggacuuuuacuuauacauugucaaaauuagucauaguuccuaaguguguuguuuaaucuaugugcagaaaaacaaauguucaugguaguagggauuuauaauuacuuuucagugcaaacccacacagugugcuaggucacauuuuuuccuucccucaaugucaugaccauggaccuuuuuguaauaucaaagauaauucagguucauucuuucccuccaaugguaagugugcuugauuuaguagauuguguguuuagauauauuuuuaaccuuucuccuuuucaaacccccuuccucuguuuuugccuuuugguuucucuuuggagaaagcaugcauccccuucuauggcuacguggcccugcaagguggugcauguguguaagcaagucccggggaggugaaggcaggggguuaggaguucaaggccagccugggcuaggugaggacccuguacaaagcagaacagcaaagcaacagcacaccccuccucaguugcagggauaauugaaugggaagaugaaaucuucuaacucuucucuuuuuuacgcuauugaaaaccuuugaaauugauuuugagcugcaauauaaacaugugcuuagguguuuuucuuucaaacauugucuuuaaauuuuuaaacugacuuuuuuaaaaauacuugcucucagaguaucaugguuguuuuguauuguuuuuccaaguugacuuuuaauuuuuuuuuuuuuuuuuuuuuuuugguuuuuucgagacaggguuucucuguguagcccuggcuguccuggaacucacuguagaccaggcuggccucgaacucggaaauccgccugccucugccucccaagugcugggauuaaaggcgugagccaccacugcccggcgacuuuuaauuuuaaauugagaaaguacuggauuaauguuagcucauugugucauaaaauucuuucguuuuguagaucaucuuaaaggauccaagacuacaaaauguuuccucugaaggaugcugagaugggcgccuuuaccuucuuugccucugcucucccacaugauguuuguggaagcaacggacuuccucucacaccaaauuccaucaaaaucuuaggucgcuuucaaauccuuaagaccaucacccaccccagacugugccaauauguggauauuucuaggggaaagcaugguaagaucuuucucuuuugaauuuuauguucacugccucaauuccagaugcaguuugaaaauacugcgucaguaucuguugacaagcagucaggaccuugcucucugugcuucagaguacucuugacugacuugacgugaaagggacucuuacugucucacuguugcaguugccuuuacagaacuaaaguaguggaaaagugugugccuugagacagcaguguugagugccguugaguucuuuguacuggacugagcauguggagauaaaaaaguacaugaaagucaacccuuugugcuuucugauauucagccauguuuucuauaaaauacauuucauauguuucuaccuaauggugaagacgaccuucauaaauauuuacuuuuucuuuguuucucugaaaaagcauacuaagcuauacuugaaauuggauagcucauuuuugaaaaaguauuugcucugagaauauuugguuuuuguagguuaugagcagaauaaucuuuuguuaugauaucucucauuacgaugguugacuaauuuucaaccauaaaauuauuuuuguugauacauaauaacuaguuuugcuacuauuaugaaacauaauguaaauauuuuuggagaaagagauuugcuaaagaagucacaacccacugguugagaaucacugacuuguagcaaugaauaaucuuuaucauauuacugugcgguaggaacaguuacaguguuguuuuauagauaaggaaauugaggcagagcaugaucccguagaggaaaauacaaaacaguagaauacuaagacauuacaauaaugaauuguuacuugauaaacgccucuagaagucacugucaguauauaauaaugccauagccacgucauucaggcuguuuggucccuuuaagacgauaaaguuugaccguauacuugcugaaaauuuaggugcuuguagagaccuuagugagagacguggggaaaauaaugauaaaaauagcaguucuaguagauaauuauaauuaguauuucauacucacauguauaugugugugcacagguguagauauguauauaauauaaauauaccuagagauauugaaauauauguguacuggcuaaugcuaguugugagcuugacuauaucuggaaugaucuauaauccagacguggagggcucaccugugauccucaucuugaggcuggaagacacaaguuucugaccuggaucuuguugcggagaucuugaggcauaguggcuaggaaaagcuuaggcccaggcaagguaguacaugccuuuaaucccaggagacuaaggcaaggagaucucuugaguucaaguucagccuagaacaaaaggagccccugauccaggcucuguggugcacuucuuuaaucugggccacaccuacucuaacagggccacaccuucuaauagugccacuuccugggcugagcauauacaaaccaucacaauguguuacuuuauuagagcuuuguauaauauaaaguugucuuuaauuuauugauuuagcaaauauuauuagaauuacugugaucuggucgggcuuaaucuuucuggugaagacuaaguuuuuuucuguuuugaagggaagaacugaaagaacacuggcuuugaaacaguauagacuuagaguaaaaccuaguuuccaaccuaaggauguuugucuuuaaguaaacagauaacauucgauguccuucuccuucuguggcaguauaacacugugaagcccacagcagcugcacuuccacauuucugcggaugucuuguccguguaaagucagggaaguacaucucugcugugaccuaugagaagucuacacauuuauaguccgccucaagaaacuguuaacucuaucaauauuccuuacuauauaucgcauucugcuuccuuucuccauaaaggauaucaaaguaucuacucuaaacucuaauuaaauucuuuaauuagcuaauuugugugugauuuaaccagaaaguacugugauaccauaugacaaauauaauaauuaagagaccuagagucagggcuacuauauguguuccaugugucuauugcaugaaagcuugagcuaaugcaguguaugagugcuaacccuaauucugacuaauccuggaaaaaaggacauuuuucaguauaauuggcuuaaagauaaccauaaggcuaaugguaacuauccccauaguacauaauuaacaacauuuguaaaaagcccaguaacgcaccucuaacaaguuuuuuuuaauuguuaaaauuaauguuugcucacuauuuuuauguguuaaauggucucaacaauauugauguuggaaaauuuggggaauuuuagagauuuuuacaccacccaacaaugaacugauacucuaauucccugcaugucuccuaguuacccuucacacucccuugcaccucaguuagaacaucuaaggaaacaccuugcaauggcgagauuucccaggcccaggccacuccaagcaaacccugcugagauccugcugcagcuggugaccuuacugcguaggacacucucagacccuugccaccuucaguaaaguacuuaguuccuagaacuucuuuccuaacaacuucagauucuucccaccauaugggaaaguccuuggagcaucucugacuugauuccccauaugcuuccuuucgucugaagguuaauucaugagcccuggcccccauguccaccuuacuccagguuuacuuccucuaaccaaagggcccccucagcacugaaauagggcugucacaaaacagcauccuugggaagaccacucuuacuaaccuugccugccuuugaaccucauuuggcuaucaguaucacauagcaauggaucccuuauauaccuuauaagccagaccagggcuucaagcaugauucauuuuuuaaaaucuaaagaaacauacuuaaaugaaaccaauaaagcuugaauauucagauuuuauggagauuaaucuuuuugaguugaaauaucagcagaguuuagaaguacagugaagauuuaaagugguagugugccccauuuugauugcuauuggauauuuagaaauguuucugugauuacuauugagaugaaucaaggaaaaauuauuuuacuacagagauuugaaauuuaaguauggaauaaacagcauuauuaagaacauaguauuaauuauucuguacuuauaaccuauaaauuucaaccuaaaugcauacauaggucaggguuauaucacagaaaugagcuuguagaguuuauguguaugaagagaucauguagccaggcagugauggcauacaccucugauucuaguacucggggcagaggcaggcugauaucugaguucgaggccagccuggaauacagagcaaguucuaggacagccagaguuacacaggaaaaccaugucucaaaaaaaacuagagagggacaaugagagugagugagagucagagggagggaggaagagagggaggggagggagaggaagaggggcagggagagagggagagggagagagagagagacugagacugaucgauuaugugcuaggaacaggaauccaugauucuugcuaguccagcccaaaccacaggucauguuuucaaggagacacugaacuuuugggcgggagcugugacuugcguuuucagggaacccucagcucugucuuaggauugauccagccugugaaucagggucaccuagguuauuagggauaagcuuucuuaguggcccuggguagaaacccaagucauccagacagcuucuuccuagaguuauggagacgaguguuugucugaauacccggggaccguagcugacuuucagaacugaccacugcagaauccugguaccacccguauuuguaaaucaguuuuucuuuguugguguuauuguuuagagauuuacuuaaauaucauuuuaaaggugaugaguuagucuauggugagcuagguuuuacugugaauaacaagaaugaugcagggacuguaugaugauaacagacaauauuacaagacauucauaauucauugccuuuauauuaaaaaauuuauacuuuuauaaaauuuaaauuugucuuaaacuuuuauauuuuucugugacugugcauguuaugcauuaugaacugggauacaaacauguucuggcaugcauguggaaggucacaggacaguacuugagaguugguuaucucuuucacacuuaugugaguuucagcucaucaggcuagcauggcaagcaucucuagucucagagccgucccuguggaccccaagucucuccuuuacugccuuuauuuauucaacugcucuguuaucuuuccugauuaaccaucagugacugaaaacacauagcucuagauagauguagagugugaaauuuguuagaaauuuuguuagagaaaaagauuauuuugugcuuuucagacauuucuugaugucuagaaauuuuguuagagaaaaagauuauuuugugcuuuucagacauuucuugaugucacauuuguugguuuuaauuuuuaauauuuuuauuacuuuuaaucacauguguguggcagguggaguaugugcaugucaguauaguuggcuucagaccccuggagcuggagcgauaggcagcugugaaacacugggugugggcaguuggaaccuaaccugggcacucuggaagagggcauucauucuuauccagugagccaucucucuaaccuuacauauuuguuauuuauaaauaaugccacuguauugcugacuuuuauuugguacauaaugauucccagacaauuuacucuguacagucaaauuguuuuuauaacaaagaaaaucuauuuucaaacacauccagaauuuuggaauguguacuucuaaugaguucuaggaaaaaaaagacauuaauaauggaaagauuccuucagaauauacucuuuuccuuuugagaaaaaugcugaugguuaugcuguggguuauggcucuacauuacuaacaugguuuaaacuaauaaagcacuuugaagccuugguagacacugaagguguugacagaggaagccuaauacgagaugcucuacaggucacuuauagacaaaaagacuuacgcuuauccacuuguaagugacugauuggugaaguauguauauuuuaauaaauccugauguuuguugcauaugaauuucaaugcuccuaagguauuguaucuagcuaggacauaagcauguacuucucaacacagaacacaucuccaacccaaauaugcccuggcaaugaaaacacgacucaauuaauaugaacacaugcugugcgccuagauugggcggaucuacugcuacacuaccaucuuccacauugaugagaccccuuagaacuucagguuucuccaggccaugugcuucugcucugcuuuucuucuuccucuuccuccugcucugccuccucucccuccuccccaucuucagcuccaccuucccuuuaucugcccaaucauaagcuguccuuuauauuacaaauuaagguuuacaacaaaucaccagagugcugacucauuccuuguauacagccccucacuggagaauggaauaauuagccccagggcuauccucaacauuuccccuucucuguccaauuaaaagacuauuuuuucacagauacaauugaacauaacuacuaccauuuuguaguuauaaaguacaagagaccuaauacccaguccaucaucuuuguuaauuaaauagagccucugucaucuauccuuacuuaaaagauuauaguucugcaacuggcuauguuuuggcuuuagauugaaugacaucugaaaaacauccucucaaaucuguuccccucaaaguaaaaagacuagguuagcuaggagacuguaguuuuucaacccuaucagaaaugcaaaacaaaugguauuaacugaaaauauauaggaagccuaacauagcuuccaaaacuuaaccaauuuauagagaucauugggcauaaaauauguccuuuuugaaaaauggcuaucaagcuagcucaacaguaaaagcauuugccaccaagccuggcacccuuaauuugauucuuaggacccauaggaugaaaggaaaaaccugauuccugcaaguuccucugaccuccaucuguacacaguaccaugagcaaaugugggcacauagacacacacacacacacagagcacuaaauaaacguaaugcaaaaguucuuuuaaaagguuaagaugagcugggcagugauggcacaugccuuuaauccuagcacuugggagacagaggcaggcugaucacuauaaauuuaaggacagccuccucuacugaucaaguugcaggucagccagggauacacagagaaacccgugucucgaaacaaaacagacaacaacaaaagccaaaaucaccaccaacaaaaaagguuuagaugaagauucucagacaugggaccccaaguguaauuccacaaaggauggaaaugagcaaaagcugauuaaauaaacauaucguggaaacuagagaaggacuuccuuauucugauuuauuaucuuuucacuugggcuuuagagugaaaauaugugggaggaagggggacccuaauuaggugaaaagaacaguaaagagauuguguggaaacuaaagagauaaugcuggcuuauccccagauugcaguggauggaauaaacccuagaguucuggaagcaauugggagauagaaauagcaggacucuauauguugcuuuaagaaagggaaaguguauguguuguuuguuucucuugaguugcaagugaccgguuuaguuuguuugcauagacaagggucuaguauauuccagauuggcuucuaacuugcuauauucuuaagaguagccuugaaaguccuugucucugcuucaaccuuucagugcuggaauucaggcaugauugccaccacccugguuuaggaagugcaggugacucagugcagggcauuguacauuuuaggaaggcaucugaacuccaaggccagcuggcuagggaauucuccccugaaggcaaaggugggcuccagaggucugccauccaggagagucccaggcuugguaaaauguaggagcuuuucaucucuagcacuaaauaguagaugaggagaaaauacaaaagaagacuaauaaauuacaggcagaagauggguagcauuucaguuuggguggauggggugcuuacauagaggagagacugagaggaggagccagauagaaguuaggaagacuggucacacgugcacacggugaaaacggauaguacuuaaaauauuguuuuucuacugcauguuaguaacuuuagagggauauauguacuuguuauuaaaguauguuaauuauaaaguagauuugcuuuguuuuucucagaaagacugguggugguggcggagcacugugagcgcaguuuggaagaccuucuacgagaaaggaagccugugagguagagugugaagcaaaggugggaaguggggauccguaacccaagaagcaucugacuggagacugaagggcccuggcuucucuuaauguucuauaaugagaccguucaguggaggucuuuaccuaauuuacgugguucauaggaauucagugguaacauuugacaaagcacuugagaaaauuccucaauggagugaguauacagauaugagaacuuugacaacuuaguucuaagaacuuauuccccuagcccggaguauuuuccugaaagggaccauuguagcuucucaguguacagugauaguccaaggugagcagugaacuuuguuaaguaauuccauguuaaggaugagacagcguuaguaauccugaguuggguagaacuuaaugauaaaguauaauucaacuauuucagcaacucaaucaauuuauguugucuuagccagaauaguguuaucuaguuuuuuauuacaaguauacuauuaaauaauuuuucaugcauuuacucaagauuauuuuuaaaucauaaaauauuuaauguuuaaguaaacuuauauuaaacuaacaaaaauuacuuaccaugagccuuuaugacuuuggaauuuucuacuucagcucucugaaccuguggaguucucaaacuuaguggcaagggacagaggaggguacacaacgaaaaaccccaaacuauccugaggucaaggucacuuauuauuucaaagaaagaaacaccaaauaccaagguggucaaccugaaguuucuuuuagugggauugcucagagugcugcagcagagagugagaaguucuaggugcucagguuagacgcuuccugcucuguguucugauugccagcagccuggcgcuuagcagacagugaaaagcucagcucuaaacagcagcaacagcaggaggaggaggaggaggagaaagaagggggggggggguugcggagcuccuggcuggaccucauauguuggacucugaagcuccucucaugaauaacguuggagcucuuggccuagguguagggaucaguuacagaucuccagugccuagcaaggcuuggcugcucucucaguugguucuacuagccacuggggccacacucuuguuugugguccuucauagccuucccuguauuccaucucugccaccuuuguccccugaugucucugccucagcagcucucugggucucuuuagucuuccucuuggugcugcugcuuuuauuuggucuguuagcucucucauccccauguucccagcucaauuugcuuauagcaaucaaaaguaggcaaaguaaaaaccaaaagcaaagaaacaaaauugagauaagccuuuuguugggcuuaauguugcguuacuaggagccaggcaggagguguccauccccuagcugauuccagagcugagccaagcugacuuaccaccagaaucagugugauauggcaaagguguuuguauuacucaagguacaguccuuuaugcaaauaaaagauuguacuucucgcaauuacaggccuuuuugcuaggccacuagcaaagcugcuuccuucugaaguggcugaaaauagcuguaggguauuuaaguucacugacacuugucuucucuagacuucuacuuucccaggcucauggaugucuggagugguccugucuggagcuucaauucagccuugguuauaguaggccucugcagcuaccugcgggauguccucagaguaugacaaaguauccaaauuagcaagguugccaugagaacuauccaguuuuugcaugggauggacugcuuggcugauauuacccauucaagcaugccaccaugagacaagacugucacacaggccugugccuguucuuaacuuguuuaaacauugacagaaaguauuaacaacuccugugguuaaaugcaggacuaauauuuuguuuugauauugaguauguaugaaauuguauuuuauuuucuauuuuuuguugcuaauaucaaacaauauaagucaauacuuuucaauaaaggcuuccuuucuauggccuuacuaaagaaaguucauuguuuaaauaguuccuuugcagauuccauacgauuuuuuaauuaagcaaccauauuaucguuaacuaaaauauguuuauauucuuuucuaaaaagucauuauaguuuuuuuuucuugaucuugauuugguuucacaaaauugaacuuuugcuaguauguauuuguauuauuguaauauaaauauuuauggucauguuucauugguuuuagauauugacuuuucaauauugaacuauuauguaugguauuugcaauaauguuuucauagaugccuuuuuuaugauuuucuauggcagaauaaaaauuuuaguguguuugugucaugauaauaaauuauuuaaaaaaugacaaaaauaccugcccuuauugaauggguggguuuuguuuuuuuuuuccccgagacaggguuucucuguauagcccuggcuguccuggaacucacuuuguagaccaggcuggucucgaacucaaaucccccugccucugccuccggagugcugggauuaaaggagugcgccaccaugcccagcuccgguguuuuuucuuuauucccagagauauguuaaagcacuguuuugcagauuauuuuaugucaggaaaguuggggaauacagauuuauaaaaauuuauaguuacaaauaaguaguauaagaauuauaaaauucuucauuuauaaaaaugcucacauuuacuguaacaggaugcuauuacauguuccgcaaaggcacugaagucuuugaaggagaaauggauccggugcacccauugcaaucaggcaguggucguuaucugaucacugcucauuaguugcuguuuaguguauauuuaucaccuuguaaauuaacagagugaagcaagauacauuuggaacauucuccaaguguagcaaaucaauucuggagccuacuguugucaaagcagaccguguuuucccuguguauuuugaccuuagcaaauucauuauuuguugaagagaaaagcuaccuagugcucagcauggguauuuguuucuuucuuauugcugauuaguaacauucaaaauuuacagcauucagcuacaguuauuuuaaaauaaaagcugaguuguaaaauauguccaaccuaacaacuuagacacagaggauguauuuuucauaccuucuacaaauacucuuugauaguuaaucuguccaaguuucauuucaaaaaugugaaacugaggaaaaaggaguugcuuaauuuagcauaaauaccugaguucaauagucaaagaaguuuuuaucuuucaguuuuagaaacuauuuucucugggauuuagaggugagucacugguuaaaaacaguacugccuuugccagggauacaugaucaguuuccaguacccuugcugguggcucacgacuaccuauaacucuagcuccagggcaaccguucucuggacauccuaggcaccuguguucacauggaaacauaccaacauauagguaaacacauaucacauaauuuuuaaaaauuaaucuuaacuuccaaauuuauuagcauaucauuaaaaacaccuuauccucugauucugaauuuauaaaacuaauaaauauugaaaaguuguauauugaaggacauuuuuaucuugaaaguauaggagggagucuuuaaagacaaacauaucuuugcaauauuauuuaagcauuaaucuuuuuuaaagcauuaaucuucaaugauaucucucuuucucucucucaucauacaguagcuaacuauaauucauccauuuccucuccauuaacuuuuuaccucaggcugauaccaagaaaauguaaccaaaggaaaauguaaauggaaaggauuaggaauuuuauaaggugaaaaaacauguugaauuuauacagucuagaauuguuucuucccugguuuguugacaguauguguguuuuggcuuaugcagugaccuuuagaaaucucacggaucauugauuugaggaaauagcacuugugguuuuaguuaacacuucuauaagaaugauucccaaaucuaucucagcagcccugaccucugguucucuugccuggcaucuauuucuugcaagcugauagaaucucuucuuggaaacauugcagauagcugagggaauuggugguuuauuugucaaguuaacagaauuuaaaaucaccugggacucugaaaaaguuuguguguguucaucuuaauucugaccauggauguaggaggauacacuccuugugagugacaccauucccaggucauggggaccggggcuguagaguucuagcacacaugcauuaauugacuccucgcugcuuuugguuaugguuguaacaugaccagcucucucaggcucugucucuguaacuucagaguauuuuaucacuguaucaggaaugaaacuaagagucucuuccuagcuuuuucuaauuuacaauuuacccaaguauugcaggauuacguauuaaucauuaugccaguacuuauuucuacugccuccaagaaauaguuauaccagcugguuaccaaguguuuaaacuaaugaguaucuucuauuacaaaaugaauucauuccaacuucaaaaauaucaguuuucuguucaaacaaaaucucuucugagacuccaaacugugagcuccauccaaaaaauauuucuaaauuacuuacuucuauaaacuaucacagaguaaacaaaccuguuucaaagagaaaagauaagaaaauaacaagaaaaccuuagacuaaagcaagacugaagcacagcaggacaagcaugacacccuguagcucaccuggaacuacauugaagccucauugaagccucccuuguaacauuaaucagaggccaggagacucuugcugugcccccuggccuucccaccagcagcgugcauguauucucuugcauugacuuuacuugauuccuagaacuuucuuuuaaaaugucccacauugcuggcaugcuuagcgucuugaugaggucugcauagcaccacaagcuuggucuucauagcuucccacaguagcuucucagggccuuguugugaggaguauaacucuaccugucauuaucuggugcaagccucaugacucccucacucuugaauucuauaugccuacacaaguuacaccauaggaugacaguaaauguugcugcugcugaagagguagucuggccccuuuagaccauugcugugcucugugcacaucuuagaaaauacuuugcuaggcaauuguuuucuagaagucaaucauggaagcucuguguuuucagguacuguccuuuuacgugaauguucuuuacauggguguuguguuuuauaucccagaucuguacgugggugagaucuuauucucaaggaaccuuuccaguuuucuccaugcaaaguguaaggaaagugcaugggaucucauuaaugggacuuuaacaauuacagcugcucuguccauacucaccuugucuguggcuuuaaccugguucaccuuccugucuucaccagacugcacauguuuggcaucuuugggcuccucuuucagcucuaaacuugcugugucuguaagucuggcuaaauggcagugaguguaaccgcaccacagcccaaaggccaucuagucuucaaacauggaguccaguucucuucaucuagcuucacacagguccucagcacaggcaagcauggauccagaugauuugucagagaggagugggcucuagagcaguggcucucagccuucccagugcugugacccuuuaacacaguuccucaugcuguggugaccccaaccauaacauuauuuucauugcugcuuuauaacuguaagugugcugcuguuaugcauuguaauguaaauaucuguguuuucugacugccuuaggugaucccugugaaaggguggauugaccccaaaaggggucaugacccucagguugaaacccacugcucuagacuaauugcuaaugaacugcuuguucccuuugaugagcaggaccuuuacggucacaucucuacagcauucuggucuuucacaguucuaucagaagcaucuguuaaguuuuccauauaucauucucagacugcucuagccuguagcuccaaacuuacaaauuccuccuacaaacaaaggcuuagaaacauggggugagacuuauuagagagacucaaguuccuguuacuauguucuguguuaguucugucuuucgcuuuaacagaaugucuggcacaguaacucaggggagaaaggauuuguucugccugauggaucaggagacauuguccaucauuaugggaaagauuuguuauugggagcgugagggugcuugccuacaucuuggcaaacugggaagccaugugcucagccuauaaaucucagucccagguuccucgugugucccaacuggacaugauacccagaagguccuuguacuuccaagacagugggaaccaaugauucaagugcaugaggcuaugcggagcgaaucgcuuuaaaccaaagcacagaaacuaaaaguuacugacucaaacgugguacuuaauguuaguuauucacaagauucugacuuuggaguugugugguuuaaacaaagccuuaugcuguguguuuauggggggaggggaugcauguuuuacagcacacaaguggagaggucagcgagcaacuugcuggaguugguucgcuccuucaacuguuuggguucuagggaucaaacucaggccaccaggcuuggcaacaagugcuuuuacuugcugagccaucuccugcuuuuuacuguacauggucaagcgagcuguaauguuaacuauuagauauuuuuauccauuauaacuacuuaaaaagauuucaucaucaaacuuauugaccauauuaagaaaauuuauuuugauauacacaccccuucauuuuaacaugaaugcauuuuugacauacaaaucuaauaccacgucaauuuauaaaagcacacuaugaaaaguagaacgagucuucuguauucaacugucucaaaauugguuuaaugaaaacagucacuguaaucauuugauuccaauuccaugagcagucuguguugaaauacagugcagcugaggaccucuagugucacugcugaauauggcauuaauuuguaaagauacuguaaagguguuuguguguguauguuuguguguguguguuugugugugugagagagagagagagagagagagagagcgcaagaauaaaaagaagagcuaaaguuagcuuauagaaccaaaugagaugcuuaaaugaaguuuuuuucacuuagaauuuuugagcauuuuaauuaaaauauauuuauacaucacuuccuaccuuuccuuucuuccuuucagccccuaccauacccccuacuauaaaauugauagccucuuuaaaaaauuauuauuguuacauauaaauauaugcacaauauguaaauccaaccugcugaguguacucuuguuaugugugcauauacgauuucagggcuagcuguguuagauuagauagcuaauaaaggcacucgucucugggagaggcuaaaccuccuucucucggccuguaguucuuugucuaggggugggacccugugagauuucccccuuucuugugagcaugucuguugauauugucauuguucaagucuuauucgugcagcccuuucuaagucaguccuacagcagcuuucuugguauucugaaccuuuucaucucccuccuuaguagucuucccugagcccuagaugcaggagcugugcuguagaaguguucacugggcaaaaguuucccacaauccauccaucucugaauuuuguccaguuucuguaauggucuccauuugcuggcgagagaagaaucguuuuauguggagugagaaccacacucaucucucgugcaaagauaacguuuagaaugugguugaggaacuaggcugcugcagcaagguggaggugguaggcucucuucuaagagccucacuaguccuagagcuuggcuacguuuucagcacuagacauggcucuccucccauugagugguccucauguccacuuagacagcuguugacuaccauccagaguuguagcuuuacauguaccuugcaucacagguuguuaugguucaugggagugucacauugggguagaacguuaguugugucccuucuuuggcaggugacauaguacucgcugguaguaagaaagcuagaucccaggaaggagacauucauguuagaucaguuuugaugauccaaguccugcgauccaagggugcuguuucuucagcacugggggcuucccuucaacugcugagaaguaaucaagggaaacaaugaagccuauguugcuugggggucccuuggacuaccuaccggcaccaacagcagggaagggcucaugccuggcaugagggucuguuagcccauggaccuuguggggaggguugucaacccagugacaagagaaaagaggacuaaaacuuguucaccuuuugcucuuucuuguacuuuaaauuuagaaaagaggauucaaguuuuaguaauaauuuuuuaaagaaaauguauuucauuuacuauuuuaaagugagcuuuauugaggucuaauucuaauaucuuaccacuuaccauguaaauguauaguuaaauuaguaugauaaacaaggucucaucaaagcuaagauauagaacaauuccaauagccucaagcucuccuuauauuccuguguagucccccaaaccuaugguaaccacugauuuguuaaucaaucuuuuuccuauuaccuauguuuuuuuuuagugguuucccuugccaaguauaguugaaucuuaaugcuuaucagaucugacaaguguuaucuuugaaugguuaaguaguaccauuaacaucuaacuucagagucuggaauggccuuuguggggguggaacgaaauggcuccuggcccuaagacaggggcaauagggcaugggccaccaugaguauggauggcuguuguggguguaagacuuguuuguauaauaauguacauauuuuuacguucauccuucauggaauauccucccuguuaauguaaaugacuccaugauagagacagcacaagucugggagaugaagaugugucuaaugucucagcaaaauuguaaaugcugggaccuugggacagccccuaaagcuauggaaaagaacucaacaaacaagaguccaaaauauauaauuucaggggcuagagagaugucucagagguuaagagcacugacugcuuuucuagaggucuggaguuaaauucccagaaacuauaugguggcucacaaccaucuguaaugggaucugaugcccuuguguauuugaagacagugacagcauacucacauacauaaaauaaauaaaucuuuaaaauauguaucuauguauauauauauagauauguacauaauuuaucaauaaugcaaaaucgaaggaugaaauaugaaucguaugagggcuucacaaaucuaaaggaguaaaagcagcugcuuggugggccaaccugucagaaugauacuaaggaaggaggugaaaacauuuggcgacccaccuagguaagguuuuguuuaagcauacaagggcaggcagauuccuaaauucaggguccaccuuccccagagcaaaguuaggcccaggugugguagaaaugguaauuucaggggucccagccaguuaucaucugugcuuaacugggacaggcaaaucucagaauucuuuugcaauguuuacaaacaaaaaugugcugggcuuaucugcaagagaugagcuauugagagaauuuuuagacuagcaagagaaaacugcuuggagaacugucuggagcagaacaaagaaaaagcagucuggaaagcugucuugagcguggacccaggauuugaccagaguccuuugucucacugcucucucagaaccccucucaggccaaggcuggccuuggcguuuaucauaacugcugugcaguagucaucaucaguugcgugcuguuuccccuuuacuuuccuuuuguccuguuuauaacuucuuagugauuucacaggucuuuaauuccagcacccagaggacagaggcaggcagaucucauugaguucaagaucagccuggauuacaaagugaauuccaggacagacagagccguuuguuacacagagaaacccagucucaaaaaaaaaaaaaaaaaaaaaaaaaaaaauccaccaccaccaccaacaacaacaacaaaaaaacagugauuccaucuaaucuuuauauugccucaauauuuauaauucuuuuaaaauauacuuuuugugguugcuuucagauauuaauuuuaaaaaauaaaacauggcuagaaaaaaacccucauauuaaaauauuaacacugauaauauuggaagguuggauugaaugauuuuuuuuuuuuuguucuucucaguauauauuaaagaaacucagggacaaacagggugagagaggugggagaaaugaugaggaaaaugggcgucucuaugagacuugacauagagaggguggagaagauuuaaaacguguuugguaagucaugaacuacuggaaugauucacaaggugauauggaaauauauaaugucuauauaguauaaacuacaucauauuuucauggacuuaguuguuuuguuuuuguuuguacagaguacauggcuuuuauugauuugucccaaauguuuuaaaauaaacugguaauuuguuaaaacaccaagcccgugaguggcaagugcaucucguuuugcuauaaaucacccaaacuucaagucuuucccagggaagacaaagacuuuuuauuguagccuaaacuauaugacaucuguuuuguuauaaucugaaaaucccaaaauauguagaauuuuuuugagaugugccuguuccccuuucuucaaguggaagagguacaguaaaaacaucacugucugaauuuuuuauuaugucucacuuuauuccuuaaagcagacucuguauuugcuugauaacugaucuuugauguuugcuuucuuuuuagucauucaacaguucugugcauagcauaugagguacuugagggcuuacauuacuugaacaagcauggcauaguacaccgggccuugucuccccauaauauccuguuggaucggaagguaacuuucacuucaugauagacacuuuuauauugcugagaaugaaaacuacuaaaaugcugcauugaucagaccuagacuaacaauguguuuucagaauauuuguagacugugaaagugauagauuguagcagauggaaaggacaauuuuuaaagucuauugauggauuauucucuacuauuccccggcuuaguuucuagcugugugcuuuaguuucuccacuuacuuaucuuucaacgggcugugucuugugugaacugagcugauccccacuacaagacagaucacaggaaggauggagagagaggcuccccgcuuguuccugcucaucaguucuuacaccuuaagacaacagcgucagccagucauguggaaugcuguuauuauaagcacagccauguuguuuuauaucuucacucuuccuucuuucccguuucacagaucucaucugccgucugcucacaccuagccccuuucuguaggauuacuucuuuucuccuagaaaucugauguaguaacucccuacacuaauggauagcaaaauggcauauuuugaugaaugaucauaauuuaauuuucccauaaauauagaaauagcuuccggguaauuuggggacaauuauuucuauauaauuauuuucugaaucucaaaauuuaauauggcuacucuaugggauaaaaaucacgaagaagccgggcagugguggcacagauuuaaucccagcauuugggaggcagaggcaggcgaauuucugaguuggaggccaaccuggucuacagagugaguuccaggacagccagggcuacacagagaaacucugccuugaaaaaccaaaaaaaaaaaaagaaaaaaaucacgaaggagaaagcaacacucauuaaugucugauucauagcagugaagcauccuugccacaaccagcaaggauguuuucaguacaguuuguaaugcagagcgaugccugagcagacaaaccacauuaccuuucaaauaagcuuuacagaaagaaaaccuaagucuggaaggaacauuuuaggagacauaaaacuuaugcuuaccuuuuuauugagcucacauucaugacuauuauuguuguucuuagaaaguaaaaaagauaacuagaaaucuuaacaaauuuuuugaaaaccuucauuuuuauuaccuguaaaauuuucacacuaagaauuacuguuucacagacuggagagauggcucagccauuaaaagcugggcucacaaccauaaauauaagagaacugcuguuucagcuaaugaucuuuucaagccccuugaaaaaaaaauccuuagcaaaauuucuauuaaacacuauaaucaaagauucaaaaaaaugauaacuuuuaccuuuuuuucuucuuaaagucuugaugcuuugcuaaugugaaugacaaagguguccaaggaaauuuugauuugacacuuaaaaaaaaaaagcauuuauuuuuccuuucuguaaaacuuucuggguguuuuugccugcacauuuacuugugccccacgcucaagcgugaugcccucagagaccaaaagagggcgucagggguugcggaacugauuuacagagaguuguuugcagccaugagaauccugguacuaaaccuggguccugugcaagagcaacaagugcuguucagcacugggucaccuccagccucugacuagacacuuuaauauauauuaguauauaugugugccugugcccacaaguauuuauacacugucaucuauguaaggcauccuaaacacugccaggugauucuguguauaaucacagaacuuuaucaauucuuaaauaguaguauuuugacaaaauauuauauguauguuccuggagagguagcucugugguuaagaauacuuguuguuguccagaggaccuuaauccaguuuccugcauccacaucaggcagcucacaugacugccaccaacuguacuuccaaugaaucugaugcacacuucugauaucuuuggguauccuguggcauacacucagacaugcauauauacacauaaaguaaauccuuaaaaauauuauauuggauugcaugauauuucucuuauuuauaaaacauaugaacaauuuuauuaggcauuuguauuaagguauuucuuauugacuuucucuuuucauuguagggccauauuaaacuggcuaaauuuggacuuuaucacaugacagcccauggugaugauguugauuucccaauaggguaagggcuauuuaucucuauuuuuaauucuauuuuaaccucggugaacuuugauuauguguauccgguuaguuauuuuugacaugaaaacagcuccucuuuacuuacuacaucuuaauuuuuagauacuuuguugacaaguaaacaaugaguauuuucccagugucccugaaauugcugaauugaucuuuaauauaacaggcauaaagagucacaagucauuggccacauuuaccuuaugauauuccuuaauuaguugcauuuuauuuagaauuaagugguuuauaguaagaaaguugaccagauucuuaaugauacuguguguucaucuauagacugaaaaacauugcuuguuguacuuucaauuuaauguuuuacauuuauuuaauuucuuauucucuaagauuaauuguauuuuuaaauucaaguuaacucauugugaacauuggagguaaugggauaaauucucuauagagagaaguauguuuaaagaagucuauuuacuuaacuguuucuuaugugaaauuacggugcccuccaugaaaugaaugggacuuuauuucaugcuauauuuagauauguuucugauagaggcuguuguauuauuuuuguaugguuccucccucuaagacauuccucuaguguaacucuuuuccuuaagcuacauuauuccucacaaguaaggaaaagaauugcuguuuguccuucagcuucucuauguuaacauuuuacugucuauuuauguaugcugucuuucauuuagugugacugaauuuugucugauauuuuuguaguagucuaagaguagaccucuuggaucuuuauuccuaagacuuaagcuuauauuucacaaucaggacuuuucuuacuuaacuucaaaacagugaugaacauaggcaaaccacaguuggcacauuguucccuacccuagaacuggucaucacauucucucaccugcagcaaacuguuuuuaauagcaucccauggauuuucuccuugggcacccagauucaguucuaccacgccagcacugggagucaugauaggcaggcaugaagacaaugucaaagcagaauauuacuuaaaauuuuuuagauuugaaaaaaauucuccuuuauucuaaaaacuuagauuguagauuuuuuuccuuuuuuuuuuuuucuuuugguuuuugacauagguucgcuccauauaguccugagugccaugggacucacuguguagaaaagacuggccucaaacacacagagauccauucaccugcuucugcuuccagagugcuaggaucaaaggugugcuccaucaugucuggccucuagcuuucuucucuguuuuaauuguuuguuccuuaguaccauugccucaagcuggccuugaacucacuguguaguccagacuguugagacuuuaguuaguaaggaaaccuuauugagcacguucugcucugccuauuuuaugcacaaaucuauuauuaguucuuguccuccagcaacucauucuuaaauggguggcuuuucuguuaccaauggcuuauuuauuaaguuaugcaaauuuauaaucuuaacguuucacagaaguucaaugguugaauacaauuuuauuuguaaacauaaaaauguuauacuaauagcuaacacauuuuuuuuuauuuuuuauuaaagaucuuagguaagcucaagcugcuuccuugagugaucauugccauaagagcagcaugagacgugacuauuacuucugcauucggucuaaaucaauuucuuuuuuuuuaaauuuuauuagauauuuucuuuauuugcauuucaaauguuauccccuuuccuggucucccuucgaaaacuccguccccuuauccccuccccccucccccugcucaccaacccacccguucccgcuuccugacccuggcauuccccuauacuggggcauagagccuucacaggaucaagggccucuccccccauugaugacugacugggccauccucugcuacauaugcagcuggagccauuagucccaccauguguacucuuugguugaugguuuuacucccugggagcucuggggguagugguugguucauauuguuauucuuccuauggagcuguaaacugcuucaacuccuuggauauguucuguagcuccuucauuggggacccugugcuguauccaauagauggcugugagcauggaccucuguauuugucaggcacuggcagagccucucaggggacagcuauaucaggcuccugucagcaagcacuuguuggcauccacaguagugucuggguuuggugauaguauauggaauggauccccaggugggggagucucuggcuggucauuuccuuagucucugcuccacgcuuucucauuguaacuccuuccauggguauuuuguucccccuucuagaaaggauggaaguaucuacacuuuggucuuccuucugcuugaguuucauguguuuugcaaauuguaucuuggguauuccaagcuucugggcuaauauccacuuaucagugagugcauaucaugugugguuuuugugauuggguuaccucacuaaggaugaugcccuccagauccauccauuugccuaagaauuucauaaauccauuguuuuuaauagcugaguaggacuccauuguguaaauguaccacauuuucuguauccauucaucuguugacggacaucuggguucuuuccagcuucuggcuacuauaaauaaggcugcuaugaacauaguggagcauguguccuucuuaccuguuggagcaucuuuuagguauaugcccaggagugauguugcugaguccuuagggaguacuauguccaaccuugugaggaaccgccaaacugauuucuagagugguuguaccagcuugcaaucccaccagcaauggaggaguguuccucuuucuccacauccucgccagcaucuggugucaccugaauuuuugaucuuagccauucugacuggugugaaguggaaucucaggguuguuuugauuugcauuucccugaugauuaaggauguugauuuuuuguuuguuuguuuguuuuuguuuuucaagacaggguuucucuguauagcccuggcuguccugaaacucacuuuguagaccaggcuggccuagaacucagaaauccaucugccucugccucucaagugcuggcauuaaaggcgugagccaccacacccggccaacaauuuuuuuaaggugcuucucagccauuugguauuccucacuugagaauucuuuguuuagcucuuuaccccauuuuuuaaugggguaauuuguuuuucuggagucuaacuucuuuaguucuuuguauauauuggauauuagcucucuauuggauuuaggauugguaaagaucuuuucccaauuuguugguugccuuuuugucuuauugacaguguccuuugccuuacagaagccuugcaacuuuaugaggucccauuuguugauucuugaucuuacagcaaagccauugguguucugguuuuauguauagauccuugauccucuuggacuugagcuuuguacaggagauaagaaugaaucaauuugcauucuucugcaugcuaaccuccaguugagccagcaucauuuguugaaagugcugucuuuuuuccacuggaugguuuuagcuccuuugucaaggaucaaaugaccauagguguguggguucauuucuggguuuuagauucuauuccauugaucuaccugucugucacuguaccaguaccauccaguuuuuaucacaauugcuauugauccauucuuaucuccuuauacaaaggucaaguccaaguggaucaaagaccuccacauaaaaccagagacacugaaauuaauagaggagaaaguggggaaaagccucgaagauaugggcacagggggaaaauuccuaaacagaauaccaauggcuuugcuguaagaucaagaaucaacaaaugggaccuaaaaaaauuugcaaagcuucuguaaggcaaaagacacuaucaaaaagacaaaaaggccaccaacagauuaggaaaggauuuuuaccaauccugaauuugauaggagacuaauauccaauauucaaagagcucaagaaguuggacuccagaaauucaaauaaccccauuaaaaaugggguacagagcuaaacaaagaauuaucaacugaggaauacugaaugauugagaagcaccugaaaaaauguucaacauccuuaaucaucagggaaauacaaauaaaaacaacguugagguuccaccucacaccagucagaauggcuaagaucaaaaauucaggugacagcagauacuggagaggaugugcagaaagaggaacacuccuccauuguuggugggauugcaggcuuuuacuuccacucuggaggucggucuggugguuccucagaaaauuggacguggugcugccagagguuccagcaauaccucuccugggcauauacccagaggauguuccaacugguaauaagaacacaugcuccacuauguucauagcagccuuauuuauaauagccagaagcuggaaagaacccagaugccccucaacagaggaauggauacagaaaaugugguacaucuacacaauggaguacuacucagcuauuaaaaagaauaaauuuaugaaauucuugcacaaauggauguaucuggaggguaucauccuuagugagguaacccaaucacaaaagaagucauuagauauguacucacugauaaguggauauuagccuaaaaacuuagaauacccaagauauaauuuccaaaacacaagaaaaucaagaagagggaagaccaacauguggauacuucaauccuuagaauagggaacaaaauacccaugaaaagaguuacagagacaaaguuuggagcuaagaugaaaggauggacuauccagagacugccccaccuggggauccaucccauaaucagccaccaagcccagacacuguugcauaugccagcaagacuuugcuaaagggacccugguauagcuguuucguaugaggcuaugccagugccuggcaaauacagaaguggaugcucacagucaucuauaacauggaacacagggcccccaauggaaaagcuagagaaagcacccagggagcugagggggucugcaaccuuauagguggaacaacaaugugaacuggccaguacccacagagcucgugucucuggcugcauauguagcagaagauggccuagucagccaucacugggaagagaggccccuugguauugcagacuuuauaugccccaguacaggggaacgccagggccggggugugggaguggguggguggaggagcguggcagggggugagggguauggggaacuuucgggauagcauuugaaauguacauaaagaaaauaucuaauaaaaaaauuuuuuaauuaaaaaauuuuuuuaaagauggccauuuauacgauauuaauccugccaauccaugaguaugggugaucuuuccaucuucugagaucuucuucgauuucuuucuucagagacuagaaguucuuaucauacagaucuuucacuugcuuaguuagaaucacaccaagguauuuuauauuauuuguaacuauugugaaggguguugcuccccuaauuucuuucucgcccuguuguuuaucagguuuaggaguucucugguggaauuuuuggggucauuuaaguauacuaucauaucaucugcaaaucaucauauuuugacuucuuuaauuuuuaugaaagaaaacuaaaaacauaacacaaaaguuauuuuaagaggcacacguaucuuugaguuugaggccagucuggucuacagagugaguuccaggacagccaggacuacacaaagaaacccugucucagaaaaccaaaaaaaaaaaaaaaaaaaaaaaaaaaaaagaaguuauuuuaaguuuuugacuuacauuuaagauuauauuaguuucuggugaaauagaagugaguuuucuuaaagccuaucaauuauuuuaaauuuaaaacacuuugguagacguggucuuguuuuagcacucaguguagcuugcuuugaagucugaguuucaaaggaccuuacuggaaaguauaaagagcaaagugugaaacauuagccaggaaaaauaaaauaagugaucaagcagccgggccaggaagagccuuuccauccgaggaggugcacagcugaguccagugacagauacuaaggcacauaaguguuaccaucugcuucaaaacucggacagaauuagaaaguagacauucacugugacuggacaguagcuuaaugaugaugaaagccaccugcaguacugagcagccacauucaaaguaaaguucuaguaguuucuguugaguguuaaaugagacacuuaagagaaagccccugaaagacgaugcccuccaguacagagacgguuucauuaaaggcucuuuaugaauuucugucugguuaaaggggacccgaauauuuagagcaaagguuaguucuuugcuucuguccaaaauuuuuugaccuaccaauuuaauuguaacuuuccuuagcuuuccauuacguguacugugguuuauuggaagucaaugguuauguauuaguauucacaagcgugggggugggggcaucgccauuccuuccugcugaaggagaaagcccagugagauuguacugaaaugaaauacaggucuguugggcagagcaauugcauggcauguacaaggccaucucuggugccaugacauaaagacgcacagagugugucaaagaguggaacagaaaugcuggguagaccauuacaucuggugcuuuuucauuaggcuguagcuauuucuacaggcuccacguauucccuuauaaaacaguauuaccaccugaggacaaauguuaucacagguguauguauaauacaugagaauauugaaagaguauuuauaucaucacaaugaauaauuuauaauuuaaugaccuaguuuuauucaaguuaaauauccagacuugaaugaauuguauuuuacaugacuaugagcuuugacaaugauagcaugagggaaugucacauguauuugcauguauuuugccugaaguuauuguuguaaaauaauguuaaugaagggaaaaaguugagauuauggugcucaugaguaaacuugagaaacacacacacauguacauaugacacuaaaauagaaauugcuuucauguugugcuuaguaauuccguucuggauucauaauauucuuggauaguuagauauuuauaaugugaauucugauuugcugucaucugauuaugacauugcccugguuugauuuuuuaagagacugaacuauuaaaauguuugaauuucuaaaacuuuuaaaaaaguuuaugauuauaauuauuuucccuuucccucuccucccuccaaacccuccuauguacucccaacccaauucuuucaaaaucaugaccuuuucuucuuuaauuguuuugcuacauauguauauguguuuguguauguacaauguguguauuccuaaauacauaaauauagccuacucaguccauauacuacacucaagaaguuucaccaacaggccuucuaaacguggcuuaaaggacuaugggguuagucaugugggaauuguacauuccaugcaguaguuauaaggaugugcugcuguuucugucaccauuguagcacacguaauucuuuguucuuuucacacauguugcagguaucccucauaccuggcaccugagguaauugcacaaggaauucccaaaacuacugaucaugugccaagugaaaaaccauugccuucuggccccaaaucagauguauggucucuugggauaauuuuauuugagcuuugugugguauguauaaagaaauauuaaacuaauaaaauaauuugugugaucauuagcauuugcuuuuuagagaggaaguuuacacaguaauaaaauauuuuguuguacaaauugacuagauauaaauagacuauuuuaucagagcucauaguuauauuucagucuauaacguuugaaggguacaguguugaacgaauucaauaaaaggaaaguuucguuuuucuaugaguuuuaugucacuugguuauguccuuaguuugggcauccagugcaaguaugacaggcuacauuuaagucuaaauagucuguauaaaucaacacuuagaauuuuauagacaauauuaagauacaagugaaugucauaccagcaacuagcaaauggaacuuuuuguguaguaggaauauuuuuuuaaaaugaguggaaagcuguaucaaaaucauacuggaaggaaguguuuacucugucacuaagaauguggcagagccaugcugccaugagacguucccacugcugcagugugugggagagggcugugguacugaugagaaaaugagaaaaaaacauaagcaguaauauccacaguaagaaagaaacagcuaauagaggaauuauagcauuaaaacuuuaaaauaaaaccacauuuucuaaaacauaagguaauuaagcucauuaagcaauuauauaaacuaucaagaaaacaaaguuuuaaugaaauauaugcaauuauuaaaacaaagaauguaauaaauucuaggaaacuggaaaaacuagaaguagaaauccucccaaaagcauuuguacgcaaggauaaagagauugcaaauauuaaaguuaaaaggaaaggaagaaguacccagauguucuaacaucuguauaauggaaauaucaaaaguagaaaacaaagcccuccuuuuggaagcacagggucuuuuaaauggaaaaaauaaaaacucauaaaccaacaaaaauacaaauaccuggaaacaguaugguaaaccuguagaagauagcaaauaauaaaaauaaccgaugauauugauaggguacuuaucaaaaaauaaggcgguuuauaacaacuucauauuggcucugucuaucgauuuuugcagcaggcuucuaaaguuuauauuuccuuuugguuuuucaagacaggguuucucuuuauagcccuggcuauccuggaacuuacuuucuagaccaggcuggcucugccucccgagugcugggauuaaaggcuugcaccaccacgccugacaaguuuauauuucuaaaaguuagaaaauuauaguacauagaggucaaacucucuaagcuauaguguagcaaagaguucugcagauacaugccugcucagcguuuugaaagcuaaagcauucaaguccuuugguaaacuucaucgcuguuguagagaagaaucuuaaaacccacaguugucacaaaugaauuuuucucacuaaaaucacagugagaaggacagugccuauuuuuucuaguagugaauauacaggaacgaccgauucaaacauaauuccaaaaaaaugaauuuuaaauuauuuaauuuacaaaaucaacauucaagaaugacagugaagugaagaauaugcagaacugugaggagcacaggacuaaaauuacaguucugagggaaaaauacuaggccaaauuauagaccaaaguagcucaauguugcauguagaagggaauauauucuaauuuaaguacacagugguaucuguguguggucacaguggaagaaaaguagcagccagcugaaaauauacaugggaaccauauccuugaagauuuuaagugcuaaauggagauguuuguauuugguuauauaaguugugggcuagcugaaagcguuaccguaggccagcccaugcuucaggcaagugacagaacguaaaaccaggaaagaaacgcagcaacuggguuuuucuccagugcucucucucucaugguaauuuugaucuugaaauauuaaaaauauuuucagaacuguucaguuucuucaacaguuuuaaaaggagagacaugugguguaaagggauuaagguaauuuaucaauguuauuuaauuaucuggugauagaaaaauucaacuuguuaugcauacaauugcucaacacaugauuuuuggagaugaaaauuuugacucccaaauccauguuaaggggcuuuagaggcaaacugauauggaaauaacuaaaauguaauguguaucuuaaagcagccuguaauaccagcuacucugagcuagggagaaccaaguuugaggccagccuagaaagacugccuuaaguuaagcauaugggaagggcugcagauggaauacggugaugccgcacuguucuagcaacuguccugauguagcaacuugaguccuggacucaguucccagcuccaaaacaacaaagacaacacagaaacucaggucuauuggaagacguggaaugcucaucugaaguugcuugagaggaagaacugcugugacugcuuaucagugcagagaagggauuacuugagcgagagacauaauaaggauuucagggguagacuuccagggccaucucuguauuuuacuaaacaauacuuuuggugaucaggaaaacuuagcaauaaugugugauucucaaaaguaaucagugcuuggaaacacauuuggauauaaugauuguuagauguuaaugccauaagcaauaaauauuacacaacucuuuuaagaauguuaacaauagucaacagucaagcugaucuuuuuuuaaaaauuaguaaaaucugauaauaaauagcagugccaauaaaaucagcuucaauuaagguacaaaagauaccuguagcaggaagaaaauucuaaauauuaauaagaauuuauuuucccauuuuauuuaggggagaaaauuguuucagagcuuggauguuucugaaagaguaaaauuuuugcuuacuuuggguaaguuucaugcauuucguuaucuuuccaccaaauacaguguauagaaauagcugucgucaugaaacugaagaaagaacgaagaccaaaguguggacacuuugccccuucuuagaauuggaaacaaucacccauggaaggaauuacagagacaaaguuuggagcugagacaauaggauggaccaucuagagacugccauauccagggauccaucccauaauuagccuccaaacgaugacaccauugcauacacuagcaagauuuuggugaaaggacccugauauagcugucucuugugagacuaugccggggccuagcaaacacauaaguggaugcucacagucagcuauuggauggagcacagggcccccaauggaggagcuagagaaaguauccaaggagcuaaagagaucugcaacccuguaggugcaacaacauuaugaacuaaccaguacccuggagcucuugacucuagcugcauauguaucaaaagauggccuagucggccaucacuggaaagagaggcccauuggacuugcaaacuuuauaugccccaguacaggggaaugccagggccaaaaacuggcaaugggugaguagggaagugggggggggggcgguuaugggggacuuuugggauagcauucuaaauguaauugaggaaaauacguaauaauaaaaaauauuaaaaauaaauaaauaaauagcugugugcauggcguacucucugaaacagagaaacgccugucuuuaaguugcugugaugagguaagcauuagaagagaucaugaagagagccuuucaaaacaugcaacaguuuucuuucuucauuaaggaacuugaaccuccauggaaagaagucuuaguuucaugauuuagccaacuauuuucuauaaucaaacuaauagaauacaaaacuguacuuccacaaccauaucuaaaccuugagcuaccuuucuaauguuacugguugucuaugaaaaacagucuaggaagcauguucauuucucuuuaaaacuugcauauguauuauuugaaacguauaguaggaaauguguaaucuaauucagagugagagaaguuaaauguaugguaacggaagagaaagaacugauaggucuauuucauauggagcagugacuugucagaauuccaguaacagguuacaaaggauaaaaccugugggaggaggcaaugaacuaacuaaguggcauaaaauuuuaucugagucauuaauuccuuaccaagacuauacacuacagcugacaaggaauuuggggcaguguuaaguguggucugaagacugaauuuauacuuuuuuuuuuuuuuuugguuuuccgagacaggguuucucuguguagccuuggcuguccuggagcucacuuuguagaccaggcugggcucgaacucagaaauccgccugccucugccucccgagugcugggauuaaaggcaugcgccaccacacccagcuugaauuuauacuuuuuaucuccagagauaugugaggucauucuccagaccuuauguaauuaaaauaaauuaauuuuguaaccaugagauaacacagcaccuucaaaaauuccuuggauuuuuuuuuuuauaucuuuauguaaguugcuauaauuuagugccuguguggaacugaacugagugguuaagccucugcuuuugucaaagcauauaaggaaaguuaauucuuuaaauaaaaacaaguuuuaguagcuuaaagaccaaaacuauaucaugauauuuggaaauuuuugucauuguauuuccccaguuauugugauagauuaaagacugguguuuacucaucuggcuuuccuuuucucuuaggcuguguagaugauacuauaauaguucucgcugaggagcaugggugucuggacauuaucaagguucguuguacaugugugcuauuccaacagacuaucugagccugggucaucuuuaaagaacaaaaguaaucaucucccaguuuucgaggcuggauaugucaugauaaaggugcccagaggcucaggcuucugaugagggaaggacacucacagcagagaagcaagcucuucacggcaguggauacgggaagugugagaucccauucccaagaugaaggcccgugggaccccaucaccucucauaggccaccucuuuuuuuguuuguuugcuuuuauuuuuauaaauucuugagaacuucauacaguguucugaccauauucaccccaauucuuuucccaagcuccucucauaucaaccccuagcucucaaauucaccccccauuuaauaacacauuaaguccaguguggcccauauacucuucgguguggguguccacugcuccauggucuauuuaccaggagccacacucuuacucauaacugauucugucuucacuagauaucacuggcugucaauagcucccccaccuugggcucuaugggucuccacccaguguuccaugauggucuuugagccuugcagagggggugugacauagauauggcugagcacaacauggucacauacuuuccacacuuuaaccauugugauuuucugccauucccuguacaaagaaacuucuucucugaugacgucugagaacuggauaaccuauaaggagagagaggugaacuuagagagcuguaugguacuaaguccauuuaguagaguaauaguagcagguucaugcuggcagcuuaucucuuaauggcaucuacuugcccuuaaguuucaggaccugaauguaggaaagggcauagucaaacgagagcaaucuguuuaggaaaguucauuuucacauuaggauacaacaacaagcuauuaaagcuguacuuaucucucugcaaaugcuggcuuuuucacagagagugacaaauuaauauaaauuuaaauaaaguaaauaaaaucuuuucuuuaauuguauauuuucuuuauuuacauuucaaauguuauuuaucuccuuuccuggucuucccuccagaacccaccuaucccaccccccuucccccugauucuaugagcgagcucacccaccuacccacccacucucaccuccccacccuggcauuccucuacacugggucaucaagccuucacaggaucaagggcuucuucucccauugaugaccaacaaggccauccucugcuacauaugcagauggagcauggagccauguguacucuuuggcuggugguuuagucccugggagcucuggggacucugauugguugauauuauuguucuuccuauggggcugcaaaccccuucagcuccuuuaguccuuucucuaacuccuccauuggggacccugugcucaauccaaugguuggcugcgaggauccgccucuauauuugucaggcucuggcagagccucucaggagacagcuauaccaggcuccugucagcaugcacuuggcaucuacaauagugucuggguuuggugucuauauaugggauggauccccagguagggcagacucuggauggccuuuccuucaaucucugcuuccaacuuugucucuuguauauguuuuaaaaucaaaacuuaugagauuuuaaauauauuaguaaaauauauuuguauaauugauugucuauuuuauuaucuuuauucaccaggagcuuccugaaaaugugauaaauauuuugaagaagugccucaccuuccauccuucuaagaggugaguccuuaaggcuucagguuuaucccaggauucuuucuauagagaguugauuuaauauuugguaugacagugauggacuaauggacgguagcugccuguguugcaguacauaguugauacccguauuguaagcgugauuuaaaguuagcuuugugugaauagaagaagucaaaucauggucaucuguguuaaggagguaucuaagacuuuuaacucccaccuugaauguguuauauuuuguaggaaaaucuuuacgacuuuuaucugugcucaguauuuucaauugucuuucucaaggccaaccccagaugaguuaaugaaggaccagguguucagugaagugucaccuuuauacacccccuuuaucaaaccugccagucuguuuucaucuucucugagaugcgcugaucuaacucugccugaggauaucagugacuuguguaaagguaaagaugaauaaaacauaagugauagaugaaccuuguuuccaaaagaaguccccuagccuguuuauuuuugaauucauaacagguguuauauucauaggcuuuuguggaaaaacaccagggaauuaggaggugauucuacagugugucaaauauaagucaaauuuuagacucuaaauuacuacuauuccacauaacgugguguagauugcuguugauaugcaggugagggcagguguaauauaaaacuggagucugugauuuagcagugaaaaaagaaggcgggcugagaguuuuagagacagaggacaggggacagagagggaagagguucagagaagauggaggaggagaggaccagccugauccauggcuuuaaauagccacagguagcugcuaauaucauagaagggauggagcaguuaauauaggacagucuguccagucuaggugggcaccuuguacuagugucauuuggcucugaguucauugugugggcauuuuguggguugagaauuuacuauuauaaaucugacugauaaauuauaagccucuagaguuuugauuuuacuggguugcgggggguuuagggggaaggaauugugacagcuagccgcagcggguggaugacugggaauaugagcagguuccacagcaaggaaaccaagagaguugggagggccaccucauggugaccauggggauggagagaccauguuacuagagcauagcugacaauaguggauuguuuuuuaauauuacaugccacaaaguggucuaaaauugaucaucaguaggaagccugugccauuauauugucccaugaagcaugaggaaaggaaugcuuuguugacgagaggguuuuucuaccacaguccuuuuugcagaguacauaaauuccuguucugucccucuaaaauggggcauacauugucuagauuuuaccuuuuuuagcuuuucuagacuuaggaagcaggcugugacuaaaguugccuaauagaaccacugugcacaucagcuuaaugugaguuucaucucggggcacgaaaaguacugaaguagcagcuuuucuucugucgugagugcaggcauaugucaagacuuucgacagucucuggcccuucacuggcuuuuaugcaugagccacuuuuaggaggaguucagccuguuacaagaugaaucaaaauauacgaauuguggcacaccugcacccagacaccccaccaaauugcacccuagccuuccaguuucacuaugggcaggaagcuugugugaccaucaugguccagaggcauaagcuuacuaaaccgugugaccugcuuauaggaccacaggaugcuguccuuccuccuugccaccaacaucauaaaaaguauucccuccucucaggucaguuagaacuucuccugcgacaagccauauaaggaagaaaagaguccucugaugguagugguauugcaaauugauucuguuuucuccucccauggccuaaagcgcaguccaguuuucuccaguauuuacugugaggaacuggccaggauccugguaauaaauuuuacugaugugccaguguucccguauaacugcauauccugggacuucaagcucucagacuugucugcguggagcuuacagcaauucaacuagaguucugcuuuuacuguucugguucugguuccugaggcuuuuuuugcuguucuugcgcauccucccaucugcuuuuccaaugguguggguaguaguuugccucugcucuguuaccuugugauucuuacauaagaguuuuacucucaucuguuagauuguuagcuagaguagcaacuugcaaaguccuuacacaccacagaacugauaaccuguucuucagcuacuuuuauuagaaugucagcuguuacuaguaucagcuauuaauauagacacaaacgguaauaguaauuuugaaaauuuuaccauuaauagauauagacaaugauuaccuggcagagagaucuauugaggaaguuuacuaccuuugguguuuggcuggaggggaccuggaaaaggagcuuauaaacaaggaaauuauucgcuccaagccaccugucugcacacucccgaaguaaguaaagaaaaucuaugguaauaacaguuuaaauuuuugguuguuuuuuuaauuucauuuuuuugguagauauucuaauacaugaacauggaagcaguuagacccucacuuguuggauggguuagaauuuguaguugcagcguuuucucucgaaagcagugacccucagccuuccuaaggcugugacccucuagugucucaugcuguuggugaccccaccauaaaaguguuuuguugcuacuucacaacuguaauuuugcuacuguuaugaaucauaauuuaaguauuuguguuuucugauggucuuaggaaaccccuguaaacaguuuguucuagccccaaaggggucacaauucaggcugagaaccacuacucuaguaauaucagugacaaagcuaaccagcauaugccagaauuauaacgaaucgagaaauauauaaaagucaggcuugucaggagaaacuucaacuagcagguacaguuuuugaaaacuuauuuuuaaagacaaggucuccuauagaccaugcuagucuugaacucacuggcuauucucagacugcugauccuccugccuccgccuucugagcacuggaaugcaggcacaggcuccacgcuaugcuccauucuaaauccauugucugaagaugagagugugauagggaauguuuuagaagaaauaaauuauuuuuuaugaucauaacaacugguuuuuuuuuccuuuuuucuuuuucuuuaaaucuuaguuuucucuuugaagauggagaaaguuuuggacaaggucgagauagaagcucacucuuagaugacaccacagucacguugucuuugugccagcuaagaaacguaaggaugaaagcuuaauaaauauggcucauuuaaagauaacacacaacacuuugcaucugugauacaugagagaucgucuguagugugugucuggaguagaacugucagaaacuaucuguguaaacuguaaguucagccuguacguacacuguaaguacacugccggauacucacaacaaggucaucuuugcaucuucauuggcuaagucuuccuauuucuccauuuaguaaacauaguacauuuuaagugauuuuaaacauuuuaaauguuuaaauaaaagcaaaaaauuaaaauuuaaauaguugaugaaauucugauguuuuaaaauguauaauacaauuacaguugccugguuacagugcaguugugaguuucagcuguguguuuagcuguucugugcauuacacgagcauauacaagcucaucaguugucauuuuaaaacuuuagaaaggauucuccagaaauugugccuucaccaauuauauuucaugcaaauaucuuugaagaauauaugaaaagcauaucuuuuugcuaaucuuuuaauaaaugaauauauuuuaaaauaccuuuucauaaucaucaucauuuauauaauuuaaaauauuuuauacauuaacuuuuguacuaauguuaguaauuugguguuauaugugaggaaauguuagaaacacugcauauggaggggaaaagagaagccuuugcucguacauaacccucgucagaaguaugguauguuugaauguucaugaacaaacuaaucuuuagaaccuauuuuucacuucuuugugcuguugugaauuuauaauuuuuacauaacuauucuuuuuaaguagauauuacucuuacuacccaacauagugauuuauaagcacuuuguuuuuaaauuggcagagauuaaaagauguugguggagaagcguuuuacccauugcuggaggaugagugaguagaugccccuccugaugcuuuuccugacucuguuagauaauaagaaauguguagauuguaaauagaacaguuauaaaguugggcuuuaauuuugucuuuguuggcccuuugucuugcgaagguucuaugacccaguauaggggaaugccagggccaggaagcuggaguggguggguuggggagcagggggaggggagaggggauagguuuucagagaggaaacuaggaaaggggauaacauuugaaauguaaauaaagaaaauaccuaauacaaaaaaaucagaagcaaaaaauguauugucuuugucccugguuuuccuuugguuguuccuuuacagccagucaaauuugccacauucaaacagcaauaaugaguugucugcagcugcuacccugccuuuaaucaucagagagagggauacagaauaucagcucaacaggauuauucucuuugacaggcuguugaagguaggaacauauugugauauaucuaacauaucaaguguuaaugaugauccauaugagccuuccuuuaaugcuguuaguucuuauagcucaaaauuaugaguauaguaauucauauaaucuucugcaauuaacuucucuaacuuuuaaaauuaauagaaguuccaaaacaacaauauaugaaagaucaccucaggcaaagaauuaacacaauuuuuaaagaaggcauaaaagucaauaggaaaagguaccuguguugauagaaauaugaauauaaacuagucaacaacuauauuaaccucaucuuuacuaggaauuacacaguuucagugggauauucuuccacaucacuaacaugaccagcacaggcuugugaaggcugcgccucuccuuucagauuuugcaaagcaguuuuaagauauauaucauguaacuaagacauaaauauccugugugcuaauaauugucuucuagaagucccuucaaauugcagauuuauagaagguuaaaugugcuagacauaugagaaguuacauaccuuaugcucagcacauaccuucuauaccagaauuuuacaaggguuuugucuucuuugaucacagaacccgagaacccugguuuucagucacuuauaaaccacccugauuaagaacagguagagcaagcccuuguuuuuaacuugauugcacagcuuuuggagauguugagguggauucaucuguuuauuuauauagauaaaaccagccccagugguuaauaaucuucaaaguggauuaaaggucgccucaguucuaucaccaauacauauuacaguguccacauuagaauaugaaccugguaauuugagacauuuucuuuuucuugccuugauacuauuuuccuuuuaauuauuuuguuuaaauuuuauuuaucaugauuauuacagugguggugguggugguggugguguguaugugugcacgcacaaugugugugugggcaucugugccagaguguacauguggaaaccagugggugacuuuguggaccauggauucaagcucagaucaauuaucaagcuagugcagcgaguaccuuuaccugcugagcaauuucucugacucccuuccagucauguauaugucaguuauauucauagguauaugagcuauauggcaguacauauuuaugagguaccacugguauauuuaauccauguuuugcaaaauacaauuuucaagucaaaauaagcuuaucuacuucaaauauuuaccguuuauuugugacaaaauaguuaucaauuuuugugguauccucaugagauacagugcgcuauuauuacuuuauagguagcugcucuuuugugcacuagcacgcuaguauuuauuucauugacuucccucucauauuaaguaacuuuuuccauccuucucucauggcugugcucuccagcuccugcugaguacaaaguauuuugcuaacuugcaacuuggaacuuguaggagaccacuuuucuaauuguuuuucuucuaauucacauaugagugaccauauguauuugccuucucugugcuuggcuuauuugauuuuaacauaguaucuucaugucuuauucauguucucacacauuacaggauuucguguuugggaaccgagugauauuccacuuacaauauacacugcauuuccuuuaucuacccaucauugguggacauaagcuaauucuauucauugcauauuaggaauggugguagcuuaguaaacaugucacugcagagauguccucuggacauagugacuccauuuccucuguauucauaaccagagcuggaaauuguggaucauaauaaguguuacagguuuaguauaaaauauccuucacaggcuucugucugugaacacuuggucacucuguuuuaggauguuagacggugcaguguagcuggguaccaggaguccuuccaauagacuuugauguuuauagcacaucucugauucuggcuuaaauuucuuugcuuccauauugguaccacauaacugugauugaugguacugcccagccaugagucagggaugagaaaaauaacuaauacaaucagacaggucuauuuguaauuuuugaggaaauuccaugcuguuucccauaauagcaguaugaauugauguugcccccacaguguacucaguaccucaguaccucaguaccucaguaccucaguaccucaguagaggucauaguagccuuaaggaggcaagaagcuucuuugugguuuaugcuuugcauuuccccaggggugguaaugcugaugguguuuucacuguccagugccuauuugcagauauucuuuucagaaaugucuauuuagaucuacugggaguuauuuaauuuuuuuuaacugucaagguuuugguuucuuuacuguguucugaauaucaauuccauaucaguuguaaagcuuuccaauauuuucuacaauucuguagaccauuucuuacuauacugauuguuuaauuagcuuuuaacuuucaacuugauauauccauuuuuccuucuguuucauaccuuuaaaauaauuccuuaaaaaaaagucaagccaacauccuuaccuaucuucuucugucuuuuuuuuauuuguuuuuuauuguuuauugguuauuuuauuuauuuacauuucaaauguguuccacuuuccagucucuccucagcagacucccccaucccauucccccuccucuuugccucuaugagggugcuccuccauucauucacccacucugccucaccgcucuagcaucccccuauccuggggcaucaagacugcacaggaccaaggaccucuccucccguugauguccuacaaggccauccuuugcuacauauguagcuggagccaugagucccuccuuguauacucuuuggugguuccccccccuggaagcuguggguggucuggugaauugauauuguucuuccuaugggguugcaaacuccuucaguccuuccccuaacuccuccauuggggacccuguguucaguccgaugguugguugugagcaucugugucugcauuugucaggcucuggcagagccucuccaggaauagcuauaccaugcuccugucagcaagcacuucuuggcaucagcaguaguaucuggguuuggugucugcagaugggauggauccccaggugggguggucuuugaauggucuucccuucagcuccauuuuuguccuugcauuuccuuuagacagaaacaauucuugguuaauuuugagauggguggauggccccaucccucaauuggggccgugccuaucuacuggaggugggcucuucagguucuagcuccccuuugauggggaauuaggcucaugccauuccuguuggguucugggaaccucuugcuucccuggugucuggaacuuucuaguggcuauccccaguuccccacauccaccacacccacacacacugcuacauauuucuucuagccguuuuacauuucauggcuuuacauuuaagugugugccuacuuugaguugauuuuguaaucauugagagaagagucuguuuucagggguuuuguuuacuuguuuuuuacagguuauuuuuuguuugcuugcuuguuuucuuguggauaccuaauuuuucuaacccauguacugaacaaugguuugugggugccugaguuaaugcccacugguuacucugcucuauuguugugugucaguuuucagucuggccccgggguuguuuucuuuuauuaccuuuguuguauaguuuaauauaguauaguauauauaaaaccagagaauacaauguacuguguucaaaauggguuugcuuuuguuuuuauuccuauuuaggauuguuugauccuauacuuugaagaauaucauguauguuuugaaagagauuacauugaaucuguagauugcuuuggauaguauguucauucuaacaauuccagaaaucugagacauuuuccccauuuuuaugcaucuucgucauauccuuccuggguuuugaauuuuaugguuuaguuuuuguuugugacagucuuacuauauagccuaggcugauuucaaacucaucauccuccugcaucaucauucugagugcugggauuacauacacgugacaccguucucagccauuaaguuuuuuaaaugauuauguagaaucaauuuagagacuuuuuucauauuuuuauuaaauuuauuuuauaaauuuagguacuauuuuauaaaugacuguauaaaauaaaauuucuaaacucuauuguagaguuccuuucuugauuucuuuuacagauauuucauuauugauauaaugaaacugacuuuuguuuguugauuucauauacuacaacuucacuaaguuuguucaguaguucagggguuuguauacauaggucauguuacuucuuuguccucccugauggcagacugggaguucuguaacauucuggauaaauagagagugugugaacaucucucucuuauuccacaucuuagaacgaaugugcucagcuuuucuccguuuggaauacuguuagcugcgggcuuguucauguacugugguacauucuuuuccauccuguuuguaaauaaucuuuuccuggacaaggugauggaucuuguuaaauuuuuuauauuuauugauaagauaauauauuauuguucuucauuguguuaauauuguguauuccauuuuugguuuguguguggcaagccaucauaugaaucgcacuggauuauacugaguuuuucaugggcuaugggacucaguuuauaguauuauguuaaaaauuugugcuggguagucauuagggaugcaggccuauaguuuucuugucuggguuugauauaggguaaugcugugcucuaaaaugaguuuaaacaaauucuuccuauuuuuuuuaaauaauuugagaauugauaauuaguucucucuaaacauuuggugauaugauuuuaauuuugacuauuuuuaucuuaucauaggcuuacccauacaaaaaaaaucaaaucuggaaagaagcaagaguugacaucccuccacuuaugagagguuuaaccugggcugcucuucugggaguugagguaagaaagcaaaaagcauggaaauggauaaguaguguauagaaagaguaugaaauguacaguacccccggguguagggauucaugguuaucuuccaaugugugggaggcuguugcaguagauuaugagcuuaaggucaggaguacauggaagaaucgcaucucagaaacacuauaacgcuucacauauaacuuuacuucuacuaauagaaaauuauauauuaaaauauuuaacaauuuuaaguagaaaaguacuugaaaaucauagaauauaaaauauaauuauuuuaauauuguacuuauuagcacccgugggaaauauuauuauuuuaaacuaguuaucuagugaauauauaucaguuauaaguaccauccugcuuaugaaguaugcuccuuuuuaaauauaacuuuaauuuauaagugguuccaaauugauuauuauuuuaauucaguuguggcuugucaaaauuaugaauguaauuuaguggcuuuucacauagcuguuccgcuuggccaaccugccaagagaaguagccgcuuugucuucuguuccugaucugcagcagugaaggaaagcacgcugccucgaguuauucacaguguguucucagaagaggcuggugacaagacaugaucauaguucuugccauauuguuucauuuccuaccaauuuccuuuucauucuguccgcuuguguucucgcauagauaaauaguucccucaaccauuuuuaaucuuuuuaaaguuuuuuauuuauuuuauacaauguauuuuucauguugcuucuccuacuccauccaucuccucucagauccucucuacccacccaauuccccccaccucucucucaaauuaaaacagauugacaaaaucauggagugcauuugucuuagccaacuguugcugaguguggggcccauccuauaguguggccuuaguuauuuuuaaccuuuauagaccucuguuggcacaauuuuuuuuucuauucuugauucucuuaaugagauucuacaaauuucugugaauguguuugguuacuuuacaagauugccuguugcuuuuuaccacauggucauaauuagugcaauagaacuguacuauacuccagucuagaaagacucacauugucagguuuuccaaaccuguuauuaauagauaucccaaaaaauauaugcaguaaauaauuuuacugaauucuuggcuuucucuaccacuauaguaauucauaaaaauaagaacuuuacauaagugauucuauagaacaugauugaaguuuaaaguacuauauucagauauucuuuguguggcccuguaaguaagaacuguuaaugagccuaagguucucugcucacagcauauucauccgauguuccugcuacugucauucuucucaacagcuuuguuugccucaccugcuuuagcagaaaaucuucugauaagauaauccucucucuaaaauaauaucuuuuucgugaaaauguugauuuaugaguuaguaaugcagagaaaauggcauuuugguguauuuuauagcuaagugaccacuaaggucauuuuccacuugguacguauaauucaaagcgguucuuugguugucguucuuguuucuuuuugaaguaaggucucacuguguugucacagcaucugccugcuucuuucucuugaguguugggauuacagguguguauuaacacacuagggaaagauccaccucaccucaguggaccuucaucagacauggauggucaaagauguagagaauuucuaagcuuuaauuuaaauauaacuauucauauuuagguagcucuucaaaauuagauuuuuguaagaaacagguuuuuccuuuaaagcaucacuaauuuaaaaauuucaaauaugaaagcucugaguauugacaucuugcugaaaaaaaaauggauuuugcauuuuuagauuagagacauuguaccaguaaauuuuaugcaaguauuccaaaucuaaaaaaaacuauaaaauuaaaauacuuaugaucccagcauauuaauguguucuucuaguuuuaucaaggauguaaagaauguauguguuauuuuauuuuuugcagggagcuauucaugccaaguaugacgccauugacaaagacacuccgauuccuacagauagacaaguaagguguucucagacaauucucccaauucuuuaaaugcuagaaggaaugacgauaccuuuccccuucauuaugaauauucuuccacugcccgaagucuguguaguuagaaaaagaguuucucuuauacucagaaaguaaggugugaugccuccagggaugaguuuaaacaccugugcacuucaucaguggauucuaagggugaaauauuccgaagcagucucuuuucccacgugcugaagaagcgagggcugcaagugugugggaucaucucuuacagcugcuccuuccuguucugcugcuuauagauugagguagacaucccucgcugucaucaguaugacgagcuguugucaucaccagaaggccaugcaaaguuccggcguguacugaaagccugggugguuucucauccugaucuuguguacuggcaagguaacauuuaguuauuaggauuuuucuucaggucuuuccucuuucaucucgaagaggggaaaaagccucuaaaauucuagugcauuuuugaagauguuaacuuuaaauaaauuaucaaacaaacuuggucuaaaugcauugaagauaucauuuuacaugauauuuaaaagucaacagcuuucagugauauuaacaggaaaacagucuaaucugugcaaacaguuuuaaucaugucacaguagugaguaacucaugacagaugagauguuaggcuacugagaauguuaccacugaaguauuccuaauagauaauuguaguuauuaggaaucgaauaucaccuuaaauugcucauuucauuuuuuuuccuuuuucucucuacuaucauuaaugucucuaauuuccuggauuucuucauuugccauuauuaucuuuaugaucauuaauucauaaauaagaaaccuauucaacccaacccuauuucugagcgcuuuguucugagcagugguuuugguuuugagugcuguacugcucaccgaccauucaugaagguaugauuauuuuugcccagcacaccgcagaguacauuuccuccuaacccauuacagguccguuuuguguguucuuucagugugguaacagauuaaaagcaguauuaucaauaaauaaauguggcuuacaucacaaagauucaucuccuacaugagaaaacauacccgaagaggccaauaauaaccaaauucacacaugguuugggccagacuugggacugaauccaucauaucuauugcugugcugcucuuugccuugugugcgacgcugaucugucagacccuccuguuuauucugcauaguaacuacugacagaaugcacaucugugcuggugugcacacaaugcugauguauuuguggagaugcaggaauggagggagguaacugcucacagaaugcacaucugugcuggugugcacacaaugcugauguauuuguggagaugcaggaauggagggagguaacugcuuacagaaugcacaucugugcuggugugcacacaaugcugauguauuuguggagaugcaggaauggagggagguaacugcucacagaaugcacaucugugcuggugugcacacaaugcugauguauuggagaguaggaauggagggagggcucugcagcucuucugcaaugcacucauuugucucuuuccuuucaauuccccugcaucaggucuugacucacucugugcuccauuccuguaucuaaauuucaacaaugaagguaagcuuucuaucacugagaaaucacuaugcauauuauucuuaaauaucaggcucaaaaacagaaguuuuaucuuaaaauucuuauauuuuaccuugcauaugucauaaaacauugugaaauuguauuaauuucuuuuagagggugaaaguaauuaguugaguauuggaggguauuccuugucacgagcccacgccugacaguguggugagagcuguucucauucugcuccaucaccucacccacucugaugaucugggagaagauucucacucuccuagaaauuacuguuaaauauauuuucuaacuaguuuauaaaccaaucaauauugguuagguuuuucccuuauuauauauccaacacauauuauaccaaacauacuugcuuaauggaaacuucuucaugccuuuuguggucuuaggcaacacucuguggaucagggaguugauccugggucuguuuuguucucauggccuguaugccagugcugccagccuuuguuuguccggcuguuuguuaguggcaggaauuuugguuucuaucacucuguuuuaggaccucucauaguagaguuuuaaacuacuguguuagauaugauacacucaaauuuagaacgagagaaaagacaaaaauaucagggguuggggauuuagcucagugaagaggagaacacuugcuaaaagucccuggguuugcuccucaaaccugaaaaaaaaaagacaaauuaauuuagaauucugaauuacaucacuuguguaguaugauauccuauauuaccuuaauacauagacaucuuaucucugaauuuucauuuuacauauacugucauauaaaauugaguagaaauacaauaaucuugaaauuuuuauauuucuuucuuugaaugacuuuauagugcucucuucugauaagcucacucacuagucuggucugguuuuugcuggacuuacucagguauaugcaauuauuaguuacagagucaggaguaauaaaagacugugucugaaaguacagguuauaacuaguucuccgaagcccaggaaucuugcuuguaucagcaguaauuaaugauuaugagguuccugcaccuuguuaauaaugagugcuuagaaauuaaaaaaaaaaauaaaguccaggcaauuaagauuuuauuauuguaggauaaugauugccacagcaauuugaaauuggaauuacuagaguguuuaucuuucaaugucuccuuuguaaauaucagaagcuuuucuaccugucauuuuguguuuccagcauuuagaucauaauuguguuuaacaguagacucacagagugugugcugagugaguaagagcucucacuacucuguuaacugaguguggcuuugcuuuguucuuucuuagccuuggcauaugcgugcaugucugcuuuuauucccaaauaccuguauaacuucuucuugaaggacaacucucauguaauacaagguaagaaaaugcuuuuuccugccuucauauaggaacacguuucuaucagaagacaccaaucuucaggauaaugguuuugacccaguagcauauguugaugguucaccacugaaacccaggaagaaguaucaggauuuuuuuccuuauaauuuuucaaggaauugugguccuuuucugaugacuauuuaauaucugcucucaauucaguugcagagauguuacuuugagaacuagaguuugucucuaccaguuaaaaggaaaacaagcuauuuuggaagagucuauuaauuagagauuagugauauugaaaauaguuuuuauagcuuacaguauaugcauaugcuggccaaugauauuuggcaacagcauaauuguuuuauaagaucgagguauucacauggaaagauaaggcuaaauggaaaaaauacagggcucggauuuuuuuuuuuuuccaguauagaaaauguuuugucuuaucuagcaagacuacuagaugagcgugcuugcuuacuuagaaggaaugguucccaugucacccucaguccaggcuaacugagugguagagugcuugccuagcuccaccacguuugagaaaucauuuuucuccucucuugagcccccucuuccuauucauuagaaggauuuaugcuuguucuuuggcuuuuaguaaggaggucaagccuuuguugcaacuuucuuagugggaaauaaguuuaucucuuugcaucuuuggagugcccagagucagcauaccuuguaucuguuuuguuugacuggcugggguuuuggcucuguaggccucugaccugaaacuuguguguagcuuaagcaggcuuaguuccuccugcucuggcaugcuggagcuggaggcaugcaugaccccagcagcaucucugccuguuggugcaaccaucaguuucaggauaaacuagaaaccuugugggagauaauaguuagcaaaugagggucauuucugaacagaaagcagaaagucauuugcuuugaaucugucaucugcauccuucacgucugcuuuuuccugcugagggagucagugcugaaaugcuuaucagaagaaaccagcaccgaugcuuguguggagauuuuaaaaguucauuuaucaauguauuuuaugcaugcuuuaaaaacaaguacagauaauuuauaaagagccauaaaauuaugguauuaucaggugaaauucuuacaucaauuucauuguaauucaaauguauguaauaaauaaaagaggacaauaaaauuuaauauacagaaauuagaaauaguucauuaucauuauauacuuuauuucaagaaauaaaaauacauguuuuucuuauuaaaauauaggaaguuauacuugguuuuauggaauuguuuugaaacuacacuugacguuuuagggagauuuuauaaauaucuucauaaaaaaacugaauaggguucaccuuuagaaaauacugccuuugagacuguucuaagaaccuugauucauuuuuuaacaauuuuuauaauuaauaauuauagugcuuuagcauuuuaauauuccuuuaaaauggguuguuagggacuggagacauggcucaauaauuaagagcacuguuccuucagaauaccuggaugcagugcccagcaucugcaagacaguucagaacugucugacuccagcuccagaggaacaaaugcccucucauugcuuuagacaccagucaugaacacagaaugcagacauucaugcagacaaagcacccaugcauauaagauagauauauuuaaagacucaauaguguuaacgugugugggaucuuuuauuuuaaucuaacaccuguucuauuucuuaauuaauuuccuuugauuuuaucucaauucaaagaauaugugcaauugaauuuuuguuacuuuuaugaauuuuauauucuauuaggggagaauauguaauauauaguuuucauguaccuucucucaggcccuccucgaaauaaagagcucacacugagauucauuuaaaagcuuguuuuccauagcccaaacuuugccauccuuuaaauuauauuuacauaugugaaguuacauugaauacaauaauaauaaagaauguauuaguauaugucuguuuaugugaguaugugcaugcuggcauaaaucuagccauucacauuuggcagaacacaaggaaaauauggguuggguuucuuugguaaauccuuaauuaguuggguaaguccacauacuaagcuuagcgggcuuauguaggaaugguuuuuaagaaacccuauuguagcuguggagaauugccugaggcacgaauuucugcuuuaaauugaaacaugcuuuuuagacguugaaaguuaauaacuauagcuuaucaauauacaguugaucacugugguggcucaugguacauacugcuggcuucuggguaaauugaaauuauagauacagcauaugcgauggugggaaagcagugaaagaaaagauaaaggucaaguuaccuggggauuucagcuugauuugaaacucuugaauucauugaaguuacaugauuuuguucuaaagugaaggagcgcaaauugaaugaagagcaaaucaagaaacguguuaguugaacaucucauucuuuaucuagaaagaguaaacaaugcucacauuaggucauuggugggacuuguugaugucauugaaucgaguacagcgcugacauuuccuuugcuugucuugaaucugcuuauuaaaaguacacacaguauuuauaagcaaguaacuguaaaauacaaggaaucauuaggaauagcauuaguugagaaaaaguaauagguuacuuuuacuuauuacuauuucuuuuuuuauuggguauuuauuucuuuuacauuuccaaugcuaucccaaaagucucccauacccucccccccacucccauacccacccacucccacuuuuuggcccugguguuccccuguacuggggcauauaaaguuugcaaguccaaugggccuuucuuuccagugauggccaacuaggccaucuuuugauacauaugcagcuagagucaagagcuccgggguauugguuaguuuauaauguuguuccaccuauaggguugcaguucccuuuagcuccuugguauugggggcccugugauccauccaauagcugacugugagcauccacuucuguguuugcuaggccccggcauagucucacaagagacagcuauaucuggguccuuucagcaaaaucuuguuggcauaugcaauggugucagcauuuggaagcugauuaugggauggauccccagauaaggcagucucuugaaauaacacagaugcuuacauaaacugauaaagcaagggaucguuauuuuucaccaaauaagucauuuaaaaaucaguuauuuugucagagaaaauuuagauuaucaaaggaaaguuuuaaauuucuauuguuaugauuucaauuucaaaaaagaaacaacucauuugucuugcugugcuucguuuagcuuugccuugucucccaggcugugguagauguuacaguccuccuccaucuccucacaaagggcugggguuacagccuuuugauuuuguuguuguuguuguuuguuuguuuguuuguuuuuugagacaggguuucucuguguagcccuggcuguccuggaacucacuuuguagaccaggcuggccucgaacucagaaauccaccugccucugccucccaagugcugggauuaaaggcaugcacuaucacauccagccacagccuuuuaauuuuaguguaggguucuguuuuaacaaaguuauugauuuagaacacaagcuaccacacagucuuauuuagguauguaaucaauaaauuggcacaaauugaagcaguggagaaagugagacuauauucuucauauugaacccuacaacuuguaauagaauuagaauaaccaaaaagguguguguguguguguguguguguguguguguguguguguuugggagggucccuacaagcucugcagccaacagugagacaaucugcggagacaagaaugaaauucaguucagcucaauguagauagccaucaccagcuuaaacaagcagucugucagcacaauuuugaaaaaaaaguuuucuggugacaauuaacuuugucccuuggguucaacaaagcuuaagacauguuuacacugaaacuuuuacaaagcagauauguguuucuccauaaagauggguucuguugacugagaaacaguguggaaaauaaggacuagggagcuugacugaaguaagcaaggugcugaugggagucaggaugggccagccugagauaacagaaguuacuuagucugucguaaaguacaggugacacuucucacaagaaguggaccaagaagccaugcucaggauuuaggguaaaagucuuggauaaacaacauaauauucuggggauuccagugaagccuggcccuacagauagcaaaggagcaucaggcuauaaacucccuuucucaguguucaggaaaggagaccgguaagagaagcuuaucugugugcacaaggacuuuuacccucuacugugugugugugugugugugugugugugugugugugugugugugugcagguacuugaugcauaugcauguggauacuggaaggugaaguuaggugucuucuaaaucgcucuccacuuuaucucuugcaacagggucucucacugaagcaguccccuagcaaccuccuggaaucugucuggcucuuauuucagauuacagaugcccagcuucuauguggguacuagggaucugaacucagcuccucacacuuacagcagcaggcguuuacacaccaggccagcucucggucccaacagaagauuauuuucaauugccuaccauuuacuuacuuucuauuaauuuuuguuaaccaauuaaguucauauuucuacauaugccaaacagaauuauacauaugaaaaaauuuacaacuagaaaagaugcugaaacuuguauauagaaagcaguuugaggcacaguuacucuccugugccugcuuagcuuuuacuguuccuaacuuauaggucuguuccaccuucuaaacaaucuauuaaugagaaacauauuuacuauuacuagagcaaauguauuuguauauguucguuggaaaauaucaguuauccugugcuuaauuucugacucgaaauaacagauagcucugaaaguaaauugugauauuguuuauugguguauuuguuuaaauacuuagcacugugauucaaguacuaacagaauggaaaauuauguuaacauaccuugcucuguggagcagguuagauucucacccagcguaagcugugguucacauacuuaaggcuuugagaugguuggagacagugguugucuugagcguuguuguccuuucagaguaccugaccguguucucccagaugaucgccuuccaugauccagagcugaguaaucaccucaacgagauuggcuucauucccgaugugaguauaccuggggcauggguuucaucccugacgugggugugccugcuguccugcagagugggaguuagacgagguaagguugagcagaaaugacagaguaaaaaugguauuuuuaaauuauuggucauaagaugucugcacaaguugcaauuaaagcuuuguguuugugugguuaccuucaauguccucacauaaaagaagguuccguguuccuucacguguucacuauuaacuauuuguuguuuaaaacacauugaaaaguggauuuaaaaaauauuuguauucuucaaacuuucaugcagcguguuuugaucauauuuaccccucuccccucuccuaccagauucaauucucccucccuaaccauccaacuucgugugagcagucuuggcaacuuccucucuugucucuaaauucaucaaguccaguuugugcugucuaaauccuuuguguguggggcauggucagcuuacuagaaaaaaaaaguguuuuauuaaauuguucucuaaaggguuuucaccuugaccugauuuuuuuuuuuuuuuuuuuuuuuuuugauagaauggugcccuuugaaguagcauacaguucagggcaaacuccugacaucccuaacauccccucugaugcugauuagucaugcuucuccacgcauuucuggagacuuauccuacaucuguuuucaugccauuuagguaaugguuucucugauaaucuggccacaaaaagaaacugaggguaaaagugacuacaucuuaacccguagaaaagucccaucuacaacuguuccuugccauaggaaguaagcaaaaaugaagcuuuuuuacuaaauaauuagcugggugauuuuuagaaacaauuugaagagcuacaggcaaaauagugacuucugagagaagauaaaugagucuuucccacugccgagccccugguugguuauccaguauguuguugcucaacccuaaaagcauaagaacaaugaauggauucaucaguuugguguuuguauauuaauucauaaguacauauguagcaauugaaagaagaggccaugaauuugagaggggccggguaggcguaggagaaguuggagggaaggaaacauuguaaauacagauauguaauuuaauuuuuuggauaaauaaauuggcucuuuuaaagaacaaauauacucuuguagccucugacagugaguagcuguggacagaguggauguggggcuuucugacacucucgggcucauauuucuuaggugcacuucaucgacaugugugcaagccuucucuuacuucaauuguuacuuccauguucuuccuuuaaaauuaccuuugagaaggcugugacugugccucuuauaauacugugagcuaggauucguucaaacaaagaguggguccagugauaaucagaucccaaacugaguucccacucaagaacuaauccuaucaaagcaagccuucauaaucccccaucuuugaaaugcgggcuccuguugcaggggagauugugauuucuggcucccuuccauuugcugugggucacagaacucugggcaccaagcagugcugaagcuuaaauagcuugggauauugugcacugaugugaugccuagauuaucuaagucacgccaguuaugugauuuacauauaaauggaguaaguaaugcguauuuggagagguuggggccagagugauuuuuaucauucuuucuugaugcauuucugcuucuggaaauguacuaggaacuuaaaaaugaaaauagcaaauugugcuuccucauucuuaagagagcaggguuuuuucuaaaauguucagaauaacauucagcuugccuccuaugaacaguagucagguggccauuaagagaaaugauacuggcucucucaguaguugguauccuuuugacccuacugucugagcugaagauaacacuaacaaauucagggguacaguagcuagcaccgucacauaacugcaggcggcgaaacacacuuacacuauccucucccucuuaaaagcuuuuccugucaucuucggcuggguuuauauaugcaaacagauaguaacucagggucacuguauguucuuagaguuaaugagaacccgggaguuuuguguuuguauuucauugaucaguagcuuuuguggcauguauagucugauaacaacuaucuauacauaguggcacaaguuccaggggucucagaaagcaugauuuggaguucaaggccagccugggcacuauagagaggcaauguuacacacgcgcccgcgcgcacacacacacacagaaaaauuuaauaauguuagcuaaaaucauauauuugaaaaaaccuguuucccucaaaacaagagagugcauuuguuuuauauuuuuugucucuaaauuaaaauggugggauucuuguaaccacuucuguguucaguuuguugucgcucauuguuucaguuacaaaaguguuuuaagcuuacuaggaaugugcaaucugaaaccauaucagugaauuuuugauccuguauuccauugcaguccauuagucugcuuugcacuucuagugucuuuuucacccaugcaugauauuguauuguuauaugucaguaauuugcaaaauauuuauuaagugaguaugaaacauuuuauuauacaaaauccaaaagaaaucacauuuguuaaugucaucacuguucauguaacaaguuuaaacagggagguagcucagaguguacaaccgagaagacccaaguuuaucaaacacucacucaacugcuagcugggcauggugaccccucugcgauugcaguguguggggggcagagacaggacauccuauaguaaucuaaccagcaagcucuggccucaagugggagccugccucaguauauaagguagagaccaacugaggaaaagaccagugccaaccaggagccuucacaugcauaucuaucacagacuugaaccccuacacagucaugcauguaccagacagcagucuuguaguguucuuuuaaguuuuauuucauuuuuaguuauauuucucuguggaaagguacgugcauguguguguguaggcucuuauggaggccagaguuguuggguucccaggaacuggaguuacagguggcuuugagcugcugaagguggugcuggaaaucaaauucagccccgcuggaugggcaacaagcucuuaaguguuagccuaucucucuagccccuuuuguaauauuauaauuuucaucucagcucaagcuguuucuugaaauaacaagcuuauuuugcucauuuuuuuaaaaaaaauauugaucaaauacccaagcuuuaaaguauuauuugccugucauucuuucaaguaaaaauaguaucucuugaagaaagcaccuuguagucucauagcucaagcgacuauccagcucccccacaguuuagaccagagcauaguuuccugccuccuaagucaucucacaaauuguuagggaagaacuguaaaggacccauaauuguaccccuuacaaacauaacuguucuaccuugggccauugucaugauuucugcagugcuguccacucaugccuuugcacuauuaacauaaaccucaauccagugaaaacagugacuggagccuaaggaugccaugcucacacuuuugagaauuuauauaucauacuugugagacagacuuacagacugggagaguccuuaugaauuacccuggcauucucuuuucugucuccuccacacuuccugcuuccaucgugugucaggguacaaggaaguuccuauccaggugcaucugguucucagccuugcugcuugcaaggcaaccuuagaauaacaaaucucguuccuguguugucuuguuacucuuguguuuuuaaauacaauuacaaauagcuuauugguaaugauaaaauaauuccuauguggcuaaaauaaaugcaacauaauucuacugagaucauuaauauuuuaagaaaauacagauuuauaaaaggugccauaucucugauuucaaagaagaaacaacuaucauuuucagauaaucaacaguguagugaaauccuuaggacccaaccugcugcuguuucuccagcauucuacagcucuagugagcgcuugccaguucuugcuugcuguugcuagggggcagcauuuacuaagcugacagcuacagacaaguacauugucaggucaggcuaacauuugcgauuggacgaauacucaaaaaauguauaacuuuuuauugguuuuagcaucuaacuuagaaaaguaacagaaacuauguguauuuuuauauuuauagccuaauauuuaaacacuuagaaccauuaaaaaauaaaaucuuucuauuguucaaaauuauuucaguauuaguucauauucuuaaaacuguaaaacagcuugagaaauuauguaaggcaauauauauaaaguacucugggccucacagaacaagucuugucauacagcuacuugggagguugaggcaaaagaugcaaaaguucaggacuuuccuuuguuacagagggcuuugggccuagacaacuuaguaagagccugucugaaacuaaagguaaaggaaggcugaggauguucuugaaagacucgggccuuggcgucaaucccuaaguccaagcuuccccuucccucucucagcaaggaaggaaggaaggaaggaauuuaaaauggaaaagggacauagaaagaauagaggaauugugucucacguaucguuauuacaugucucuagucucaguugugucgcuaagaggcaucucgugcgugcgaggaaugcugguaacagugccugcaagucucugccuuaucacugcacaugcuucccgcuacucgaguaaacucuuuaacgcaccugucaucaccugucaucaaugcgugcgucuguagagcucgagguggggacacuuccugugcuuccugcugcuuagugugauaauguucuuccggacagaguagucagcaugaacuccuuuccucguccuuucuugcuucuuugaagacuucucaggagggcaugaucucaggagccuuugcuucuguacucugauagcuccauugugugcuuccuucauuguucaaacagauauuugguugccucuauacccugaauacauuaaaggacagggguuaaaaaacguuuucccucauguuuuuguggaaguauaugauaaaaagugauggggcuggagagguggcuuggcaguugagaacuccugcagaggacccaaguucucugcccaguccucacauggugacucagagccugucaacuccaguaccagggaucggaucccucggcuuccuguggugcacaucacucauccuucuuaauagaaauauaaaagguuaaaaggcaaggaaauaaaaaaucguuuacaaugcccauuugcuaauaaaagccauaguaaauaaauaaauaaguagauauugugaaaaaagauauaaaaaauagacaaugugauauauucaguauauauugguaaauucuagagaaaugaagaacugaauuuggacauauguguuaaguguuugaauggaggaagaguugaauuuuuaaaugagauugccaggaaaagcucucaggaaaggugguuugaagucaguuccuuauaaaaaugaaauaacaagcaagcaacagcaagcuccagccugggugggagggauacacuagagauguuaagggaauagccacugugaguggagcauggugaggccacauagcaggaacugaaggggagagcauuuugaguguuauacauauauuaucaccacuggcuuuauuucaucaucacaaagaaacaagaugcuuuugaauagaauggugacccaugguguaacauaacaagaucacucugacaucucauuggcugaaauucaagaacagauaaggauagagugucguagauuagucauagcuauggaguaagugggugugugaugggguggcuucaaucuggauuuagcaguagaggcaggagaaguuuucgauguucacagauuaguuggaagguagacgagcaagacugcuggugacagauacaugguguuuuagaagagugcacucaggaacaacugcaaaccugugcuccagcaaguggaaggauaagggguucuuaacccgauguagagauguauguuuggaguuacagaguauggaggaagucucggggucaauuaacgguaguugauugauaaaaagacuauagacaagcagaaagacaaauagacagaaauguuucuuauauguguuaaaauauaaauuggcauuuuaaaaugugagcuuggacuuuaugagggaagacuuggaguagaacuaaaauaugccagucuucauacuaaaauuaguauuuuaagaaaaaugggaaauuaaaguuucagggaaccgagcuguaaugguucuguguuuaaaagucaaaagggugaaaaggaacucagggaaaaaacaaaagcaaacaaaccgcuaccauggauaagcagcaguaagaaaaguuauggaaaacucugcgaguauguugucuagagccaaguaagacaaaagaguguucucauaaagugggacuggucagcaaugucuggcauuacugagugguaugaaaagugagcagagggaauugcaguauagaaacaaucagugggcauuggaacuaugacuuaccuggucacugccuguccugagugccuacgagcggucuuggcauguauuaagccacaagaauguuaccaccauaguaaaagaggucguaaguuucugcaucuuugccaugaaugcccuagccaguauuugcgagguuuuaccacauagcuaccaagcauauagucucuguaacacaucugcuuuauccacauugagaacaaaacauuguauggugagugaaugaaugaaaaugcucagaaugaauuauacaacacauagucgcauuaauaaaauuggacaaaauauucuuaaugacaaucaauugaccuacaccaaaauggucacaaguaauguaauugguguuauaucuuuaaaauaaaggucagauaaugugauaaaauugaccucauauuuuuagauuuaaguuaagguauagaacuuauacuuaguuauauauauuuuuaauuuguacaaugcacacugguuacauugaagcuaaauaucccaagcuuccuuuugugcauuugcagcaucccuagagaggauuaucugcuugucugcuuagguagagugauguggaaaucaauguugauuguuuuacuauaguauuuauauuuuaaugaaguauauaucuuuacuuucaguucuugauuagccuuuggauagaacacauacucucuuguauacaauacaaaggcaguaugcuucucaccucauaaaucuguaauugauagguguugaaaggaugugugucuaaguuggcaauauaagucuuuguuuaacuguagccuggagucacucacaaaguagucuuaacuuuaagacuuguuaacagucccaguccaagaacaggggugaaugaaaugaaauauugcagaucaagcaaaugggcaaaaaagaaaggggagauuucuucuucuucccacuucuacucuguggcucuucagugggcuggauggugccguauacaaacuagggcaguccgcuuaccuagcaccuuuuuaaaagguaguuccaccugaaaacaugcucaagggugcaucccgaaguaguacguauucacuucacugaguguccuaccagucugucaguuuaacacagaacauuaacuaucauaaaggccuuuaaaaucuauaaacuaugcaccuaaaauuuaugugcuauuacugcauuugauuuggccauggucuugugcauacuuguugguaaaaagaagauacaccguggguaaucccuggcaaaaggagcacccgcauuuguaagauggauaacucuauauaaaauguauugugauaauaacuguaguuagcuccauucuuucauaucucgucacuggaguagaacaaaacagagaacuuuuaaaccauuucguuuggugauaggcacccuaauuaugccuuuuacuuucuccacauccauguucccggcuucuuccuguucugcucacagcucuacgccaucccuugguuucucaccauguuuacucguaaguaccaucccccuugguggcagcaaaaguauagccucauucuuccucagaacuuuaaaaguaucccagagcuugugucucuagcugcauauguagcagaagauggccuagucggcuaucaaugggaagagaggccccuuggucuugccaacuuuauaagcccuaguacaggggaacgccagggccaagaaaugggaguggguggggaggggagcaggguggggagaggguauagggaacuuucaggauugcauuugaaauguaaauguagaaaauaucuaauaaaaaaugaaaaaaguauagaauauuaaguaagugcaguauacaucucuauaaaauucuuacaugauauaguuuauagacaaaaauuaucaagaauucuggccuuaaauauuaagaaaauguugcagaaaacuaaaaucuauuuugcauguggcuuacaacuuuuuaagaagagaauuugacaacuuuuugaggacaguuuucuacuaaauugucuugcuuucuagguguucucuguuaacaccugguucuacuuccuagacugggaguucucuagaaauuaauccuauuuuaugaguauguaaugauuuagucagguauggcuauguaaaugaagagccauauuuaacugcaaugcacaugaugagugcaauggcaggugagguagccuaagugcuuuuaccuagaaagauagucacaguguuauuaagugaaaauaaagcugcauuuuuuuaauuaauagauuuuugguaggaauuugauaaaguaauuguauaugauacacaauggaaauguuaucuuauuguauauaaagcaaucccaaaguucaucugcagauauaaacauguguaaauaguuacuaaaaauucuggggaaaauucugaaugaaauuuaccaauuauuaguggaauucaaaaaaauguaaucuuugacuaacuugauaucaauuugaagcacuuuaggaagcugcgaauuaaugaagucaggguuagagcguugacugaauaguuaggaaaauaacuuacugcuuuuauagagaaccagaacuugguuccuguuacccaucuggguagcgcacagauagauaucuguaacuaaggcucgaaaggugcacgcacacucacugucaagcauuuuaucagcacaguuuaacauauuaguucuuaaguaauaaccuuaaucuugaaguuauaauaaucauuuacuuaguaauccagcuguuauuauuuuugacaaauuuggauuuuguuuaaguauauuuuauaaaacuuccuacagauguauuuccacugcacaaaauuuuccaccucugggauacauuacugcucggaaauuccucuuucccauucugcauuggaguagccauccuccagcagcugcgggaccgucuuuuggccaauggcuucaaugaaugcauccuucucuucucugacuuaccagguaugugucuaaaugaaggaaucaccgaaugcaauuuugacuauaaaaugauguguucucucagccaugugagaaaauccuucugcuugcacccuauuucgauggucaggauaaucagugcuuugugccagccugagaaugagaggcuaacucgggucauacugagccacuguggauuauuuccaucacaguacugccaccaggaggguaaaaggucauggcugugggaguaacauauuuacccuuugcuuaggacccauccauuuaucuucagcugauagagaguaaacaacggccacucaggaagguguuugaaaauauguuuauaugagaacgcuaauucacauggaacuuugcucccucuggccacagcugcuugguaacaacaaguuuaagaggaggaagcacuguucuaaaagggaaauaacccaagcuuuauagaaauauguuauguaauaugauagcgacuaagcuguaugagguauuacaagaaguuugaaagccuugggaaggcuauuccaaugcagaaauacagaagacagcuaagguuucguucuugguguuggaaagauaagguuugugugguuaccuaagguagaaugcauuuacaaaauauggaagaagcuaaguguuuuuaagauacaacauuugaacugaaaaagagacucagcccuuaagaguucuugcuguucuuguaaacccacccagguuugguucgcagcauucacaugguggcuaacaaccauccauaacucuaauucuaaaggauccagugcccuccugccucugugggcaugaaacacauaugugguacauacaugcaggaaacacucauaaauauaaaauaaacauaaaauaaaaauaaaucuuuuuucauucauuuauuuauuuauucacuuuacauccugaucaguuccccgcccuccucuccuccuaccuuaacaauuaccuccccccauuaccccuucccuucuccucagagaaggggaagccccgcuuuaguaccuccuugcccagggacauucagucccagcaggacuaagcaccuccucucccacuaaggcccaaccaggcaguauccaguuaagggaaggggauguaauggcaggcaacagacucaaagacaguuccaucuccaauuguuaugggguccacaugaagaccaagcugcacaacugcuccaaauauguagggugccagccuaugcaugcucuuuggugguucaggcucugagcauccuugggccuagauuaguugacucugaaagucuucuugugguguccuuggcccuccgggucacucaguucuauccccuacaagucucuccaagcucugccugguguuuggccaugugucucaauagcuguuugcaucuagugcuggauaaagccucccaggagacaauugugcuagguuccugucugcaaguguagcagagcgucaggguuggcucucauuacauaggauguguacaagcugcugugcaucuuguaggcaggacaaguuuuagguugaagguuuuguggguggauugguguucuccuuccuccacuggaaguccugcuugacuacaggaguugggcacuucagucuccauauccucuccgauaggaaucagcuagggucacccccauagccuugcuccccacugauuuccguucucacucccagcccucuccugccccccccacaccugauacccaucccuguuccugcuccucaccaccucucccacccuguucccucuucauccaaccccuugauuauuuuguucccccuucugagugagauucaugcauccucccuugggccuuauuacuuaguuucuuugggucuguagacuauagcaugguuauccuguacuucauggcuaauguccacuuauaagugaauacauaacauguuugucuuucugggccuggauuaccucccucagcaugauacuuucuaguuccauccauuugccugaaaauuucaugauguccuuguuuuuaccgcuaaauacuaucccacuguauaaacaaaccacaguuucuguauccauucuucagcggagggacaucuagguugcuuccaguuucuuucugucuuuuacaaauaaaggugcuaugaacauagguauccuugugguauaguggggcaccuuuugguuauaugcacaggagugguacagcuggguccuaugguagaacuauucccaauuuucugagaaaccuccaaauuguuuucaagcguggcuguacaggucugcacuccugccagcaguggagcagugugccccuuucuccaaguccuccccagcaugugcugucaacuuaguuuuuuaucuuagucauucuaguugguguaagauggaaucuagaggcauuuugauuuuaauuucccugaugacuuagaacauugaacauuucuuuaaguguuucuuuuuuuuuaauacaaaaauuuuacauuuucucacaauuuucugguucuguguuuuuuccugguuccaaugaugaugccaguauucucgcaggcacaaguaaugauaguaaaugaauuaaaccgucugagagaggccacugaacaacaaacaaaagaccagugaguuuugagauuauauauuuauuaagcacuuuuaagagaaauaaggaaucugccaccuaccuuuguuuauauuuggugaauauuuucuacucugacaucuuuuaaaagucuucauccuuugagggaaaauaauaacgaaaauguguuggaauaauuuaaaaacuuuucuuucucauuuuuucacaaaugucauccaauuuaucaaauuuaauuaaaauaaguuauuucuuacauuaagcaaugauaguucuggacuuuauuuuucaguuuuuuucuggaagguaguggaucugaguaaaaacacagaagccaguuucacaaacccggaagcagucugugccccacagcuguuucccugucaucccagcuuugucaaaggaagcagaggaggauugaucaggauuaaaggaauuuuucggucaguuauaaaaauaaguauguugggaaugcugauuguguauuuucaaaucuaguaaacuugguggcuuuccuuccaagcguaagugucccacaaaugcuggugaaaacaucugugaugauggcuuauaggcaaauuugugaccagugcuaacucagcuagugcaguuuguaauaaagaccucugaaggcagagcccuagcauguccguguguuagaacuaaguaguugaagugcagcccucucuucgccuuugaaaccaggaugcaucuacugaugggcagcgcccugacccacugugcuguucugcuugcucagcacgcuuuacucacuggaugugauuccucuuccugagaaaagcucaugagaaaugcauuuacccuuaaguggcccauguuucauuuuuaaugauauuguaccugggugggauauuuuucucaaguagauuuaaagaauuucauuuuuuggcaugcuaaguucccaacuugaaaguugcuugaagaacuuuggaaguagccauugacaacccuaaaauguaaaugcagaccauacacaaacuaacauguucagaguauuagacaauaauagugucgagcacuuuugaaacaaauuguauguuagucuaccuacaaagaauagauaggcuaacuauauuguacuucuaauuuuaaggccaggaucagcauugaguuuaacuaacuaaauacauuguguugcaguaaaaucccacugaagguuuaacaaacuaggucaugggaaccguagagaagugguuucauuuccucaucucuaacucugauaaugaccauauuuccugucaauagaucacuguguuaaauuaguacagauaaagaauuaaagcagcauaagacagaugcaauauaaauuguaaauguuauuaauacuauuauuauuguuguuguuauuauuaugcuucuugcuuuuuauucaaauauaauaugcugccuucuuaauaauauaaauguaguaaucucuccucuuagcuauuucuaaaaauucuugaaguuaacugucauaagaauucauuguuagaaauuaccuuuaaaauuaagccuucagggcuauuguuuuguaugacuaggaaaaacauguuuuucuugcuucacgauaguuuuuauagaggccagcacccacaggcuuagaagucaaggcacacaugaguuccagucgaguuucaccaugcucggccugugugaacugagaaaccuguagugugaugcugcugcugcaaaagccugcucugcaaagggagaguagccauguacacagcacagcacuucagccacgugggcugccccauuuaugucagcuuggccugagcuagauucaucagagaggugggaggcucaauggagaaucgccucucuaagaccaggcugugggcaggccuggaaggcauuuuuggugauugagguagaggguccagcccauugugggugggccgcuucugggauuguaguccaggguucuacaagaaagcagacuaaucaaguucaagacaugggaaguaagccaguaagaggcaugccuccauggucucugcaugagcuucugccucagguuucucccaauguuugaguaucuguccugacuuccuuugauaaugaacaguaaagugacaguaucacgucucacacuguuguguugacuacuaaaauaauaugcaaaaugcagccggcauaaaaacucauaaagggaaauaugcccaacgucuuuuuuuuacacuuuuaaaaaacuuuauuaguuauuuuauuuauugacauuucagauauaauuccuuccugguuucaccucacaaacccccaucuccuccucuuccccucugcuucuagaggguauucccucacccacccacucccaccucacuauccuagcauuccccuacacuggggcaucgaaccuucacaggaccaagggacuccccucccacugauguccaacaagaauaucuucugcuaaauaugcggcuuggagacaugggucccuccauguguacucuuugguuggugguuuagucccugggagcucuggggauuggggggugucuuagucaggguuucuauuccugcacaaacaucaugacuaagaagcaaguuggggaggaaaggguuuauucaucuuacacuuccaaguugcuguucaucaccaaaggaagucaggacuggaauacaagcaggucagaaagcaggagcugaugcagaagccauggagggauguucuuuacuggcuugcuuccccuggucugcucagccugcucucuuauagaaccaagacuacgagcccagagauggucccacccacaaggagccuuucccccuugaucacuaauugagaaaaugccuuacaguuggaucucauggaggcauuuccucaacugaagcuccuuucucugugauaacucuagcugugucaaguugacacaaaacuaaccaguacagggggucaggucugcuugguugauauuguuguucuuccuaugggacugcaaaccgcuucagcuccuugaguccuuccucuaacuccuccauugggguccccaugcucaguccgaugguuggcugugagcaucugcaucuguauuggucaggcucuggcagagccucucaggggacagccauaucaggcuucugucagcgagcgcuucuuggcaucagcaaucgugucuggguuuggugucuuuauaugggaugggaccccagguggggcagucuggucuuuccuucagacucugcuccacucuuugucccaguauuuccuuuagacaggagcaauuauggguuauuagggaaaugacacccuucacaauacucacaaauaauauaaaauaucuuggugugagucuagccaagcaagugaaagaucuguaugacaggaacuucaagucacugaagaaagaaauugaagaagacuucagaaaauggaaauaucucccaugcucauggauaggcaggauuaacauaguaaaaaugggcaucuuaccaaaagcaaucuacagauucaaugcaauccccaucaaaauuccaacucaauucuucacagagauaaaaagagcaauucucaaauuuauuuggaauaacaaaaaacccaggauaaugaaaacugaucucaacaauaagagaaauucugugggagucaccaucccugaccucuacuacagagcaauagugauaaaaacugcaugguauugguacagagacaggcaggaagauuaauggaacagaauugaagacccagaaauuaacccacacagcuauggacacuugaucuuuggcaaaggaacaugaugaggucugucaggcuuucuucugcuuugccccuuuccaggcugcuguagcauccauuugucacuaaggggauaaagguauguauaagcaguuucgaggaugaguauaccugcauaaggccaauguggcaguaauuuuacagugaauuucuguaacuugagauguuuauuuuuuauucuguuguuauucucuuuuauagaaucuucugcaauaauacuauuuuauguguuucaaguaaauuccuuuuuaaauuuauuuauuauuuuauguauaugaguacacuguagcugucuucagacacaccagaagagggcaugggauucuauuauagaugguuaugagccaccauguuguuacuaggaguugaacucaggaccucuggaagaguagucagugcucuuaaccacugaaccaucucuccagcccuuaaguucucuucuuccacugugaaaguucugagugugaaacugaggcuugaggcuuggcagcaagugccucuucccacuuaggccuuucaccaaaccccauagcauauuuuuaagcaacucacuuaaauaucacauuuucuaugcucuauauaugagaaaaccauagaaauauuuagggacuaaaagucaaguuacuaaaacuaagagggaauuguuaaacuagggaaacuccuuaauacucugucucauuauuguccuuuuuacacccaauauggaaaugaacaaugagaaugagaaaauaaagaaccuuugguuucuguuuuagaacuacauacaucucaaggcaauuuggugaugucacauucuuuugauuucaaguucuuguaaaccuguaacauguuuuugauaaagucgaaaguuaaucuauuuucucacaugccuuuaaaucaaaaaacaauauuaagcuguuuucuaauuuuuaauuuuuuacacugauaugauccaagcuuuucuuuauauauagcaugcuguuacagcauaaaucacaguauaagcugacaugucacaaucaguaugccucauuaaauuugaauuucaaauaguaaauaaaauaaauaucuuaauguaaauaugacccaaauagucauugguugagacuggauaucuuuuuuuuucuuuuuuuuuuauuacguauuuucuucaauuacauuuccaaugcuaucccaaaagccccccccccccacuccccuacccacccauucccauuuuuuggcccuggcauuccccuguacuggggcauauaacguuugccugaccaaugggccucucuuuccagugauggccgacuaggucaucuuuugauacauaugcagcuagagucaagagcucugggguacugguuaguucauaauguuguuccuccgauaggguugcagaucucuuuagcuccuuggauacuuucucuagcuccuccauugggggcccugugauccauccaauaguugacugugagcauccacuucuguguuugcuaggccccggccuagucucacaagggacagcuauaucaccguccuugcaacaaaggcuugcuaguguaugcaauggugucaucacuuggaggauaauuaugggauggaucccuggauauggcaguuucuagauggaccauucuucugucucagcuccaaacuuugucucuguaacuccuuccaugggugauuguuuccaauucuaagaaugagcaaaguguccacacuucagucuucguucuucuucaguuucauauguuuuacauauuguaccuuauaucucgcuauacuaaguuucuggguuaauauccacuuaucagugaguacauuucauuugaguucuuuugugauuggguaaccucacucaggaugaugcccuccagguccaaccauuugccuaggaauuucgugaauucauucuuuuuaauagcugaguaguacuccauuguguagauguaccacauuuucuguauccauuccucuguugaggggcauuucuuuccagcuucuggcuauuauaaauaaggcugcuaugaacauaguggagcauguguucuuauuaccaguuggggcaucuucuggauaucuuacauuuguuuuucuaaaccuggaagucuuaaguguagauauacaaaauauaccuuuaaagaaacuggaagaugacucagccacaaaaaaaaaaaaaaaaaaaaaaaguuuccugccaagcccaacacccuaagcuccaucccuaggacccacaugguggaaggagagagcacuccuacgagcuguccucugaucuccucgggugcacugaggauucacaccugugcacucaugcucacucacacacacacacacacauuuguuaaaauaauaagauuauuauuaagaaugggaaaaaaaagaaaaaaaaagaaugggaaaaagauaugggaaaauaaggaaucaaguacuacauguguauguuucauuugcuagcuuuuguuuuucaaauuagaauaaaauguaaugggugucauuauggcauuuucauucauauauauauauauauauauauaaaaucuuuauuggagaguauagucaagugacauauuuuuaucauuauauaucauacaggaaaaacuuuauguagcauagcauuaaaaaggcuacuuugaauuuacuuuauucauuauacaagguuaaauuuucucaauuugaaaccaugaacguauaacauuaugaauaaugaacauuuaguagcuguucccuccuuauuuuaagccucaguaaauaauguuuacauagaagaagaaggccuuuuaacucuggaacgauaugguaauuucuuucacaugaguauaauggaaugcuaaacuguuauuuaggcuccccacuugggaaauucuaaacauuuggcuuuuguguguuucugugagauagcuucuaaguguaugcauacaguugacggcaugccugucagaacaggggaguauaauuggcaggaaccaagaaacaggucagaugcauacaggccagugcuggacucuucuuaaguucauuuucuaacauaauugcaggugggcacuaguaaucaaaaauauauagguuauauuuaggaauuacuaauuauaguugauucagguaugaggugaacaaagauaaguuaaauuucuuacuuacuaauugcuuuucaauauuuauuaauuguauccucucaaagucguugccuggcagaaacgaauuccaaaauguccaauuauaauaacuaucaguagaaucgcuauuaaacauuucaugauagcaagaugauguuauuuuucgucccguggcauauuuuuaucuuguuacguacuauguaggaaaaacaacuuaaugcaucauagcacuaaaaaggcugcuguguguuuacuugauacauagaauaagguuuaaaauuucucaauuugaaaccaugauaguagagcauuaugaaugauuaacauccaguagacauuaccuguuuauuuuaagucucacaaaaaagaaaucuuagacaguuuucucauuucuaucacuauuggucaacuuaauuggauuaguuucuuuucuauuacuguuagaaaacagcaugaccaauauagaagaauauauuugugcuuauagcuccaaagcauugcagucucugauggcaggguggaggcaucaggcaguagacauggugucugguacagcagcucagggcucacaucuugacuggcaagcacaaagcagugagagcaaccuaagaauggcuccagucacuaaauugucaaagcuuacccccagugacuuacuuucuccagcaaggcacaccuccuagccucccaaacagcaccaccaacuggggaccaaaucuucauagccugugacuacgagggacaucucauucuaccugccacacuaauuaagcacucguguuacugagaacacucuguugagcuuaauuucuuuugaguagauucaucccccaccauggauauuuuaccugcuaaagguguuuuugaaugucuggguguguugcucagagauagagcacuugccuagugugcacaggcuuagaauucagucuaugcuguuguugggucagguuuguauguauacugcugcuauuuccucuuuguucauuuuaggacaagaaaugcaguagauuagaaauggaauacaauaauaugcguguuuaauuguaaugugcucaguuaucugaauucuguuuuacacuucacgaccuuaugugaugcagaguuugagggaaugcauucucugagaacagaaggcuuuggauacaaaaacaaacacucauuugcucaaaagcauagaccaauuuugucauuuuagcuaaaacauuuucauuuaugaaucagagguauuagaaauauaaacauaaaugcuuagcuaaugaaaagguaacaugguauuauugcugugacuuaggacagccaucacuggaauaaacaguccccagcucugauguuuccguuguucauuaccuaauacagcaaaagaacuaucaaguaauuauaggcucucuaaagccuuugccaaguuaauauagacuugugcaaguuucaaagaauuuuagggauuuuuaacuauacaaauaaaaaguguucaguauucaauuaauagauucugucauuuaggaauaaauguaaauaaaauaaguuauaaugauauauuuuuuauaagacaggaucucauuuucccuacuagccaggaacuugaaauuuagccaaaggugacagugaauuccugauuuuccugucuccaccucccagugcuaggauuaaaaguguaggcuuccaugccuaguuuaccauggucaaacccagaauuuccaacaugcuaggcaaguauucucuuaagugagcuauaucuccacgggagguuacaacaguacuuuuauacucuaggaaguaacuaauaccacaaaauuuuaagcccuguaagacuuaaggcaaauauuaaugauuauagccaaaagacugcuaauguaugaccuguuuguuacuuuaaguaacugagggauacaaaaugaaaggagaaaagcuuucucgauaggagaaagaaaguacugaacagaaaaacuauucguaaaugucuuguacuuagaaccaauaggacaccagcuagaaaagaaaagagaaaauauagacugaaaagcaucauugugggcuguguggggaguguuuuuaaaaauuucuaaauauaucuacuuuuaaaugucuuugaaaaauaaaaaaauauugucagauaccaaaaaugggaguaauauguugauacucauggagcagccuuguuccucugccuucuccuccagacgcuccagcuguggagagcagagcauccucauagggagucucagauccaggggaagcagcucacucucacggcaguucagggccgugcuuaugcugcucuacccagagcuuuggaucugguaguaauuagguauuuucucagguaucucuacccacguucucaggcuggaacaucacggcaguugcacacgccugugucuaucgcuguggaugucuuagaguuccugugggaugggcauaaaagaagcugacuauggagccuuuaucucugucccuucacuuccagucaauccuaaaguuacacauuaucuuaaggauccauucuagaugccaauuaaauuauuuugagcucaaaaauugucaagcauacuuagauggaauauuaaauuauuuugagcugaaaaguuguuaagcauaaauuuaaaaaguaguuacuuugaggaguuuuucaggguguaggguaugauuguguggcugccuaaauaaaaugucaugaaaauucauuuucgugaaacuucaguuuacauucagccuuguuagugagacaacaggguauagcuacuucauuauuuuugaaaaucuuaaaaugcauuauuucuaagcuaaaauaaauaauuuguggaacuacaaauccaaaaacagagcccauaaaggcugucauguguuaugugacuccaggaagccagagauuuuuuauaacacugaccuacgaaguacucuuaaaacauaaaacuggggacuguggagauguuucaguggcuaaagcauuugucccacaagaaugaagacuggaauucagauccuccaaacccauggaaaagccauggagacuccuaaccacugcuaaugcacaggaggcagagaugggaaccccgcauaggcuggcuacucacacugcuagaagugguaagcucugggcucuguaggucacauggagguacaguagaggaugacccccaccacaaaugucaagucuucucaggugggcguauacagguacacauacauaugaagaaaagaaacacuuuauauauuagcaacuaaagaaaauugaagucagggucggucaguguuuuguaauuaccuugaaaacggagagugaacuaaaaucauucaucuuagagccagucccacguuuucaaagcccagugagaaggccuuucaccaugguggaaagaguaguuaucuuguaacucugagaauuuaugagcaguucaaaaauuaucugaucauuuauaucguuguuaacauauuuccuucaucauacuaccaaugaaauuaguuuuauuggccuuccuuauugucgacuaucuugguuuucagaucacucaaaauguagauauacauauuaaagccaacuguaaaauacuuaaaaugagacacuagggcugaagagaaggcucagcuuucaagagcaguuguugcucuuguagaaaacaggguucucuucuaccgccuacaguguagcuccuagccacauaucucuucuguuucaagggguccagcacccucuuccagcacccucuucugacuucugugggcaccaggcaugcacgugguacacagacacgcaugcagggaaaacacucacaaaaugaaaugaaccuuuuauaaaaaucagaaacuaacuuugaaauuucucacauuugcugcuaauaccacaaggaagaauuuaaagaccaaacugcuuuauaauuuaaaguaauauaguucauguauuuucugaauaugauuuguauuuuaguaaaacaguaacacuuguggauuuguuuuauuucuccccuccaccugaccucucuaucuguuuacauuuauggugcacgugcgcgcgcgcgcgcgcgcgcacacacacacacacacacaaagauugaaaguacugugaugugcugccucuuuaaacuguggucuuugacaaaauggaaauaacuucacccugugggcucagaaugcagugaaucugcugagucggaucucagcaaaaacacuuuagagcagugugccagagccuagggggacaagggcuggaguggcgauguccucagaaccguguuagagggaacgaccagaacauucuuauucucauaagaaacuauaucuaauuggaaauauuucacuuauuuccaguugccugggaagugcuuaucagauuuguucuaguugccacaaaaauccaaaguuccuguuuuauuucugauuccccauaagguauuaaagggagaaaaugucugcucuguggcuguccugagcugucuucccagcugccccuuuguuccuucugaagugugaggcuugcaguuuagcaccaccugcugauuugcacuauggugucugucuacuccaccgcaacugaucaagaaagauacacuaaggguagagaaacagcgcacauggaucauugcauuuuuaaucauguauucuucauugcaggcacuaagacgcaggaaugguaagugcuuuagcaacugcaccagcaauuacaugugcauaggcucuuugcaaagggagugaauuagagccaaauuccugagaauauucuaccuucuuuccuccuagacauugccaaggcugcauuuauguaccuauccauccauccauuccacagauacugcagacuuccuacaaagaaugugugcaugccugaugacauaaguguauaugugcauaacuagucuuguagcuagauucuguucuuugcuauuugucagaaagcauucaugaaucauuauuuaaagugacugacacuuucaaguugucuuaauuauauauguuguaacuguguuguuugaacagcucauugguucuguaauuuuuuucaguuaggaaaaucaauuucccucaaggaacugcuguguguaaucaacaggacuggaaauguagcagugcuaagggauuggguggauuccuauacaucagcccagauuagcccaggcugcuaggggggacaggcuaaggaugcuuaugguauaagaaagguagugaguuaagauuuagaaguguguguguguguguguguguguguguguguguguguguguguggaauuggggacuaguagagauuuuuaagugauaaaaugaucagcauaguuugaagauuagagugcagaugaccuggaauugguuaggcuugguuacaacagccucugcugaaaacagccuaauuaaagagaauauaaugcucuaaauauuaaguaguucuuccuucucccaaaacaugaacgcuuguugcucucuucgaguuguucaauuuagacacgaucuguggaucugaagaggaguguaugauggggacaaguaaugcaaaaaccuuaucuguaccaccaauagugucaccaacaucuagaacaaaacgacaaggcaagaguugaguucugucuggaaaacauccgggaaugcuuagcgcugagaaaacucaccugcuugguuucagcggcuucaagcagggaagcaaccaaagcauggaaauuggcuguaaggacaccuugcucccugucugagauaccuaugcuuauuaauuuaacacauacuuagcaaacuuuccucucuggcaggccucgcaucaugcaguugggacauagaaauaaaucagaugccuuacuuaccacuguguacagcauaguuagaaagcauggaacugagaaaagagcacaggaugugaagccucacagugcccuaaugcaggaaggaggcagauaacgugacaagacgagagggcugaggucccugugugguggggacacuggcacugugcugguuaggggcauugcauggggugcugaggaacuuggccaugcuuuguauaugaucugaaagugguaaaagggagagguauaguauauuaugugcauucuaggaaaaucauucaagcuaugguaugaaccuucaaaauucuguucacuaagaaaugagaagagaguuauccaagaauauauucagaaauauaguaaaagaguuuuuauugaagagcucuuuaccaaaauacacuucauggcaaagucuugagugccuuaagaugaccgcuuucucgaauacugugucucuuccuugcucaugcaccuuguauuacacacauccuccuuacacgcaguccuuaaauaugggacgcugggcuccuggcagguccugggucuuuggaagaccuagaaucuauaucauauuguaaauauuaauuuuaauuauucuucauuuaaagcaauaguuaucaauccuccuaaugaugaaacccuuuaauaucauuguagugacccccaacuucaaaauuauuuuuguugcuucuucaugacuguaauuuugauacuguuaugaaucacauaaguauaugugguuucugagggucuuaggugacccugugaaaaggucauuugacacccagagggcuuuccacccacaugcugagaacugcugaucuaaaggcauuagaucaugauaaagauacuaucaaccugagggucugacgcaguuuucuguuuaaaggguacuucauggugugcaauguuuguuuuguuugucauggucucugcugauaaguuaagccuguucuggucuaucuucuggaguucugagucccauuguaguaguuuuggaaaguuuucaugucucuaggcaucaguacuuauaguucaucuuaccuucuuuuuccaaacaaauuuuacauucuaaaauguuaauuguugaaggacugcugcauauaugaauauacagagacugugacaauauagcaaaaaccuguacaaguucaagucagauagaaucccagcaaggagaaggggggugaacacagagucccacuccaaaccaaaaagcuguuugcaauuaauagcugcuggaagagggagaagugguguuccuugggggcgggggugugauaccagauauaauaccagcccacucagugccuggccucaugcucagggguaguuggucaacacaaaaugaacuguauguauguuugugcuuugguuugguuugguuugguuugguuugguuugguuugguuugguugcuuucuaagauuucuaagaaggaauuugguggauugggaguuggagugggaucugaacagaguuagggauggaaaaagaauguaaucaagauauuauauuguaugauauucucagaaaaauaaauaaaacauuaaaaauaaaaaauaauuguugaaaacagucaauuauucgaucgaaaaucaucaguguucuaacauuuuuguagucugaggaaugaagcucuaggacuagggagaaggcucagcacuggcugcucuugcaggagaccuggcuuccauucccagcaccaucauggcagcuccccaccaguuccagggcauccaguacucucuccugaccuccauuagcagaaggcaugcacacacauggcacacauacauauauguggguaaaacauuuucuuacacaaaauaaggguuuuaaaaaaaaaaaaaccugaagguuugugcaguuaacaguuaauaugcaauucuaaaucaaguaucuauaaauuucaagcauaaagaaacuuuaaaggaaaauauguaaaaauuguuuuuuauuucuuguauuuagacauauuuucauaaaauguguagguuugcauuaucuaacucaaugcguugugacaguugucagcauauauguaaaucucaccccagauacagaauagucuuaucagcccagaaaauuuuuucuuucuaccuucuaauagauaugcucuucuuccauagcagcuuaugucuuccuuaccucauucugucaaccuacaagagcuuuagugguuggggcuuuuauuuccugaguuguuugucuugauuuuuccuuuuauuuuaaugagaugaacugaacucaggugagcgagagagcugguguugagauugugaauucuagcaacagcaccaucugaaaaugaugucaaccuuuaaucauuacugaaauagcgucucucccaugcugaaggcuuccauauggagaaggaccaggcaaggggcggauggaugagcagagccaggggcuucagaugcugccaagcgcugucacuuagcaaaugguccucuugauguuaggaaccugaaggacagacagggguuuaauagaaagggcuaaaaauagaaaugcguugggucagaguggaagggagucucuauucuucugcacagguaaccucagacuugcccuaaaaaggucucugcuagugagaggaucccaaguacaggagccuggacugagaaugcagacauguacaggaguguggccagcaugcacaaaacaguuagcuaauaaaguuuuaaucauccuaauacuuuauuggcuucccauuuaccuuuugaauuaugugcuggucauuucucugggucuguagugucuaacuagccuucucacagcuggcugcucuuccuuccuccucuucuuucuucuguuuuacauguaucaaguuaccuugaguacauucuccuuuuaacccuugacauagucacaauugcauuacuacccuuaccugucaagucuaauaucuagauaauuguuguuccauuccuuuuuauuuguuucucuaucacaagaaacaaauauuacauuuucugcuuuucaaauuauuguuaauuauauaguugauauugauaaacauaaauuauagucuagcucuuaucauuuuccuuuaaagagcuuggccuuauuacagagugcuaauaucugauggcucuuauuuuuuaauuuggauuuauucuuuauuaauuugugucugguuuaaaauuuuuaaaacuuuguucaagaauguagcucucuagaucuaguuaagacgcucacuccaaauuuugagcaaacuccauaauuucugagccauuaauuaucuuuguaaagacuaguaauccaccuuggauagucaagaacucaguaaacggguaguagguaaccuuuucuguuagcauggagaaauaguguuuacacuuacauccacacuuagacaguauuaguacucuucucuucacaguuguguugggaacagaaaauauuggcccuguaggaauucucuacuucugacaacuuuaaaacaguuuuaaaguuuaacacuuaugaaacuuuuucuaacaaaagcauuucucugucaaauagauauuauuacuauuauuauuguuauuauuauuauuauuauuauuauuacuauuacuauaucauuaugaaauuuggaaguaccaagauccugggagcacauaaaaggaguaaaucaugccaguuuucucaaauucaauuuugaccugacuucuuagagaaaacaguagaucccuucauagcucagaaggaagaagaugcgacccugaggcacuauggucagugaagucaccuucagcagaauagagauacaaaagguguguugcugucuguguacucucucaugagggcuccugggaagugaggaaacuccuaucaagaugaagcaaaucaagaaaaugaaugucuuacccccguucaaaaaaaaaguuaauauagaggagagacaaaaaaaaaaaaggccuugcguaauagugaagggauguucaaacauuggagauucaguagaccuaagcagccaucauuccuaucaagacaaaagggcuucaagagagacagcauuuuaaaucugacuuugcucacauagcaaacaugagauguguguuuaucauguuaaagauauuucaguuuuucuaagagauaugauacugaucagugaggaugaagaaagugggaguuagaaaaauuauuucacucagucacaccacacacacacacacaaaagccuucuaucuucauucaaacccgaugaccucaacaugggauucaggcuuuauuuacaaauguaagauuuuuuuuaaugcugguucugugggugagagauuggucuauaaaaaugauugcacagcugauggcuuauaagauacaauugcauuaugcuuuaauuaugggaagauugggagacggacagguuagaugaauggagaaagggacagccauugucgaauuggguggggccucugcagccuuucaggguucaccgcacaccacaccaagcugcagagcucgggaaucagauggagacuggcauuuuccuuugccaguggcgggauggaacagugcugcugauacggaucgcugacuugauugaagcuuuucuggauggcagaugugucaaacugauuugaaggcuggaaauacaaaauauauggacuaaaauuuuuuuucuuuagggacucccuaguauuaaauauacaaaauuuauauaacugaucauuucuucucuuuagcuauucaguauuuaaccuuacuuauuguaauugaaaguuuucuaaaauaaauuguucauaguuuguuguagacauguagggacaacucuuauuuuucuuguaguugcuguuuguuuucaggcugguaaugguagaaauuuuuaaaaacacuguacuggcaucauguugaaauaaauucauuuaugucucaaaucuuguuuaagucuuuauauaauuguaugucaggaauaacauguagaauguggaucuaaaaucugaccuuuuugugcagccguggaacuaaccagcugugaaguuggcaaaaaucgcuaagagcagauaaaguacugccuagugaguggcuggucuuuaggaacugcugcuuauauuccaaaccuaaugaaccaggaugcuuuugugauccuuaguagcucacacuccuaccugggcaacacacccaacagucauguugcuuucuagugucuuaguucauucuugcaaaagaaauggcuggaguagggauaaccugaugucggggucauugugagaauuaaauggaccaauaacauacaauagaaagcucugccaggaaguagggacccaggaaaugcuguuuucucuucuccaaagauucuccauuuugugauggcaaacaaucccagauccauauggcaugcacuugcuagcggucuaucucuacaacaaaacacuugagacacauagcuaaaaaaaaaaaaaaaggaagacugugucgucggcucacagguucagagcuuugagucuaugguuacuugguucuccugccuuugggucuguguauggagguugaacauugguggcaggaaacacauaccaagaaaauagcaaaagagagcaagaagagggggugggaauuaaauagccuuccagcccugccaaccuccuucugccagccccagucagaagugugcuuugucauuuaaguuugucuauguccaaucaggucaguaaccacacagcaucuaccaaaucuaguucaugccugucuccacuucuccuuaagagagcaggaaucuuaugucuuuggauuuuuaaaugcauguuuuuaaucuauugcuuaucuaaaccgugauggaacugcugacaaagugagacucguuccguuucuuggcuuuaggaaugaauaaaaugcuagcaggugcuggaccccgucucugucaucugagacuucacuguugugcuccaccuuccuccucuagaaacaguuaauucuucaucagaauuguuggccuccuggcuacaguccccucaaaaaccaaugauuggcaggagugaugagcacauacaugcauugccucugccucaaaaggaaaggaaaggaaauaaaaagucauuuuaaaucuuugaaugcauuauaucucuacauaaaagcucacuuaacuaaagaaauuaaaaaugaugggaaaugccuagauugguguuuugaucaccuuucccuggauauauuauauuuaguuacuaaacagcaguauaacuuuuaguguauuuuacuacaagcuguggcuagucaacaucugaguccuuugucuaaugauuccuacgucuaagucucuauuuuaauuugcaaaggggaaacauuuacuagaguaaauguagcagguuguuaaaugaaacaaguuucaugguauuuagaugauauauugaaauacacaaagauguucaugcauacauaaauaauaucaaaucccacacaagaugagauggauauauuuagguacagauaugaugauguaauaauaaccaaauaacccuuauauuuccaaucacuuaugcacauuaauauuguuuuuguuggguuccuuucuauuuaguuuucaucccauacaaauuuagaaaaaaaauuacauuaacaauacagucuaaguucuacagauuuuucucucuuuguauuuucaaccuagaaauugacauugaacgcugcguacgugagucggucaaucuguuuugcuggacuccuaaaagugcuacauacagacagcaugcucagccuccaaagccagccucggagagcaguguagugcgaagcucagcgccuuacuucucugcugaguguacagauccuccaaagacagaccugguacguguuagcagacaccuguuacaaauuuuaccaucauuagugaucauaauacugucacucguguucuuucaguguaguuaucuccuaguauacaacuguguucacaugguuaauucagaagagcucuggcuccuuucauguauaguaaugaagguuguuuggacauguuccuccaaugacaaauuucguuuuauuuucuacauaagcauaccagcuaguaauacaucagcuuguuauaugaggucauagaagcaaaggaagauuucuugaaacacaucaauauuaagaguuguugauauaauaggaacauauuuguucauaaccaaggaaaugauguugagaaaacuaucccauuauguuuucgauauuggccuucuuauuaaucaaauuuacaaaauauguucaaccuaacuuuuauuuauaacuucaguguucccaagaucccacuuuuauauuauccuagugauuuucaugagauuggcuuucaguuaauaugcaugcauugucuuagugguagccagguguacugauagaguaguaggaguaaaaaggagcgcuguaaugaugagacauugcaggcuuugacuuguuaaacaguauuuuucacaguuagauuuguuuguaguugaauauuuuugcaugaauccaccuuuuuacacuugauauuuucuaugauuuuuuuuauguuccauaaaccuggaugcaucuauguuuugccauuuccaauugcagccaauuuguguuucuuaacaacagacaaagaucugggugaggaagaggcaacagcuccguggguauauaugagaaagguuaugauaagcugguaaaggauaucaagagauaggaauaaggaccuacacuaggaaguaaauacuuucacuagucucccaaagguugaguaggccucccaaggggagaauuggcauucauugggauaaaacguaaauauuuaguguuauucuaaaacuauuuuucaauuucauauauaugacuauuuuguaugugucaauguuuugccugcuuguauguaugugcaccacauaugugucucgugcccccagaggucagaagagugugucugaucccauggaccaugaguuauaaaugacugaaccaccaugugguugcugagaauuaaacuccagucaucuggaagagcaaccagugcuucaaagcacugagccaucucuacagucccuauauaaaauauuuuuaaucugagauuugguccucuuuccuauuuuuaagguucaaauuuaaauuuuaauauaaagggaaguagauagaaaaaaaaucugugcugauauucaucaaaauuaggauaaucccaauuuagacucauguaaugucauaccauuguguuaguuuuuuuuuuuuucauuuucauuuuucuuguuguugaugagagaggaacuauguguccugguuagccuggaacucacagugauccuccugccucuaccuccugggugcuaaguuucaaguccuaaacuaccaugaccagcuugugucugauucuuuaaaauuauuuuacaguaggaaaaacauguucacuguuuaguagauuuggccucaaauuuugacccugccugguuuuuugucauguaacauugaauaaaauccacagucucugcacuuacuauuuguaagugcaaacacacguguuacugaccuuauuuugugacaaaacacagagacacucaaagaacgaagaugguuuuugucuugcaguuucagagguguugguccauuaucucagggguuguacaauagaacaaaguaguucaugugaugagccaggaagcaggaaaagaggguaaagaaagagguuaggcaagacacagcccaagggacucgcuuccuccagccuggcccuacugcuguccuucccaccucucaguaaugccagcauaugagcccacccaugguguaauucucucaucgcuggaagugucacagacacaccaagcaguacacuuacucucuucuaggcauuucuuaguccaggcaaguuggcaagauuaucacaucauaauacuuagguuuaccaaagucauuuuauaaauaauauacacaguauccagcucacuguaugauauauaccaagaauuuaaacuaguagcaauuucuuuuacgugcuugguaacgaaaggcuaaaaaauuucaaccuuguaaacuauacagaccuuugugacaccaaucuucugaauccaaguugcugugugacacaggccguguucuuggguccucugucuucccaguguuggcugcaguaccaccacuguacguucaaaacgcacaaacaguaaggcagcggggagaguuggaggcugcuuucuaaagaaggaaucuuccuggcaguuuuacccuaguaauuuuaguuuaaaguuucgcuuugaccuuuacuucuuaguuuuaauuccauucugacuuucaagccacuaaagaauugccaaaagaauuauuucauguccugccaagaucucuuccauccaguuuuuccuuaaauaguaaaaaaaagucuccuugagaauuugggucguaguuuucuaauugaagaaaacaguaaguaaagguaugaacuuuugauggauaugaugaaguggacauucauuuggggugugugugugcagagaucagagaucagcuuggguuaguguuccaucauauuuugggugggguuggaacuucaaguuuagcccaagcgaacugaccuccugcauccacauugccgguacugggaucacacaugcaccaugcuugcugugucuucagaucuccugcugacauuggcuccuucgguuugcacuggaagcauccauuagccaacugcacauuccaggccacaagggugaaaugggugggguuugguuuuuuugguuuuuuaaacugaaugcacuuuuuagaaaaagauaguaguuaacuuuucaauuuuuuuuaaucccuuugacaaauuugaucagcauauucauuuauuuguaaguaguauaacuuaguuauaugcagucuuugaagaagcaagaauuauucuuguuuuucaugauaaccugauuaggaacacauauaguagcccaggauuuuaaaaaaugaguuugguuucacuugcauaaugguaacuacuugcuauugucaugagcaaaacagaacauucaacuuagaagcaaugcuuuacaugccaacuggucuuuugaacauuuuauacuucaugauggaaucgcuucucaaagucaaauauaaauucuggauauaaaauuuaaucucacuauauaaacuucauauaauuugaacaauugaaaaaauagucucacugagcuuuacaguuugcagguuuucaggaacauuuucuucccuuaaaccaaucucuaacguauuguguuuuauuuucauuuaagaguuaaaacaagcuaaugaauucaguauaacuuacaaacagcaauuuuagcaaauuuccuguagaauguuuugggcccuggauaauucaagcguaugugcuaaucuauuccacacagugcucuacagucagagcugcucgggaucucacuguuucguuccagucuuacuagguguacaucagcauguacaguuacuuguauacucuugaagaaaguggauugcuucguagugcagugcaaggaaaaccacaaauaugugcuuucuucuugcuaauaguaccaaguguaaaauauuagcauaagcccaacuaaaccuuugauuagaaugcucagaucagcaggacacagggccuuugcauuugcaucuguccuccugacuguguucucuacauauucuacuucucagcccuugggggaagagggaaaaugaccacucuaaugaguccuuuaacggaggaauucaguucauuuucauucauuauuauugauauguaaggacucacuccugucuguuguuaccuuuuuuugagauucucuuucuuccuuuauccuuuccuacucauuuugugguuugguaaugcuugcuugcuuucucucucucucacucucacucuguguguguguguguguguguguguguguguguguguguguguaugugugcgugugcauagauguguguguauauguaugcauguauacaaauaggugacuuauuuagcucuucacuuguaagaauuucaaaauuuucuuucuugaauuucucauuaauaucccaauuaucuuucuaauuucauuuaauggguuauuuuuuucucauggauuucauucaguuuuuaaaugacuauuuaaaauguucuuuaugguguauuucaucugugcagguaugaaaucgguuauuaaagaguuugaugugugccuuuauaggcaugguagcuugaguuuucauauuuccugggcuucuguauugagauguuuuucuaucagauggaucagacugaaugcaauucuuguuauauuucuaaauugggacuacaguguaguuucccuguagcuccuugggcuaugaucaaugacucugcguacagugcagacugaggugggaucagaaacucacuagccuauaagccccacaagugggggcaugagcucaagcagguauagugcugauagccauggcugcgaggcacucacuguguacuuacucacacgugggaagaguggacccuaucaggugaccacaguuucaucaaaugcuguugguucuagcugugcaagguccccugccagcagcccuagcagugguaagaaaccuagcaagcuugcccuucagucuggcagugacuuggguccagauuucauuggcaaaaacccauagcaguagcccuguggugcucauacccagucauaacuuuaguagacuauuagacaaaguauagagauaauaguuuuacagaagggguggcaaacagaaaccacugugcuacucuuugcuggcaacagugcuugucaaggcucuugucuugccugguaugagcacccaaguuuggagugacaacuggaucuagggggauuuccuucuuuagaagcaguguuugcugcuguaggguaaugguuggggcuugaguuguucagggcccuguaaaccagguggcaguagaaacuuuaggauuaccucuacacuuugucuguaacugccaguguagcauaguauaguaaauaagugagagacaacaagaaacagcuguccuuggcuuugguccugccacuaacaugaguucacaaagagcuaugcagaaccuggggcuuaaaagcagagagcuguagucacagugauaccuuccaucccccuguaugaagguuguuaucuccuacagugcagcucacucauuguucagguggacuucacaaagugucuguucguguccuauuagucaaugcagcauaaugucuguggagucccaacaauggaaauauuuaggaguuuauaacuccuagaagaguucaaaaucagacaucaggucacaucucaagauggucccugacuguagcaccuuagguguugaauguaugacauaugagacucuuuuuccaaaucuaagauuucauguuucuuauggacuacaagccaguguccacuacagggcuaacuugauggucaugaauuccuauacuaugcuuuaaaaaaaaaaaaacaaaaaaaacauuuuaugacaguuugguuggguauauuagagugggcuugcacuugugaucuuucaaaauuggaaauacaucugucuaagcccuugcuuuugugguuuaaacugaaagucuauuguuauucugaugggcucuucuuaaucuguagugugaccuuucuuuucuaugguguauucuauuguguuaaauugcaauauaaaacuauaacauauuauagauugacuucauucuuuuauucagcuguuuauauucucccggaaaauauuggaaucuuggaucuguccuaucauauuuauaaucauuauuuugaauuuaccuggaauuuucucuaagucauuuugaucaauguuuaguaauuugugguugacagcuuuugaaggaaacaaguuuuguugguuuuuuuuuuucauguuccuugugguuuuguuaugagaucucaguuaaguuauuguuuaagauuuguugcuguugaucuuuuucuuuuaauucaggaugcaucucuucuuucaguggaugugcuuauagcguuagagacugggucauugaacaguuguggugacauuuucauuugguaggcugguguuccuguccacagacugucuccagucugcaggugugggaagagcuuucacagcaacaauuacuacccaguaguuaacccaguaugacuaaacagaguaguggguaacuggaaacaggcacaugcuaaguacagguuaguuuaaggagugaaggacuccauuaguacugccugggcuaaugcauuaguaugagagaaagggaaggaaagggugagcaaucacaguaaggcuggugagaaauguuggguuguuagagggaaguagaggagagacauucauaggaauuaaaauaguugagacagaaaaaaaaaaguggguagaugugugggagcuuugguuagcauuagacuucuaaagagagguaaggauaugugcccagauaucguaaaccaggucagcgucuggccuuuggaaaauaugacaguaagaggaagggauaugagagagagaaggaagaaaaggagaaaggcacuaacaguagggaauaguguuggcuuccuaugcccuacuguacuguauagaaaagacuuaucuguagagagaggcugcuagguggagguagaagauaauggacucucagugagaugaagaauugcuguaguagggaaggagagcuggauggagauauucagaaaaugagaucacuggccugaaugccuuuuguuucuucauggauccacuggauuguuuguuuguuuuucucucugauccuggucuaagcugugcugcauaugcuuuuaaagggaguuuccagcuucuuucgcauguagguuuucuugguucuuuucuguugguuguggacugugggcugugaacaacuaagacaaauucugccccacugugguugcugaggccccacagggucaggaauggcugguuguaugauucccagagcacacugauugguugauguuuguguuuaguuccugcuuuucccuguggugaaguugaugggagccccuccagaguaguggggggccccuucuuucaaauccaugcuagcgcuacguuugcaauuauuuuagugcaguuaaccuggaauaaaaugcagcaagcaaggccagucuggugguagagaaaguccauguuuaauuauagcagagguuuguugaccagcagagccugacccuggagaaguaguugauugauugucaauuauucuuguucccuuuauuuccuaaacuguuauccacuacucccucugacggggcuccuaguccaccauguuccaaagguuuuuguguuguucuaaaaggggaauauucuuuuucuuuucucucucucauuauuaaagugaauuuuggauaguauuuauucuuuuagcagauauucauugagcacaugcucaguaccugauuccuuucacauuaauguggacuguaucuguuccaaguaccuugguaaauacauggacaugaagaaaguugguuuggaaucaggagaacaaagaggaagaaaaccugcagugucugccaugccucauuuacaacugcguucuucauuuucugaaccuaguuguuauuuaaagcugagcuccucaagucuagaguuagcaagauuuuuaucauuuuauauaaacauccuuucucccaguaucaguuccagauuugggauaucacuuaauucaguacaccagaaaacuauuuuggcagaugaaaauaauguaucagaacgggauaaacaauaaagcauuuauuagagaguaaguugaacuaaacguuaacucaaaugcuuugugaaauaagacauuuaaguaaauauuguaaccaaauagcuugagaauacgccucacuuuccaggucacggagcuguaaauuaggggugcauguccauuauugcuuuucccggugaaccaucgugugcuccucauuuuuaaaaacauggaauuguuucccugcagccaucuaaaacuuagaaauuauaguugguacuuuucacuaucuuuuaaaacaugugcuuuuuaucauuuugugaaauuaucuuggagaaaugagaauuuguaguggcauaucaaagugcuugcugucuggguuauaacccucaguguggucacuccaacucaucgccuuguaaacacagcucucccuucccacuguaugcaaggaucuucuggauacagccauguccuguaaaugccacagugaaaugagcacagaaaguguguccauggucagacaaaacguguaccaggagaauuaugaaugcauuguguugaugaggauuggaggugauagaagcagagucaugauagaguucuuaauagaaaauaaaagaaaauacuaauuauuuucuuuuuggcgaaaguaacauuggcaugauauagggcagaguauuugaagaggguuugguccagacuggcagcugagcugaugugagacaggggcaugucuccacaggcagcaggcaguucucaaagcacaauuagcauccccacaugaaguugcagggaaggcugcaguggugacaguuuuccugagcagccugauuuaauucaguguugauuugacacagaucuucuagcaauguuucuccaccagugagucuacagaauacauuucuccauggagagugaugggcacagcagccugacuccagcucgcuaaugaauaucuggggucuugcacagagauguuccuuauacaaccucaaaguucagagaugucauuucaugaaucacuggcauucugugacauuuaaagagaaauagauucuggcacaauucuacagaugggguggcaacgagagacaccacuauacacaggauccaggaagccuaaugauguucaaaguaucccguuuauucaggcacucaguguaaguauauucauauaagauacccauauaggauaaauaaacaaacaauuucugugacaugaguucagaaaccacaguuaaaccuagguauacaauuuuaauuuugauguuuuuuagucuauuuuguacacauacuaacacagacugaggcuguaagaaaagugaaaccagagcuuuaccugcaacucacacaccugagagaguucuagcaaggaggggguuccuguucucucaagcacaagcgaguaaaguuuagcuaccauuguuauuuguguguuugugugugugugugugugugugugugugugugugugugugugugugugugugagagagagagagagagagagagagagagagagagagaggaguugucauucagaaguccuauaugaaucaagcaaaaugaccacuuaccaacagacaaucaagucaagauaacaaacuacuaaacuuuuuucuaaaauauuuauuuauuuauuauauguaaguacacuguagcugucuucagacacaccagaaaagggugucagaucucauuacagaugguugugagccaccauguaguugcugggaauugaacucaggaccuucggaaaagcagucagugcucuucuuaaccgcuaauccaucucuccagccccucuauuaaacuuuuuuauuuaucaaauggcuaguuuaauaugaagauguuuauuuucuugaacaaacuaaauuacuuuuugauucuaaauaucccuuuauaguaaacaagauuuauacucauauuuuuguuauuuuucaauuacauuaucuuuuagaguuucuuuuuccauaccaagaagcuauuaaaguccaaauugugcuacaaauaaauuuacagauaggaaauuuugauauguuauuuuuugaaaaaaacaaaguaugucuuuuucuuuuuccauaccaagaagcuauuaaaguccaaauugugcuacaaauaaauuuacagauaggaaauuuugauauguuauuuuuugaaaaaaacaaaguaugucuuuuuguuucuuagcauccuuuuaaguuacuuguagcaugauagagcuuuaacccucuugcauugcacguauuugucuagugucugcaugagucugucugggcacaucuaccacaugaacaugcugaggucagaagacagcuccaggggcugauugccuuccaccauaggguuccaggucucagcgguagccaggcgcagcaccagucaccuucagccacugagucacuucucuagcugguuauugagaugcgcccucaucuugagauguuuauagcagguucagugucucgagcuuuaacuuugcucucccuguguguacacguuccguuuuccuuuuuuuuuuuuuuuuuuuuuuuggucaaaaccuagguggcuauagccauguguacuuacaucuugauccuuuagucugcucuacucuguuuguaucugguuuucugccaauacugugcagguuuuuucuuuuguuuggggaguggaaggaaaggauuuauuuuccuacacuuccauaucacaguccaucaucaaaggaacuuaaggcaggaaccuagacgcaagagcugaaacagaagccaugaaggaguccugcuugcuccuuauggcuugcucagcaugcuuuugauagaacccaguuuugucauagauuaccuuuauugcauugaauguacucacauaaucccuaguuuuuccaggaccuucaucauaaagggauguuggaguuugucaaguggcuuuucuguaucugcuuauguaggacaucaugugauuucuguccugaccugugcauuuuaaccaauuaauuacucacugcuuuuaaaauagaguagugauuuuauuucuauaaguaaaauuugugaacacuuaaguaugucauaauuugcaaagaauaauuuuuaaauauuaaugggauauauguaucaaauuacauguuuacauucuauagacaauauaguaucuuaaagauuuacuucaucacaaaaagauugccuguagcuuuuagcaauauuuccuugucuuggauugcuuauuauuacacuuucaacuuuuuauugguugugaauuucacaucauacaccccagucccacucaucucccccuccccucauaccugcccuccacucuugcaaccuaacccccaacagagaaaaaaaagaucuuagucuggaagcuguagugugcccccauaguacacccuuuuguccauacuuauuugcuugcaaauauucuuuggcaugagucauuggucugguacaaggccucuggcuucugcugcuuuaucaauacuagauccucacugggauuccucucagcuauccuguuguugcucugugucauggagauccuguaguuuuggaucuauaagagcagccgcuucaugaacuccaacaauucaucgguggaguagaugaugggguaugccaacucaaaggucugagucuagaccugagagguaucugagcuggucagccugaugacucuccugcacucacaccauugggcuggcucaccuucaacccacacguccagggccaguucuacugugcuucccaggugagguacagaacacccuguuccaaguacugcagcaaguaaggggcagggacagcucuccugcucucaaccccagggccagcucuccuuccugcuguaggugguaagaggagagggggaaggaaagggaucucucuugccuaugcugcugcaaggcagacagauugcugggaccccucuccugugcucauacccugaggccagcucacccucaacucccacagaggccugcucccccaagcacugcagcuggcuagggacgaggcaccgcucuugcucucauggccccagggccagauuucccauguucaagcaagggauugggcuaguucugcauagcccuuagaucagcauaucccugggcaacagcugcgaccagggacauccaccuggccucaggugguaacagacaucugcugcugcgggcccacuggcccagacaugggccuaguggcagcauaggccaggaucccugggacuguggucccaggaggcaucaccagcuacucacaucagcuguuccucacuacccuccagucuccaggucugccucucuucauugugcccacauccuucugguucucuuucucuuccauuucuccaccacuuacuugcuccccuuaguggugcccagagucacugagugcccagagucaucucaggaguggucucaggagugcugcgcccuuuggugcauuaugacacugggcagggguaaucucagacaugcucuacccccaaccccagccuacacagugcccaacuuuggucauuucagccuagcucccuguccagaccccauggugcccgucugguggacaucucggccucacuccuugcugaggccuacccaaguggccccauuugagggugggcugucucaggcucacuucugccagggacccaugguccuagguaaggguucuucuagucucuuucucacucucugcccugggagcccuuccaggccuguguugugcuggacugaugguugucucaggcuagcucccagugugagcccccagguaccagacugguggucagcucagacuuguuuuuuuucagggaauguuagacuacuaauuauucaucuggucguaggucagaauacugaguguagacauagccucuuucuucucugccaucuacugauucaugcccauaccucuaggagcuuauuaucacauuuuaagcuacauuacaccagaaaggagauaugaagaucuuuaguuuaacaguuuuaaaguuaacuguaucucaucuaaauauuguaguaauucaccuauauauaauaacugaucauuuuaauuagaauuucuguucuguuugguagacuuuugcauauaaaauaguuuauugaguuuucucuuuauugggacaauguuuguaguauguuuaugcaaugcauuuuuaguaauuaaguacauguauauaauguauaguaaugcaaucaggguaauaagaauuuccauuccuuccaaacacuaaucaucuucauauguuggaauuucauacuuuuauggucacauugaaauaugucauugauuguuugaaccuauacuuacccuucuguauauguaauagagaacccagaacuaagucuucuucccagcugugguucugagaacuucuuuugauucacuuuccaagucucccgugaccacagucccauuccauugcucacgacacugacuuacaaguuuacagagaugacaacaugugguaucucugucugacuuucuucucuuagcauaaugaaacuaauucuauccauguugcccaaaauggcaguuucauacuuuauggccgagucaugcucuuaucauauuuaugugcacacuuucuuuacugacucaucuacccagagcauuuagguagacuccauauccuaguugugugaacagcacugcagugaacauaggaguacgugcaucuuuuuuuuuagauuuauuuauuauuaucucuaaguacacuguagcuuguaggaucuaaaaggggagcccuggggauggggggggggcgugagggaaaagguccacaccccgccagaguuucccuaugcucuggucagucaggcgugggagggcugcuaccuacccuuuccacucaucccuggguggacaucccucuauccuacucuucaaaggguggccaaggggcagcccuaccuagggaccccggagcuaccuugcuaaagcccgggguuaugggagagcgggaugagggaagcgguucccaacacugaccagagugugcagcggaucuuaauggagcagagacucucuaugguuuaagagcuuuauuauagauauacagggagaaagagagaaaguaaaaagagagaggagggagggagagggagagggaggaaaggcuagagagaaagagaaaggagagaggguaugagagagagggguaagaaggagacaagugagagaguaagagagcaagguggaccugaacaccccuuuuuaaggucuucacuguugcuagguaacugaggaggaguuuagccugaaggucagacgcuugggucauugccuaccugacuacugaccuugcuucucuuggggcugugggggcaguaacuuaggcaggggccagaguuccaggagcaugagggaaugccuaucgugucaugaaggugaauuaugaccaucaggguucagaccucagcucaacuggauaccagccugcaauuccccacaguagcugucuucagaugcaccaggagagggcgucagaucucauuauggaugguugggagccaccaugugguugcugggauuugaacucagcaccuuuggaagagcagucggugcucuuaaccacugagccaucucuccagcccccacaugcaucuuugugguacaaagauuuugucuccuuugcauguguucccagugguaaaauuaccauaucauuagagcacauccagugugguuuucugaggaauacuauaugguauuccauaaagccuauccaauuuacauucccaccgcccuuucuccccaucuguauccucauuugcuauuuuugucuuuuuugauaacagccuuucuaauugggauuggaugauauaucuuagugguuuauugucauuguuauuuugagaaagauagaaucucacuauguacucuuguacaccugagguacucuugagcucacaacgugccugccucccucaccagugcugagaauacagacuugugacaccacuuucccaagcuuuugauuugcuuucccugaucauuaugagacuggacauuuauuaaauacaccaucuucucucuacuguauacugguaucuuugcuaaaaauaaauauauauuuggccauaugauuguaaauuaauuuaaauuuuuauuguguuuuuucugugugugucugucugucugucuguguaguauaacaguaccucacuguuugguuauaauaacuuugcaauauguuauuuuugaaccauuacgccaucccugcagugagucacacuggaccauggucuuuggucuuuuuaauguaaugcugauuuuuuaacgcuacugcuuuguagagaacauuggcauguauggucaucaggguaaauguuuuuaguuuuccugugugggggaucuuuauaugguucugauacuaagguaaugcuggcuucagaagaagaaguuggcaguucuucucauuucaguuagagaagaaguuuaagaggaauuugaauaagucguuuaaauauuuugcguaguucagcaacaaagcucucauguucuugaggcuuuccucagaugggagauuuuaguuauuguuucaguguugcugcucacuauuugcauauuuagauuucuaauuugauaguguguauucagaaacguauccauuucuuguaggccguccacauuguuaguaucuaauaugggucucucaugguccuuugcauuucugugcugugagaaaccuuguuucaucucugacuuugagucuucuccaucuuccuuguuagagcagaacauuuagucguucucauuuaccuuuucaaaacccacagcuccaucacucagcaugcuggucacagaacaugguggcccaugucugucaucuccccacuguggagacagacagggagaucuaggucaccugggcugcaaaggcaaagccugucuuauaaacaacaagaagcugcuuugauugauuguaguuuuuaaaauuuccauucugguugucagucuuuucucucguuuggauuuucuuugcucucacuccagauuguuagugugcugcggagucugugggguagcgccuuugauuugcccauguacuacugcaugcuucucuguaaugugcuucuuuacccagacuucauagacucugguauguuagggucauuuucauucuuauagcauuuuguauuucuuuuuuaacuucuccaguuagccacuggacuuuuaggagcguguuacugaauucccaucuaugugcauacuuucuacuguggccacucugugcuucucucccauuaugagaaaaugucacgguuucaguuugguuugguuugguuugguuuaaagauguauuuauuuuauuuauaugaguacacuguagcugucuucagacacacaucagaucccauuacagaugguugugagccacuauguguuuguugugaauugaacucaggaccucuggaagagcagucagugcucuuaaccauugaggcaucucuaaaauuucccauaauuucuguuuuuaaaaguuuauuaaaacuuagcuaggcagugguggcauacacuuuuaaucccagcacucaggagacagagacagguacaucucugugaguuggaggccuacugggucuacagaguaaguuccaguauacccagggcuacaaaaagaaacccugucuuuugaaaaaaaaaaaaagucuguguuuuuauauauauugccugacagaacaucuuaaggguagaacuauuuauuuggguccuggcuuuauugauuucuggacccauaagcuugagcagaauauaaugacaguaggaguguauacuaagggaucuguuuacucauggcuggauaaaagaaaagagagggacuguagaaaagagcaggacaauuuauuguccucauuaacacagugacacacuuccucuaacugggcccaaccuccugacguaaccacauccuaauaccaucauauuaugaaucaucaaccaaucgcuacacuaugucaguaccuucauaagcaaacuuuccguggaaauuccuuucaagcacacccagaaauguggucuacuaaucacuuagaugucuauuugauguuuguacuagccaccacauuugaugaugugcccuaaagauuguuccgugcauugauaagagagggaaaacauguguccuacugcuguuggaugaaaaaaaaaauguguccuauugcugcugguaaaagauguauacauggaggaauaggaggcagagacaggagaaccccagagacucauuagccagcaggccugguacacaacagugaaaauuaagagacccugucugaaacaagauggaaggugaagaccacugccugcacuuauccucugacgucacacaugggaccacauucacaugugacagcaggaaagaggaaaacacuugguuaaagcuccauguugguagcuugcaggcgguccuuuggauuuuuuauacauagucauccauauaguuggagcugugaaaaaucacugagauuguucucaauacacucccuuuucaucugcugggauuccuguagugugaaaguuguccauuugguaguauuccauaaaguccauaaguucucuguucuuuucauucucccuccuuuuccuaucuaacuacugcuaugccugagguuaacucggaaggcguguccuccacaucagaaacccuuccacuuguuguagucuuuuguggaagcuauuacuuuuuuuuuuuuuuucaggguuuuaguucgaagaucagucuuuguuuuuuguuuguuuguuguacagauucugugucuuuggugaauuucucacuuguaccuugaauuguuuuucucauuucuuuguaucauucauguguuuugcuuuguaugucacuaaguucaaaucauugcuuuacauuuuuuuucaggcauccuuagcuuuuucucugagaucuuuuucugaaagauuguuuucguuaagggcauuaggcuuccucugaugcucucuccucgaacugaugucuacauauuugguguaauauuuacuuacucugacuauuuuaugaaguagcuuuuguacgaaagguuuuguuuguauggaucuaucaguugguaggugcaucggguucaguuauaggcagcucacuagcacaucucucaguuucuucagcuuuggugucaagugucuagaaugcaaugaucccaaaauugucauagguuuucaguggacauaagcaaagugacauguccauuagcaauacauacuugagcccugguggcaccagugcuugcaguuguauuuguaguguugaugaugcagaauauggagagaacuaucccuuggucccucaguacaagaagagcaaugcuauaguuucuaauaacaccuaccauaguuccugaucuauagaaagugaagacauucuccaggaccuucaggauaaaugcaggagauaccugggccucugacaucagcaaccauuccuuagagccauauucuuagagaauaguguagaacuuucucucugacaucuaggaugaguacaggucaugcugacuucugugguaauaguaaccuugaacucaacauuguggaaccuaaacucuaugauacuuaggucccaugaggcaauccccauuuggugcuuggucucacagcacuguuagcugguuuuauagagauuagagccauagcugaugcuuucaccagaucccaaaacaucagcauaaauggucucaguucuguguacuguagaggaaggggcauggaacauuugaauuuguggcacuggucuccgcccucuuugaguuauaggauguagaggagacuuuuucuauuuuguguagguuaguauaaguggugauggggcuuguagcugugauaucugccuucuguauggauggaaauauccucaggaaauuucaguaagaaugagacauguggcauuuguugaugcaguccaggaccugcuauagauaaaagggaccuuccccuugguccaauggacaaucuugagucaagccucucuguacuaaguuuaaucugcaggccauagacuaggacagaaagcuuucccauuccccauuguguguucugauggugccaagggcugacggggccucugauggccaguuuacuaaaguuuuagaguagcgauguaucuuuccagucucuggaaugaccugugaggaaaugcugggauuugcauuaggagcugcaguguggagguaggaaagaaaccucuccuaauaccugcagguccagcucaugcuggacuuggacauguaguagaggcauccucuuaugcuaaaacugcaggaugccgagauggcuguccuuuaguccagugaaguccacuggagaaagcugcugguugggucaggcaagaugacaucagguaauuccuucuuuggaacagagaggucccuaaagcagccaacacccagacuggauuuaaguguucuaaaacuguggagucugugcugggacugcuggcuagaugcuaagugugugcugcagguaccugaauaccaugagggagucucagcagggagacagacugcauacauaccaugagggugccucggcagggagacugcagagcuugccaucuguguugcuguuaccugagucaccuuucugacucagucuucagcugcccagcuuccuugcugguuuccagguuucccucccucuccucaaagcacagauuuuccuuuguuccacaccaaacaccuguuuuaccauccuggcuacacuuuugucuauuuuucuucuaaaaauauaguauuuguuuauucucaauuugugauucagagauuaaaugaauuguaaaauuacaucugagauucuuuuaucuucaauaagacaauauuaaacacgagagcuaauuuaacuuaguugaaaggcagccuucagauuugucaguuccauuccauaauaugcacuguuauguuauaauuucaagguacaucuucauggucucugguuuggggcuuggcugugacaugaauagccuugcugaucucaucacaauuaaaaugccuucacauauuugaaagaagugagaaaugcagcuaaauacauuauagacuuugaugcuucugaacccaaacucccaugagcauugucuggcuuggcuuauagugcauucaaauaagcaauuaguuauuaaaaacagcugaguaucccuccuuugcuuucugucuccucugcugaaacuuuggaggcuuuucacuugauauaaaugguuggcugccaugguagaaaauaaacauuguguccuaguuuacuuuccauugcugugauaaagaccacaauccaucaucgggggaguccgcacaagcacuggaggcaggcaccgagguggggaccaugaagggacucugcuuauuggcgugcucuccauggcuuacgcagucugcugucuuauacaaacaagggccaucaacucaaggguacuaccacccacaguggaugagcccucacgcgucuaucauuagucaagaaaaugcccacagauuugcuuagagaucaaucugacagaagcauuuucucaagugaaguuucuucuuuucagaugacaaaaaaaacuaaccagcaaacauuucaccagaaauuaagaguaauaauaaaacaguauugaccucacuugauaccuuguucuugauguggucauaagaaugaauugguagagcuacagauuuucuucucaagccugugccaaagcuucuaucagagaccauuuggaccguuuauuugauauccucugguuacagacugaugaaaaauauucugagcaacaaagaacagcuuaacaaauauauuauugcuaagcacuucagcauacaggaaaagggugagagcgaggacuagugaggucacaaauccaacucaaguaacagcugugccuuggagggcuaaguuggagggaaaacuauaacucugauucacuuacauggccucaaaucacugucuuuguucugaagaucuaucugaggcugccagaggaaacaggcuaugccuaugcucuguagaguagcagcucuaagugucccuuccaggaagucuagacaccccgccuccaggguugaauugagccucauccuuuucagguucugcuuuuauuugaaaauuacuuccagagacuucuacacaaguaagcaaguagaaccuccuugccccugucucaguaccggacccacaccgacaccacacugauauguucuucacuuaccaccgccucccucucguccauccucaccgaaacagcuuuaacuggguggaguauagcuuguacuugguuuggggcugaguuuucaccgguugguagucuguuuguguccugcuuaugaggaggccugcagugaucaccacugugucuuuuuaaggaaaccucaaauaacagaguacuaaacaaguuccucacuuguccaaggaagggagugggaguuuggaaguguauugcugucuaucagaaaugaagucacagaacacuagaguuaaaauaaaugauagugucauuuagucuucuuucuucaauuauucaucauaaaacugaggcccagaagaugaaauauccccaagcugauacuguaaaucaaagggaaaauuacugucuuugaggaaauuuagcccgcacucaguuuuuauagagcacaucugugaaauuuuuagcauaaaauccucaaucacugaaaagaauuuugccucuccucuccguuauuucauacucacguacauuaucucuccucuauuuaggggaacaaagccucuccgguguggaaaaugcauugugcagcccccagagcauagcagcucucucagacucugaugaggacgcuccucugaaucuuaggaaccuccaguccacgaaaaaugagaaagauaaacuuuaaacgugcuauuggagcacuguagcgucugaaauguacagagaacucugucugcagauagaugacggggcuuugcagagggggguuuuuaagcggcuucucugaaagcuugagcaugguggugaugucugugccuuugcauaggacuguccuuugcacaugcacuugaaauaccgagcacuuuaagucaucuuaguaaugacgugcagaaaaaugagaaaugguugaaauuuuuuacaaaacauuucaacucugcuucuaauacuacaaaauuuaaaguugucucagcaguauauaacuaugccugccaaaaucaauaauuuuuuaauuaguuuuuuucuuaugaauuuacuuacaguucucugcugauaccuaaauauggucccccagcagugacuucucacaaauuucuguuccuaucucuggcuauauucuuaauacuuuuagugugauguacucugugaagcugaguuucacauguguaaauuugaauuuaccuuuucucuacucucugucuuuuucccagucucauguuuaaacuuuagggccaagauguguucaucaugauauguucccggaccuauuuucgucugucuuauuucauaugucuucccuuucuuccuuuacuuuuaauucauucacucaguuucccuuagcugcuaugucaucuugacuuucugguaguuuaugagaugcaaaagucuuugagagaacuccuacugcacugugagaccucuguugugagucacagagcagggucgacgacccaaggcauugauuagauacuggggaauugaacugggggcgggggguggcauuucgaacaagauucuuacuaaaaucccuguuucauucauauuagcuuaaaagugggaaggggaauagaaagugugugugugugugugugugugugugugugcgcgcacauuauaugcauuaaaagauuauauacauauacauaugcauacacacacacacauauauauauauaacacagcauaucuccuaaagguagaacugaugcagaguuagaaguagaagcccgggcccucccuucccacagugucaaaaugcuaugcuuacaaauagcaaaauguacaucuuguuuucauauguagaugcuuaggacuugauaggaauuacuauaaauccaugcagguagccauuucaaaggucuggacuacuacagggcuuucaucaguaaucugccagguaaauucugauucuggcuaaacaaaacaauaugacuuuuuuuuaauucucagauagguuuacauuuuggacuuuuacuauguaagcuugcucucuccuggauauggugauaaacuagucucaucuuagcacuuaaaggcugaagcuggggcucacaaguccaaggucaaucugagcagcauggcaguugcauauuacaaaguagagaagaggcugagggaaugccccguccauaaugugacaguugugcaggcauaaggaccugaacucaauccccaggaugaagugaaaaagccaggcauggucggugcccagcucugccagccuuguacacucaaccaucuccagagcaaugacagaaacuguuucaaaagacaaggugaacggcucucaaggagugaccucuguccuaaacacacacaugcacacacaccugcaagcacacaugagcccacauacacauguacacccauauauucauguaccccaaagcucauauacacaaaguaagaaaggagaaaaaagauaaaguuuuaauuguugagaauucaaaucaaaaaguacuaaauaaauaauucuuugcucacaagcucauguaauauuaaacacucaaauucuugugauaaaaccugaguuauauguaguuaaucuaaaucccucugcaucaccuguaacaaaggccgugagcuagaggcucccaucauaggaggaaagcaguauggcagugaggcagacaguauguggaagaggcucuguuuuccucuuagaacagaguuuauaauaaauaaacugcuuaggaaacuaaaaaaaaauacuaagauauguauuucauaauaauuuuacuguucucaguguaauuuguccuaauagcuucauuuuuaguuaaucuacagagguacuugcauauaucauauuaaaaucccuuuuuuacauacauucagagaaggcuggaaaguuaugcuuugucugugauuccucuccugcucuuaaaauuugaucaagcaugguggugcaugccuguagucccagcacucaagaggcagaggcaaguggaucuccaugaguucaaggccagccuggucuacagaaugaguucaguauauccagggcacagagaaaccuugucacaaacaaacaaaacaaagaauuauggagcagggaaagcugucucuaccccacaagggcagcagaacuuggagaaggcccugcaccucgccaggcaguggugacccaaguggcauggguacuggaguccuggccccauguaacuuaugagugugggagagcuagaaggcugaucaacucagauaccacccaggcccagacucagggccaugaauugggccaccccagcaucuaccccaucugugaacugauagggagcaugaaggggcucaucccugagaaccaaagcugcaggaucuccaugacccggggcaacagcaggcuagcugaggagaauccuccugaggagccaguacggauggauagugucagagaacagaggucuuguacugaggauccaguauggauggauagugucagagagcagaggucuuguacugaggauccaguauggauggauagugucagagagcagaggucuuguacugaggauacaguaugaauaaauagugucacagagaccagaggccuuguacugaggauccaguauagauggauagugucagagagaccagaggccuuguacugaggauacaguaugaauaaauagugucagagagaccagaggccuuguacugaggauacaguaugaauaaauagugucagagagaccagaggccuuguacuaaggauccaguauggauggauagugucagagagcagaggucuuguacugaggauacaguaugaauaaauagugucagagagaccagaggccuuguacugaggauccaguacagauggauagugucagagagaccagaggccuuguacugaggauccaguauggauggauggugucacagagaccagaggccuuguacugaggauccaguauggauggaugguguccgagagaccagaggccuuguacugaggauccaguauggauggauggugucagagagaccagaggccuuguacugaggauccaguauggauggauagugucagagagaccagaggccuuguacugaggauccaguauggauggauggugucagagagaccagaggccuuguacugaggauccaguauggauggauggugucacagagaccagaggccuuguacugaggauccaguauggauggauggugucagagagaccagaggccuuguacugaggauccaguauggauggauggugucagagagaccagaggccuuguacugaggauccaguauggauggauagugucacagagaccagaggccuuguacugaggauccaguauggauggauagugucagagagaccagaggccuuauacugaggauccaguauagauggauagugucacagagaccagaggccuuguacugaggauccaguauggauggauagugucacagagaccagaagccuugaagcagacagugacucauugcaaugagcauuugcaaguagagcuguucgggaaaaggguauauggugagaugcauagcuuucacagucagaguuugguuuguuugcuuuguuuguuuuguuuuguuuuauuuugggggagguugcaagagcagaggguggauauggggagacaggaagaugaguaggauuggggccaaugaugugaaauucacaagaaucaauaaaaagaguuuuuuuaaaaaccugugcagcaauguucuucccuaaaaccuccucccguacacauuuggauagaacagagcucagggagcucuuucuucagagagaacacuccuauaaggcacucuuucuuaucagccaaggaauguccuucacucagaugacacuucaguucagaaugccacauucaucaccaagugacugcaggcagaacuaggccaaucaaagcucuuuauuucaucuccaaagauauguagagcuucauauggagacagugggaaauaccuacaagacugcagucuaacaaaagagcauaggcagacucugauuuuaaagcuuuucaaucuuuuaauuucaaaauauuuaaguagcuuuaauucuuaauauuaaaaauuaaacucauaaaacuuagucauguccauuucuguucaaauguuaacaaaguaaauggauaaguguuuuaccacuaaagauuuuaggacacagucagagaaaccccagagaugaaagcugacaucagauuccaguugaacacauuuuugguuuuguuuucagaauaaauuugucuggugaaugauuucuaugguuuauuucuuuuccuagaaauacuaagcugcagauccagaguagaauuacagaaugaaacucagaaaaugagagaacaguuaggcucaauuuugauagugacuaagcauauaaauacuuucuccuugauugccuuacugucaaucaaggaaauguuaagagcucuuuguggguuucuuuguuuguuuguuguuguacugggacuagggccucaugcguacagggcagacacuuuucuacugagcuacauuuccaaccuuugaaagcucuuaaauucucaaguuacauaacagaagguuucaaaaucaauaguacuaaaucagaaggcucaguuagcuuuugcuggguugaauuuuucgcauugcuuacugaggagcuauguggggcggugggggggggggggggcggaaauacuucucucuuaauaaauaacacugagaaugacugcuaauauccuuggucucaauuagccacacaccacauaacagguaaaaaaaaugaaaccuaguuugauggucuggggucuguugaguaaggaguacagcuauacaauaauuucccaaauugagcuagagucaucuucuccuuggacuauacugaagauauaaguugccuauaguuugucucuauaaaauuuucaauauuuuuguuccuuguaccuuuuucuuuuucagucaagagaauccaucccuuuaagugaccugaaaucagaaguaucaccccggauuucagcagaggaccugaucgauuugugugagcucacagugacaggccacuucaaaacccccaccaagaaaaccaaguccaguaaaccaaagcuccuggugguggacauccgaaacagugaggaguauccuuggcugugguuugaaaggguggcagggcccuacuccugugucuuccuuuccuuccugugucaguguguggugaaagcaaagaacauuucugggaugccuuugaacuugaauagugaaguaacccugaaacugcaugcaaaaugaccuugcacauuaagaaucaaaucaaaguuauaaaaauguuuuccaaacucuacccagacauugcaggagcgggguugugcaugugcaugcacguguguguguguguguguguguguguguguguguguguguguguguguguuugugcgugugcauauguugcagaccaaagccagagcucggacugacugugcuacaaagcucucuacugcugaguucugucuguaacccucauaccuuuuuaaauauuuacuuaguuucauuuugugcauaugagcauauacccaaaagucuauaaguggaacuggaguuauggacacuuguaaccuaccaaguaagguacagggaacugaaucuagucuacugaaagaguacccagugcucuuaacuuuggagccaucucuccagcccuauacuuuuucuuaacagagcaauuccuaaccagaacuuuucuuuaaaaaaaaaaaaguauaugaaauauaaaagaagacuuuaauaacuuuaaauuuucacauuuauaucuuguucuaaguauaacaacaauaaauuagggguagccaacugcuggaaucuuacaugccaaaaucugcauuucaugugcauauuuuagugucagguuuuuuuguuuuuuugguuuuuuuaaaugaaauucaaaccaugcuuucccagaauugcaaaagcagugugaaaaaucuuagguuacuuacaguacaauucaaaagcccacaguuucaaauauaacucaaauuuuauauuuguaguguugcuucguuuuguuuuuuuuugaaacagagucucacuauauagcccugagcagccugaagcgcacucuguagaucaggcuagccuugacuccagauaccugccugcuucugccuuuugagugcugggagggaauauauacaucaccacucagcucagaauccagucuuuucucaaaauguuccuuuuauuaucucuguaggauuacaggacccugaguuuagagaaaggaaagacauggugugccuggguuuaaggcucugaguuauagaaagcuccuuagggagugggcauguggauucuuagaggaggaauuccaguugacuagccagaaguucugaucuggugcuucaagaauuugaaaucacuuuacucuuuuuaacaucuuauuuuguauuuugcuugagccuuuaauuaaaaucauugucuccuaagccaucagaaaaaggcugggaacguggcuuaguccagugcuuaauacacgagcccggggaucugaguguggauccacagaggucagaugagaagcagcugagagucauggcgugugcccaugucugcaaucgcagcacuguaggcugcagagacccgaagggcccuggagcuuccuggucaggccauccaaccgaaucagugagccccgccugggucaccaaagacccuuucccaacaacaagguagagagugauagaagauacucaacaucaaccucugaccucuacaggugugcaugcgcgcgcgcgcacacacacacacacacacacacagaaacagacagacagacagacagacagacagacagacagacuuagcaaccugacuugaaauguucacuauccauaauugaacacuaaaggaaaagaguuaguacugcucuaugccacuugagagugggguuggcucaaggcaaugaggacaggaauaugcgaucacccuucuuucucaaccaucccaaaggacucaucuugugaauuacucucuuuuauaauauacuuaaucuugccaguuuugguggcacuucucaguguuuaagaucuauuauuacuaucaucaucauauuuacuacuacuacuauuauuauuauuagaauuauguauauuuggugaaugcagauacccacagaugucagagacauugggucuccucgagcuggaguugaacgcaguuagagcagcccagugugaugcugcaaaccacacucagaccuucugcaggaacaguguaggcucuuaacugcgaggccaucuuuuucccccuugugaauuauuuuaaauuccuuuuugaaagauugcuuuaaaacaaaaauuuugcuuuguuuuuauggaacagggcugcuggguagcuaaagcuggcacagaacccaugaucuucuuccuucugagccccucaaguacaagacuguaggcaugcaccaccaugucugucucuaagacauuuuaaagguaguucauuuaucaucacauuuauuuucugugcccucuuauuguauuacauacuucuuuucuaccuccaaauaccaaauguugacaccuucauuucacagugcuuugaaagaaauacaaguuaaacucuguucccagaaucacuggguaucaguaaguaucaugaauaccauggggagugcaaugguguccuaaaauacccugugguugagguguugaagcugccuggugccuuucaagcuagaaaacugguuuuuaaaaauaauccacauuguggacuacuucaucucauuauaaaacaacuaauauuuucuccuaacucuucaaauugaauccuacuuacaaguaaguaaaggcaagggggagucugcaguaauuaaagaugcacaaauucagugcuuagagccauguuagaauguuaauuguuaguugucaucauuaauaucagcuagaaacuguaauucucuaaggugcuguacauaacuuuuaaaaaaauauaauacaguuauuugauaggaauauaaaacaucaaaauauuuuauacugaaaacaaaggaauaggaaagacaguaagagcaaagauagaaacaagcaaagagcauugcccgcguuaucucaggguaagacaagacacucuaguauccuuauaauguguguagcccagccccaggcuucagaacauggccaggacauauuuauuaaaggagaagagagcaagauagcuguccacagcccuacugccuccccacccuccaaaguaaaaacauuuaagagacaguuggcagugugugagcccuguacguucuacaguugaucucaugcucuucuccauuuaagcccucaagcaagccuguacucagaagaaggcaggacaauaaggauuuuaaacuaaacacauuuccucauguaacagucuuucauucagcaauuauuuuauugucuuugugugccaaucaguauaccagauauaagagaacuauuuuuuuaaauaaaaaugacaaauucuuugcacuuauagcaauugcaauuuaauuggaaagauagaaaguuguuuuuacauagcaauuagagcuguuguaaguaaauagggccuguuagugauccuccugccucugcuucccaagggcugcaguuaaagggcuacaccaccagacccagccuagagggaacauucuaagcagaagaaagagcaaggccaaagaccuuagcauauuagcaugcuuggcaguuugaaccaucaaggagaccagcaaaauaagagauggagucaggaaauaaagagguacugacacugucagaaguaaguaaguuagaaaucuacacaaugugguuuaggauuuauuaacaugcccucacuuucccagguaauaccaguuccugaguccaucguuggacucaguuggcuugaggacuuaaaugcaugucuugcuuuagaauaagggaugcuaagaacaaguacauuucagugagcuaaguuuuaauaauagcugcaguuuacagguugcaccaccccaaguguagugcuaguccuaagauauugagucuucagcaacuuugguuggugaaaaaaauggagcuucaagaggcuaaagaaccguguaauguccaucuaauuggcagcugguagagcugaccucaagcugcuaagcuuuguuguguuugccaggucccuauuagacccugcauaggcuguuaaacauacaaaaccaagcugagccaguuaacacaaaucaaugaccaaaugucauguguuuugauucucaauguauguauucauugagaagcuauccacagcucuucuucacauucuacugcuacccucaguacccauauguacacacggccuggucagcagcagaaaaucucugccugcagagcucuuuaauaaguauugccaccaaaauuaagaaaaauuauuuuaauauuuuaacuauuuaauaacuauugaaauguaauaauguaguuugaaggaaaaggaguauuagaaaaguccuuucuuuuuaagacuuaauuaguaagauuuaauccaaucagacauugaauauuucuuaaagcuacuaaaauaguaguucuuuuguuuuaaaucuuaauuauauuauauguuuuuguuggggaagggcacaugccacagugugcaugagagaucagaggacaacuuguaaagcuggcuuucuucuuccaccauguggguccugggaauggaacuugggucaucugcuuggcagcaagcaugacuuacucauugagccauuucagcaacccagcagugauggcugcaaacuuacagcaaugggcuaggaucugauaaaaugucugaccuccuugguaccaggcacuuaugcaguauauaaauaaaaugaaagcaaacacauaaaauaaauaaaucuuaaagaauaaacaaaauguaaagcuauugaaauccuuauaggaccuaugaaguauuuugguaugauggauaacucaguuuacauggagguaaaacuuuacagugaauguaggucuaguauuacucuaccaagauacuuuuaaaauaauuccaucucuuccguaccacaaaacaggggaaaaagaacauucugugaguuccuucucuaaagaaaaguauuuuugaaauauugaugucucuccacaucuuguucugccuuaugcuucuguucugguuuggaagcaaggccucuugagugcaugcuagucucuaacuugcuguagaggggcagacgggaccagagcuaaaacugucucucccuccacagugcugggaccaccaggucugcuuucugcuuuguuuuauaaagccaauaaaaugaaaggcuaacauaagucuccuuggguaaaaucuuucuucauuuguguuuuagggauaaugaauuucuaaaauuacauuuuaaucucauuuuucuaaccuauauaaaauaauugaaaauugugaaaagaagguggaacucuuaaucuuuuuuguuuguuuucucucuuuuuuuuaauugcauauuuucuuuauuuauauuucaaauguuauccccuuucccauuuucccucccgcccggaaacacgccugcuucuaugaggguguuccucuacccacccacccacucacaccucucacccccauuccccuacacuggggcaucugucaagccuucauaggaccaaggaccuccccucccaugggugcaugacaaggccauccucugcaauguaugcagcuggagccauguguacuccuuuguugauggcuuagucccugggagcuuuggggggucugguugauugauauuguuguuccucuuacuguggcuuuacaaacccauccaacuccuucagucccuuuucuaacuccucuauuagggaacccacgcucagucaaaugguuggcugcuaacauccaccucuguauuuguaaggcucuggcaggagacagccauaucaggcuccuuucagcgugcacuucuuggcauccauccacaauagugucuggguuugguaacucuauaugggauggauccccaggugggacagucuuuggguggccuuuccuuuagcuuacacuuuaucuucauauugcuccugugaguauuuugcucuccuucuaagaaguaccaaagcacccacacuuuggcuuuccuucauauugagcuucauguggucugugaauuauauccugguuauuuggagcuuuugggcuaauauccacuuaacagugagugcauaccauguguguucuuuugcaauuggguuaucucagucaggaugauauuuucuaguucauuugccuaagaauuucacaaacucaucauuuuuaauagcugaguaguacuccauuuuguaaauguaccacauuuucuguauccauuccucuguugaaggaacuuugugccaauuuaaggaaugccuuugcagaccgcuuagggcagcugccugggauucuauggaugcugcagucauuuagcuauuguccauuuugguuacugguaaagaaaagugcacuauaaaaccagcaugaagugcccucugacugugucugaggacagcaaagccaaacaguagacugcagacaaagaaagcugaaggcugcagccagacugcaugcacugggcaguaaaacuccacccagacuagaaauaccuccuaaagcccucacagaggcaacagagaaggaaacagcaacacuuuugcugaaaucuuauuuuacuucucuuucuauuagaagcuugaaauucuucuagguaaagcuuucuuuaguguagcauggaaauuguggagaaaggcaauagaaacuauuucuguguagugccauaaacuuuaugaguaauguuaauggcuucaaagguaauacccagcccagcuguuguuugguagcuauaaauauuuggaguuucaaauuuccugaaguucguauuaaagguggccuuagucaugcaaauguggguccaacugauguuaucuguaaacaggaagacuuugaaggaauguuaaucucauuugcuucacauaaagacugaguuguacaacuuuauuucuaaugcucuugggggaaaaaggggaaaaaaggggaaggaaaagauggaccaaaaaagggaggaaagggaaaauaggcaaccagcugcaggcuuacacuuccuuuaaaaucaaccccacaguuuguguuaauaccccauccucauucuuaguggaugcuaauaccgugcuuucuacuauugcuuaagaauguguuucugccguuaugaucaaagugcugcagagaggauaccuguggucagaggaagcuggcucauaagcaggcucugcaagauuguguucguccuauguaaguuuguauccagucuaucuaaacuaagcauuccuucauuuggaguuucauaucggaauggaucuucuguaaugugggguguacaguaguuacugcagaggaauagcucuacuaguuggauuaauagguguuagcgucacauuagcaguugauaccauuugcuguuuuaguccuagaucacaaccauuugguccuguuuaaagacauuugcuaggcaacagggauacaaaguuaaaccagagcuauauagucauguagcuagaacagacuuuuaaauaaauuaucacaucuuacugugaugugagucacacccaauacgucucagaugguggcuacuuacaucacaaguagauuuggugagcagugcaaauauauaugcgagcauuugagaaugagaauacacuccauagaggaucagacccagagagguuaaggacacauugaagacauuacaauaaaaugagggggucaucacugaacuacaugaagguuagaaaugagauuagaguugacuuccugggagaauuucagguagaggaauagaagauucagcuuuguauuuugaggaaagcuaccagagggcuguacagaaaggccuagugcucccucccaaguaugaaagaaagaaagaaagaaagaaagaaagaaagaaagaaagaaagaaagaaagaaagaaagaaagaaagaaagaaagaaagaaaggaaggaaggaaggaaggaaggaaggaaggaaggaaggaaaggaaaggaaaggaaggaaggaaggaaggaaggaagaaaggaagaaagaaaggaaggaaggaagaaagaaaagaggaaauggguggugguggugguacugcugaugaugaugauaauagugaugauggugauggugauaaugaugguaguggugggcagaggcuagauggggguuaaugguacagguaaagcuggaaggauggggguuccucugauucacaguguauaaacaugacuuuuugcuugcuggcauacagagugaggucacgagcuuuuucuuaauaaaacagcuuugcugucacccuagguaaauacccaugcuggagaacaucuagagacgugagcuucgcucuucuuuucuacaaaugugcccagaggaaagggugcucaaugcauuggugcuagugagcacugcuauagcugggucccuggcuggagcggccagaggcccuuacaucuguacgcugacacugguuacucuaggcuuggcgcaguucugagauuaaguuccuuaguaaauaguauacuuugcuaugcaugcaugcuguauuaaacauuguaagggauucaaggaagaaguauguguccuuccuauaagcuguuuagaguuuugauggaaaucaugcucaguauguuuaguacaaggucaaauugcugucaugagccauacaccgaugucuacugugggaacagguagcuccugacuguaaccuuagcacucgggaagcaggcacgaggagcuagcaggugccgaggcccugucuaccuaaaugaaguguuuaggcagagaaaaguuacaggagccgagcagaggcagcugaaugacuccacauggaauggggguuauuagguccugguucaugaggcuguacugagcacgcugggccauggcagauuucucagcaggaacauggucaucuggccacuuuguuacuuguuuagauuuuuaacuuggaagaauggauuucuuggugggaaaaaauggaaauguuuuagaaagcuucuucagcaauacuaugagcucaagguaacuggugucuuggcggauuguuagaggagagcuaggaggaugacauucacggaaguggacacugcgucaguggaggccacuaaggaggugcuaaaagugagauguugaccuuggaugacagggcgcucaugaucccaguucauguaauaagagaguucuaagaaaagugauaacagcauuuuucauuucaguuaauacuacucaguuauagauggagaaaccacagcuuagcuauguuuucuuuuuggcuauugguauagauagguacagccuucaaaugagccuaaggagcucauuguuuacauuauuuaaauugguucgcaugggcugaagagaugauggcucagugguuaagagcacugauugcucuuccagagguucugauaucaauucccaucaaccacacaguaccuuacaaucaucuauaacaggaucugaugcccucuucuuggugucugaagacaacuacaguguacuuauauacauuuuaaaaauaaauaauucuaaacuagcuagcccagaaaacaggccagcacagagauaucuaggauuuuauaagcggugaaguugguauggucugaugaagaggcuuaguaccccugagugcagugccuaauaaaacacuguuaauaugagcacucauauauuuaccuauaugauauaauugcauaaugcaugggacuuguuuuuuccuauccuuuuuaacuacuuuuguauauuguuguauaggcaguguuagcuacccucauccuugcugugacccaauaccuaacacaaagcaacuuaaagggaagacagcugccugugggguggugcacucacuguagcacaucucugaaugugaaaaucacuuaccccauauuugugaguuagcugacaugcaguggaauucuuaaacuuaauaauuaaaugcagaaaguauagguauuugccuauauuaggaaagcagugcaucucauuauuuuccuaacuacauacagaaguauguauguucagcuccaagaccacagugcuaggagaaucccguacaaacucaucuuucacagcagaaaaaugcagugaaaccagaguaccuaaagcauuagagaguuuaucucagcacacuugacaacaacaaaacaaacaaaaaagcuuacauauaugugugcauauauuuacguguguauauguguacauauacacuuaaguauauucuuguauuuguaucuucacaaauacaaaauguguucaguauauugucagcuuauccagaaucagcuaggaaacaaagcuccagacagaucuguaagagauucguuucuaggcaugccuguaugacaucacauugagagggaaagaggcuaaaagugggugguaccauuucucgggcuuggguccugggcuacaugaaaaagaagacauuaucugagcacugagcaugggcguucacaucacuguuuccugaucuuggugcagugugacuugcugcuucaucgucuugcugccuugauuuuucugucaugguagauugaacuaggagguaaacacacccguucuuucuugugcugcuuuuuccccaguauauuuugccacagcaacaacaacaacaaaacaaccaaacaagaaacuaagauacucaguauuugugauuuugaaucuacaguuuuuacaaaacacauucagcuacaucccguuacaguaauaaugugaucaccucuacgguguccagaaguuccaauacaucuuacugccacccagauaaggauuuguguugugagcaaugaacauaauuaccgaggaccaaagguccguaaguaaccaaaacuguuuucuucccugucaaacauacuaagacaaaagagacugcuuguuguaauugcagugacuguaacuaggccuggcucuuucuccucugcuguuugccagaaacgcaguuauggguaggagauggggaggcuugacaguccuguguguccaaacaucugugcucacucagucucugccucuugacaguguucugggaaggguguccuuagaugguuuccaggaccguucuacaugaggaaacuguggucuaaggcccugcuccuuuguguuuuguuuccuaaagcaugaugggaagaacgacuugaaguauuuugggguuuggacagaacuuuccucuucuccaaaacucuuauuuucaucauauuuugucaagcauuuugacauuuaauccccauuuuaaaaaaucaaaccauaaagcauaacuaacagaaaauucugcaaauaacaaguuuauaacauacuuuuaaugacuaaaaggcaauauagacaagucuccuuuaaaaguauauacuaaauaucauguaaaaauuauuccuaugugucuuugauuuuagauaaugauguugaacauuuauaugcagaugaauuacuuuuaaaaccauauauucacagaauuuaacuuugagcaguuuuucuucuaaaguagaugauucuaguuuuuuuauauacgguauuguauuauucuauauagaggcauucaaaugugauuuuuauguucuaaacacaucuaaugagucuuuccucauuuuugagaaagaaaauaagauuaauccaaguuugccucaaguaccuagcucugcccuccacaccaucuucccugccagcuauagcaugaaguaguaggauuaucuaacacaaacaucauggccaaggggcacccugucccuagggcaugucugaggcuguucaaacaggaaggaaggaacaggugggcuguguggacaugccugccccugcgcuuagcuaggauagaucugcauugauuuugcugcuguaaaacugcuaagucagguggaucucaguccagaagugcuggcugagaaacacaagguccuacugcagcugcugcaggccugcugagaagaaaugagcggccggacuccugguuggcauuuuaaauaccacucuuaagauaucuacugaauauuuuuaaguauuuucaggauucuuauuuuuaaagaccccauuguuccugaagauuaccauugagacucuaggauaauuguuuuugagagacuaaugccacccgggcaguggugaugcacaccugaaguucaaggguccucgaccuguguuuauaaauagucuccccauucuacacuucucuaagcaaguccacugagauuccaacaugaauuguaucucacauuucuuuuaauauucauauuaaauguuuucuugugccugcuaccuucuagaaaggaggagcccggaucuguccacucuccuugagugaggagcggggaagccugcagccugagcucauugauaacuacuguuucaacauagaugguucccucccacacugagacaugcagaggggaaacaguacuugcucgggucauagccuuuuaaacuaucacuugucuuagucccuuaugugacaguuuaggggagggggcucuauugaauacagagauggccuuucaugguagucaacagugauuauuauuaagaaaggagcuauaacccaaauuucucauuaacuagguacacaguuuccuuugugcuuuuccccacagcagcacucaagugcaaauccaguauccugcuuuucugcuuagaauacauggguuuuccuuacuggcagaaaaaauaucguucucacaaacagcacaggcacaguccagccuccaccucccuuuaucucacacuuaaauuccacgguguuguccuuccccgccuuagcuggguauaugcucccuccgccccacugugacuacaaaaucuccgccucagcuccccaucccuccuccacuuccuuccacuucuuuguccuaacuucuaucuguucuucaggauuuaaccuuaccaucacccccucagcaaaccccgccccauccucucaaaccaauguaaucuacccaguagcucauaccucucuuuuacaguuuucuggguauaaccauguccuuuuaauuuccaaaguucuauuuuuaauuaauucauccgaucauacucuaauuacuuaguaaagagugugugugugugugugugugugugugugugugugugugugugugugagcuccugcuuaauggaugacuuuauuuccuaaacuaacagugauagucacuuugagcaucagaauucuaaaguauaagaagcauaagauauggcaccuucuggaggauaugaacucagaauaauggauaugucagcugaguuugcuggacacauuaaccugcaacagaacaguuuccagcuggggcuggugaccucuaacaguucuaaaugaagucugacuuagcaucuacuuugcaaauauuuuucaguaucaaauuugcccugagacaguggacuuugaacuaugcccgguugugcuggugaacaugauagcacacaggcuguagccaguugaggaccauggcuuaacugggucaggguugcuuucaguuuccacugaugaguacgucucuuccuuucucuguuccacuuuauucugaaauuuaauuuucuuccuccuuagagaaucucacuuuguucaaauaaaauacucaggugaacauggaaauuuuuuaaaaaacaguuuuccuuaagcucccugucagcuucguucgcgggcacauugcaggcagcaucaacaucccauucagcgcagcguucacggcagaaggagagcucagccaaggcccuuacaccaccaugcugcacaacuucaaggggaaagucauugugguuguaggccacguggcuaagcaaacagcugagguaaguguccccagagauguccucaacuguuccugccuacugucuagguugucgaaaauguguuucuucagagauaaguuucuuaucuuucuucauagauaagucuaacuguauggaucugucugcauucuuaccaagaggagcaggccucuuauggaagccuucuuccccccacacacaguccaguuuucagcaucaggaugaauaguaggaagcuuaggaaaccccaauaguagcuucugauguuguuugucaaaagucugcauguuaagaccuuaguuguaaguuggguaauacuaaaaggucggacuuaagagugggcccuagugggaaguccuguggucaguggaggucugucuauguaagugccugugggaccgagugugaacaccagugggacuucuacaguacuaccauccacagugggcacugacuguaggccuuugggcucccugccuuugcaacuaugagcuaauuacaccuccuuucuuuauaaaguuagcugccuccauuaccaacauuauuauguuauaugaaacauaaauuaauaugauggcauagguuuucaggguuuuugguuuuuguuuuuuuuuuuuuucuaacugguuuuuugacauuucaaaagcacagagagaacuucugugagagcagcaaggcugagcgcaggcucugaagcugcccugguggggccuguugggcuugggagacuucuuuacccagaaacucaagggccaaguguccgucagaucaugaaacaagaguugagcagauugagagaggaacugcugaguaauucuaagcaaacugacaaauaaaaaguacaugugaugaccaaaacugccaccaugaggggagggggggagagagggagggagggagggagggagagagagagagagagagagagagagagagagagagagagagagaauaugaaugagaauggagccugcugugauugguaaggcaggccuuuaauucaaacacuugugagucagagacaaguggaucucuuugaggucaaggacagccuggucuaaacagcaagugccagggcuauguagagagucccugccucaaaagaaagagaaaaagaaagaaaggaaagacaagacaagacaucagagacagcucuugcuuucuugcucuaacucuguccucuuuucccuuuacucucucucuccauuuccccccccccgccccccccucucuccaugugcuuauagccggccucugcuugcuugcucgguuucuuucucccucucccucucccucucccucucucucucccuuucucuacuacccucucaauuuccccuccccauguccugaauaaacucuauucuauacuuuaaaaaaaaaaaagacaucagagacuacagcauacaaaagccaagcagagcaggguugcagaugacaucuucagagucaguagagaacguagcuguugcgcugaugcagagccugacccauccaagccuuuccagaagguguaaaagaauuuuccccaggaaaguagcaguuacuaggggaagacaggcugagcugucccagcuuuaccagucaaacaaaccccauggugcuagggcagaaugaauaaggagaccaaggaaaagucaaggaagagcaauauuuguuggaaaaucaggaguggaguuaaaaguauucccauucaauuuccuuuaugucucuauuaaagggacaaacuuuaaauauguuggguuuuuguuuguuuuuuaaugugggcaacaugagaaugugaagaauuuuagacauagucuuuaaguauccaaaacuuggugggcaagauggcucaguggguaaagguacuuucuccaagucugacaaggugagucuagucucugagaucuacauggugagcaaaggacugccacagguuguucucugacuuccguguguguguguguguguguguguguguguguguguguguguguguguguguggaauguguguaugccuuuucagcauugucuugucugaacugagauaggaaggccccuccacuucguggugccacaccuagauuauguaaguggacaaaggaagcugagcaucuuguauuaacagccgcuuccagcuccugucaccuugacaugauaggcuauauaccuuugcauugugagucaaauaaaaucccuucuucguugcuuuugucaaguuuuuuaaaucauagcgaaagcacagaacuggaugcucacagucaucuauuggauggaucacagggcccccaauggaggagcuagagaaaguaaucaaggagcuaaagggaucugcaacccuauagguggaacaacaauaugaacuaaccaguaccccccggagcucaugucucuagcugcauauguagcagacgauggccuagucagccaucacugggaagagaggccccuuuguauugcaaacuuuaucugccucaguacaggggaaugccagggccaagaagcaggaguggguggguaggggagcagggcggagggaggguuuagcgaacuuuugggauaauauuugaaauguaaaugaaaauaucuaauaaauaaauaaauaaauaaauaaauaaauaaaaucauagugaaagcaaaaguagcuaagacaagguagaauuauucuacccaucucaaaugagagaaauuuggauucaguuuaccuaaugugccuacccagagccccacucacaauaccucuuaucacucugaagugcugccuuuagcucagcuccagaggcuugugagucugaaugcugccaugugcccaggcuuuaaaacuagcuuauucugacuuugugcacagcauagcaguucaucccagugcacgaaaccaaaaccuuaaguacacuuuaccagauuauggucccauuuucauuaaguagucaccaccauuaaacaguuucuaauagguuuaaaaaaacucuuuaaacugccaacuccuuccaaacauccuaaucauauuaaucugugucauuuaucuaauuuugccauaagguaaaacauaucugucaauacauagauuauuucuauuaagacaucaauaaucuguuauguacaaaccaauaaaucuaaguucaaaauaugaaggaaauacagaaaaaugcauacucacauguaguauaggaucgguaacuaaugaaucaucuuauucuaaauuagcaucauguuuauuagaagucauguccuaguaauuuccuuuuaaaucccuuuugcuguaucauuauagacaauaaagauuaaacaaauuauaugcacagcuacuaaugccucaguccaguaaccaguaacuuauuugugauaguuuuaaauugggauaauaauaaauaauaauaaauuauaaauaauaauaaaauaauaauuuauucuaauuggaucuaucuuuaaugauguuucccagcaaaggucaaagacaacuucagacacuuauuuguacuguuuuguauuuuccucugcuacccagaccugcacagcaguauaggugcuucccucauagccacugaauuaaaugcaugucauuuugaagcauugaaauuccagugcgugucuguguuugcgcugaauaucuucuccucacucuacugcccauugcagauccauucucugcccuucuucacacuucuuucuagcccacaaagaaaaugccuguggcuucuaaauccuaguuguuuauccagugagaggcucugagaaguuauggguuaaagagcaugaagccuucucuccuggaaggcuucuugccaugaaucucuuaugagccccuggguucuuugucuccaggaaugguaaauuuucuucugccagccuugguuagcacugccaaugauauuuccccuauacacccucccccauuccucuguaauucucucuaccucagauuaugcugaggucaugcuagaacccaagcugucauaggacacuauuuaaaauaugugaauuuguaagccuagcuuugauguuaugcugacuuucuuacuggcuguguuaauuuggauaaguauuuaccucuucaagucaccauuguuaauuacaaaaugaauaaaacaguuucaacuucagcauuaauguaaagguuuuuaacaagauauguaaaguucucgaggaaccuaauaauagugcucacuacauuuauacaugaguuuuguagaagaucugaaguuugaguuuaggagcauagcaacaaaacaaguaguaacuagcccagcccugcccagcuucagagcucagacaaugcacugugcucagcuguagacugauaaggcaaccauucccccacagaucagucuaaagaaacaagcacggucauuggaugauaaaggagucaacuaaagacagaaugacaaucuuauguguguauguaugguccucaauaccagaguacaaaacaauguaaagaaauaaacaguggaauuaaauuauacccuagaccaaguggacuuaagauuucugcagaacaauucaucaaacagcugaccaauauacauuccucuuaacccgacauagaacauucuccaacauagaguauguaguaagcaacaaauuauucucaacaaaauuuuuaaaacuggaauaucacauauuuuuguuagcaguucaaaaaaauaaaaaucaauacuagaaaaaaguuuuauaaaccacaaaugccugugaguuaacuuauuuuugaauaaccaauggauuaaugauguuaagaaaguuuuaaauuugugaaauaaaugaacguggaaauacaauauaccaaagcauauaggacuaaguguacuucacugaauugaugcaagaaugauugaguguaugcaaaucaacaaauaugacaagagcacacaacggccgaaccauaugaucaccucacugccacugcaaagggagcauuugacaacaggcagcauucuuauguguaauagagcugcuaagcaaaccagguauaaagauaagaaagacuauaaggaggcagcuagcagcauauugagcaguacacaucugaagacuacguugcccacauuuauucaaccuuauguuggaagugucaaaaucacaaaagaaagaagccaaauuauuacugcuugacauugacgugauuuguacagagaacacccaggcuauaaaagaaaguacgacaacuauugaaaucaucaguuacagacacaaaaucaguaguaaugcuguuugucaauagcaaauaauaugaaauagaaaucaagcaugcaaucuauuauagccaaagaaauuaaaucagggcuggggagauacuccaguugguaauugcugcuaaagccugagggccugaguucaaucccccacagaucagaugggaaggaagcuggauacagugguguucucuacgcccagcucuggugauuccgaggugggagagucucugcuucuggcuuaccagacauucuagcuaaauuaguucuccagguucagagaaagaccaugucucaaaagauaagucagaggugucugagaaagaaacccucugucaaaucugcccuccauacacauauucacacaugugcacaucaaaaaacaugaaaucaauaugccaaggaaacacaccccuguucguuaugaucaauagaaacugccucaauguccaccagcugaugaauggguaaaccauaugugcuaaauaccuacaguagauuuagccacaagaacaaugaaauccugccauugcugacagugugguuaaacuggaguuuauuauguuaggugugaugugcuaggcauagaaugccaaauauuguaaucgcccucagauuggaaucuuaaaaaccuuggacugugugaaguagaauguauaauagugguugccagaaguugaagugaacauaccgacaguuacacaucaaggugaagugugcugugaauguagauagcauuccaaacacuagaagaaacgauuugaagauuuuuuuaucauaaagagauaauaaauguguaaugaaauagauauuauaaucagaucuaaacacuacacaaucuuuacaaauguuuacaaauguugaaacacuguucauuaauauauucaugcuuuguuuuuauauauggauuaaaacucauuuaaaauauuuacuuuggaaaacaaugacaaggaauuaaugauuugagaaauggugaaaacugcacauugcaacuacaaaguacugcugaaaugaaugauggucugaguaaguagaaggaugucuaguguucauggacuggaagaucuaguauuguuuugacaaaaaggcuaggacaaugaugucaugauucuuauggcauguuuuguagaaguaggaaaaaaagcauccuauaauucauaugaaauguuuaaauaccaaaauagccaaaagcaaucuagaaacaucagagucagaagaugcacauuuccuaguuucagaacauccuggcagccuucagaaaucagagcagugugaagcggacccuccauacagaaggaacauaggucacugaacugaauuuaacaaguagcacaauaguuuuuaaauacuccaaggaagaauaagagagccacaagcauggaauauggcagcaucaaaacuacccaucugacauacaaacuaggacucaugucuuguaauauaaauauggaaguauagauauuacuauaacugguuuucaaucuguggguuacaauagugguuugacaaaccuauuuuuccaaaaguauuuguauuacuauuuauaagaguagcaaaauuauagccaugaaguaucagugaaaaaaauuuuaugguuggggucaucacgauacaagaagcucuauuacagcgucacagcauuaggaagguugagaaccacugcuaagugauaaucaaauguauucaguaaagacugcaucuauauuggucaaaauuauaagauuaggaagaucugucuaccaauaggguuaaggucuacugagguauaauauuauauuuaaaaugaaauucacagggaagucucacuuuugugucacugaaaugauaauauuuuccaaaauucacaagaaaaacuauuuucuuuuuuuuuuuuuuauuagguauuuagcucauuuacauuuccaaugcuauaccaaaagucccccuuacccacccacccccacuccccuacccucccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaauuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuagugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguacuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaagucuuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggagcaagauggcgaccgcugcugcuguggcuuaggccgccuccccagccgggcgggcaccuguccuccgguccggaugguggcuggcuguccccggcccacaaagggugcugccucagcgccucugugcuucugccuguuccagaagcugucagguucucuggcgcacccucucaccuguucagacuaauuuccuaaguucggcgggucucggaccaagauggcgaccgcugcucgauaucaacuuucuuccgaaaaacuauuuucaauugauaaacagcagucccaauucccuggacauaaagaaagccugauucguguacacacacacaaacacaugugcacacacauaaacacgcauauacucacaaagacacacacacacaauaaaaagugaaauaaaauuuuauuuguuuuagaaagcauaaagauaucuccugcaaagcucaaaguguugaauuagucccagauuaguguaaucugauacagagccuacuuaacacagucugccaccuguguuaugcugugacugaccaaauauuuuaaaagaaaggaauuacauuacuuuagacaccaaccaaauacuucuaaaaggaagucuguuuucaguacccacaacaaccguucacucacuaguccacucucaacuaaagucucauagaucucuugacaggcccuguagugaauccaucucuccuagaggaaacuguggcuagugaagcuuccaggagccgugcugggagauggaacucuagagacaguagugagucucaggcuggauagcuggccagaagauuaaaucucaaugaggauucuauccaacuuaauauauccuuaugaaaauguggaaacauaggaaaaauaagaaaaaauaucacuguuuagccaugagcaaaauuauccuacuugaagaagaugucugaacacaguccaaggauggagucaugugagaauuuuaaaugcuugugagaaaacuccaagaaaacaagacagagucuugugaccucaguuacuucagaacacagugaauuguccuuggagggucuuuccgugcuccucacgguauagcagaaaggagugaguuuacuucagcgauuacacauaugcuucuaugggaaaauguuugcuaugugcaacgugucuuugcaguuguacacuuuacucaugugacucuucuuuacccucagaguaaauugucugaugcucugaauaaaguugguuauuguauaagacuuuagucuaccccauucuuaggccucugaucuccaaggcucacgcuggcuucuaaaguaguacacagggaaaaccagaugauuguacuccauccauuauaacaaaauauugaguagaagggcuuuaaaaauaaagaguuuucaccaggugguaggggcucaugccuuaaucaaaggacuugggaggcagaagcaaacagauuuuuuugugaguuugaggccagccuggucuacacagaacagccagggugauacagacagaaacacacacacacacacacacacacacacacacacacggagagagagagaaagagagagagagagagagagauugaaauugauuuacuuucucaguucugguuuggcucgccaaauuaaacaguucccaagagucuguggauucagugucuaguggggaccugcuuacuggcucauagauagccaucuuuucacuaugucuucccauggcaaagagguaaggaaacucuccagagacuguuuuauaagggcaccaaggcuagggauauaacuuaguggcagaccccuugccaaguguggaugaggcccuguguucaaugucuaggaugggguugggggaggugaaggauggguggguaugugagcagacagaccguucauuuauaaggguucuacccucagacuccuaucaccuacccuaagccuguccucauaauguuaucacuauggcuaucgaaaugugaauuuaauaagaacaauagaggcccaggccauugcacucuucucuuauuaguacugucuuccuccuuugcacaaacucuuccuacuagucuugaggacauuuugcuacuacaccugcgugcucaaaagaauaaaugauuccuaaaacacuuaaagccaauugagcauacagauugucucuauagaaaccacugcaauucaagauaauagcuacuuaauucuucaaauucauauauuuuaucguaauuucuaugcggucuuuuauauuuuuagaaacuggaguacaugucuuuaucauugcuuucaacccuguagauagagaaugggcagcauccuuuguuggcugcaggugcuuccuugccacuuugucagccuguuugcccuuacuguggccagccuuggacuccuccugucuccccaugcuguuccugccacggaacauuucagucuguggguuuguaucauaugagaaggaagguuuuaauacugcagcuuggacacuguaguguugaacaccgcguaaacguuaaccuaacagugaaaacucuucucuggcugacugaguggugaacagugcucacuuugauagaccuaugaacugaaaaccgcccuguccuauucaggagccacuuauccucagagcuuuuccauccucaaagcccuaucgaguaacacgucaucaccuccuuauaggaaugcaguagaggagaccagggcccaccagucgagaguucaaccauuuacuuaccauguuuacuagaagcauucucuuuaagguauggucagcucuagagccagcucauaucuguuuuccauaacaaaugucaacccauccucugggcacuuccuugcuugcccggcuaagaagaaaaguuaucuugucccaguauguuauucuaccugcccgcccugccucgcaccacguaauuacuccuccccacagggaugugugcggcucaacaagcacaggggcccucucgccugaccugcggagguuggaauuuggcugugcuccaucacagcccuaaauguuuugaaucugaguuuuuaccauacacauucuaugcauaguccacaccaugcgauagggccagggcuggcacacaguguggguuuaccguugucaguugucuaguauaaacaaaagaugaaaaaugauuauugcugaaauucacuucccaaauauacagaucaaagggaaauagaccagaagacuccuugggccuccugacacacaguguuauuagaugauggaauuuuaucagaaaugcuauucucuaacacgagccagugugcauuuucuuagauauaagaacuauuucaaauaacucggcuaucauauuugcuuuuuaaauuuuugcucuacagagaacacuggugggacuuaaauuuuuaagaugugguauuuaauuuaauguaauauuuaguauacaaaaauguuuacauguaugcucucucugagagaacuacaguuauccuaugauuggcaaaaggguauuuaugaccuaguaaguacuaaggcucacuggcuaugggccuagaucaugggugcauccaggugucuaccaaguacaggcuucuaucucauuugucugcuucuuaaaucugaauuguauauguuguaaauguaaauucuucuaucuagaaaguaaauaaggaaagggaagagaaaagaaacuauuugguuccagaauuucuauagaccagagcaaugaaagcaaucuugaaaaagaggcuuguuaacauuauauggggauuagacuguaagaggcggggcagaagcagaaaagacaguggcgaguuaaauggcuauaaucuaagacagauugguguguguguguguguguguguguguguguguguguguguguguggagggugcugucuuuauuuuuaaagauaaccuguguguagcccaagcuggccucaaacuuguaauagucuccagcuguacccuccagggaugaccuuccaaaccuggccauugaaguuuucaaguguaauaagacuacuggcauucuauauauuauuauaagucuuuuuauuuuuaaauaguuuauguguuaaauauuacacuguccagaauuugcaucaaagagauaaaagugggacaauauuauaugggcacaauaaugaaauaaauucaguguaaguuaugauuauuaagccgagcuguggauuaaugaauuuugccacucuggucuguucuuacauguuuaacaugagaaaugagaagaaaugaagucaaaguagcaacuauagaaaaaagaaaguuaaaauacagaaauauuuagauuuaauucauuauaguuagucauguaacucucuauguaauucaacauguuaaaaacuauuuaagacagacuccuaguacuaucagauuuuucugaucccaaaaguaauuguuaaaagccagaaacaaugccuaaaaguuuguuguaccccuaauguauaccauauuaaggauuuugaaucucauagacacuauuagaauaguugucuauaaaacuguguaauaaauuuucuuauaaacuuucaccuuuuuaaaugaagaauuauaauuuucuguuaacugugguuucagcauccuugccaaaauuccuguugaaaaucacuuguuauuaacauuaugacauguagaaccuuuaagguuacacccagcauauggggauuagaccauaagggguggggucaaagcaggaaagacaguggagagucaaauggcuguaaucuaagacagauugguauguuuguggaggugcucaucaugagaaagugcacuaguguuggguuggauaucaugacagaaggcuccugagagaagggagguuggaccuucugccguguuaagaugcacgagagguucucaccugauguagaacuuccccuauuccucaguauugaacugacuacugaacuuccccuguuccagaacuguuuaaaaguaaucuuaucacaaaguaccucagcugugauacugugucauagcagcaggagggccacuccuggggucccugcuauguccugugccuuucacagaugucuaugucagcguaugaugugacuaccaggccauagccucccgguccuggcuuuguagccgcugcuuucagcucugagugacuuucuuucuucuuuuuuuuuuuuaaguuuuauuuauuuauuuuauguaugugaguacacugucucugucuucagacacaccagaagagggcaucagaucucauuaaggaugggugugagccaccaugugguugcugggauuugaacucaggaccuucagaagagcagucagugcucuuaacugcugagccaucucuccagcccucugaguaacuuucaaaggaagaaaaaguagccacuucuuaguugucacuauguaucauuucugagaaaacucacuucacauuuuauaacguacaauugaacuucaguaaguauacaaaaaaaaaagaauacaaaaauaacagggagagaauauuuaccucaguuacaggaagaacguaggaaagauuugacugaagaauggcguucagaauuacauuggccauguggugaugggaagaagucagugccguauuugaugugucauuccacugucuugcucugacccuuaucagaucucauaugcuucucauuguuguucauaagauguccagaucuacugaccaagacuuucaggaacugucccagaaauggcuucaaugauccaggcaagacagcauggugcuagucagaauugcugcugcugugaugaagacuugagagaaagggugaauuccauagcugugcucauagaugcaggaguggguccaucauggaagggcauuggcugaacagagccacucagcacagagcccagggagcagagagaaggaaugucaguguugccuuuuacuccuggacccucagucugugguacugcuggccacuuucagggcagguccacacuccucagucaucuacggaaguacccucguggacacaagcagaaauguguuuaaucgaagugauucucaggcucaucaggcucauaggcaggacucaugaccacagcaugcugcuauaaauuaucucuagccaauaccacaacugacccagagaaaucuuuuccucaucucagacuugcaugacuuaggaucuugacaaauucuucaaaauugcuuaaacaauucgcaugcauuuccaauguaccaugaccucauauugcaauacugaaugugugccauauuuucagcauuucagagugccaggaggacucauacgacuaacacagcuucagccuccagucaaaugcguacauaacccagcucuucugagcucaguaccauguccauccagaaguagcauuguuggggaagucagcaugggucaggucaaguggauaagacaaggcuucucugguuuugagcaguguguuaauuggccugucuccaguaugaacuuggaacucauaaagccaaagguuaaaucaggcagcguaguuguccugcugugguggugugaaugagcauggcccccaucuuuuccucgccuaaaucuugcugagccugggcuuucuguuugcuugcucugcucauucgcuugccauucagcucucugcaggaagugggaauucaguccuucucuugcgccuuaucuguccucagcucagcaugccuggccuuaguuaaccucaaguacucuggcuacucaaaacguucauuucacucauuuuccugcucauagaacuugauuuccuuuggacaaacaugccuaucucuuaguccaagcuaagaugcaagauaaaaaaggaaaacaaaauagaauggcaccuacaaaagccugcuuugugcacacaguaugguuugaggugugcuuacccaagcuguagaagugcauaccaguacccgggaguacccacaagaguuaggcuaaaaacacaagaccuucauccaugcagucuaaacuucucuaaaccuucucccagcaugucuagaucugucuugcauaacagaccuuggcuguacagccccauucuuccaucuaggacuguacucuaaguauuggagcuuugggucccagacuaaccaaccuuaauggaucccauuauucaguacugguuucucaauacuggcugucauuggcauuagcuaggguaggcucuaagcaaacaacugcuguugaaguucagccucagaaacuuauuauuagucuggcauggaccuagauacugcuacuuacuaacagcacccagacaguugggcuguuguuauccccagcccacuggagaacccugaacuuccaucaaggguacuucucaauauguccagcuguguuguucuccugugaaguguacaaucuccagacuucaccuccggugcccagucccuccagcauuugcugaugcugcugaaggucugcccauagaagagggaagaauagaaacauuugccuacuugugugguuuuucugucucauuacagaucccgguggggguuugacuuuguaucaaacugagagccaaacccagcagcuucaaagcccuuucuuuucucucuuaccucaagcaaucaccaaaauauugugucaucgguguagcaauuuucaccaucaaauuugaauuccuacucacuucaggagucaguaaugaaagagugauggaguaugaagggggaugagacagcuuccccaacaccuguuaaauccagaaacucuuaagcgcccuaaacaacugcucuuauaaucccauacugcauuccauucauuguuuccuuaccauuuccuccauucauaagcaccccaaaccuagaacaguguagaguauugacuagaugcucagggaaacgcaugacuaguagaugagcaaguaaaugagcagauggaaaagaaggcuggaguuggaaaagauggaggaauaucacuaugguucugcuacaggaccaguauuaagcaugaaugauuggaaccacaaagauucagagcagaacucccaaccucacauggaaauccaacagcugcuuuuuugucccccuucuacugaaauucagcuugcauccugucacggcaauccgaacugcucugucuccuggugcuccaccauucugcuugccuuuucagaccuguuugagaucgccccucugccucuuuugccaucccagugucucagcuuuacagcaaccccguguucuucaucuacaauagacgucuuuccagcuugacagcauucguuaagagauuagucaagggugcagugguccuucucuacucauuuucuuacuuccagaguguucuuaagugcugaaagcugagggcuuacccacaaggcccuuuugguaaugcuauguuaucuaggauuuccaaguuccaugguaauuguacagcugcgugugggaaaugcagcugugucaguaaucauacgguaagaggcaaugcugccugugcauucagguggaugaaucugcugccacuggucuugaggaccaagcuccaaagacuagugagccagcagggcagggagaugccugccagcuuccaacgugcaguagcacaauuucuccagcacugcuuaggacugaagauccccaucuggauuugaacuguaaauggccacuugacucuugggggccugcagagcaugguggagaaagaggcauggucagcaauacugacggccauuuaucugugucucuuugcaguaaggaacgcugcaaucgcaguccaucagcauauacuuugccuacacacugacaccuuuagccuuuugucuuaagacacuauuuuguacaauugucccugaacugccugccuuagacucauuuagagagguuuaagguauguguguauauauauaaucaaaacuucuucaaaaucuauuugguacugcuuuagcuuucauggaagguuucagaguaacaacagaaaggaauagcaguaagucccuuggagagaggcuaaccaacuaggaagagcuuauucucuacagccuuuacacugcauggaaauuauuuacaguggcuacuuauuaaagcacauaagguaauaaagagacauguuuaucucauaacaaacauuuuguuagaaauaaauacaugauuuaauuuauacuaaaagacaaaugaaugagcuaugcaaaagugacagcaauaaacuacugcuauaaaaaugccuuugucucucccugccugaugcacacaggacgugaaagcaauacucugggugaucccuguaacacugucuguccucucuuugcaguuugcagcucaucuggugaagaugaaauacccaagagucugcauucuagauggcggcauuaacaagaucaggccaacaggccuccucacgguccccucuccucagauaugaaggaccaaguccacggcugacaagacagaguaccaucacccccucacagcccgucacacugagacacaaguggacaucagaccacugcauugcgaaguuuucucaugagaugcuuuuggaaaucgugacucaaauggucgccuagcuaggcaagaaauuugauugcucauguauugauugcuaaaagacuuuucuuaauagugaaaucugaucaugccauauaaauccacacugccacauaaagccagaagaauucagccgacagggcaaauuuggcacucucaagaauccacaaugaacugagaaagcugccguccagugcacugagcagacugucuuaacaaagguguuuagaaaaugugauguguuucaccaccucuuccuuauggcagaaaguagaaagcuagucacaguaaaugugacauuuguuaacucacaaacaagggguguguguguacauguguauguguuuagaccauugugaacagugguagcagcaaucucagagaauggaccuucagagacuggucauauuugguaacauauuuguccacuuguauagcaagaaacucgaagaaugacugaaacagcuuuucugaucuaacacacucagucuucaugggcagcgacggcuuccuugccugcacaacgguacagagcugauagcuucugcugcuuugccacagaacacuuuucuccuugugagcacgaaagcuccugagacuguggcagcagacagaggcccgagcccggugguuucccggugcugagaggggaaauggaugcaagcccgucccucaccaagaagcuaucuccaguugguagccacucacaaagaaaaaugaguuucggcagagccaucucccugggguacaaaccacagagucagaccccaugcccagcaguugauggccaacaaaauaggaacucaacuguauuuuuagauuuuuuuucugucugauauugcuuuguuugucauuuuuuaccuuuauuuuuuucucaagugguauuguuucugauuuugugguuuuauugguuuuguguguacguguauauaaguguauuucuuugugcuguuuuuguuuguuuuguucugguguguuuucuaaaugaugaaaaagaaaggguggcguuggaaagaacugggagacaggggaaucugagcagagcauauuaaaugagaaguuuuuuguuuuuugguuuuuuuuuuuuuuuuuuuuuuuuuuuuugguuuuucgaggcaggguuucucuguauagcccuggcuguccuggaccucacuuuguagaccaggcuggccucgaacucagaaauccgccugccucugccucccgagugcugggauuaaaggcgugcaccaccacgcccggaaguuauuuucaauuuaaaaaaaaaggcuccuccacuuccaucauuauauccgaaaucuagaaggaaagaaaugaaagagggaaggcaagacagagaaggcagaaguaggaagaaaucaggaagaaaaggugagcaggaaagagaaggaagaggcaucgcauucccuucaaagacacgagcugacgcugcacacucccuccacugccucaccggugaccagccuggacucgcauggcagcacccagggaaugcugagggaagcugggauggcagccucuggguugccagagcuccccagcuccgaaagccugacugcagugugaggagaagagaauguguacggagagccagcagcagccucugccccaggguuggaaaaguuauguccugagcucuaccgaaucuaaaaauccacaauugugugagaccacaauauggagucagaaagacaaaggcauucaucauuuguaagaggaacuuuuuuuucagauuucugaaaugggaacauuacugaaauauauccuuugacuauuuugaauguuguuucaaaaguguccacucuuggucccuucuauuccccgucagugugacgacucugaacaucuguacagaaaccucaagcgucugggccuggacuucauucuacaacuguugccgccuuuauuuuacuugcaucuguuuuuaauuugugaguacacaggugugggugcagguacccuauggugguacaccuauggggucaccuacuuauucuccaacuuuucuuugguauuuuuguuuggggcuguagacuagaauguuaauagcucagcaguaggccagcaagcuccuggggucaugcuguauccaaccuuccgcacuaggauuacacaccacuaccgcgcccaacuacuuaguuggguucugggcaucugaacucagguuuccauacuugaaaggcaagcacucuacccacugagccaucuccucagcuuacaucuauguaaaacuauacuuugcaaaccauaaaauucaccuuuuuauccuaggugauucagugacuuguuauauucauaacauuguacugguaguaguuaauuccagaacauuuucaugacccaaaaccaaaauauuguauuuauuugcagccauuuugccaauagccucuacuuggucuuugauuucauuuuugugccuggaguaaaacagggaccuaacuucacuuuugcguaaagauauccaggucaauuaaauuauacuugguuauccaccaaauaucuuuugaauuauuuacuaugcaagauacuaaugugaccaauaacuaucauuuugugauuuuuacauaguuuguaaaggaaaacaaauaggauuagagaaaaaaaaaaacgacuaccauugucuagcgccauuuccugaccaacaugagccucgccagcgcuccugguuuucuucggucuuuggugguuuaacugucuccacaggaagaagaaugcagcacugauaauccacucagaauuguucccaucuuaccuuucucacaguggccccgguuugacuggucacagugacagaugggagagggugaagacaugagcguuguaaagaaaacuauaagggagaguuaugguucaccuccaucagggucuuucaugugauuuuuuuuuucuuaaaauaacauauuuaggcuuguucuaaaugacagggaaauguuuuaacagauaaauuuuaaguaauauuuaauauucucaacuacaacauucgaggugucuaugaugguuaauauugucaacuugacagguucuacacuuaccuaggagacacuccucuuaggcauguccaugcgggaguugccagauuggguugauugaaaugggaugucccauccuaacuaugagugguccuguuccaguagcuggggucagaauggaauaaagggagaaagaacgcugcgcaccaucauucaucucccuguguccugacugaggauguaaugugaccagcaagccugagcuucuguuauuacaacuuucuuucugugauauucuguauucuaaaacugugagcaaaaauacccccuauccuaugcuguuucugucaggguauuuuaccccagacacagaacaaguaauacagcaugcugaccuguggcagaucaucucaauaaaguggaccuuagcaaguguuucuuaaaguaaaccugugguguauaggaguccuuuaugguauauuauugaccccuacucugucacuauuaaagccacuucuggu

SEQ ID NO: 1719 - RNA, 3620 nt, Mus musculus
aggguuuuaguucgaagaucagucuuuguuuuuuguuuguuuguuguacagauucugugucuuuggugaauuucucacuuguaccuugaauuguuuuucucauuucuuuguaucauucauguguuuugcuuuguaugucacuaaguucaaaucauugcuuuacauuuuuuuucaggcauccuuagcuuuuucucugagaucuuuuucugaaagauuguuuucguuaagggcauuaggcuuccucugaugcucucuccucgaacugaugucuacauauuugguguaauauuuacuuacucugacuauuuuaugaaguagcuuuuguacgaaagguuuuguuuguauggaucuaucaguugguaggugcaucggguucaguuauaggcagcucacuagcacaucucucaguuucuucagcuuuggugucaagugucuagaaugcaaugaucccaaaauugucauagguuuucaguggacauaagcaaagugacauguccauuagcaauacauacuugagcccugguggcaccagugcuugcaguuguauuuguaguguugaugaugcagaauauggagagaacuaucccuuggucccucaguacaagaagagcaaugcuauaguuucuaauaacaccuaccauaguuccugaucuauagaaagugaagacauucuccaggaccuucaggauaaaugcaggagauaccugggccucugacaucagcaaccauuccuuagagccauauucuuagagaauaguguagaacuuucucucugacaucuaggaugaguacaggucaugcugacuucugugguaauaguaaccuugaacucaacauuguggaaccuaaacucuaugauacuuaggucccaugaggcaauccccauuuggugcuuggucucacagcacuguuagcugguuuuauagagauuagagccauagcugaugcuuucaccagaucccaaaacaucagcauaaauggucucaguucuguguacuguagaggaaggggcauggaacauuugaauuuguggcacuggucuccgcccucuuugaguuauaggauguagaggagacuuuuucuauuuuguguagguuaguauaaguggugauggggcuuguagcugugauaucugccuucuguauggauggaaauauccucaggaaauuucaguaagaaugagacauguggcauuuguugaugcaguccaggaccugcuauagauaaaagggaccuuccccuugguccaauggacaaucuugagucaagccucucuguacuaaguuuaaucugcaggccauagacuaggacagaaagcuuucccauuccccauuguguguucugauggugccaagggcugacggggccucugauggccaguuuacuaaaguuuuagaguagcgauguaucuuuccagucucuggaaugaccugugaggaaaugcugggauuugcauuaggagcugcaguguggagguaggaaagaaaccucuccuaauaccugcagguccagcucaugcuggacuuggacauguaguagaggcauccucuuaugcuaaaacugcaggaugccgagauggcuguccuuuaguccagugaaguccacuggagaaagcugcugguugggucaggcaagaugacaucagguaauuccuucuuuggaacagagaggucccuaaagcagccaacacccagacuggauuuaaguguucuaaaacuguggagucugugcugggacugcuggcuagaugcuaagugugugcugcagguaccugaauaccaugagggagucucagcagggagacagacugcauacauaccaugagggugccucggcagggagacugcagagcuugccaucuguguugcuguuaccugagucaccuuucugacucagucuucagcugcccagcuuccuugcugguuuccagguuucccucccucuccucaaagcacagauuuuccuuuguuccacaccaaacaccuguuuuaccauccuggcuacacuuuugucuauuuuucuucuaaaaauauaguauuuguuuauucucaauuugugauucagagauuaaaugaauuguaaaauuacaucugagauucuuuuaucuucaauaagacaauauuaaacacgagagcuaauuuaacuuaguugaaaggcagccuucagauuugucaguuccauuccauaauaugcacuguuauguuauaauuucaagguacaucuucauggucucugguuuggggcuuggcugugacaugaauagccuugcugaucucaucacaauuaaaaugccuucacauauuugaaagaagugagaaaugcagcuaaauacauuauagacuuugaugcuucugaacccaaacucccaugagcauugucuggcuuggcuuauagugcauucaaauaagcaauuaguuauuaaaaacagcugaguaucccuccuuugcuuucugucuccucugcugaaacuuuggaggcuuuucacuugauauaaaugguuggcugccaugguagaaaauaaacauuguguccuaguuuacuuuccauugcugugauaaagaccacaauccaucaucgggggaguccgcacaagcacuggaggcaggcaccgagguggggaccaugaagggacucugcuuauuggcgugcucuccauggcuuacgcagucugcugucuuauacaaacaagggccaucaacucaaggguacuaccacccacaguggaugagcccucacgcgucuaucauuagucaagaaaaugcccacagauuugcuuagagaucaaucugacagaagcauuuucucaagugaaguuucuucuuuucagaugacaaaaaaaacuaaccagcaaacauuucaccagaaauuaagaguaauaauaaaacaguauugaccucacuugauaccuuguucuugauguggucauaagaaugaauugguagagcuacagauuuucuucucaagccugugccaaagcuucuaucagagaccauuuggaccguuuauuugauauccucugguuacagacugaugaaaaauauucugagcaacaaagaacagcuuaacaaauauauuauugcuaagcacuucagcauacaggaaaagggugagagcgaggacuagugaggucacaaauccaacucaaguaacagcugugccuuggagggcuaaguuggagggaaaacuauaacucugauucacuuacauggccucaaaucacugucuuuguucugaagaucuaucugaggcugccagaggaaacaggcuaugccuaugcucuguagaguagcagcucuaagugucccuuccaggaagucuagacaccccgccuccaggguugaauugagccucauccuuuucagguucugcuuuuauuugaaaauuacuuccagagacuucuacacaaguaagcaaguagaaccuccuugccccugucucaguaccggacccacaccgacaccacacugauauguucuucacuuaccaccgccucccucucguccauccucaccgaaacagcuuuaacuggguggaguauagcuuguacuugguuuggggcugaguuuucaccgguugguagucuguuuguguccugcuuaugaggaggccugcagugauca

SEQ ID NO: 1720 - RNA, 68549 nt, Mus musculus
ggcggcgggcugcgcggcgcgucccucccgccucgccccuccccgcgggcggcgcggcucccgccgcagcgccuccccucgccaggagggagccggaggggcucugccagcccgccgcagaccugcccggcugcgcgcugcgcucugugcgucccagcagccgcgggugccgcgccgaaggcggccgggagaucccgggacgcgcagcuccccgcaaccuucagcguccccgcgucccgguccuccggcauggcugugcuccuagcggcggugcucgcguccucgcucuaccugcagguggcugccgacuucgacgggaggugaggcgggucucgggugcccuccccuuucccucagggaccucgaguggagcagccuggcuccgggcucaggagaaagagaggcucgugccccgugugcggugagagcgggcaggagcagggacacaggugacgcguggagcgucccuacagccagugaucaggauggacugugucccgaggggaaacuugcaggugacccggcgauucgacaaaggguggcggcgaggaccguacuuggaacaaauggcacccgagggcucucgguuugugguucggaggggggacgguguacacaagcuuaacaugaguacugagaggaggcgcucggggugcguguguguguguguguguguguguguguguguguguagcacgcggcaccgcucagaccuggcgggccugacuguugcuugcucugacaggucccaacaaccuccggcagggucucugcugucacucagcguguccccccaaggcagcgcaccgcgcgaucuccccggagaucccgggcucaguccccacugaaggccucagcuggacagguuucccgcuggcucacaccaccacucaccccuguccccaucccucagagcuugucccagggcugccuugaagaugccgcaccuguuuuaccugcaaucuuggaacgaaucaauuccaggauugauuggcuuuccugucccuggaggggaccagaggaaaagccucggagcgcggaagaaaaaggcacccgcucccgguucaccaccuggucggaggaaauagaaguugggguuguuuuguacuuugagccugaggguaaagcgaagaugaauugaagagauaaagaguuuaaagaagaguggaaagcagccagaggcuaagccuuuuauuuuccaaaagcaauucuuugcccacauuuggauuuguggugcauuacuuuggggcacacauauuuacaaagaaacacacacacacacacacacacacacagccuagguguccauuuacaaagaaacacacacacacacacacacacacacacacacacacacacacacacacacagccuagguguccagaaagucugguaggugugaaucuaaacaggcuaacagucacagguguaagugugaucugaugcauaaaucugcauccuaaacuuggagucucucuggguacacuuuacaucggagagggaaauaauguggauugcugaugcagacagcuuguaaaauacgaggacacuugagacacucuucacggccugguuuugggcuuuucuuacagcagugguggggaagaggaggaggaggaggaggcaguuguauagaaagagcuugguugguugcauuugauuuuugaauaagcuccucuucuugcccauuuccuuaucugcccuuuauacgaagcaaacauucuuucugcucugacagaucuguuauucagcacauuucagcgucccggugcauuagucaaaacugcccccuccuccccgcccccaacagcugugagucuggcuaaucuguuuuauuucaagcuuucagaaaccaucccgugaauaguagccugagcuuucuugguugcagccaaccugguuucuucucccuacuccugugggcuggguguguguacauuuaacuuuacaauuagaaauuagaucacuguaggacuacuacugggaaggugucuuauucuccaauuccuugcaggcaguaaggagcuuguagaaaauuacugggugugguuuaaguauauauacauuuucuaaauaaaacaaaggggaaauuauuuuaaaucucaggugucuuuauuuauuuuaaauauuuuguuuguuugguagguggcccaggcaaauaguuucuucaaucggccuaugucgcuauggaggcaggauugacugcugcuggggcugggcccgccaguccuggggacagugccaacgugaguaucggggcuggagacuccuguuccuuggugugugugugugugugugugugugugugugugugugugaugguucuagacuuuacucugcacuuuggagggcuuaccauuacugaauaagucuuaacugugcagaucugacccaaaucuuuauucugccccuuucuaaucagagguaccugugucacagugccagcguugccauuuacagagagccacuuacuguguuguccaacaacacaauguauuuuauucuuuuauguguaaggguguuuugaucgcauguaugugcaccaccuggugcuggaggauagccuggaacuggaguuacaggugguugugagccaacacgaugguucuaggaauugaacgcggggccucuggcagaacaucagucucuuaaccacugagucaucgcuccagccucggucugcacacuuaacuuuuguuuucaguuccuuccgcucuaggcuucucaucaggcuuccucccuccuuugcuccaagcucugagaugacggugagauagugagucuagacacuauuuacacuaaauaaacugagaacuuaagagucccuguaaaaccaccacuggaacugcuguguaagguggccgcuugcccuuuccaagucucuuucuccuccucuuccucuuccuccuccucuucuuccucuuccuccuccuccucuuccucuuccuccucuuccuccuccuccucuuccuccuccuccuucuucuccuucuucuucuccuucuccuucuccuucuccuucuccuucuccuucuccuccuucuucuucuucuucuucuucuucuucuucucucucucucucucucucucucucucucccuuccuucuuucuuuucuuugggaauuauuuauuuuauguauaugaguacacaguagcugucuucagacaccccagaagagggcaucagauccuacuacagaugguugugagccaccaugugguugcugggaauuugaacucaggaccucuggaagagcaucccaugcucuuaaccgcugagccaucucuccauccccuucauguucuuuuugaugaagggaaguuauacugacauccauaugagccaacugauagugucauaggaaacuucuggaaaacgucguuuauagacuccauaauugaucaaagucuuauauaguaggugacaaaucagaacacuaauuucuguuuuauucaugauugaauuagauacuuuaaugauacaauugcuaguccuaaacgaaacuuugauuuggcagauugcucagauuuuacuucgaucuggaccuacaaacuucaccccagucuuccuauuuucccuccaaaaagagauaccuccuacuccaaaugaucaaggagcuuucugaggcauccguugagaugaugggggacugaggagggcucuacggugggacuuccaccuugucagucaugauguguuacagagaaggaggaucguaaaggccagagggcaauggaggagacuggcuuacagauggacuggcuaacugaggaaucaaaaagaugaagaguccccucagcuguuaccaauaaucugcuacuguuuaacuugguugaggaaggagagugauugccacagguuggcuaguggacauucaggcuaucgucuuugguugaggacgggcagugaguaguaaaauggcuucuuauuacuugugcacacuggccccuugcucauuccaaccuuugccuccuccuuaagggagguggaguuucuaguuucuaguacacggaaggaccaggcaguguuggcuuucacugguuggucaguucagcauuguuccugcaggaagaugguccaaaauaggguuggcaccugguggagagucgccuucugccaaacacauggcacuguuagaaauacuggcagucagguuggugagccaccagguaaaauagaguauagacucucucucuuggcccgauggggaaacaguccaucccagauaaaaauauggugagccucuuugcaggaaggaguucauuuuucuucuugccugcaguaacuuucaagaaaugggggaauuaaacucugaagggccucgagguccacacagucucccagcucuacccaggucaaggaggcaugcccuggcagaaugccccggcacagcagugggccacaccuucacaccugcccccgagacagagauuaggagaauguagguucaaugccaggugugucgaaauaauucuaggguaaaaaccccugggcuccugagaggaauuccccaagcaacacucggaacuguucuauuuuucuguaccgaguaauuaaaauggcucaaguaugcaccagcuuggcaaaucugcaucuggauaaguacgggggcucuuuaagguuacaguauaugauaaaauguaaucaaccaaaagauuucccaggcuuuucugucucccacgccuuuccuaacagacuggggacacugucagcuucaaaccuucauguccuuuuuuacaagcaugcaacguagcgacauucagcauuucccuuccccucuuuguugccucccgaguaaggaaaguguaacacagaaacugaagacgggaauggucacauuaaggauguguguuacacaguccugcacgugucacaggucaucuggggugugguaaaguuggggagccagcguaucuggggugggggacauagacucugguucuagacagccugguuuuaaauuccaguuugaccuucuuaacugugugaccuuggcugagcaauuugaguugcugugcuucauguccuccgucucuaaaaucggucugaaaucucacgcaccuucacgacacagagcgcucacacgaguuaucauuuauaaagcacagagacuuguucuuggccuaagcaacggcuauacaguuguacuuggucaaguucaauuacaauuacaguucuggagggcauauauaugcugucagauucugaguucuucaaucacgaaaaauccacacuuggaucacuacuggccagauuaaaaauguucccaagcuccccuggugcagugaccugaaggcccuuuaaguugaaagagccucagccauuaccacuaaagauggggagacuguggagaugaauccagggguagaaguauucuucuguuuguuuuucuucugccaagucuuagaugguccaaaugucuccugucaguugcugagucugccuuccuuuguuuugaucuaagguagaggaaugugagggcaagaggucagcuggaaggggcagaacaguaccaagaaguggcuuguggaaugaaugaaguaucucugaacagccccggcugucucacaugccuuuacaaauggggggcuuuacagucaaaauucaguugaaacaagucugguagucaguuaccgcugcaauuucugaccucguuccacaaaagcauagugugaaaaauauuuugggcucucugacccuuaacuaaucugaguguucucuuuuuuuucccccaugucgcuugcuuagcaaaggugccguggcucucuucugauuaacucacuuuggaauuuuccuacaaauggcuaacacuaaccggaaccaccugugcagcucaguucucucuagguagacgcguuagugggggaaggugguacccacauuauguugucuacuggauuuuauggccucugagcagaggcccuuagggagugucuacucuccuggguugaauauuugugacauguuuugacccuacugucaccugaguccuauguucuaugcaagacacucugcaucucgcuccuguuugcucuccuuuuccugaacuuguuuggagagacucacauugcagggucacagaaucgucugaccuccugucuggcuuacuaccauuagcuacaaaaccacauuuaacucagggacuugcuaucuuucucuccagggcuauugagggacagaguagaggaaccgcccagugggcauggggucuguccucauauucccugcccgugccacccggaguccacucuuagcauuccugcccugcugaaaaggucugacaguuuccagaaauaggcagguuguguuuucauaguucauuuuuggguuagaucuuuggcgucuuucuauuucuuugacucguuguuuuguguucucggcucauaaauagcucucuuccgcauugaaaauuccacacuugauuuuucuaauugucuugggccuuuaaaugcauugaauauuuauggggcucaucauuauccaaugcaguucucuugcagucaccuauguauugguggcuacauguuuacggcucacaggccucggucucucaacuaucaucacaacggguuuguuucuugcuuguaauuuccuguacuuuagcuucccugucaauggcacauuucauuuuaauuauguuaacguuuucucuccuucugccaaguagagacuucuguuguugaggguucuuggguuuuaugucacuuuaaaggcucaccaugcagcugaaggggugugcagcccuauagguggaacagcaguaugaacuaaccaguacccccagagcucgugucucuagcugcauauguagcagaagauggccuaguuggccaucauugggaagagaggccccuugucuugcaaacuuuaugugccccaguacaggggaacgccagggccaagaagugggaguggguggguagaggagcagggccgggggaggguauaggggacuuuccggauagcauuugaaauguaaauaaagaaaauaucuaauaauaaaggauaaaggcucaccaugcaauacacacaaguaaaagcacuagauaaguggggccuugagcucaggcccccccuuuuguaccugcuuagccacuagcagaucuccaaggaaggcugccuguaaacgccacuggagaacuuccauggugagaaagagcacagugucugguacuaagcacuacagcuucuucuuguuaugaccauaguauuuucucuugacugcacgcacuuccuaaagaggcaaaggaagguucaaagugcagcacaucccaggucgcagcuucagagcccuugggcucucagggcucucaggcucugcugugggcugaugugguuuuguagccuuuauccuuaagagcagagcaaaugcagaauccuuguuauguuuccacuggugggcugggaaagagugaacaaccgcauccacagacggacagacugcuauuaguucugaacucaguccuccugacauguuagccacagaaagcccacuugaagacuucucgagguuaauagagaagggacccaccauggaagagcaaaucugaaaccauuagaaguuauggaauuaucauaguuagggaauguguuccuggucagugguuauggauacaggagagguugaucgucacaguauugaauuguuucugcauuucagcuaagaggcuguuugauaaaggcacaggacuucaugucaguaauggagauacuugaauuuuaugauuccuauuuucuuuauguuuuugcucagaaaccgagucuuggaaaaagaacaugauuuauuagggguuuuuuuuuggcccuuguacagaccauuaauuggcuguccccauucauauaauuucauaagccacauuuuuuaauuuagguuuugaucacccucuuuaagauaguuaugaguaucaucugcaaacacagaaguggaugcucacagucagcuauuggauggaucacagggcccccaauggaggagcuagaaaaaguacccaaggagcugaagggauaugcaacccuauagguggaacaacaauaugaacuaaccaguaccccccggaguucaugucucuaggugcauaugaaucagaagauggccuagucggccaucaguggaaagagaggcacauuggucuugcaaacuuuauaugccucaguacaggggaacgccugggccaaaaagugggaguggguggguaggggggguggggggaguguauuggggacuuuuuggauagcauuggaaauguaaaugaggaaaauaccuaauaaaaaauuaauucuaaaaaaaaagauaguuaugaguaaauuagacauuuagaaauuagaaaauucguccuuucagcccugacgauaaaaccccgggccuugcacgugcugggcaaguacacugccaccaagcagcacccugugguccuucaaugagaagucaucuuuggaaaguuauauauauuccccucacagcccugugggcauggggucuguccucauaguuccugcucaugccacccagaacuguaaauguaaacagugaaguaauccagcggcugaauuuauuuacccuguguuaauccccaauaacuucacagagaaaccaagauuuauuuaaaacugcaccuccauagcugagcagcuaauaaucuauccuuauuuucuaugcuaaucuggcuaccucccagucccaucccgugaugcuugcaugcuauccuugaucuggcucuuugggccccuuaucaaggcuccaauucauccuccuucucagcacaucugcccuccucccucucacuaguggacaucccgcccuauccucucuccugcccagccauuggauggugaguguuuauugacaaggcacagaauaaauggugagaacuguuuaaacaaacuuaagacaggagauucuugcuagaaacauugcaaugccguaucuggauuaaaacaagaugugaggacagagaaaucuccauuugaauaacacaaggguaaacuuuacacaguacacaaaaacauuacgccuacacagaauccaauucuaacauuacuccuagcaaacaucuuucgauugguagccaacaaauaaaacaacuuguguugagcauggauuauaucuuacaaauaaaacaguuuaugacuguucaauuaugaguacuccaggaauaaccuggaaccuggggugggcaugcuaucuggggcuauaugaaagguugcuggcaggcaucucugucagcuucauagcccauuguccucagcucucuagcuucuucucccaaugaugagguuagaucguagaaucucgcuuguuuguuuuuaaggcaacaagagaauagcaaggccauggauaacuuuagaauugcuuaugucaccaaaccugcaucuccaaauccuuaggaagugacguuggguuuguugcuguuguaacaaagguuuuucacacacacacacacacacacacacacacacaccacuuccuggaaggucuauuuaggaacaccuuguuccuugagcgacuuugagugguccuggaaugcaaauuccaagcacaaaguaguguugaagaaucuugaccuuuccaaacagguaguuuuugagugcgugcagucuucaaagaucaguuuuaaagaaaugccuucgcucuuuccuuucuuuccacgaguggaaaugaucuuugaaguaauaccauuaaaagccacuaauuucccaagcuccuuccuacagguaauucgggcagcucuuaaccuuuacagacuagaaguuuuaguacuucucaggcugaagggccagccuagugagagggaagcucaguagacuccgacucuuuaucagccaagccuguccucacaccccuggccugcccucacaccccgccacaggaacacacugcuggacacacacaagcucugcacacagggaccaaggagcagcgugguggugucugcuacucagaagcuggcucaucuguucagagcaggugugcuuucuccccagaugcucucccucuggugagagugucuugcccaccuaccguuccuacuuggugcuugcucucuaucugccagacucaugcucuguacaguucaaguugagccagcugcucugagggugaucagugauguugaauaucacccccacaguaaauaagggaucuuauucaacacagagauaggaccuucucugcagugggggagggguaggaaagcagagucuguugacccagccuuucuuacugucuccucuacaacagagagguggcuuugccuuuucuucauucaaaacuuacugcgaguuuauacauccacaugaauacagaaacuguugcaaaaagcuauaaaccgcuuaacaaauuugugugucaugcuuacacaggggccacgagcaucuucccuguauugcuccaauuuuagggaauaugcuacuaaagagagugccuuuuccuagcaguugaaggucggcuuuuacuuuuugucccaacauuuuuuuuaaggaucuuaaauuuagaaaggaaaauguauucacauucugcgauaaccauuccucagagguauaaguguuaucaggugcccuauguagcucucagagauauuuuucauauucuggcuaacuucucugucuccccuaccaccuaccugcuugguacaaguacaaccuaguagauaaacggcccugugccuucuucgaagaacaccuuaaagccauuuucuuaucauccguaugggaaaagccuccuucuuauagguucaaaguaugcuaugguguggcuguccugaaauuaauuaagcaguccuuacugcuagaucugugugcugcuucuaaaauaaccuugaucauaaugcugagaaacgcugaguuguggucuucuaauaugcaggcagauuucugugugugucugaaaggcauacggauucuuagcuuugaucagugggagagugguuucucacuuggucacgcuggauccagagacuggcccguugcuuguugcuugaucuuaguauacuuuccucucuacuuucuuccaaggaagccuggcauuagucugauccuaguuuaauccagguuuaauguuucgccuuagcccagugaccuuugaccgcuggcggcagaauggacugaaaugugucuguuugccaaaaucucuuccuggccugcagccauuauauugucuaguuuuaugaauauagagucauuuucuauuuguaagaaagauucacauagucuuucaaaaauugcuccuauuaucuuucaacuucagccguaauucaguguaccugaggugagcgcucuguuacuggauccgugauguaugggggaggaguagaagccaaagcuggaaugcuaucuggggacacguuaugacagaaagaccaaaagcccugaucacaguguuucuaaagcugugggaugugggcuuacauguucuauugccuauucugguuaaggcauuuacauaauacaucuuucauuuaaaaaaaaaagcuaagaaauggauauuuaaguuaaaaaauugagaaggagguguggcgagccagagggagggagagaaagcccccuggagcugcagaagcggguacggaucuguuaccuuucuguuuucucaacacuaaguucuagucuccgguagacagucacuguuucuuacuaaucuaugcagaagugucuacauaguuucaagauuuucacuuuuugaguagcaauagcauaaauugaagcccuucuguacccuuucaaaagcguuuaaggaccauuccuuacagggccauguaaaccugucucagucuucuagauggcuucacaguuugcuaucauacagacguacaguaauaaccucccacuuauaugcaugaaggucguuuucaggauuguguuuuuacaagcuauacuacaaugacuuaucuggauguccgucugucaucacugcugucuuauacaacuaaauacaggaaaacucuucagugacauccuguuucuacauugagagagccuucauuuuacucugcacuuucuuuauaaaaauguacuuaaaacagaauaaaucaugggugacuuuauaaggagauuuuguuccuacucagucacugucuacuuuuggucccccugaagauguguuaaaacuuaaguagauugaucuccuuauuccgauuugcuuauguccucucuuguuuguaaaaugacgcuuuuucaaauccuuuucaaccauuuuuuaagaguagaaaguguuuaaguaagaagugggagacagagagcaggcggcuagcaucgugggugaguauggggaggugaccaugggcuccacuauaaauaggugcugggaagaaaucagugggaaauucuuacacuaauuuuuacucaucagauaugagcauagaaacucaucaccaucucacuuugcacccauauaaauuaugguuugggguaaagagacaaacacagauauuauacccaggcaccauuuaccugccuucuacuacuacauggucaauggccagugaagcgagcaacggugcugguuucuucacuaagcucccuucuucaaagccucauacaggaguucuaaugaagccuacuugaucuccuagucugucuggaccuuacagagggcugcucuguauaaacuauuuagggcugacuagacagaagcggagcauaaagaaugagcugaauauacgauagucuggaauccaaacuuaggucacugcagcgugaggagaggcugacucacauggaccccucaccaagcaccuuugacaaugggaccugaaauccuggugcacauacacccuauaaggauuucucuucccucccucccucccuccuuccuccaugucuccuuccuucacucuuucugucucucugaaaacaaacuaacaucauaacugugcaaauaauaacgaaaagaugguguguguucugagaugagagggcacaaauccaggaagaccgcuguccccuuagagaagcagaaauuccuguuccccagacaggaagcagcaaucugagcugcuuggauucucaccuugaacagccuuggagaacgaaggaguuagcauuuucuucuuaaugauagcaaugaaagauuugucccccccaaacaguagauagcaaagacaguuuagaucgggggggaaagcaguugcauuggucuaaagugguuguuaguccuucccuagggacauguagggcaagaagaaauguaauugugcuuacugaaaacguacauguuauuaguauuugguuaaggaauaccaauuugguuaaauaauaccaaauauaauuuucgacuuucauguacuauaacaucguuuuagguuuuuuuuauuuccuuacuuguuaauauguaauuaaagagacaauuauggucauaaugacguucuccuuaaagccagcauagaggaauauauuacagcccagaugaguuauuauggugugugguaaauauucacagacaucuucuguccguucauuccauaucuuucuacaaggaauuugaguuuuaauuuguccugauaaaauuccuaaagcaauauaauucugauggaggaagguagacacaaauaucaagaugguuuuugccuuuagaaugcgguagcugcaucuggagaacgaacagccucgccucccagcggggcuucuuauacuaaagucagggcuagcacugguaggugccgaacuccaggaaaggaaaauuuguaacuaaggauuugauauagaugauuuuugucagugaaauuuaaagccaaguacuuaauuugguaauaucucucuacccauucuauggaguaauggcguacauuccccagaauuuuguccaguuucucuggcuguuucccugcuaaaacguaaucagauucugugcuuggucaggauugccuuccaugguagauauuauucauggacucugaaucuuuaggaacucuuucaucacaguuuaaacuugugucuguguagacaaaaggaagaaaagcacucaguaauucuuagauuaauagacacucugugaagucaguguuauuuuuccuagucaugggguugugcaucauugaucccaguaaucgagaagcagaagcaggcagcuuuccaagaguucaaggccauccuggucuacagagugagaucaggacagccagagcuaugcagcaagacugccaaaccaaaacaaaaaccaaaacaacaacaacaaaaccacaaaccucgacaaccuucagucuuauuuuuauaaaugcuaaauaucaaacccaauuucaaugaauuccauaaaugauaaaagguauuuguugcuaaacugacaguaauugucccaugcauaauuuuuuucuuuuacuuaauugaaaaacuuuuuauauaauauauugugaucauguuuuuucuucccccaauuacucccgauccuuccuaccuacccacccaacuuuauguucuuuuauguuuucuuuuauaaaaauuaacauuuauuuuuauuauauacauauaauauacauucacauguaugauuguuuugcauacacauaugacuaggcaacaugcccaugacuuguguucauguaagcuagaaggggccaucagaucaccuggaacuggaauagcagaagguugugagcugucauguaggugcugggaaucaaaccuggguccucuagaagaacagccagugcucuuaaucgauuagccaucuuuccagccucaguuuuuaauuuuuaaaaguauguauggggguggggagagacaggggguagguacaugcaugaguguaccuacaauggcuugaaaaaaaugcacugagucuucugaaacugcaguuucaggugguucuggaccacucuguguggauguugugaguccacuaggugcucuuaaucaccgagccaucccuccaguuccuagacuuuuuaaacauaagcuucccacaaccaaaauucuuuaguaucuucucuacugggauauacuacacacacacacacacacacacacacacacacacacacacauauuaaacuggauacuuauguuuucuacauuuuaugguauucugagagguuuuuauuuucagauuguuauuagaauucaucaaugaauuaaguuacucaccuuaucuuaguaucuaucgacauauggcuugauauuaaaaucacgauaugcuguuucacuuuuuauuuaaaauugggcuuuaaaauggcguuauaggaaagaaaaguauaaaauuacaaagaacaauguauacaucugcuaacugcucuauucucugcacuaaugaacccuuuaauagucaggaaggagcauccugaaagcugggcucuccuggcuucuuaacuuccugugcucugcugucugucauccuucgugcuuguguguaacugugccaaguucacuaauugacugugaagagauuuccccagauuaaugccaagucuuugacaaugagaacuauacaauuuaagguugggaucuggagagcuuuugagauugguagccuuuguggcuggugguuaggauuuggcagguagcucaaggaugacaugacaugucuuccuuucccucucaugcuugccccucacgguugucacugugaggaguuggccccuggccuguuggaccacauguuuaagggacucugggccucauguaguaacuguacaagccaucucaauguguaguacuuaacuguuucuuuccaaagguuuuaagcagccuaacaguugaguagcucacaauucuuuauaguaaauuaaacugcaaacaagcagaucugcaccgugaguggaguuacuaccuucagguucugugcccuaucccucaucuggcuucuucucacaucucccuucuuccuguccuuacuguucccaccagggagucaaagcuggccucagacuugugauccuucuauuuauuccucccaaaugcugcuauuaaaagugcauaccaucaugcauggcucugaagauugcuuuccauugcuggagaucaagcccagggcucacacacaugcuuuagguacacucuguaccaccgaaguacaucuccccgucaucuuuaacacugucugaaccuugggacugucuccaaauccacaaagcugugcucagcaggcaagaaaagcuggucacuuaauaguuuauuuagugugcaacagcuucauaaacauauccaugugcuuauuaauuuuaaggguauguaggaaaaugugaauuaucagaagucuccgaugaauggaggcagggaagacugaguccugcacuacaaaccaguggguuugcgggcaauguugaauguauuugacacccaugaccauuuuacaauagcuguggaggaccagauuaucaggagaaaagugggccagguuuuucuguauuaugacgagcuccaaaugagcuccauuccagagcuucuuacacugcacuaagacacagagcacaugcagaaaauguauuuuuggcaacuuuucaaaaaaaagugcuauagguugccuaugaaaauguccuuauccaucaggagagauuagaccccagaaacugugaauuuuagaauguaggacauuggcugagauuuaagcuagaagccuuaagaggguugcauacugauaccaaucaacuuaccaaaucaaguauuuccagguuaccucauguuaauuaagaaaaaugugaccaaaccuaaagcuauuauaaggaaauagaccauacugaacuguugagcugugugguacugagacagcuagcuuguaaauaaugaugcuuucuauccuuuaaugacucuuuuuucuuucguuuaaaauaauuuaaaguauuuuugcagguaaauuauucaaaguugguuauggaauguauuaaagaaauaguguucgcuuacauuuucuuucuugugcauaaucauggccacaaauccaaugucuaaauaugccacccgcaugugcuuuaugcuuugacuuauuuccagaguuucuuuagacaauacuugaugcauuucacuauucuaucuaaacaaauaggucucugucaacauaugguggauuauuuuaaaaucaaaggcaauaaaaacaacaugcaaauuauaaacauaaacaacacgggaaaaaagcuagcaaaccugggccgggagauagcucagugggagaaguccacgcaggaggaucugggccgggagauagaugggugggugaguccacgcaggaggaccugggcuugaauccucagcacccaucaaaacaagaagccaugcuugauggcagauuccuguaaguccagcaucuuuaggaggcggugcggucccaggagggacugugcuggccagccagccucacccaagggaccaguuucuguucaguaagagauuccaucucaaggcagucggguaaagagcaauacaggaagacacccaguguccucuucuggucucugcgugugcuuacacuggcaugcauacccccauacucaugcauacaacacacaugcaugcguacaugcaugcacagaaaucacauauaaacaacaaaccaaaaauccagcaaacgaauguaguguuugccuuucauaauacuuuguaaucauucuggguggauggcuaaauuauugcuuugauugagucaacucagcccugcaaacucuucuucuguuacccccacccccaccccccaaaagacucccuuaaauuagacaaauacacaaagcgaucauauguuaaaguggauguuuuguguuuuaaagagggaaggcauucauccaaagagagauguaaucaagccaucucuucucccaccccaggacucuagacugguccagcacugaccauuguugguaguguuuuggguuucuuccuuuacccuucauugaacuggauauuaaugcaucuccaagggaaauggcucggguuuugugguuaguucuuguugcuauugacgaccacagcagccacgcaagaagacagagccacggaagggaagaagacaaacuuuaauguguuuuucucaaagcuggagagaaaagggaacguguggcuuaugagaaaaaaagguaagugaauggucaugacguacgagcuaccagccuggguacggauugagccaaaguuggucacuuuuuuuuuucagcugcuuuauccaaaauugauuuaaauaaaagaauacugacucuagaaccccacaaucaguguuuugaaaaugaaauacuggaaaagauacaguguugcaaaaacucugaaauauuucauuagaacuuggaauauagauggcugucccuguugcucauuggguagauacuugcugcuggucucggggacuugaguuugaucccugagacccacauggcugaaggagagaaccaacuccgacaaguugacuucugauguccaaguguacacugugguacgccugcacaugccccucccccaacacacacacuaaaaauguuuuaaaauguuuuaagaagaacuuggaguacagaagaauagcauagcuucaauuauugcuuaauauuuuuguuauaaaauguuuucuaauaacaaaaugaugacuaaaauauuacuauuuuaaacauguccuagauuuuuuuuuguuguuucagagaagcacugaaaguugaauguguguaagucucccggaauguaacaaguuggucauacccgagccccgccuccuuacagagaaaagaucuggaauuucuuuuuuuggccauuuguuuugcagcuuucuacgucuuaaggcagagacuagcaaggauaaggugccagcucaaagguuagaggaacauauuucuugacauaauuuuggcuaauauaugucuugaaggccauaacaucuaaaagauacuuuauaaagcuacaagaaaggcuuaacauuucuugguuuugagugucuuauuugggggaaacucuauuccacagagaagugggguguuuuguuuuucauguuuucccuuuuacuuauucuaacuuuaacugagugguuagguuaaacuuuuuccuuucaaauuuuauuucucccucuugauuuacaaaucuaauaaacugaccuccauccuaaccuauaagacaguuuaaacuuuuaauucuuagagaggcaaauguauauauguauguaaagucuaccaagugaaauuacuaaugccagcccaucacuaaccugugggaauuauguuucauguuuauuaauucuccgaggaacaauucagguaagaaaucuuuuuacuguaucaaauaacaagcuguauauugaccacaccugcauccuggugcuuugguuauacaucugugcacugaguaaggucacuuaccaagcccuucacaacuucagcgaacaaucugggugagguaauaccaaauuacaaagugcaauccguuccaaggaggcaacacaacaugggugcugaaggaggugucccauguccccagagacgguucaaagguaggauuucaauaagaacauuuggugaaaaaauuaauaguacuuuuugggggggcaaguuucugaucauaaguagacuguuggcuacagaaaaauuuuucuccuuuucuuuuucuucucuucucuucucuucucuucucuucucuucucuucucuucucuucucuucucuucucuucucuucuuuucuuccuuuucucuucauccccuuccucccccaccuuccuuccuccucauucucuaucagguagccaggugucucuauggacccccaagucagcuuuaaacaaacucucuauauaguccagacugacuucaaauuccgacuccuccugcuuugacuuccccugaccccaaagacugggauuacagguguggacugccagauccagcguuugagaacaauuuccuuaacucuuuaaguaagacacaauuacauuauucucuccuuccuuugaccucucaccccccccccccauauugauggccuuuuccuuuaauuauuguuacauauguauaugcaaauaacuauauaaauacaacuuacuggcuccauguugugucacuuguauguguaugguuuuaaggcugaccacuggcuauuggauaaccauuuaggggguuccuccagggaaggacuaauucucccucugucaguagucgcugucugcagcuuuugaucuagggguggugccucugauauuuccuccguccacacugacaugucaaccaauguuuaaauaguucuugaugaauguguucauucaaacguagaucacaaacagagcucugagcuguguuucccugcauuguagggcgaagagcacauuuaaauugcuuuucauuucccauguccaucuuuugcaagaguuaacaggaaguagcacauuuuucucguuguucauugcuagaauaaagccauuugcuggagugcugucuuugguuggcgccacuucuuuucccuguugugaauaauaucuuugcauaaagcccucaggggaaagguuuugguuagcucacagugcuuacacuuaaaauaaguagaagaaggcagaguugcccucuggaaccuuagcguuuacaguuaccaugauuuaccaggagcuaaauuuaggagccagggguguacagagaugaacagagcauggaccuucgcucuuaaggaacucagucauauaagauuuuggccuuuauuccuuuuauaacucuaacauagggaaaaguuagggaugaaguguugagggugggcagacaggauggcuccaugggcgcaugacaccuggcgggugaccugaguuaacacccagaacauuuauaaagguagaccugaaaaaacugacugcgcaugcgcaugccaccguggcgcucaagcccucacguguggcuccccucccccaguaacaauaaaugacaacuaaagaagaguugaggaagcucaggggacgaaucuaucccuucugagucggagcaaugagagguccguagguuccacgguguucaguuaacucgucuguuccguaaguaauaccgaaucacaugcuugaucuugaguuccgcucagcaucagggcuuaagguccacggcagcgcuggaugagagcgauguauuguaaugugauguaaaugauguuggauagugugaaugugccucucaguggacagcacuguagaccagaagggacggcccagcuaaguuguggauaaggcaagugaagggaaaacagagaacugcacaaagaucucagaagccaaaaugagcacauuccaggaaguaaguguacgcgucccaguucagccgugggguaaacgcuugaaggaugucugauaagagaagcaaguagggaucucucaggagccuuugaugucauacuaaguagauuagccuugaccacagggcaauacaggaccucgguaaagacuugaaucaaggaaauugcaacuaccuuagaccauaugagcuggugccgaggagcccaaccuaaccuaaaggugaauuucuuucuggucaggaugcuuuagcuuguuuuugaaauugucaguguuucacaggaaaacguggauuccacagacaguguugaaaauuggugacuuggcauugcuucagggaacccgugggcuacaagcagcagcccggguggaaggagcccaugcucuguuuuacccaggcucacuuccuucagggcaaaugccuggcacgugcagacauuugagguuuggggcuaauuuuggaacuuucucuuuggcaguuuaaggaauaacuauuugagguucagagcuggaguuuuuacagugcgagguggaaaguuagacuuugguuguaaguaguggugggaauagaaaagacagcaaggcacugaaaaaaauccccaaagcaggauggauggggacucggagagugaaggcagcgacggggugggguuuccugaggaucuuuucugaguacaacuucauuuuagcagaaggcagaugagacuccuaccucacuggaauucuaaguaaggauuaaaugagaagcuauuuacagagcacuuagcugagggacuggcacauacucaauccaacgaaguggcuauuguggaagacggugaagaggaaugaaucaagaaggagaauugaggaggagucaaaaguuucccgugaguucuuuggugaccgagaggacacaggagaaggugcagauggugacgccaguuugggacguguuaaauguggaacacuugugagacuuugaaauggaaaaguuugauguguaccggagucuggcggacacagugugacucugggucccccucccccccgcccccuccacucacuacuuauaucuuccuuccuguucuuggacccuuccagccaacucgcuaauugucacaaauaccuaacagagggucaucuugaaguugaagaacgugccguaggcaaaaucauauccuauuugcggaaguguuuccuaaaagcuuuuguuggguuggugugaagaugccauccaguucacccuguggcccacaugugaauggaagcagugauucagcaucucuuuauaucaagcguggaaaaaaagucacccucuauaagcagauucucucgucccgcccccaccuccucuucuauuugaugucccuagcauuucuaauuauagacaacuguuuagaggaaagugagugguugcugggaagggugggcgggcgggguugcucuuggaguuuguaugccuuccuaacucagucaagccugggcucacaccccacuuucuuuuguaugcuguccuuacugucacagcugaccucugucccuucucuacauucuguuauuacauuugcauggagccugguucaugcacccucugcuauucuggggguuuguggaccaacguuauuuuuucugcugcaguguuugcccccgagggugagccagcauuucagacaccauuacacccaguggagcaacaucugugacauacuguccagucaguucagcccacguguaaaugugaagggauaggacuuucuauauuauaggaaucaaaauuaugaaggaucuaggccuggcggcacacauauuuaaucucagcauuugggaggcagaggugggucuauguguugauuucugggccaggcaggguuuugucaaggcccugucucaaaaaccaacaacaaggucugcaacccuauaggaggaacaacaauaugaacuaaccaguacccccaagagcucgugucucuagcugcauauguagcagaggauggccuagucggccaucaauggcaggagaggcccuuggucuugugaagauuauaugccccaguauaggggaaugccagggccaggaagcaggaguggguggguuggggagcauggaguggggaggauauaggggacuuuuggagaggaaacuaggaaaggggauagcauuugaaauguaaaugaagaagauaucuaauaaaaaaauuuuuuuuaaccaacaacaaaaauaugcaggagauguaauuuuaaugagcagauauuuaggaaggacaauuuacucugaaaaugagcaucuuuacucugccucccuuguaacuuuauauuucauuaacucucucuuaggguucagaaaggaacuuaguuuacauguguucacucuacugagaauauauauauauauauauauauauauauauauauauauauucugucugucugucugucugucugucugucucuguggcacuggcccuucaggugcagagccugugcuguuuccugugccuuucugaccauucugcugcugcucauucugagucccuccgcugcccacauuauacauuuccacuccuuucagauucauugcucaauccugaaggcagucccuggcauuuuucugucuuccaccucuaugcagagaaauucggcuguguucuucuaacaccuuguauaccugucauggcugucuuugucaaaagacugaguuauguuucaaaggaacuuuuguauauuuaaagaacucaaggucugggagcuagauuugugaaacucuucaaagauaccaugaaauauguauauguaaauguauguauuugugauuuauaacagacauauauagagagacuuagaaaaagccccgaggagggcuguacuuaguacaagaggcuaaagcaaauuuuggagauagugaagguaaaaauugaguccugaagccugucuacauaugagucuaacagacaccauaugugauuggagaugacacuugugguuggagaagaauucagacauacaauauggcuugcaugcuaaccaagugcucaggcaaggaugacuaagcaaggcaaaugaagggagccgaugagugaauacagggagaccaccauuccagaucucagucaagggaagccucuaaugguggcuuaggcuuggacugaagggagaaggacuguugugcccucucucgcuuaaccgguuuuauacuaaugggcauuuagguuaucaagacuugccuaagguuuucuaucagucaaugugggaacaacuaauaauuuaaaaauaaauaaauaaauaaauaaauaaacaaacccaaacggucaaagucacaaacaucccacaucauauuaguguaggcacaguccuaauacugauuuaauuuuugaaacaaugaguguguggcuugauucacauguuagugaaucuuuugaacauagggauuuuuguuacugaagaaggaaaagauagcuacauuaaaauuuuucuguccuuaaugaugacaccuccauaaguuuggugucuccuuagagaggaucaaaucuucaacuaaaauagauaugguaaguguaagcuaauugaaacacuaucauguguuucaucauuuccugaugaguuguugcguugugcuaucugaugucuugucaacaucguugaaucagucagcacugcuuucuacaacaguuugucgcuuuccuaaacccacaugacaagcucugccccuccgggguccuugguucucaagacaucugugcuugcucccaugucuccuuacuggaccuaccugcuccaggacaagggaucagucguguucacuuguuauagccauaguucucguacuuugucuuggagagggcuucuccucuuugccauccuuaggacacuauuuuaaugaacacuuaggaugcugagauagcugauacucucuguacuucacuacaggguuccuuucaguucucucaguaaaccugggggcaaguuugaucugaguccugugaguuuuccaucaaagaaaaugaaaaagacaauguggugaauguuuagccucucaccuagcuucgagaggagaagacagcuggguaaucuuuauaauucaucuauuuccccagaguucuuauuccaaugucuguacucaaccccuaugaagaaaacacauuggaaaaaggagcaauagcucucaaagaaugcuagucuagguauccauauuaucaaauucucucucucugucucucucugucucucugucucucugucucugucucugucucucucucucucucucucucucucucucuaacccaagaaaguuuccauugaaaagaaggaagaaugaugccaguggauaucaaugaacuccaucugaugaacucuaucuguaacuacugacauuguaucugcuuucuuaccuuacuaucauuuucuaugaauuaguagacgguccacaguggggugaguugaaccuguaccuucuguuggcuuguagauacucuucacaucuuuucaguggugcuuaugauguccugcuucuccgguuccaucauaugucuuacuaccuggcauccuuuacaaggaggcggcaagccucuucucuuuucggaaucucgucaagcccaugaguucuguuguggcucaauuauuauacauuggcauuauuacucuucuugauauucccaccaucuggaaucuggccagugggagggaacucaccaagccaacuuccacaugcuuugcauagaucuccaacauucuguaaauaugguucugcuuucugcugugggagaacgcuguaacuuucuauggucucccucuuugaagaaagagaaccccaagcucuauugugcauccggcuacacauagccacuuaacaagaaaacagaacuaucuaccuuuccaaaggaaugcauagcaacagcuccucagaugugcuuaaagucugaucugguuuuacccuaaaucccacucugucuccaugaacacaggagcaaaauuucaaguaaauugaaaaaugacaccaguaccaagagagauuuuuaaaaaugcuuuaaaaaaauguauguguguguaugugaguacacuguugcucucuucagagacaccacaagagagcauuacagaugguucugagccaccaugcuguugcugggaauugaacucaggacccauggaagaacagucgaugcucuuaaccgcugagccaucucucgagcccagaagagaguuuugaagggcaaugguagcgugcucagugaggaucaacagaagcuggauggaggcacaaagauucauacgcagccucuuccauuccugugggcuucucuagaaauacaggcaguuagugagggaaagcgauccuugagaaaguccucugagucggauguucccagagacagaaaaugaagcgagcucuugccagacaacucuuggaaggcacuguuauuuauuucacuucguucucuaaguggguaccaauuuaucaauccuggcuuuuuuuuuuacuauaguucacuuuuaguuaaaaguuuaauuauagugaugucaauuuuugcaaaaacccaaacaaaccaaccccccgcccaaaaaaccaccacaacaaacccuuauauguagcaauacuucauuaaagcuucagaguauacaaugagcaauagaacaaagagauuauuguaguuuaagauauucuagcagguuccccuagagucuuuggggaugauagacuguuucuucagggcacuuauccuuagaggugucacugcaugccauuaugcauuugaacaccauucucagcucucauuccucucugcuuagcacuuuaucauaaccucuccuuccuauuuccaaauuaccucacacgcuggccucccucuucuuuuuuaauccaccauuggccugaaccaagauguuuuugcugaaauuggucaacucacuuagccugagcugauucgguggcaauggccacaucuuuccugccuuauauggauacuacaaggaaaaaaucggccacgugaaaugguuuuuaauuuaguguccaagagagcauuuccucgauagccuuuuagauaagaaccagagguucuuuacacuguuuuuaauuacagcaggaauuuaauguuuugaguuuguugaauaauugacgagugucaauacgauguuugggacaaacagaguuguuuuccucuggagaucuugccugauggguuuuguucugcaugugauacgugauggcucagggcccuuuccagcaguucuuuauaaacucugcuuccauuccuucuagguucuauuaauaagcagcgagggauuucacauagcuuuuagcaauguuuucucuuccaaggucaacugugcuuugcaaaugagacucucuucauauuugcaucccaccccuccccaaaucuacccaaauccaguccauggagugguugggaauugugggagcucucuaacagacaguuuuccagcuguucuuucuucucugcucuugaaugccuuuugucaccuuguugcuaaggaagaugacuuggaggggaaggcaggacaccaugucaaaaugacagaugagauucaaggacucagaggcauucuuauauuaagaaaaucccugucauggauagagcuuggauuggcuuuuuccucauugcuuuccagaacagcuguccccuuagcaucacagcuuguccuccuuaguccagacguuggcccuugguggccaguaugauucacuuggguaugaaacauuacacaguuaauaaguaagauuaauugccuccuagcuuuggauagauagaucgauauuuucugucaggacaagaaggcacuguugagcuuucacaagcccugauguaauagucaggaugacucuguguaaauuuuagaauauacucauaggugagaagcaugaaauugggguauugaagaacuguguuugcuuugaauauggagacuuguuucucuguuuagucaaaacaacgacuuagcaguuacucaacgaccccagagaugugacagcaauauugggucauguuuugagugugauguaccucugugcacuaucuugaagggacaauaaaaaucucucagaucagugacccucaagaggccuuuauuuacugaguugaaaccguauaaguauggcaggagcaguacaccaucaaauguggccugucucucuuguuccugguccauacagagaucagagaacccacguaagccucccugauuaccuggaguauauuuccuccaggcuccaugcacuaucuccuguugacaguuuggaagauuacuacaagauaaaaacagaucagucucuucagucaggcagaugccucaauucacugaguagcauaguuuaugcaugcaguuuuugcccaucccugaaagccacguuacaauggaauaaguuauuacuaggcaggccaguuuacacaaaaauggggaaccaauuuugcauaguuuuuaaaauagccaugcgcuuucugauuacuuauauauaucaaugaagcucuuugcauacuugcaugaguauguggcauuguagauacaaaaaacaugguguguucuauuucuauauuagaaguuacuaauaggacuuccaacuguguauccaaaaaaaaaaaaagcagaacaaaauccccuugucugucuugauaagagcagguuguuaaguucguauuccggagccuaguguucaagaccagucgggguuuguauuuagcugggugcgacggugccagaaggaauggggcugauguuaugaauccuucucuaucuuucuuuucauucucagcaucacugguuagaagugagcuguaacucuccauucccagcaggaacacagacagguguuuuuguuuuuguuuuuguuuuuguuuuuguuuuuguuuuuguuuugacaagcuccccuaaguagcauccuaauggcuccacucagugacuucuguuuauauuagaaauuagcuagaauuggguccuuugguuacuccuaucugccaaggagaauagaaaguauaauuuuccauuguaaacuuaccgugcauauuuuauaugaaguaaaagcagaaagacauucuguaguaaggcaacaaggaaauggaaaggcagggagccaaagcaugcugcuggccuguuguggucucucuggggcuuccuuugaucucaccugcugucuaagcacuucaggggauagccuacaaagacgucccauucggugagaacccccucacugccuuucccucuuccaccuguucacacuggaaaguuuuugccuguagucuccacugccccuucccuuggauguuugcucucuguggucauaguuuagacuugaggcucugugaucacagucauuguccacacuccuucccugcuuugaaauucucuaauccuggcccuuggcauggucaaaauaaaauuagucaugcuuccaucuauccauauguguguaucaaggauaauaaaugcuuggugcauauuuaccgacuucuaucccagaccuaaaacacagauugguggggaggaguuuuaucaacacuuuugucaacaguuuuaauuuucucugaagaaaguaauugauugugucagcucuguuguguacucuaccucuuuuaauagcugcuggguaaucuguaacugcugguuacuucagguagaaacgcaaucagcagaguccccaaauguagcagcaccauuaacagcccugaccucuuggaguguguacauuugaugcuccuaagauuagggcauccugcugagagcaaauaagaaaggagagaggacaacaaaacccuuugugaguagaagguagacaaagccaugaauggauggccaucagcuggucagaggucaaaggcaguccaaccuggaggccacaaguccgcaccaucaccuguccuccaaaugaacaucauguuugcagggaccuuuuaaagccaccuuuccauagcuucagauauuuucacaucccaguuauccuagggaacuaucccucugacucacauggaacagauauguaaugcuacuuuuuaaggacaauaucaaguucugggcgccuccgaagacuugauuauuuaguuuacauucauauauaaaaaugucauaaucaagggaauagcaaucuuuuuuuaaaaaaaaaguaucuaucuauuuagguaugcaugugcaugugcacgugccauggugccaguggaagucacaggacagcuugugggagcuggagguucccuucuaccauauagggccuugaaaucaaacucagcucauuagacuugguagcaggcacucuuaccugcugagccaucuuaccagggcagacuugguggcaggcacccuuaucugccaagccauuuuaacauugcugcaauauuuucucucuaaaaugaacuuuucccccccaaacuugcauugcuugaugaugaggucuagauauuacagagaaccauguuuggaggacuuccuuuaaaaaucuucauucaguauaaacuauugacccauucacuggaaguaauacuagaaagccacaguagggauuguagucaaugggccuaauugucauaauaaauaggcugacagggccagggccaguacacucgugggagaccaaggagagcugagcgagggaauguccaaaaugaacauacaguguaggucggaugcagcagugucaggggaauguuugagaauuguccgaggaaacuggaacauuccgcgucccagaguggagcacagcaugggcugcagagaagggacaggaguccaaggcgucagaaggcagagggaggguugauggcgcugcccuagcucaaggccuaucugcuuugcaccugcuggagacugaaguucaucucuuccugucaggagcacaacgcauggaugucuagguccagccugaacuugaacuucuuggaucugaucgccccccuuuaccucggaaugauucacuacaucagugcccucacgguuuuuuuucacaguaauucuccugauugugaaaguccuccagaaacuuuccauuuccugcagauaaaguaucacuccucagucugagacuuuaggaacaccaccaucucauuccaagcaugaucgguugcuccuuacucuuccgagagcaucuacucaucuuguuagcuacccaggccucucgacugaccucucaccuuugguccacuuucacugcacauguuuccucuccaugggugaucuuucuucucuguucccaugcuucacgauccagcacacuugucuuuaugaagcuuccuguccaagcccguaugcggugaugucuuuacacauuggcuguuugcuaaccacuaugcucaugaguaauuauugucuugaauugagaacaugggucguggcacuggagugaugggucaguguuuuaagaguauggauuacucuugcagaggacccaaauuugguucacaauacccauguuagguggcucacaacagccuauaacuccaguucuaagggaucugauguucucuucuggauucuucagagccuauauucacacaugcauguguacacacacacacacacacacacacacacacacacacacacacacagagacacacuuuaaaucuagaaaagaacauggaauaauuuugcuuuaaauagguugucagcuccuugaagucagaaaucaugcuguuauuuuucauauuagaguaauaucaugaacagauaggguaugcuagaacagucuuucccauccuuggcuccaugacauucuggugucauuuagauaguuuauuuuguaggugggacaucugaacaugguaggcugucuacucccuaucugccagcaaacuccacaaugucuuuaggcauugccaggugcucccaggaaggaaaggcuccccaugaaacgccccugauacaaggcagagagaaacuucugagcuggaaaaagacuugccuucucggagaagggagugugcuuguuagagaacaauaagguuaaacugagaacuuucaauuuugcugagauacaggaagccacuauaaguugaaaaaaaaauaacuguaaugcacgccaggguuaagagggaccgagaugaugagaauaucuaugaauagaaguaaugaagaacuuuguuuuuauuuguuucauuuuuaaucacuuuauuuuuaggcuuugauugccuauaaaguaauucauugaucuuuaauaagaaauuuaugucuuuuugguuugugaccauauuguugaucaaacccaggucgcccacauucuaggaaaguauuuacuaccaagucacauccuagccuggaaaacucuauugauuucauagaaacccaguaaguucagacuaaacguuuuguugacuuguacuugagagaguacguuugaaauugugugugaacauuuuuguaaaaguaugugugaccuuuuuuaauuauuugagcaguaugcucaggugacaaaguuuuucagucccaagugaugcauacaugauaaaugcauacaugcauguucauaguguaggcugcagaaagaaauuuuuagcauaacuuuugcgacuuuauuguaaguuguuagugcuguaucgucacacuggucugugaccuuagcgcuuuaugggggcugcacugcugacccaggauugacacacacuguccucuuuccacagcugugugucaaccacagugcaaacacggagagugcgucgggccaaacaagugcaaaugucacccuggauuugcugggaaaaccugcaaccaagguaggcaaaccaugugggagcccuggcaccucuauccuggacacauaaagaauuccaaauucugcccccagccauuuucauagcuguuucucccaacuaugaaacaguuaaaaaccaaaaaaggaugguaaaucuuagacaaauauauugucccaaaagauguucccguacuuguguucuuggauacucauuagaauuuguuuaugaagaagcaaaugguuaaaucuguaauuuaauucuuauauucuggggcacugagagggaucagcaaauaaaagcucuuccuggguaagucugguaccuugagucugagccuuagaacccacauaaagguagaaggagagaacuaaauuuacacaguuguccccuggcaucuacacaugugccauggcacacacaccccaccaccaccucauauacacaugcauacaaauaaaacauaaaaauacauacauacacacacacacacacacacacauacauacauacauacauacaguuuuaagucuuacauucuagaauuucuucuuccuccacuaauaaguugguaagccuuuuaggaagugggauaccauuuguuauacuuagguauauagguaauaacaaaacugaccccauuugaagagaccaaaagucagagauauuaggugucuugccuaaguaaacagaacuaguugggaaaagcuauguuggcuucgagcuauggcuuacauccucuguauucauuuugcuaugcuagucuucagugaaaaauugcaacuggaaacuugauuauuugacucuuccuccacagccuuccacacaagacuccucuucuuaauuaacuaugccugcaaaucucaacuguuagaguuaaaacgcuaaaaagaaagaaaaguuaaugucagcuuucauuugcaaagauaagaguuauguuuuacuugaagacaaaaaauaagcucacauaucuuaaaaacgugugacuuuggugucccuguaaagacagcagucagggugcaucccaacaggccugguucauucuugggcagcaaggaccuuugcagccucucugauuucuggguuccuaaggaauguuggcaugggacucauaguugcuaagugcacauuacccacuuaguaacagauucacacaagacucuuggucuuaagagucauaggaaccuaagagagucccguggagauuuuugguaucacaccuuaugccuggguuagugugugcucagcuugaagucccuauaaaccuuaccaaagcaaguugugcagacuuaccacacaauaaauuaacugcuuuuaucuagaccuacacauuuucaugaaguagaaagcaugcuucagagauagaggaaagucaguaagcaguaaguuugaaaaaaaaaaucucacauaacuggaaauuagcaugugaucaguuaggcagugggguaagguaaucucagugcagguaccaucugcuucagaagcagccgugggaaccugcuugguagaauaaagcucucgaaugaauaacagacacuaguauuugagagaugccugggcgcgaccagaacgggagggcaaaccaugcuuucaacuggcuggauuuaaaagucuacacacccaggcugguggggggugggggugugucgcuccucccucugagucauuuucuggacuuguugcucuaaggucagcuaugaacguaugccuuugaaaucauuagcguacucucuaagacacgcacugccuuuuacaauggauggaauucaaacuuaaauucugacaagauuaucuuuaaucacuugcucccccacccuuguuauucuccaguaauguuauucaugccuauuuccuucuccuuaagcaucuuuacccaaacaaaucugucccaucaaagaaagaauacuauuuuaaauaauccuuuuauaguugucuuacuggagaauuccuuuuggcauauaaauuacaucaccuggagauucuaagcacgcaaacauaucguguggucauaauuuuuuuuucuagaaauuaagacauucuucuaaaugaacacuucauauuaauuucagaagaaaucauuuauaaguauugauuacuaacuaguuuuggauugguuucugauccauauguugauuuccucauccaaggaaagacgagcauagaaccacgacguagagccagacauuguuaagucuggguguguacugcuuacagcagcacgccgauugccgagcugagcacacugugagugcuuucaccuuaacuaggguauuaucaacaaccuugcuuucuaaaaguuccaaccccagaaacaaaugugccuuugauuuagaagguuaagggaccgauaaacagcguguugugacacagaaagccaagaggcuuccuugacuuucgacauucagcuuugagcccagucaugucgccguaguugguuagauaucaaagguaacagguagcauugcuuuuuaaagugucugaugugcauucuaauucaacguagcguaaguuuuuacuuuugaauaaaagcaugguggucugucaucuuaugauuuagggaaaguccauaugcaaauaagcauuugugcauugcuugggaauauuuuaaacuacuauuagcaauguaacaauauaugauaacucuuaaauuggucauuuaaacuuuaauauucuaaacaggguuaguugauuaugucaauauuuguauaauuuaguuuuauugucuaacuucuguugaugaacgugacaugcuaaucuuauuuuguuuuuuaauggucuaagaaugguggauuauuaauuuauaauuuuucuuuggaaaggaaggugacuaucagaaauuguuagagagaaaauaaagaaagagagaaaaugguuggaaauuauuugugaaguagccagagagcccuauuaagcuccaucaacauuuuguaauuguuuaauauauacuugugaagauuuuuagggcuagaaaugacaucaguucaaagcugacucuuauuaccuucuccccgcugugaagaugaguccuuccacccaacuccucuugaccaaggcagugaacagccucuuuuccaacccccggaucaucaagccacaaauguaccuucaaggggugagcgugcguugucucagguagccgcuacucucaccugcaaggcuuccugcaguuaugugacuucuugcaaugaaggcuggugcagagaugcccagccuucagccugagcaugcgaagcaggccugggaguugucaccugcugcugauucucugugcccuggaaagcagggagcuuucucuccucuuccuguaccacaaauggcuacuuuccccucuucucugaguuuggaaaccuucucccaaaaaucagauugcaagauagguuuuguuuucguauuuaggaagagucaauaauucuucucugaagcuauggguuucgaugacuuuuuccaguagauuugaaaaggaauguaaugcccuucuucucuuacugucugggauaugggguuuuagguuuguuuagaaaucagaccacacuuuggcuccuuccuuuuggugcacacucuguaauggccaaagggcggaguucugguccuaaucaguuguuccuugguagucuguuggaaacaucucaguuuuaucaccacuguguagugggggacaggaagguagcucuugcccugcuugucuguggggcugcugugaacccggucacccggaacuguuuuguagucuccauagugaugaaaacaucuguaggggaauaaggugguggcaggagcacucuccaguucuagauuuuaucuuuacccgcugaugugcuuaacucacaguaacugagaucgcuggugaaaaauuguugccucugcugauugggaacuugcuaaauuuguacucguucuguacaaggggccagaacguuggcauucguuuuagaguugcucauaauucagagaguuauggccgucgauauuuagacaaauauucaccugugacauaaaguuucaaagguuagauuucucaaauaucauccaauuuaagcaucaaaggggaaaaguccaggugcuuuaaagugaauggaagguggcuuucuguaaaacuccaguggcuucccuaggugagggcuuucucccagguuuuucaagcuaccuuucguugucugcaugcuaauacaguuucugacucucuuuguccugaagucaaauaaugacgcuaugcagcuugcauuucuguucugguccagcucccuucucaccccaccuucccgcugcuagcuccugaauccaccagccugcuuaaauguagccgugaugauaauguucuucaugaauuauauguguaguauuuaaagugucuaaauauaagggauaaaauuauauccuuuaguauaagcuaugugcaugauagaauucguuauaauuuuauuauagaucuuauacuaugcuuccaggguaagauuaaagaaaccuuaaaauaaaaacacuuagguuuauuuucuagacucauguaccaacuuuuaaauuucuauaagacagugaggaucacugggagucuuucgugcuuguuauaaggacauuuaccauaauuugaaagugucauuuaaaacuucugacuugauuagauaaagauacagaugugaauaccacauuuaucacauauuaccucaauuuuguaaggcuuugggucaacagagaaauaaggugggauaauuauacacuggaaacccugaggaaaagaugccaggagcuuugcuguucccaccacaggcuggacccccuguuuuccuaggccugucguaguucugguaagggcacugugagucuguuggagauggggccuggcagucaucggggauauuaacauaacaccaaccaccugucaagggaaugccauccuguccauuagcagcugcuagagcaauugcucaaguugcuuuuacaugccugaauuauuacauagcuuuuaauaucagguaauagaaccaauaucuccuaauauuuauucauugaaugcuuucuguuuucuuccuuuuccauauuuuuucauagaucaaguuuucagauuuuuuuaaaaaaugacaguuugcuccuuuuuuuacauaauauuuuuauugauuauuugagaauuuugcuucaugaacccugaucacacucacuucccaguccuccuacuuuugucaccuacccagaaaagaggaggaagaagagggagaggaggaggaggucuaggaggagaacgaggaggaggaaaaaucaaguccauugugugcacacuggagcauggucaaacucccagugaccagccccuuaaagaaaaccgaguccuuccucaugugcaccauaccagagccaucaguuccggagagcuacccuucagcauccuuaacauagcucuuagcuuuuauauccuuucgguuucaugauuccuaaccacaaaacacuuuucccaugggaaggaaaagauaaauauggauuaaaggcagucuuuaagacgucuggcaagcaggcuggauucccaaagucaugccuagggcuccaaugaccagcacuggaccagauuguggaggugccgccucuaauuggcuucagcuuuaaguaggggcgggugucagagagacucacucccacuggcaucaaauacuccuggcuugugagcuugcccugguuguaaacagcugcugguucugguaagaaaccaccagaaguuucuguugcucucuaaaaauaaacuagggaaucuuaauugacacucuaaaaagccaucaauagccuucucccgaaauacagagucauaucuuacucuacucuguggcguuugaaauaagauucucucuuacagucaacuuuauaaguacuucauagggugucucccgggagccaugaagccagcgugaacuggcaggauugauguuaaggaugaugagaaaacuuuuaggagcuaagaaagaguuuccugaugcaaaugcuuaauacaguuuuaaauacaaggcaacggaguaugaacaggcaggagaauuucacuccaggcagccaugcuuguuccugcagcuuucaacggagagagaagucaacuuuuuugauacaacaaucuacauagcaccuucuaugaagagggauucuuuuuuuaaacacuuaaaaugugguucuguuuugaaaaccuuugacugggcaagagacaauaaaaacaaaaaacugaagaaaacauaggaaauggcauuugcuguguuuaucuaaccuuucuagaaucugcccugcugccaauaugcuugcacugcgguaagggcagaaaaaaaagaccaaguuggaaaguccguuaauaugaaaaauauuuugagguguaauauuuauuuggugacuuuaaaacaugguauaacuggauguuucagugaggcuaucacagaccucugggaaaggagcagucagauuuaacuuugauuagauuaggaaacggcuugguagcuagcuauacuaucuguguuuuuauucagugauauggauaaguugaucauuaaauuaugcuaaucgggcacuuaugcugcuguuuccagacaaagugaacauguggucacauuucuuuuuaacgaggucuauauuacgagcauuacuauuucauuguuuuaugucauugcgaauuuuauguucacuugaggcaguguacaaauugugcugcaagaacuuuuauauuguggaauucauuaauuucccauugauacuuaagccaauaaacauaaaauacauaaugcuguuuugucccuuagugcucccacaugcuccucuuaacugccacacgaagggaaacgugucgaaaagcuuuaaaaucuuguuuugugacugaguggacuagugugcagggggcugaauuuucuuuacucugaagucaguauagcaccuaucaaguugaacaggaaaacaaacaaacaaacaaacaaacaaacagaauagcagucagucugaucccugcaggguuuuucccuucugaaaacauagcugcccuuugaacaggucagcucauucugauguuuuaacaauuggcacauucucuaugaagugaaacgugucauguagcauccuuuuuaguagaauccauuagcgagaguggcucuaaugacagagcgcagguacugugagcuuaguagcagucacgcagacaacagagcacccuacagacaagagagcaugcugcucuuuguaggaauuacagacaggucuguaauuagaauuacaggucugugaggagaaugcucccaacugucccuaaggcucagagauccauaaagucccaagcagccucugggugcucccaaugugguauucgaguuaggaugauaugcacggacuuuuaucugucaccgaagugaugcuuucgcugucuugacccauuuuugcccucaucuucuccacugagggguguuuugaacguuucccagcacugccaaggcugugaugucucugauuuaaccccucacuguccgcagauuuaaacgaguguggccugaagccucggcccuguaagcacaggugcaugaacacuuucggcagcuacaagugcuacugucucaacggauacaugcugcugccagacggguccugcucaaguaugucaagaaucuuaacuguuuucuaagugcucuaggcuugauuucugacaugcuuugguagccugccucuggggaggcugccucuucaucuccacccaacaggaugugugagcguguuugugugcgcgcccgaggaaugaaagaucaaaaccagaggcgcacauuuauauacaugacauucuucuuauugugcaggccaacauuaaauggguuuauaaauuguaucuagagcaggaaucacaucuucuaauguuuuucucaguguguuuuucccccguguucuccaugucaaagaauuuuaacgaucacuggggcauugcuuagagagaauucaucuggucuguucaaaaauauuccucagaccauuuuuauaagaugauuuaagaauuaucaaaaaacuguuuuaaguggaaaugaauauaacaucaggaaaaauuauuauuauuuuuauaaauagggucucauauaucccaggcuagccuugaacaugauauauauauacauauacauauauauauauauauauauauauauauauauauauguauauguauauauauauauauauauauauauauguauauguauauauauauauauauauaugggaauggucuugucuuucuuccaccucccgaguguugagauuaucggcaugcacggccacauuuggucuuauaaguugcuagaguuaaagccuucaugcaggcuaggcaagcauucucccaacugagguacauccccaggccuaagaggguccauuucacgugcaucuuuaucagagagaauugugugaugcucucuguuaucacugggauguguuucuaagauggucacuacccuaaaggucucugcaggcugaaaauuuauguuucuauuaucaucaacaaguaguggccugauuuauuugaauuguauauauaaaaugauaguaccuaauuuuauuuagugcuacacagacauaucacuggaacucugaguugaugaaaauguauuuuaguugcaucugaccaugguuccagagucccguaacacuguggggcucuauagggaaucuucuuuuguccuguaggggguuugacuauggagcugagacaguuaauuugguauguugguuaggaagagcccuuaacucaagucaucuggagacagaccucaguuuacccugaacagucugugucagagaaaguuuuaucucuaccugucaacccuuccaaagcaccaaaggggaugacggagcggggcuacuuuuccaucaucccaugguccgagagcaucuucccacccugcuucgcccuucuuggagggcugguucauugacucucuguuguugaaucgcugacaccuauuguuggacacgugagaaaaguacacgaguuacagauguuuucuuccuccuggaggcagccgcucacccacucucuucccaggugcccuaucguguuccauggcaaacugucaguauggcugugacguggucaaaggacagguccgaugucaguguccauccccuggccugcagcuagcucccgaugggaggaccugugugggugagugcacucgggaagcauucugaggagaugcuguggggugaggaaggcagccaaagggauaaggaagaaggcaguuacuuagucaggcguguagcugccuuccuggagauaucugguauuuuagacgaggauuccugugaauggaccaacacaaucuuauuuuugaaauccgaaggucaggaagaagcaugagacagaggaaaccauccaaaugugcaaaaacccugcaggaaacagagcacuggguucaggaaaacuggaucucaguuucuguagcccagagggaagagagcaauggagcugagcaggucaccaaggcuacggcauuacauggguugcaucacgcaucacagggcauagcauuuucccacaacauugagauggcaguuuagaucauggcagaguuuggacucucucaaccuggcugagcugcagacuagcuaugcaaccuuaguuaggaaaagaacuucuuuucuuugagcuugggccucccuuucuuuagaaugugauuaacacaagaccauugcaaguggcgagugagcucauguguuccaaaaguucaaaagagcucaguagagucuccugcaaggagcuagucacuaauuaagagccauuuacuaagcagcugcuguauucaagacacugugcuaugcuggcugcauagccucgggcaaagcucaugagguuuugguccuuaaagaagugacuuccuaccggggaagacagaacguuaauaauacucaauaaaauuacuggcccugccaagugcuagcagaagaucguaagagaaacaaaagggccugucuuagaaaaucauccauaggggauuccuaaaguuagaccugggccauuagcuacagaaagaacaugccaagggacuggaaaggcaacuggcuaagagcacacgggcuaaucuuccaggauucccaguacucacaaugcagcuuacaaccaucuguaacuucagucccagggcauccaacugucucuggcuuccauaggcaugggcgaugcacaugguacacacaucuacaugcagucaaaacaguauacauagaaaauaaaauuuaaaauaaauuuaaagagccuguagagaggugaaaugacuggaggagauaagauuggcaguccaauuuccagacuucuuugucucagucuaaagcgagggaugcuggguaggaaugaggugguugacagugcuaggcagguuccagcagucuuuuagaaguagaaauaacaggauuugguggugguuuaggaguuguaagcgaaagguuuagcgugcaugcuuaguugaagcaacuaaguagauggugucguaucuacugcuguugguugugagcgcagaagaauucaguuuaagaggaugaggggaaaccuggagaugugcaauuuuuuguuuuggggauguuucgauguggagugugaugccaggguaaccagggggauaccaguuauaacaggcucccaucuuugcucuuucuaagacgugauuaacauguguuucuagauauugaugaaugugcgacuggaagagucuccugcccucgauuuaggcagugugucaacacguuugggagcuacaucugcaagugucacacugguuucgaccucauguacauuggaggcaaauaucagugccaugguaaugaagccucccuuccuuguguacucuuucuuccuguagcguugagaagucuccagcuguggucacaguuggacugucgggacaggggaggggaaaggcacugaaugagcaauguuaccuuaacccaccagucauucuggagccacggguacuuuucuguucucugccauuuucuggggaccucuguaaugcuguuucaugucaccauuguuaccucugcagacaucgacgagugcucucuuggacagcaccaguguagcagcuaugcccgguguuacaacauacauggguccuacaagugccaauguagagauggauacgagggggauggacugaacugugugugugaguaacgcccccuccugcucucauuucuucagggaauauggggucacauaaaggccauugccaaggaagaugagggacacaauugguuauugaaggcgcgauuuuucauaccuacuaauaucagccugguauucuauaaacaguaaaaucaaccauuggguaacuuuaaaaaaacauuuuuaaaaaaacacucuaaagcauucuaauuuuaaaaucuuuagaauuuccugaguaaagucuagggguugcuuccuuucggcuaggaaaaaagauggagcccucuuugggaauuagagcuuguugaaucggaaauagaaaaccauuguuagcauugcauugugauaucuggauauauucuacauguuucuuuauuuugguuuggugccucuuaacucuacuacugcaaauaauuccaauguuuauuuucucuacauuuaaaacugcuuugcuuuuagauuuuccuaaguuaucuuuggaguaguggguuaccagauaaacaugaaaaaugcaugcucuugaagaugaaagguugacaaaccaaaggccauaauuugccacacguuucaucuaacacuagauaauuuuuaaaaauuuccugaguaaaauauuuacugaaaaaucacagggcauaaaauccuguggguugaagggcuguugaagugucgugaagucauuccuacucuggaggcuaucauucagggcagauuaaauauugauucuuuuuggcgaagauuaucagugggaaauauuccacagauaauuuuuuuuaacuucagaaaaaugucuuuuuagaaagcaaauauaaauuagcaaauaugaagaaagccaacucuaagacuaauuucuuauguaaguuacauaccucuaaagucuaggugaggaaagccucugccuagcuuguagauuucugagcacaguuacauaacacacaggcaggcggggacgcagcacagacugcauuucucaaaaaaaguaugaucuuuccguauuuugggaaaauacugaucucuguugcuacugcuuuauaaauauugaaaacauuuuuuugugcgucaaauaauacauauucauuauagaaacagcaauauauuuuugcauguauccuaacacauacacauuuguuauucagaaaacagugugacuucuuauagacaagacaauaaauguggaaaauagggcucaauugccaugagguguuucuguguauguguuuugauugcacuuuccuguugcaguuuuuagagaggaauaucuucaugcuaauuuucauuuuuugauuucuuuuuucagauauccccaaagucaugauugaaccuucagguccaauccauaugccagaaagaaaugguacaaucucaaagggugauggaggacaugcgaauaggauuccugaugcuggaaguacaagguggccccugaagacaccauauauuccuccugucauuaccaacaggccuacuuccaagccaacaacaagaccuacaccaaacccaacaccacagccuacuccaccaccuccaccaccccucccgacagagcccagaacaacuccacuaccaccaaccccagaaaggccaucuaccagacccaccacuauagcaccugcuaccaguaccacuacacgaguaauuacgguugacaacaggauacagacggauccucagaaacccagaggagauguguucaguaagucacacaaauuauuaucucuuuaaagcucuauguauuguauuuuagguggaugaguguuuugccuucacguauguaauguguacccuggccaugccagcgcuggauuuccgagaacuggaauugcaguugguugugagccaccauguguguucagggaaucaaacuuggguucguugcaagaacuaugacugcuacuagucaccaagccaucucuucagccuuuauuaucaccuuuuaauagauccuuuaagauggcguucaacucuaggcaauauuuuugguaaacucaacugcuaaaaagaguuagcuguauaaggcccauucauggugauugaugcaugguaaaaagccgugugaagagucaguaugacugggcauagggaggaauguguguaggucgggaggacucuuacaaacaucaaguagcagagcacagaucgguccacuguggggauucccacaugauaguguucaaaugugggaaacuuacuaugccuaaugguauuuaacuuuuaaccuagcuguccauucauucagggaagaauuuugagcauccuuuggaggcaacagacuguguuagauaaacugugucaaugagugggguuccuguagacuguuaaaggaguggaaugaaggggucagauugugcuaugcgacuucuauggaucccuaagugaaacuggacagaagguuugagggaggaggggcauucuagcuaaaggaaacagagaaaagagaacgcaggagccggaagcaguaaagacagucaacuggaggguuacaugggcguggggguggggggcugagcaucuccccucauacuggcuguuagcugguguggcauggagaugggucacaucuaggacuccuugcccuucacagguacagagcagaggguagaacgcucaguggggacaggcgaguggggaagaaaaggcccuucucucauccccagacugagaucggcauaggcauacugucuacucugugucugaucacuugcccggcugcaguucacuucugauuggcuugcccggcugcaguucacuucugauuggcuugccgggcugcaguucacuucugauuggcuugcccggcugcaguucacuucugauuggcucaccgugcagucguaaugcguaccucccuugacuuuuauucauuaccaguuuacucgaugcuuuuuuuuuuucccaugauggagcuaaaaugucacuguauacuuucuuugacauaaauagaaacugaugcuuguaauuuguucauguguguguguguguguguguguguguguguguguguacacgugugugccaguauucauccacuugaguaggugugcauauggaaaccgcaggacaacuuaggguguuauuucuuagguacagucaaccacuuuugucuugugagaaagggucucucauuggucuggaauugcccaguaggcuagcuaucaagguacagggauccaucucugucugacucuucggugcacuggugguuacaaacguacauuaccaggccuagcucugcauuuucaacccaguuuccagggguucgacuugagcacuguacugacugaaccaucuccccggcccccuaugacaguuguuguucuucacaagagaagauguaaggugguuuuugccuacauaagauuaucaggcuuuuuuguuucuuucuuuuugguuguuguccauugaaaggaauauugagauucauucuauugugguagugcauguuuuagaaaaucugccuaaguuuuaggagaauuacaugguagcucucaaaauauacaugucauaugugcauguaucuguuuuuuaaacugguuuuuagaauuuucucucuguguucucucucuucccuccuuuguauuguccuaucucuuagugaucauuauauaaugugauauuuuaacucaugcgucaaccaauuaugacauuuacguuauuuugcugccuuuauuguucauaaaauuuuggcagcauaaauauacacacuaauugagaagacaucuuucugguuauuccuuuuaauaguuuuuuucuuuuuaaagagcucuucuuaaucuuuucucuccucacauauagauacacauacaggauauaaaaauaguguugacgcucaccagugggaccuggugguauaggaaucggguggagguggggcacagcucuggugaauguucagagcgccggcugugagacagugugauccucaggagaugccccaggaggucaccuugaucccgugccagggcugucacaugccacagauagccuugccagggacgaguucacugucccuucaucuucagcaaugacuacucuucaguuugguucaugcaugggagaagauucuggagaugucuuaacuugguuucuugugguuauuacagauauucugaaaagugaaaagcuaccaagcuuuuucuucagaaaaaaaaaauuaucuauucacugugaaaguaaaaagaaauguuagcacaguuuuagcucaacugagguacuuuauuuuaaaaaggacuacauggaaggcagcacucugucucgccacgagcuuguguccucugggccaagucuucucucuccugguuuauagauccaaaaucuaccauacgcccauagucuaggugauugugaaauauaauauuuuuccagauuguuaaaaacauaaucagguccuggugcuguauaaugaaggauccuuuccaugguaaaauguauugauguuaacaaaaaugucuuuuuuguuaacauuauauagauguuauccauugagaacaguuaucucaaagcaugugucuguuuccuggcucuucaaguuuguuaaaaugaaauuuacuuuauaauuuuauccuacgaaggucugucuguuuaaaaguucauuuuuuuuaaugcaagaaaggcuuaugaaacaacgugggcuugcaaagaguaccaucaacaccaacauuuuguuccuuugcuauugcuacaggagaaaggacacagaauugcaaacuuuuauuuuaaacuucaaguaagugguuuuugugauaaucaccauagccucugggcauuuuaauuuggggccuagaaacauuacgaaaauaacuuuaguuaaguauccaagagucuucuuauucuuauaccacauagccuuacgaggaugcuuaagucacccccguuauauccaacuuuccuucccguagcccagcucagaacugagacauccuuaugccucaccuagauuuaugaaaucauaacauuuguguagacucagcgguaauggcacucggucauuguuuuaagacucaccucccauguacuuugaggaauacuucagaaaagaaaccaccucuuucgaaguaguuccaguuuuguuucuuguugcagcugaauucuacuuccugaucgugauagccuuccuuccaaaugacccguuauugcagauuacaguuuuacucuuaccucauauaggguaacauggccauuggcaagaaacaugcucuagaaaauucuacauccagugugcuuuuaagguuugagccugguguugagaccuaucauaaacuguaggaaaagaauaugaaggcaggcugaagcacuuggaccggauuccccccaggacgcuuuuuacaauacgccgagucagaaagccugcuuuugcuuccuaucgcugguauuuaugaguuugcaacuuugcucaaaugcucuguuuacugcugugaugagugauggauagcccaggccuucuuuuccaccgagugaguucaaggucagagggaauucagguaaaaaguguaugaauaaugauuacuuacuuacuuuaaccauaguggggagaauaaauauauuaaaagucaccuuucauguaggauaugaaauauuaagcaccuguuucacaauaagaauaaucuagggcagugguucucagacuuccuaaugcugucacccuuugauacaguuccucauguuguggugaccccucaacuauaaaauuauuuucauuucugcuucauaacuuuaauuuugcuacuguuauaaaucauaauaguaauauuuuuggagacaaggguuggcaaaguggucaugaccuacaggcuaaggaccuaagccuaaauaagggauccuaaagauuuuuuguuaaaugggacuagaaagcuaaccagaugcauuuucagagcuaauuggaaacuagcuaauagacugguuugaacuguacuaaugucccggacaaagugugacguuguuguucuuucaucacugggucaaagcaguguuucucuaaguguguuucauaggccauuagcuaccugaaacauugugcaaguucugaggacaaauacauuaagaaauaccagguucagcucugcuaucaagacguguuagcugucuagcuccucaaaccuuuaauguguuaaugucacuguaaaucucuaggggaagcccccuacagaguguaacaucuucagauagauuuaacuaugggaucauuucacucaugggauuagaauucucuaccaccaguugucuggucaggucuuggcugaacuaggccguuuggagcccacucaccacgguaaccaagaguccugacuaaguagcuugcauggagacuaaugaggccguucuuagauaggcugauggagagaauccugaacugagcagacacgagcagagaaacagauugaaaugcuagugugccuaucuggauacaggggaucacuagaaaacggggacuaaacacaaaagcaagacccuucuguccacagagguaggaagguaagagcuccguaagagcaaagacgauaaaggucuuagcagaagaaguugcaggagcaugcauccugaucucacaguauaauaaaugaaaauuaaaaaagacauucauuuuaaaaguuucuuaggaaaauauccauguuuaaaauauauuaacugaaaaaguaaaugcaaaaauauauagagaccauuuuaccccaauuggauauaaaaauacaugccuccauauguuuggauguauaugaaagucaggaagaaagaaauuccuaaguaacaaccauuggcuaugugaugguccuggugcuuggggugguuuucauugccugcuuguuauccccaugcagugauuuuuaaauucuccguugucgucauuaaggauaaccaugauuuacuguaacgaugccuccuuaggagacgguagugguaauagacuccagcucuccccaaggaagagugaagaaugggguugucguuuuugagaaaauaccccagggaguucugguucuuaaucaugccaguuucaucugaaacauuucuaguuuuccaaaaucuauuauggguuuuauuaguuucuaacuccuccaaaaaugucuucagaauagaaugcgccauaacuggccaguuucagccaaaagauucagguuacuaaaugaauagaguaucaguugggccagcacacauauuuuuuccccaaaaaaguguuucagaauucagguugaacuagaauaaacuaggauacucacuuaggguuucucugguguguaugcacucuuccgcacugucucgggucuucaguguuuacagauuauaugccggucuuauuaaaauaaagaugcuaauucaaugaggauaggaaaggaucucagacugcauuuuucacacacucacagguaugcuguugcuauauuugcaggccaaauuguguggcaggguucucuaagccccaguggcaaucucuauccaacagagccacgucuugccuaaauacagaauuagccagauguaggauguucaaaauaacaauaauugcaaaauagacaaugaccauccauaccguguaaaacaaagggaacgguguuauaggcucaugauuauagacuauaagguaauucaccucugccacauucuuuuauaaauggccgugucugaaaaccagucuuguugcugccgaacaggcgaauggguuggauacccagguagcaaacaggaaauggaaaaucgcucccguccuucugagcgcugcccuguauguagcaccaugcugucccugggguuuuuguuuuguuuugucuuuccauuauuucucuuguacugauuuuguagucuguagaucacaacguuuuaagccauggacauauuucagucucucuucucaucugggugcugauuauuucagcagaggggugagaagguccucggacugugagcugcagaagccccaggaccacgcuaacgucuccccaagauucaaucucugccaguuauuuagagaauuguguugcugcugcacacaggucagggucuggugcuauggauucugagaguuuuuaagauuuuuugauuuguauuuuaauaggauuccguggugacuggugaagaaaaaaaugacuccucuuagaaaguauaaauugaguucuuugcgaacgauguguccuggguuggagaucagaaauguuaaaagcuccaugaacaauuguuauaauuaaaaggauuguguuugggacauguugccaaauucuuccaucuguuucugcaucggaucauugggguaguuguuguaugcacuucacugggcagcuuugugaguuagaugggaaggucugugcaagccacaugucacagcgauugccacauaggaacauuagcuguuucuaugaccacugaugcuggauucauuuguauuguaauaauagccuuuccuaauuauucacaagagaagccauauauucuagugaugacaaaacuuuauuuugaugcuuuuuauuaugguucacugcaguuuuaaugcuguuuuuagccaacgcugucuuuucaaacugaauugauuugauuuacaagugugagcagagaagaugaagauggaagcgagcugcuuugcaugugcuuuguguauagaucagguguucauagcauaugcgaaguuaagcagauguuaaacuagaggccacacccccaccuucuucacgguggguauaaugauaguugucuccuggagaugaaucugaccagauggcaagcuuaaaugaaagcuuugaugagguagcagacauagaagcaccccuuccccuuuugauugaugguuuggaugagugggccacaccucucucauacaguaggcggguucuauacucagguguguuaugcucaccuuuucucagcacccguguggugugcacaccggccugggggagccuagccuuuaugguuugcuuugguuuaaaagagggcaggaggaccaagccugugggauauucucuugauucuuaaaaccauccuuagugaagaaccaagauuuagagucucagucuucuuaggaguucccugccuuugaguuccuccgaaacuuucuaaaagucacaugcagucuauggaggaguuggggucuguugccgccacaagaggcucauugcugagcaacugggccuguguucagcuuucaccagggagguaaguuuuacuaguucuguucauuguucuuagguugucuucugaccugcacguccacccuaugggauaaagugcuggcaauuucuauaggggcucagcaacccuguucuugugucgaguaaccaacauuugccuaagacauuucuugaauaagaauaaggaaauugcaaaugcguuucugauuuuuuuuuuuaauuuucuucucucugcuuacuauguucuacguuuggagugggagcaggagggagaggaaagaauacugccccauaaagccuuuaccguucauuucugucuuccacccuguugucuuuuaaaauaucuagguggguuuucccccaucuaaaagacaugagaauagaauagaguuagauguauccauaccucucgcuucagugcagcaaaccucuaagcauagaaagaauucaagacagggguuaucuguuaucuuuaguccaacaauaaacgucaggauuggccuggacaaugucauacaaaccaccuuagacagaaccugaguaugaaaaccugccuuugaggaagaaugcugacggguuugcaagcagcuuggcagugggagguaugugcaguuauauuuacaucuucuucucuguguuuacucuugagguuuuacuggguaaaaacugcagaugacugcuugagaaaucuuauucaucaauauagacuauauguggauauggucacaguccuggagagccugcacacaauagacugggacagcaguuuuugugaggacagcuccuucucacaguugcuuuuuuccugaugggcaccaggacucugcagccauugugggagaguccuguguccuuagccugcugcaaucacacuugcaucccuuagucuccaucuuugggcuuaguacccucuauaccccacaguuguuaucauuugggauuaguaucaucaguaucccacagucuccauaucugggguuaguaccuuauuuuauuuauacagauuauaguucgaaauaacaggcaagauugaaucuaucuaucuaucuaucuaucuaucuaucuaucuauccauccauccauccauccauccauccauccauccauccaucuauauacaauaaucaagauugauccauccauccauccauuuugagacugggccucacuauguagccuggguggcuuguaacccccuauauaggccacacuggccuugaacgcacgcugauuugcuccccucugccucccaaguguugggauuaaagccgucuaccaccacaccauaagaauguuuuuguugguacaauauggaauaaugucagaaaaauuuuggagaacacuuuuuaguaugugaacauucuuuauaguaaaugugguuacucauaaaugcuuucuguuccuaccuuccuccuuuagcagugugaugauuuuaccagguaaaccuucccuaggcaccacugucaagcucuuugagugucugauuucuaucaagauaaaaauccaacauuucagcaaggcuuuaaacagucauugugcagcugcaguuccguuuggagcuuuucuuccugugcucugccucucccccaagcucuccggcugacuggggguucacccuuuuacucucccgggccuuccaucaugaaagucuuccuucagaucuuacuacaaagcucacuucucagagagcuucagcaucuccccuuccugggugagcuuugucaggcuuuacgugccauacccacaccuaagcaccucuuccauuaaaaccccauuguguccaacuuugccucaggaauguaggagaaggauaccuuuggaauggaugaagguaggagaaggauacguuuggaauggaugaagguaggagaaggauauggaauuugauacuuuccuggugcuuuccagugcccugcaccucguggacacugcauuuugcuggauuacccagugaguggggaacuuugaaggaaaggaaaugaacagacagggacacuuguuaccaucuuuuauucuuuuuaaucguuauuauaccauucugguucuaagaaaguaucagauauguuucugcuuauuguguaucaaaagugagcacuaaccaaaauaucacgcaaggaagaguaguggaaaacauguguaaaucacugcucaucucuucucagauauuuuaauuaguauuuucuacauucauuaagauugcucccuugaaucaaagaaagcauucggauuucacugacauuucaguuuuauaaccuagauuacaccagacaucaagacuauccagagcccuuugaucaggaugccaacaucagauguguagcugcuguguaucgauguccuuacaaacaccuccuucuccagaucacguagggguuguucauauuaaaacuuucuccuuuuaacaccucaaaauauaaaaauuuaaaagacuaaacaaaucagcaaagauaaaagucacuuaauuuucaauguucagacugccacauuauuaauguauuccugaugggccuauuuucuagucuuuaaaaaacauuuuuaauguguuguugagacacauuaaaguguuucaaguuuccaugcuuauuucagaugauacuuucacauacgauuacauauaucaggcauguacucuacccacuguugacccuucaaagugauguucuuagugagccaccaugcugauguggugaggaaaggcaauagccuggcagggaucagagcggagcacacagcgcucacuguaagcauagaugggugcugaucacaucagguggguaaauccuugggaauguguauccgugaucaucacuguuaauuagauaauuguuggaguugucuggucuuccagagccaucugaggcuuugcuagugcucuuuugcaaaugcuucauccugucccuuucucuuuauccaugucccguggcgcucucucuaucacuguguugccaaagcgucaucuuuaucauccuggcucugggcuuugugccuggaaaguucugccucuuucccuuucagguuacaugguucugucuggagaaaaccucccgcucuuccuugauaaaacagccuccugugucagagcacccaggcacgucaggagacaagcaaaugccaucggacaggccuuaaugggggugggguggcagaacugucauaaugcccucagacucuacaccacagggguugagcuuuuccauuucagagugauuuauguuacugaagaggagaacaaacacacaauuguguucucauauuuuuaugucaugggaaaugaagcacauuuaccuagaauguuguagguaagaaggaaggugcucucuaagaggcggaaaugaggaaaggaaaguugucauuggauguaauugcugucagucauucagcagccccagggaccagccuauccacauccaucuucugccuuagcuuggauuccgucauaccugacaguguaugugugugugugugugugugugugugugugugugugugugugugugugugugugugugguauguccugugaaauaggaaggcacuucuguuuugacuuuugaaacaaaagcgggggaacaguccagauguagugagcuaaauacaguugcaaauaguccaagaucgucaguguuaaaaguccuggcuagcaauaguaacauaacuacaggaggaaaaccugucugaaugucaucaguuuugugguaggcuaugucuuuuauuccuugucuuauaaaaauaaaguauuaauuaaauuucuggcaggagaagggagugaggacucccuggccucuggucaggaauuccccuccugaccauagcuuucacugaguuuucucugcucuaugacccagcuguucuucaaggcaucuucgggcauuuauuuuuuucuuuccugccccuuuucaaagcuuucaauguccauuuaucuccaugugugaugucagugucugccauuagacuucaagcuuguuggucuucuuuacccuccuugcugucuccucggugcccaccaggggguuuggcguuggguuaaaaaucaaauauacgucgcauugaugcuuaaacaaggguuuaauugaaucaguccucuugaagugcauccuuaagcucuaacccacuggugacauuugaugaagcguguugacagagaacauggguuucugacaggaccuuugcagucgcucagugaucacuagguugagcccuggaaaugccaugugagucggaugugauagaugccauugaggaccucagagacuagcagagagauaggcugugugugugugugugugugugugugugugugugugugugugacuugagcuccuuacaaaugcauaggaaggaaauaugcaaacgggacuacugguaaccaguggagaagaauuuaauucuaccaaggguaggaaaguuuucaggguucucugagauuuaugcugagccugaaaggaaggggggcggugcuuuuucagguuaaucagcaggaagaagaggaccaauaccagggcuguggaaaugaucggcaugcuugggcaaggguguguguuuuguuguguggauggccaguacucaccaggaaaccuccuauauugaagcuuacaggagcuggggaaccugcagagaucaggaaggccguggaaaucgguguggacuaguguacacuacugugcagagcuccuuagguguggacuagcguacacuacugugcagagcuccuuagguguggacuaguguacacuacugugcagagcuccuuugagggacggacgugcugcaagaaaccacugaacuauucacuacugugucuuucacagagaggaacuugacaauuuuugcuaaaaauuugaaguuguuucauagcauauuuucacaugaauacuuauuauccuccccuugucugugugucugugugugugugguauauguauguguuuaugugugugcauacauguucauauguguauguauggagaacccagaggucaauaugggugucuuuuuuguuacuacccacuucauuuuuguuuauucauuuguuuuucuguuuuguuuuguuuucuuuuguuuuguuuuugaagcucaaggacaguuuuaugagaggcugagagagaaacaaccaggcaggcaagcuguacauuuccacagccgcuggcuggagggugguggggaugagaagauaaagccaagccucuuacauuguggcaugaagguagaucugaaagaaggcagagcugcaccuuugaguuaaaacucaacaacagcagcagcgacagcagcagugagaacagcggguagcuuuagcagcaaagaucugcgagcaacuaucuuccccuuguuuuuuugagaucaagucucucaccaaaccagaagcuccgucuggcuaggcagagaggccaaaugauuucagggauccuccugucucugcccccacagcacuggaguuauggguguguuuuccugccucagcuuuauacaugugggguagggauccaaacucagggcucaaacgagccaucaccuggcccauuaacuuauucuugcuuagaauuuuuaaaacuuuugaaacaugaugucuuucauuuauauccagauaaauguuggagaacacaucucugcacaacaaauuguacugcucuucauagaaaaugaaaugagaugcauggguuuucuccuugcucuugcuaaagaugugggaucguugcaaggucucauaaaaaaacaaccaaccaaccaaccaacuguuggcuucuucucuuuuguaguuccacggcagccgacaaaugaccuguuugagauauuugaaaucgaaagaggggucagcgcggaugaggaaguaaaggacgacccagguagacacuguuauguuccaauccugaccccccaucccaggaaaauaacuugaaauuguuuuuuuuuuucagcugggaugcaaaauaguggguuucauucgccucaggaaguaccauuguagagcaccagucacaucuacgggacuuaggcaguccuucucuuuuguuguauuugacaacccaguugguuagaucacuugagcaaaaaauaauuaugagucaucaucuucuuuuaaaaucacauuaaagcacuguuugaauugugagaaggaagucagauuuuaacagugacaacccaaugaggucaugagccaucgggaguggucuugguucuguuuucucagcugagcaucuauuccaguugugcuggcaaaagaugcgcgucaucgccuuucaagcucagggcaagguguucuguuggguuauuaagucuggauaggagaaaacuccugcuauacggauaaauaccuauuauuugcgacuugccagcuguuuucuguugaguuugucaucuugucucucuggccaccuccuugcagguauucucauacacagcugcaauuuugaccauggacucuguggauggaucagagaaaaagauagugacuugcacugggagacagccagggacccagcagguaaagucacacaauguaacaccuccuggcucuguuugauccucuugaccauuaaaaaauugccccuauuauguauauuccaucuucuuuaagagagacgauuugcuagcuguccguuagacuccuagcaugaguagucaaucaggaggccaggugauuugccucaaaaagcuugguaaauagcauuuaggcuuguccugcaccauaauuuucaaaauacuugucgaacccaauuccuccguguaaaagcaguaacacaguggccucuccccugggucaacaguuugcaagcauuuuggucaguuaugccccuggauuuguuaaugaagauuugagcuguagaugauggagcaauugaaacugaagugugacaauuacacagcacaguggcccucuggaaacaauuuacuccaagucagauccuagaggcaagaguccaugcuaccacccugcuuccaagagaagcuuauuacaaagcuggacuuagacguggacucucgggaaauuaguagacuuguaaauuauacagugcuuacuaauguaagcauucagggcucauuugguacuuuaccucguuucaagaaggaaagcuccacacuggacucuuccuucccucuguaauuaagugggggguuuuuggugugaagccaacuuaauggaagggugagaaaucuagguucuguuuuuuccuuugguucugauucuagcuucuaaggauaagacacacaagcuauggagggaaagugcuguuuuaugugcaucuaaagcccaguuuucacaugccacagucuucagaauacaacacagaaaagcuagugugugaguacuuacaaucuacccuaacaguggugcaggugaauggggcuuugaggcacacaggucugagggaugguaguuggcuccucaaggaucccaauagugcuaagaguguccuucugguguguacagucucagaaacaaggcuucaaauaacuaguccaaaguacuuucauuagcgcuucuaaaauuuaauuaaauauaauugaaggaauauugaauuaaaauugaaagauacuuaagaauaaauauuugggguaaacuuuuaagauacaauuauccaauaaauugauauaguuuuuaaggucuguugcuauaacucgguggucgugcaugcaugccuuuaaucccaguacuuggcagguagaagcaaguggaucucugagauuaaguccagccuggucuacagagugagguccagaauagccagggccacacagaggaacuugugucaaaacauaccacacacacacacacacaguuuuuguaauaccacauagaauuuaauuguacucauugcuaugucuugaauuacucacacucauguaggaugaacuccaaguauaauguaacugucacagugucuauaaauaacauagacucaacagauauuaauaucugauauaaugccagcacagucuuuaccucacuaauuuuauuuaauccuuaucucuauccagugaaucaggugauacugucuuuaucucaagugaagcauugauccccugaggcaaaugcaagccuccucaggccacaagcuagaguaaagaaauguaguacauuguagagugagcucagugccuggaccugauguauucaguacauccagccucuaagagggacuggguccgaucugagugaugcacaacagaaaggucuacacgcuuggaugaggagcuugucgguaauguucacugcuguagugaaauaacccuuuugaguaagguacaccaugaaggauaagguacagcaugaagguacaugcacucagguuaaauuuuagaaaauucauuuguuuuguagaaacaggcugcuuguaauaguccuuguaaaacaaacuaaauugauuuuuuagaacacuuuuuuagaaccaugugcuacuauucagcaccuuucauuguuaccauauuugcagauguuucaggcugugggucacauucuucuuguccucuaguaggagauagaugaaauguggaaugaugggggcauaucuuacguggucaucggacuguguuagagcagagcaaauggaaagaucguggcagccauggcagcagcuuagcuggguuaaccccugagcacagaucugccucccagaggcugguuucuaguuuuuauuuaaaacaacaaaacaaaacaaaacaaacaaacuuggaugaaauggaaauggaauuuagauacugaagaaaacuugaccuaauugugacucagaguagaaagugauuguguguguuaacaaauccagcauccaugagguuagguuaaugggcuacacacagagauaaacucugaugguaaguaugucucaagcucuagaaaccaaccacaacuguggaaagaugcaagcaagaccuaaaugugaaggauuugguacauaaggacuuuauuaugggugaaucucaugacacuuguuuuaagaagauagaccaugucuauagguaugauucuuuucuacaauauaaauuaugcuauggugaagugauugguccacuucugggcagccguucuuaucuaggacuuaguugcacaucauucagagaguaugucucuggauggagagguguuucuuccuugaccugugaaaaguagguaaaggccaaaauguuucaccuggagaagaagcaacagaauguacugcuuugaaacaauugacccaagguugaccaguuguucuuugugauucaaacaggcauaagagguaggauuugugccagaaaacaauguagauggauuuaaacucucaaaaagaacauucaggagagcuacuagaaagagcagacugauaugaggggaagagccuucugcuggagauguuuggugggguggccucugcuaagauguuguuaaaggacuaaagcuucaccugagaugagaugaccucuuaauccaguugugagggucuguggucauucggaaaauguccccuggaacccuaagggaauuggcaaauaauguuuuagauuggagaaaaggauggaaagagcauaagauggcagagaguugacagacugagcaagugcacgugucaauaugcccuucagaauggguccucggagugcuggggaauuccaaccauacuccucugagcuguacaugcgugcuauggcgugugggcauucccgcuccucccaacaaugagucacccggugaacaaaauuaaagagaacuuaaacccaagucagcgcggcugcauggaggaagaagugaagcagccguguuccucacuguuacaaugguagaguuuugaacauguguagaaaaggguuguugggaucuugggcaccuugguuuguucgaugugcuguuugcaugcagugucucgaaaaugguauuagcauacauuccuuagggcuuaagauaaucccugcuuucuugaaccuggcagguucaccguaauaaucuuaccuuacccuuaaccacagacgcagacuuagacagacacuuaacaugcacauaaaacuuuuggcccaguauuuuggggcugucaauaugugaggaaagggagccaagauaaggaaggaggaagccaacgccuuguguuugcuuuguguuuucauugacucgguacaugagucagcaaauuucuggcuuuuuaaaaauuuuuuauuuuuuuauuuuauuuuauuuuauuuuugcuauauuuuuggaacaucagcuauacaaauaacuuuaauuuucuccacucuguccuaggaugcugguggggaaguuugagguagggaugggacugacugguuucagcuuuugcagccugcagggaacacuuagcacggggcgaggguauaucacaguaacucaaaguccuuuguuaccuaggagaaaugccaacaggaacuugguagagaaaaacacccaagucucuggccaugugguguagaaaugaaucguaaggugauggugauggugauggugucuuugaaaaggaagugagguuucucccacagcagauaacaagugcccaggauuccaaccacauucuucccauggacccaauguugaaacccucaaucgccugugacaaaaaccgccugcaggaauugucaucuguagaagcgcuggcuuuugaaacacucauaaccuucccuugcaagcagcugcccccacuuuacuggugcuuagcucuuuuuuuuuuuuuuuuuuuuaaauugcacugcucuauagauguuggggucugaggucagccaaggugacuugucaaaaguggagggcuuuuauuaaguuuuuauguucucuuagauacaacaagacagacauucagacacauagacagagauauacaguuuuuaacuuguauguauguguguguauacaagcugugcguuuuauugcccugagauuacuugucuacaaauaaaucuuaccagggaaauuuugggucauuuuuacuaaaacagcgcgggaugcccaccagcacagagauggugaggaucaggaggcaguucauguaugugguaggggugugagacucuauuccaaggaaacagccaguguucgguuacuaauccugaacucaugaugcguugucuucugugggcaaaguacguggguguuauuugugaacaucauagcauuuacaacaggcguagaaauaagcuauuguuuuucuucauagagaucugagauucuucaucaaugaauguuacaguaugaaguuuauuaaaaaucuccuguccgugcaguuugugcuagaaagaggcccugcuuugccauugcagguggacaguaucucacagugucugcagccaaagccccggggggaaaagccgcucgcuugguguuacgucucggccaccucaugcauucaggggaccugugccuguccuuuaggcacaaggugacugggcugcacucgggcacacugcagguguuugugaggaaacacgguacccacggagcagcccuguggggaagaaaugguggccauggcuggaggcaaacccagaucaccuugcgaggggcugacgucaaaagcguaaguagaucccccaaacggaagugcugcuuucaugggagagccuggcaaggagccuugcgcuguacaauucagggccaguguuuuguggcuuuuccuggagggcuccauccaucgccucuuccuggaauucuuuucugcuucuucauccuccuucauugcaaccuugaccaccagacccucgcucaauugugaugaucaaucguuuucaaugagagaaaaucaguaauagaaaauuuaaggggaaaaaaaggaguugauaaacacauccagggucugaguguugugguuaacagugccugcuuuuccucuaccuucaguuccuuaaccuuccaacuuuuaccucugcggcugcaguagcucuucuuucuauuuuuaaguguuucuuugaaauucguuucccucuuuggcccaaagaugaguuaagcggcuccaggugggagcccagauccagguuugaacaguguuguucaggauggguuaugguggaaguauugaauggggaugcuauuuguauuuaauuuuuaaauuuuauuuuaaauaaccaaguucuggguagugagaaaaugaucugucacaugccaccaaauauaacgggugacucucagaaaaugucaucuugagguagacgcuuauacaacuuugcccugaagugucuacaucauucuuacagaguuucuugagaccacauuagaagcacagaccccauuacagcuuucaggggggucauuagaugccuguguacguuuugccuuugucuucuuuaaaugcauugcuucaugccauaguauugaaaggucugguccaguuuuaagggagcagggauacccuacagaggauaaaaugugaaagaguaaaaucucuaaaagcugggggcucuuuagccccuacuuccucagcauugugucacacucuacucuucuuccuuccaaaccuugguaaucuuugaccauugucuacuuugccaacauuucugcaguaaacgaguguguagugagaaugccaguuugaagaguaacugauucugggcccuucggucugaugagcagcuggacgaucagucggagggcauccugaaaggccagggcccgggacgaggcuggcccuugagcucuaguguucccacuugccauagaaaucugaucuucgguuugggggaaggguugccuuaccaugcuccaugagugagcacugggaaaaggggcagaggaggccugaccaguguauacguucucucccuaggucaucuucaaaggugaaaaaaggcguggucacacgggggagauuggauuggaugaugugagcuugaaaagaggucgcugcugagaagaccccuggcagcucccgagcuagcagugaauuugucgcucucccucauuucccaaugcuugcccucuugucucccucuuaucaggccuagggcaggagugggucaggaggaagguugcuuggugacucgggucucgguggccuguuuuggugcaaucccagugaacagugacacucucgaaguacaggagcaucuggagacaccuccgggcccuucugggguguuaccuuauauggugucuucuuuaggaaggccuuuggcaugugugaccgggaccauccuucauccugguuauagagugggccugcuagccaacuacgggagacguuuucauucugugcaaaugguauucugugaucuguccaguguuguaccaugaguaguacugacuuugcuuacaguaugacaguaugauguacagcgugcuugugaaacuaguguaucuuuuucacuucaguuacuucuggccugaccucaauccauauucuuuauaacggaggggugugcaacauauuaagaugcauuuauucuuguaaacugugucuuucuguuaaagacaguuauauagggugggcauggaauuuccugguuagcaguacuguguuuguguaaaugugcuauuacuauaaguauuuacauguuccgaauauccacagacucuaguugcaaggucaaaggcagcuuaugauccccugaguuaaaaaaaaaauacauggugaccugucaucuaugcuaugacuuaaaccagcagcaagaaaacuggcaaaggugugcggcuugggguagugucaugauggcuuuguuucuguguccuugaguuugaccuauucagaaaaccauucaagggaagcaaggaccugcaguuaauauauaaaaccccuaugcuuccgguuauacuuuaaacugacagccuucaccacuguuacaugccuccaccaguaagaagcuuuguaaagauucugggggggggagcggaggaccagaggacagcccauaagacaggugcuuuaaaucagcaagguuuccacgagugcagcuaauguguuaccugaggcugggcuaggaagcaggccugugcacagaggugacgcugccgaugauggagcaacacuagcacugucgaggaggacaagauuggaauuuuaauaucgacagagccccaacuucgucuccucccugucagaccgcuguuuuaaaaaaacacauagcuuuagagagucaacuuuucuccuuagcauuucucacccuucugauuaaguaaucaaaauauuuucugcuguuuuugccaggagacacaaagaugauuaaaggguuggaaaaaaagaucuauggugacaaacuaaaggaacugggaguguucugccuggagaagagaagacugaggggcaggccgugggggcuccuccaggcugcgaaggguuggcaccaagagcuuggggagcggcuguucuccauguguccugagaauaggaccagagggaacaggcuuaggcuagagugugagggggacuuuccuggcagggacaguugcuaagcccaauccuuuacaaaaaagaagugugaucauauucauucuccuccuacucccuccuucccucccucccuuccuuccuucuuuccucccucccuuccuucuuuccucccccccuuacuucuaccuucaucucucucucucccuuucuguucucuucucuuccucucuaucuucuuugucccuucccuccauuaaaaaaaaaaaaaaaacuacauaaaauguuagguauuuaagguguacguacuucaagguaaagucccugaucauggacacuagaagacacuuuggucuccaaaguaguccaugauaaugaccaucuucagaacugagcaguuuggacugagcuccaagguagacuuucugcucuuggccuccuccuguaaagggcacaaaaggaaaugucaagcucacugaaagggucuucacucaacagccaacccagcaguauuaacagaacaaauccccaaauucuuuauuccuggagagggugugucacacaggugcuaucgaaucuuaauaauguccuaauauggugguguuaauguuugauuccuggguaagggugcgaccccccacgguuuguucagucgaugcuuagacuuguuuuucaaagagacccccaagaaacaugaggcagagagagccugucuggugcauugccuggcuugcauugacaaguuaacauggcuacugaaggugugucaaccacagcaccguuagcccucguccuugccuccuuccaugacucacuuucucaccaggagccuuccaaguuccacgagcugguaaugcuuuuugaacagcuccaagugacuuugccauuuagcucaacagacacagauuuggggcuucugaaguagaaguaaagagcaccuaagauguccuuagguccauuuuuuuuaaugauucauuuccuucuuggucauguaacugcacagcugauucagaagaaaggggaacguaaucgagaauuucacucccaggugccaauaagacauugcacuacacugauggaggaaguuauccaaaguacuguauaacaucuuguuuauuauuuaauguucucucaagugagaauuguuugugguuuucaaaaugaacaaauaaaagcaaucuuuguaaauaaaaaucacuguuccuacugccac

SEQ ID NO: 1721 - RNA, 2489 nt, Mus musculus
guuaauuuuauaacacaaaauguauuuauuacauuucaugaaguacccaaaguauaaauguuccaggaguauucaaaaguauaagcauaaaguuucuacuggggcucaaucaaucucuuauggugagacccagcagaaaaaguuacauauuucuaauauacaauggcacaaaauccaacagagagcaguaagggcauaguuaagaaugaugagaccauagcaagaccuaaacugaggaggugaacaccaaacucugcagcucuguaucuggcaucugcagcuuauacuggaaucaucugggccucgucuggggugguggguaccccugcccacucaggucuccaaccuagaguugaccauuuacauggacugcuuucacuccuguuuaguuggaaaaucaacagcaucugcuucacacauacuucaggaaaaggaaagccauuuaauuaaaaaucugaaaagcucaaagguugucucucauguuagcaaccugguauuuuguuuauugugaagugaccauaagcuaaauuucuauagacuaaaagcuauucaauauauugcaaguccugcaaguuccaugcuauaguugucuccugggcuccacauuggacuggcuccuggacaccucacuauucucagauacaaaaucagaaugauggcuaagcucggcuacauaccagucaccccaacccuccaagcucagccaguuuucucuuuuauuuguaaauucuggaucugugcucaagagcuuuuugaacauuugucuuuaccccuguuuuguaaaguccuagaauuaaaaauuaagacacacacuuacugucuuaauuucaucauuacugugaagagacauuaugaccaaggcgacucuuauaaaggaaagcauuuaauugagaguagcuugcaguuuuagagguucaguccauuauuacuauggaaggaaauauggcagcaugcaggcagccauacuagacaagcugagaguucuacaucuugauuggaaggcagucaggaggagacuguguuccacacugggcggagcuuggauacaggagaccucaaagccaggcccccacagugauacacuuccuccaacaagaccacaccuccuaauagugccacucccuauguaauucaaacacauaagucuaugggggccuuaccuauucaaacccccacacuugcuacaugauagugacagauguccacagaggaaauucagcgaguuagguuccaaaugucuacauuugaaauggacaacuauuguugaauaaauaucuucagaaauuuguauuuuaaaauuaaccaguaagccaacuuuguucucauaacauguauuguauauucgguuuugauccacagguauuucaguaaauuauagaaaaugaaagaugagauuuuauauguucaaaaucaagccauuucuuuuuaaugccauaaaguaauauguuccuaaaucacauacccggaauuugaugcuaauuuuaagaaucuagacuauuagacagcccagaaccuuguuucaguaggaauuucuuucucaaauauccaauauuugaaguuuaggugaaauuuuaagcuuucuuuuuuuaacauaggcagaaucauauaaaucaaugaaauaaacgcaggaaggaaauguuuccauuuuuuauaggacaacuuagcuugcaacuccgccuaaucauguugacguguuacaaagccacuaaugucaaaauuuuuuagagacuaggcuaagcaaugucuaaguggcuaguggcaccucuaagagauccuuucugaaaccuggguaaaaccaguuuggguuuuaacugucacaauuuagaugcagaaagaacccaguaggugaggaugugagccuugcucacaguuggagcagaaacugguagagguccggaagaccauuccagugaggucuucccaaucaacuggucuacagaaaagggcaaugguugguuccuuccuuagaaccacagcucccguuguuacuggaccagacugcaaagacugcuguuguaacuaguuguggccaccggaccagacagaaauacuugugaaguaugcaauugcagagaaguuaaaaguuaccuguacuuggguuaaauauuaaagggccuuauggaggaaguggcguuugagggaauuacagauuuaggauaaaucugugucagaugucuucacaaggacgcucgaucauuauacauuauagucguguguguguguguguguguguguguaugugugugcgcgcgcgcgcgcguguguguacacucccuccuuccggcuuggauguuccuuuagaaauuucuggagguaugcaugcaaccaagugcuacauuaauguaaucaaagucugaccgcagacacugacagugugugagugggugcgugguggugaauuccuggggcuucuaagguccuugucuugauggucuucggccucugagggcuuguggagcaaaguggagagguagguggccccaggaaug

SEQ ID NO: 1722 - RNA, 87886 nt, Mus musculus
cuugagugcauuaaauaaauauaaauuuuauuaaaaacacucacauggcguuaucaggaaugauauaauaaacagcuuuaaaauaaacugcauucauaacauuacaauacuuacaguauuuauaaccacccucagauuguauaaacaaagccaaaaucucaggaaguaagcuacauuaaaaaauaaagcauagaaaaaugcacacagaaguucauuaucuuagugucaaacugcaaaaaaacaaaaaacaaaaccaaaaaaaaaaaaaaaacccuaacaaguuaaccaaacuaccuuguaaagugaacuauacaucacugugcgucaaucaagaugaaaaauucauucaaguaauguugacaccaagcagaagcacuuguaucgaguauggcuauguagucaagcuguuccuauagaagcaaaucacagaucugccucccacuugaucuaauggacagaggugggaugucacugccuuccucccuacaccacccauccucucaaaccacacuuacuacuccuguuggccagcaguuugacaaaugacagugggugacauguaaagcaaauauuccuuagggauggcuggcucaaaaaaaaaaaaaaaaaauugccaagcacaccuugcaggaaccugauguggacucaacaucaugguuuggaaaccuugugguuuuuguuuuugugugugugugugugugugugugugugugcaaggcagacauucugaaaguuuuuagugacaaaugugacugaugguaaauuacaaaggucuccacugacgcaaagcuauuugcaaagcuaguaagcaacacuguauuuaggccacaauguaacaacaguccuauugcacagcacaccaccagcuucuaggacuguccagcugcaguccaaagcuguccucgucacuagaucagaagccauuaccggcgaugucuuguaccccccaucucccucugccagcucagggcuuccuauuuuacacuuuuuacucugcugaaugccaacucuccaaaauuuacaauugaaaggugacaaaauuuauaaaauuaguuuucaguuaucaguacauauacaagcaaacuacgagggauugcaauccucugaaagcgaauauauuaaccgacaacuuugcauaaacagaugacauguuagcauaaggagaaugagcugaaauaucccugaauuuuuagaacaaaaaguuugagauucaaguuauacuugcuaagaaaucaaguauuuaaaaaugguaugucuuaauacaaagauuuaaaaaaaaaaaaaaaaagaaaaaugguggucuacaaugcucuaagccuccacuguuagcucaguaucccauugccuagcuaguguugagguaugacgacaaguaggaacaccacuccaacuuugaauggauucuuagcucacauuaagaucuauguggagcaaucuggguagcaccaucgugaugugaauuuuucuucaaucucauauauuauauauauauauauaauauauauauacacauauguauauauuuaauuuuuuacaguacuaaaauacuaaagcauugcauuaaaaaagguuguuuuacaauuuaauuuacuauacaacucuuuuuuaccuuuuaauacaaauuaauguuuaaaaucaccauaaaccagcugccuauucucuuucgguuuuuguugguugcucuguaaccaguagaguccuauggacuuaaccaugucuucucaacuucugcggguuucaguccacucaaccuuccugguauauauaacacuuagcuaagaaaagacaccacaaagcauguaaugaacacaaaggcagccugcuguucugaagaacauacaggucugugugugggacaacauggacuuaagugggcaagcuuugcucugucugcagcaccaaggcuaauuaucaccugcaauuaacagacguucuuaagcuguauacgcaggagggaugagcuugcccuaccaccguuuuacaggauagcaaguaaggugagcaccaaaaacuguuauuuguuuucuguggacuagcauauccauucagcuucgguuuggauuguaacaggccugauacugcucaucagccgauaguggcuaagagcaaagcaaauguuuccuuaaaaggaaacaaaacaaaaccacuuuuaauccuaaaugaaaguaaacuuuuuuuuguuuuguuuuuauguuuuaguaccuuagcauugcccaaguugccaaagcuuagguaggcaaagugcuuuucuaagacacaacuuaaaauauuucaguacacauguguaagugugcauaucuauacauuauaguccuacaaggacaucgguggauaacuacaauccagaggccuuugaaauguccacauuuuaaaaacuaagcugaauaauuaagauagaaauguaaaaucagagguaccccagugccuccagggcccucgaccacacuggcuagaugauagaaggcauugauuuuucagcuauuaaaaacaccauuuguagcaccauuuaauguuaacacccaaacagauucaguguuuugccauuauucacuuaagcuuucuguagcuacuuugauaaauaaguuauuaagauuacaguaaaaaaccugcauguuaaaaagucuuaguuccaguauuucuucaguacaucauacgucagcaccagaugauccugcaacugcucuacuacagcgcugugucccacgguuacacacgcugaguacuagaagcaguuacguguagagugcugaggggcauggcacacgcaugaccucagccaauaagagaaccagugguuuucaagacaaauguccagcgcuuccuucccacugugcccuugcauaggaugcucuuccugaaugccaccauggaccacgggagagauuaaauauaaugauaaaauaaacuauuuugcuggugagcugacagcccccccccaauaaacauacacacaaacacacacugcauuugucacagaugcugugaccugucccuacggcccaugccaugaaagacauacugcucacaggucguccuugguggucuggccuaauggccagcgucauacaaauguguuguaaggcccugugaccugagugaaagcauauggugauguagucacgguagaauccguagucacagacccuguguucucagcaagagacuggaugaaacgcagguaacuggguuccuguggcccugugggcucacgcuuuuccuguuugccaugauuuuucugagacacguggucugauccauucuuuccgcacucuuccucuuuccgggccuuuucagccauuuuggcuucccagagagccaaacaauguuuugguagaaacaaauucuuaugccuauacaguacaagugagauccugguggggugauuccggucgggaucguuuacuuugguuguggcaugaaccucacacuuugcacacucaauaagaauugacccaugaguuggagcuauagccaccccuccaaugcaaggauccugaaaguugugcucacuaucugaccaauacucaauuuccugcacagcagcugcauccuggccugacaccucaggcugcuucuccugacugcugccagucagacuguauaauaguucuugggcagaagcaguucuaucaugauuaaacccuggaagcacucuugagagcccauuggcuauguugucauucuccuuguuguggaaggcguggcuggaacugcuccccgaagcugcugccguguagcuguagaucgugugagaggguagaugaugcucacugguuuuguagucaguguguggguggcuguauggugaucuggaggcagcucccaugaaaugacuauccaucuugggggugggguaaggagaaaacguugcuaggugguguacauuugguuuuaggguggaguuaguagugaaggcaucucucugcauauuuugguuuccauaacuuaaguacuuagagggacuguccccaaacgucuguuggugaaggguguggaugggugguaaguucugauuggugagaugguccugguuuggauaucuauguagaucccuggacugagccuggggggaauaagaaccuaagaaaggggaaccauuguccacuggcacacucccauuguauggaaaaggugcauauugguuauucugauucaaaagcccaagguagggguucauguaauuagaaggauucaaauaugaacccgaggcaugagaugaagugggguaaaaguucacaugguugguaucuccauaaauaucugaggugugugcugagcugggauaaggacugugaggaguaggcugucucguguagacacugguggauccagaacaaugagaaccaacagacugagaguuaccgggcaugauaugcuguggcuguggcuguggcugaggugucgucugcggcugcggcugagguggcugcggcugcuguggccucugcccuugcugaaggugccucuggaguguugguggcugccggaugaccgggcccgaaagcugcgguugugcuauggagaggguaggagagagcagguacaaacacaucuaagaauggagauacuuaauauaugcaagagcauagacaagcccugcaagcaaggacaaaggaaagcgagggcuuugagcauugucacccauaauuuugugucugaagccauagaagaaacacgccaaacuuuuaauggugcauguugguaaugugcguuaccccacccucacuccagagucauucaacaugccucugcccacucuaccuaucuaccucugcuuaguucaaugccaaccuagcuugauaacaaagacucuacuauaauggugcccccucaaacccuacuauuccugaaggaagggaacaguuuauuuuacuuuacuucuuaaugaccuggcacauggcaggacuugucaaaaauggaauggcauuuaucuauaccuaaagagaacauuucccggcaaggacauuuacauggcugcauguagagagcaccuugugggaauguuccccuugagaaccaugcacugggaaaauggaccugcaguggcacuuuugggaaaugaacaguguuaucauggaaaccagcaaggaggggacuuuuaccucucagagcaaagaggacugcuuaaggaaacacuggauuucuuuuuaguagcucuaauuauagacauacagcaaggguuauuauuuauggugcccagugcuccuccguugggacuaaggcagaguuugaugaguguggaacauuaccuaagcgagaaccaaccugucuaugaaagaauacucaguucacccuuuaucccgcaaacgaguuuggacuuaguucaguauagcacuguuuuaauuucuauucaguccuguucuuugcauucugagaggguucacuuucauaguugcucgcaaucccccuacuggucuacugcaucuguguccagugcuccccuccuuaagcuuggugagauauuacgccaugauucacauuaauuuuggcuuguuauuuguacccugaacauuugagggagcauuaugauagacuagucagaccgugauugcuaacacuucccagcaagcucacacagccuuaagugucacacagcuuaccugucauuuguuucauauggcuugcauuuuccaucagcuuuguaugugaggaagacuuucccuucucaguccuacuggagcaguucuccagagaggaacgcuuucgagcugcuuucuuggucuuggcuuucuugggcuccgcuuucuucuugcaacucuugggcagcucuccuauccuuaugacccuucuccuccgaaaugacugcagaaccucaauggaccccauccguaucuucuucuccuggccuuccguacucccaaacucauccucaggggcgaugauguacauaggcagcacguggaacugcucauccucaggcuuagcuccgacuucucgauugucuucucuauugagggugaccaccugaagcggaugugagauguuccaagcucaguuguagguccagaaagaaagugugugcaugggccucccuagcaguauccacaugcguguuggaugagggacaugcauauuauuaaaaccagaucugccuguuuuaacggaagacaauguacaaauggaggaaauagguagagaaaaagaccaucucccuuuuuauacuuuucaagaauagaauuggcuauuuucauggacuucuagagccaugcuucuuccaaaugaaaugaagcacuggccugcuuucuguaacacauggcagaugcaugucuuucaaaagaagcuacagcccucuucuuccagcacaugcaaugggauggggaaggaugacaacaggacacacagcucuaugucccccagaccugacuccuaacucuccauguguaaaaaacuugcuauacucaagaaaaagaaaaaaaaaaaaaaaaccaagaugccaguugaauguaugucaugcauaucuucaugcauccucuuuugcuugcucugaucuuaacuauaaucauauuaauugauaauugguaaguggagaaaauaaaacuuaaaggacauacauaacaaggagugggagauaucccugaagggaaagagugguuucuaaaugacuaaugugaagaacugguucccaaacucaugucucugaauguuucuuuuacaaauacaccagcauucaauucccacccaagugccuuuccauccugccuuguagccccugggaucauccaaaggcaggcucauugcucauugccauuucuuuauagaacgaagagcagucuacauggcugcacuauugugauuauacuacagccucagacagggcugacuagggucaugaguagcuuauuuuccuggaucuaacuucaaacuauggcagguagcuaauauaccucagagucuguguuuagaauggaggcuguauuaauccauugugcuaccgugcuauguaggcaugagcucuuguggucugauuguacauaagucacaagugaaugacaggaagugacaauuacuuucuaccuuccuuuuggggacaggguaucucagggagccugaaggacaccgaucuugcugguuggcuggauagcaagccucagagauuccuguguccacuuucccaauguugagugauuaacagcacuggguauagguauaggggauucaguucuucagcuugaagguaagugucuuccuggcugagccacuuucccagcugaauuucgauuuuucuuuuuaaagauuuuuaaauuaaguguauggauguuuauuguacgggaacuagcaugacugcagaaaucaggaaugucccuagagcuggaguuacaggugguggugagcucuggguacuagggauggaacucagaucuucuccagacccacauuauuuucuugacaagcacuuugaaauaacaauguauagacacaauuuagauuaguacuaagaccacccaaauucuugugugguugucagcauuucugcuaaugugccacuuaguugugagagggcuaguaaggucaccugucaccuaggaaggccacgggaacauaaucuauccaugaaaacacauggccuggugaccccugcugaaagcacagugcucugugccaagcacuguacagcuugugcuugucaguggcagacgcugcuaggaucguggggugccacuuaccacuguacugccauuuggcauguucugcuggucucugugggaaugagcagagaaguccaaacaugcagugacuccugagaauggccggccuuccuucagacccaaacagcagucuggggcuugguguucaaauucaaccugacagacagaugugugucaaugggaaaguucuuuagacuuuugcacuuuauaucuagagcauaauggaaugaccaaaaauagagcacacuauuacugaggaaaaggcuucucgguguaguaagguaagcaaucuagcacugccaggucccacauuuccccauccguuuccucccuccaaacccucacuuauaacccucccugcucucuuucaaauuuaugcccaaacuacucauuagugaaauaugugagugugugugugugcacaugcacaauuguuaugguagcacauacuccuaaauaugacuugcccaugaacacauguuaaguagcauugauggaaggcagccuuacuuugaucuaugugaacacccacguaaccacugcuauaaacaaaucaggucuauauacccauuccuccccuaaaguuucugccagucucugguguuuucccuccugcuuuggucagaccuaccacacagacaaaugaggauuacaacacauuuaaagucuucuacaugcuccaggaaauaacccaaguaaaaugaaaauacaugggauggaagaaaaucugcguagaugguuuuucugauuaguuauuauccagaaucuacuuuuuaaauaaaaauucaaucacuucaucccuccucgccuuucacguacccuuuucucugugugccccauccuagcuguuauuaugugacaguugcuuguuuuuuaacacuuucuuuuguuuuuaaacacauagaagacauauugaucucuugauaccuguaguuauaacaggcuuuugcucaagcacaaagggugauuguuguggggguggggguaggguguuaaucuuugagacugaucucauauagcuaacuagugagccuucaccuugcaaaaucagcaaauacggguuuuguuuuucuuuuuguuuacuuuuuuucuuucuucauggacaaagucuaacaauaacuugacaccuggacccauguguaauaaaacaacuguauagauaguccuguaaaaaucaggguaacaugauuuaaacauauugaauaaaaucuucacauggauauaaauuagauaaaccaucauggagauuuaauuuuuuuaaggcugaaaaccaaacgugugcacuuuuagcagugaaauucauacaauagaaacaauucaaguaguucuaaggauuaagaaaacaauaagagugcggcuggagagacaccuaaguaaagagcauuugaaucuugcagagacaguaacccaaauauugguuuacagcugucuauaauuccagguccaggggacucaaggcccuuaccgugcagugcauucauacaaaugcagggaggcugccccauacaugaaaaggagaaguggcuuuauaaaggcuaaaaaagaagucacucuuggagcugagaugaaaggauggaccaucuagagacugccauauccggggauccaucccauaaucagcuuccaaacgcugacaccauugcauacacuagcaagauuuugcugaaaggacccugauauagcugucucuugugagacuaugucagggccuagcaaacacagaaguggaugcucacagucagcuauuggauggaucacagggcccccaauggaggagcuagagaaaguaaccaaggagcuaaagguaucugcaacccuauagguggaacaacaauaugaacuacccaguaccccccagagcucaugucuuuagcugcauauguagcagaagauggccuagucggccaucaauggaaagagaggcccauuggucaugcaaacuuuaucugccucaguacaggggaaugccagggccaagaagugggagugggugggugggggacuuuugggauagcauuggaaauguaaaugaaauaaauaccuaauaaaauaaauaaauaaauaaauaaauaaagucacuccuucaaaaaauaguuuuggggcuggagcuggcagugcacaccuuugaccccagaauuuaggaguggaggccagcccauccaggacagucaaggcuaauacuacucagagaaacccuuucuugaaaaaacaaaagaaaguuuuggacuggccaggucaccaguaauggcauuugacaauaaaaaacucacuuaccugauuauuguaugcaucgggugcaagcuucuuguauauuggagcaaugacaguagccagguuuugcaaaugagaaccuagucucucuuccuguacaaaaaugauucaacaaauuaaauucuaaauuaaacaugguuauauaaauguguacaugcauuuagacaugacacagucuaaauuauucccaaguauaauguguuucuuauuguaggaaauaucuaaaucuuuguuuaaaaaaaaaaagaacaguucuaauaugaauuuguaugugcuaucuaccaugugcuaucuauuuggauuuggguaugauggucucuacuuugcaugcagacaacugacaauuuguaaacacaagccuccacuggggguggagugcugaacaagccagcuggcucauggaaacaaacacuuuucccucucacuauucaaauguucguuaaggaagaugaacuacuacaucugacuacuucuaagcacuuccuaaguuuaaaugaagucucuauagaacuuacuggacauuuuaaguguggauaaaauucucuggacuaacuacauucaaugcugagcaguuuguuuaaaaaauggaaauacuguuacauccccacuaucccaugcucacaaagaaauguuuccaauaggcuucuaaaguggcaugaccuaaauucccucugacaccaucuaauuucaaauugcuacuguugaacaaucuugggaggcugggagauaaagcucaguuagcaauugcugcucuucuaguggaccaagacuuguuucuucucauuuaugcugaguggcucgccagcacaguaacucaguuccaggugacuucugggcuccagagccccugcaugugcaagcacagggagcuaagguggaaccugaguacucacguaaaagauggggacccauaacagugcugggguggucagagcaaaaggaaagcuggggcuucuuucucugauacccauucuagucaaaacagccuugaguucaaugagaggcuucuucucaaaaagggauaaaggaagaugcgcauacgcaugugugaaugcacacagaaaugcaugacacacgaauccagagaugcaaacuuuaguagguagguagaguuggcugugcagcaggccugcuuaagaaaaaucuugcagggaagugguggcaaacgccuuuaaucccagcacuugggaggcagaagcaggaggauuuccaaguuugaggccagccugguccagggcuacacagagaaacccugucucagaaaaaaaaaaaaaaaagaaaaaaaaagaaagaaagaaagaaagaaagaaagaaagaaagaaagaaagaaagagaaaagaaaaggaaaaaucuugcuuacuugcauaauuuauauuuaauauuauaacuuuaauauuaaagauaacauuucccuuuaagaugaauauaucaaaguuaauaacaauguguggauuuuagcacuuuagauucaauuuaauuuuuggucauugguuuuuggucauucagcucuuaauuaaauccuacaaucuuaaaaguauugucugccagagaaucuuuauuuuaaaagauaaaaaguuugaugguuuuaagugagaaaucaguguucguuuauuugaacugaauauguauacuaaaauaucaaccuguuuuaguugcuugaauucauauauacugcaguaacuuaaauugagauauuagaaauaguuuaagcaugaguuccauaauuuaaacuugaaagugaauaucacaaauccuaauuuuaguuuucugaugucccuuucugauaccuggggcaaugaauuaugccacuuugagcagaagccaugucuccaauaaaguauuccuuccuuuaaaaaaaaaacccaauauuuauugauauguauugguaguuuacuugcaugugucugagugucagauccccuggaacugaaguuacaggacaguugugagcugccauaugggugcugggaauugaucucagguccucuggaagagcaaucacagagcucuuaaccacugagccaucucugcaggcccuaaauccacacugucuuugcccuuguuugcaacaugauucacugccauaguaauucccaguaguaucauagaucuuucaagcaggauaaguuuuaauaugcaaauauuucuuauuugguacuggcaaauuuuuguccaaauacucuaugaaauagaauguuaaagggagccucaauguuauacaucagugugaaauuacauugagaaaucagaaugacauaaacauggucuauugcccauauuacagacuuuucuuuacacagagccucacucuuuaguccaggcuagccuaaucaacuuaauuuacucuuggcauggguacucuauaaaggccuaugugcuggcuaguuguggcaacuugauacagccaaccauuucaaaaugccaccauguagggaagccuguggcucauauuccugauuguugauugauauaggagggcccagcucacuguggacagugccaccccugggcugguaauccaggguacuauaaauggcucuaucaagcaacagggaacaaaccaagacaguacacagccccucugaaauaguucugugccuacacugaccucccuguaugaacuacaagcuuuaaggcaaaauaagcccuuuucuucccaaguugauuuuggucaugguguauagaaaccuuagcuuacugcucacaggucagaauaauuugugcugcuauauauauauauauucaugauaaauuuauaaaauauuuuauguuuaggggguuagccagaauauguagguucaucugagaugaaauuccuucuugaguaugacaggucauuaggcucauugauucuguaugaaaaacagguuauagauuaggaaacaaaccaaccucuuuuggcucagcuccauguagccuaaauuuccuugguuucuugcuucuggcaaacuuacauccauuauaguacaugcuccaagaacaaccaaaagaaaaggaggcaccacaggucucuggauucucacccugacaacaacaguuucuacugagagaacacaggcauuagaaauagucucugacaauagccauugugugcuacugagccauuugcaugucuuacagagguaagacuaauuucuaccuuucaaauguugacugaguguaccuagaguucaugucauuguguaaugugugucaaagaaaacuucaugcauuguuuggccagcccaauuuucucauucaucuucauuguguucuaaacugucuuauuauuuuugugaugaucaguuaauauauacuuggugaauuauuuauaaguguaauauuauauacacauucugauaaggggaagaaaaacuaccaaauguucuacaaauuacccugacaccuagccaauaaagauaacuaaacuauugaucuaguucccuugaugaacacagaugaacaaaaucuugcaaaucauauuuaagaacacauuaagaucauacauucuguuagaguugguuuccaacuuggcucaacacacaaaugaaauaauucucaaacagacaugaacauuccuccacaagaagugcuaaagaaacuaggaauggaaagaaccuguugacauaaggguccgugaugaagccaguaaacauauacuaaauggugaccaauuccuugcacaucaaaaguggggcaagauuauuuuuuaccacugcccuucaaugcucagucuuuucagcaaacuccagaauacaaaaucaacaugcaaaagaagauuuugcagauagcauguucaaguuuacucccuagcacccacaucaguuagcucauaauugccuauagguccaguuccaggggaguccugugggcacuagcaugaacccacucagauauucacaaaaaaauaaaaauuucaugacaaugaaauuuccuaaacuuaacaagaacauucccacacuauuaccaaauagaaaugcauaaaacuaaccgaagagguaaacgaccuccacaaugagaaguauuugggcauugacuuaggcaguauuauauaauggcugcauugauaaaaugaaucuauagauucaaagcaaucaaauuucuaguuacauucuuuacaccccuagaaaaaucccaaauagcuaauaauccuaaauagaagagagcacagcuguaucauaacuaauuucaaauuauacuacagagccauaguaacaaaccaucaugguacuuuagaauaagaggaucuaggaauaaaccagaguuacagccagcugacuuuugauaaagauaucaaguuacaaauuugagacauaaugccugaauaauccacaugcaguagaaguagaucccuaucaccgcacacuauggacacaaguggagagacaagggacaagucccccugcagcucucaucuccagaggugcuacccacauuacagucggucaacccaccucaacuaacccuagcuauagaaaucuccucagaggcaugcccaggaauguguccaaccugagucuagaucuugucaaguugacagucaugagguaguaauaacggagauuucauggccccagaaaucuuaugugggggaaagucuuuagcaaauacacuuauaaggaccaaauguaagauauuuaaagaacuacagaaacucaauacggaaaaaaaaaaaagcucaaauuauccagucaauaaauaggcuagugaacugaagggacaggaaauaaaugaccaacaauuauuugaauguguuaagcaccagggaaauagacauuaguacugcuuuaagauuacauaucacuggagucaaaaugacuuaagggaaacaaaugaaagcaaugcuguugaugaugugggcaaagaggagcauauauguauauauacauuacaggccagaaugugaacuuaugccacugcuggagaagucaguguggaugcuccucaaauagaaucuaaaaagaacugucacucuauagcuaucccacacuuaguaucauuuagauuguggcuuacuuuaaacgcggucaucuuuaguuccauucauuuuccugaaaauaauuucacuuuacucagguucaaaauguggaugcauccuguuuuucuuuaucuaucuaucuguuaguaguggacaucuguuucauuuucuagcuuauaggcauaagcauguuugugcuucccuaaguuauuuuucuagcucacuagcacuuuagagccugaagccugcccugagacucuacgguaagaagagugaguucuucagcaaagugugccaaugugccuucacuuuuaaauguacauacacacaccuuuagcagaaugaacaagauaaacggauaaucugaagagucuuuacaguuaaaaccggucaucagaaguguacaagucauaggugaggaagugaaugagccauuugaauuaaucaguaagugaacugaagagcagaucgugaguuuuuguuuuuggaguuuuuuuuuuuuuuuugaucaaacuugucaaaagcaaaucaguuucaaauaggaguuauggauaccuguauaauacaaccaagacugaggaacuaaggaacagauaugauuagcagugagauuggugaauguggccaggauucuuugugaccccaggaaaugaaucugugugguuagugguuagguagauuuuaaaaguacaaacuguaaauuauuuuuagaccaacugugagaaaaugugucaggagaaccuucgugugcuaacaucaugcaugaauucacaguagaggaauaaaacgaaccuggguggugauugcuuuuucuuccugcaaaggggagaaaguuaacccaacaaacaguaaacgauauguacuaacuacccagcaauaacguacggagcagcagugaaaagggaagaaagugugaccuacaggaauaaugaauuagaauaaauggaacaauaauuucaauuucuacagaacuuuuaugaaucucgaaauuacagauuaaaaguuaaugaucagggcuggugagauggcucacugcuuaagagcacugacugcucuuccaaaggaccugaguucaaaucccagcaaccacgugguggcuuacaaccauccauaaugagaucucuucugaugugucugaagacagcaacaguguacuuagauauaauaauaaaucuuugggccgagcaagcagggccagagugagcugaaguccugaauucaauucccagcaaccacaugauggcucacaaccauuuguacagcuacaguguacucauauacauaagauaaaugaauaaaucuuaaaaaaagucaaugacucgaaucccaaaaugguaucuuacuaaaaugguagccacauuaguauggaguuuccaaguuggcauaagaacuagaauagaaaugguaaaaccaaauccaccuagaucuuaccagaaauggcuccggaacaugacucccuaugguugaaguggaccuuaauaagcauucacaguccugacuaugaaauaaacacgugaccccugcuuuaucaauauacaaauucaagccccucuggagaacgggaaaggucuaaacccacuuacguuucauucugagaacagcgacgguuggugcauaugccacacuugcccaagauaucuguaaguucugaguagaguucugaugcgaguagcuuugggauuccgucccacaacaugauggcaauuaccaucaccgccgucucacaugugugauuaggucgcacucguaccaaacacaguaguuucuccuccucacucgaucuccgauauaccuguguggaucaacaauccacccaaacagccccacccacccaaacagaacaagggucaaucggagccaauacgggcauaugcauagcuuucauaucuggaucaaaauuaccaacugcaauuccucuuuuauugcccagcuauagagugggaaccuaaccaacugugaaaaaaagaagaaagaaagaagaaaaaagaaaaagagagagagaaauaaagaaagaaagaaagaaagaaagaaagaaagaaaggaagaaaggaaggaaagaaggaaggaaggaaggaaggaaggaaaagaaagaaaggaaaaagaagaaagaagagagagagagagagagagagagagagagagagagagagagagagagaggaaggaaggaaagaaggaaggguacaaaauuacucaucaaugguuuagcagaccauaccugguacaguggacaguuaaauguaaccuccuauaguaagaacuacaggaaagacaugcaaggucuuagcugaaggcuuucuuuaagcggcuuaaguggcacuacaaauacuaaccuguuguuuaagauuaaaaacuguuucuucgcagucuaaggacuauucuuuagacagugguuugaccuuccucuagcugugccucuuuaauacaguucauugcuccuucauagcuguaauccugcuacuguuaugaauaauaaugcaaauauccaugucuuucaaucaucucgggugaccccugcgaaaaagucauuacuuuuacacaaggggucacaacccacaguugagaaccacugcuuuugaccucaaaauuauuucaguuuaaugguuucuucaugauuucagaacccuucugccuuuagaacacaaggguacacauaguauauauaugcuucuucaaacugucaaugcucuuuggcaagaauugggcaaaccaguuacuaagguuagagaaaugaggagaaaugauugagcccgaagaccaagaucacacacaaggcaaacuuacccauuuagcaauaggacaucccugagagcucuugccuucuuuaccaguauauaugacuuuuucaauccuaauagcuuuacccuucucuccauaccuuaaagaaacacauacuauuauuagaugacuucaagaagcaaucaagccauuuggacauuuaagugguuuuuuuuuccccuucaaccacauauaaauaaaggguuuaauuuacuuaaaaaaaaauuguugggagcuggagagauggcucagugguuaagagcacugacugcucuuccugagguccugaguucaauucccagcaaccacaugguggcucacaaccaucuguaaugggaucugaugcccucuucuagugugucugaagacagcuacaguguagucauauacauuaaaaaaauaaaaucuuaaaaaaaaaaauauuguuuuucccugggcauguccagacccugacggaagcagcuacauucccauuccggacagggcugucuuugugucacugagccauacuagcuagcuacagccuguggagaauugucaccaacagcuccccagcugccucauguuaauucaaucagcaagaagccuguacaccugacgacaguucagacucugaggcgaacgauuaaaguuuaaaaggucgcaugccauuguaauaccgaaaagaaaccucaugauucaucauuccugaugccaucucaucuguuuaauaaagcuguauuucacucacagcucauauuuaaugggccaauuuaaaaaaaaaaauggucuaagccaagaguaauacacaauagucuuaagucuuuucuucagcauccaaguacaucagaaaugaccauggauuuuucuguaauuauaugguggaugaaaaguauugggaaagauauuuccauauacaaaguauaaaaugaguuugcuaaauucaauucuugaaacaauuugauuuucauccuuuacuaaauuuaucuuacagccuggauaauuguaaguuuuuagaaagcuugugugugggaauuuguuuuuuguuuguuguuguuguuuuugcuuucucuguguagcucuggcuguccugcaacucacucuguagaccaggcuggccuccaucucagaaauccgccugccucugccucgcaaaagcuuguguuucuaaagacaucuggccaaaagcuaguauccagcuaucuuggaaaaguuagaacugcagaaacagauuguauucuuggugugccaaagugcuguauaguguucacaaaagaaaacuggguagcucuggcaggguaccauggcugggggugagcuauguggugaauuucuacauaauaacuuuguaaagcacaugauuugaaaauaaagccaagaauauuguauacugccccuacaaugcaaauauauuuuaaaagcaacucugcuaauggcccagaucccuucguucagaccucaguccauaagaaaagcugauucaacauacagaaaugaaacauaaauaccccggacugacaguuuucaaggcuuucagaagaaagugaagucucucagucaguaagagaaacaacucauucgcaaagcuaacucagugguguuccagucauuucuucuuggacacaccaucaaguaaguaggagagagccaagugaggucacacuuuguaaccugugccagcacucucaugcagguugauuuguuugugccuggguuuucuagcauccaugugccagcggagugacuauuuguccugucaaauauugugacuguagugaauacugcaguguauuggguuggcaacccuggaauagcuaauccuacugauaauuacuugauuuacacuuguuuacugugcugugugggagacuggaaaaacugcuguauacagaggguaaacauuaagcugcccugugccuuugaguuaauuaccuuucuuccaugaguguucuaauagcugccacaucaggaccagcuccuagauggguauaauaaggagcuucaucuuugucuguugagauaauagaagauuauuuuagacuucaauuauaccaaauauuaaggcuacauccacacagauuauucuccagcuguauauuaauggcccuaaguaacuuuaauuuuuucuuuaaauuaaaguacauugaugguuuguucuauuagaaaaugugcaaagccaaguaauacauacuauuggaaauacauacuauauuucaagauauaggaccaaacaauaaagaaauuaaaauauauuauauguaagcaggaaaaaaaagcuuuuuuugguuggguuuuuaaugaguucuguuuccuuaggggauauggggcuguauagauauuuugccagaucuugauuuaacuuuguggaaucugucuagaauaucauccauuucaucuauaucuuccaguuuuguugcauagacagguuguucaauagaauagaauugaagauccagaaauaaaacuacacacuuauggacacuugaucuuggacaaagaagccaaaaccauccaguggaaaaaagacaacauuuucaauugaugguggucaauauguaaaaaaugaaaagauucauauuugucaccuuguaaaaagcucaaguccaaguggaucaaggucuucaacauaaaaccagauacacuguaucuaauagaagagaaaaugggaaagaaccuugaacucgugggcaugggguugggggugggggugauuuccuauacagaacuccaauggcucaggcucuaagaucaaaaauugauaaaugggaacucaucaaacugaaaaucuucuguaagacaaaggacauaaucagucaauaggacaaaucagcaaccuauagauggggaaaaauuuuucacuaaccccacaucuguuagagggcuaauauccuaaauauauaaaagaagcuaaccuucaaaaaaaaacaaaacccaaacaaccuaauaaaaaauaugggguauagaacuaaacugagaauuuacgacagagaaacacuuaaagaaguggucaaaguccuuggucaucaggaacucuaaaucaaaaugauccauuccaccgaacaccaaucaccuuaggugacugcauaugguggugaggauguggagaaagaggaacaucccuccauugccagugggauugugaacugguacaaccacgcuggaaaucaaucuggcaguuccucagaaaaacuggaaguagaucuaccugaacacccagcuauaccacuccuaggcauauacccaaaagaugccccaccuugccacaagaccacauacucaacuauacucauagcugccuuauuugugauagccagaagcuggaaacaacugagaugccccacaauagaagaauggauacagaaaaugugauuaauuuuacacaauagaaugcuauauucagcuaucaaugaggacaucaugaguuuugcaggcaaacagauggaacaagaaaauaucauucuugagguaucucagacccaaaagguucacaaaccaaagggaccaagugaggcugccucaaucaaucucacuugggagauagaagaaaaguagagagcuguggggagggaacuggguaagaggauagggggaggggcagaguaaaggggaagaugaucagguauuagagggagggggcauaagugaagcuccaaguuccagcagaugugggagguaggggaaucucaagacucaaagaccuuagaugaaaugcccaacagugggagaggaaacuugaagaaucuaccuucaguagaaagucagagcagcaaguggagggaugggguugccaucccugucaaaaaacucugacacagaauuguuccugucucaaaggacugcagagacaggaauggagaagaaccugagguaaaggagauccaaugacaggcccaaauugugauccauaucaaugggaggcuccaagaccucccugaugcuauggagugcuuacagacaggaaccuugccuggcugccuucugaggccuugaaugacuugauuccucagggggguggggaggccuggugguguguggaguuagaugggaguguacuuuuguagggugaugacuggacuguaaaaagauuaaaagauuaaaaaaaaaaaaagaaaaauggaucccagacuccagcuuaagaaagaagcaacacacaugaagaugacuagcuaacucuggcaaacaccauguauguuacuggcauguaccuggauugcauccuucacauuugccauucugacuuuguucaccaggaguaucugauucugaaacaucgucgagaacagaacaaucugugcuuuugguugcuugaggcucugcagcucgggcgugguucuccgauucugcagccuggauaucuguuggcacuuucacguguuucugugacuugagagucagagccuuauagucacagagugacuugagcugaaacugcuucaggugcuguuccauggucucaaugaugcucuuuggcugcccauugucacggcuuggagaggagaucucuugcuuuauccugcuggacauauuuucuuguggcggugacaagggguaucuauaggaagaagguuuggauacaggcucagucuugauuggccuaagcaucugguuaugaccaggcugggauugcuguguuugcugcuguucuugcuucuguaagagaagccaccuuaaggcagcgugcuucugaguguccuucugaggaggggucugugucugacuuccuccuugcucaggcacagggagugccuuugcuucauuaugcaccaaauaccucuguugagcugccucagcugguggggcuggagacucacccuggcuucuguccuuaagccccuguagagacgaagcuugcugaggcuucugcgcuuguuccugaaagcaccggugaacguccugauuuggggucacauuauucgggaaauacugcauguucugcagguuugaggucuuacuuccuacgggauguagagcuuguucccgcucacaagccgggugugugucauuugaagggagaaucuguaaguugcucgaauuugguguuaagaucuucgaauaaggaaaauuuuuauuuauauuuuguacuugcuccaaccccccuuggguauuauugugaguuuggaaauuacuugauuuggaguacugauuuccgacacaaaagcuuucuuccacuuuaaucuggccaaagcacgagccuucucuuugcuuaucauugcuaccuuggagaugagagaaagucugaggcauuugcucuuuauucuuccucuguaacugcugcugcugcugcugcuggcagauuugagggaaauuugaguucugggaugcugguguuugugaugccugcgucugaggaguauguuguaaaaagccugauaaccguugagucucuguggccuguugacucaaaugcuuaucacuggagggauuuacucuuugcuggaaaugauacugaggaacgcucggugcuugcgggugagccucagaugacggaucuguccuggggaugcacuccugguauaaagcuuucuggaacugaagauguuggucccccauaccuggagacgguccuugguucacuugcacuugguacauuugugccuucugcucuggcugggcuguuuucuggagguaagguagccuuuggaauccuccuggcauguugacauugccaguggacuguuuggagcucaucugauugacagggccggucugagaguggaggacugagugcaaggauauauccuugcguuuugucugauggagugcuucaugcaaauucggggcuuucaguucuauccagccaggugcugccuguacagagccuugcguuuguuucccguuugcauccuucggaaucucuugcucccugugccccaucagguauuggcuauguucuuguaaaccuccacuguggccaugauuuggcagguaauacaugagauauucugacauuuuucuugacuuuucagggcucggugagccacaaucauucugaugcuguucuggaagcaucaaggggggguuggguguauguacagauggauucagacucuggcuagaugaugucuuggguugauggucuauuuucccuucccuuaaaagaguucgguugcuucgguugggguagucaugguguucuuccaaagcuacaucauuuagagcgccuuuuccuucuaaaggaggcugaagaacaagacggggagcaagaagugauugugacgguggggucacaguagugggagagauggaaucuuuagggaacuucgagcuuugccugaaguaagcaccauugguuuccuuuugcuuugaauacuguucagagcugccaugcgaagcuugcaaauuccggucggaacuaggauaguauucuucagcaaauagcuccaugcuuccuuggaugguuuuguuuucugcacgagaugggccuauguccaaagcugacuuuuguugguguucugcuuucugaaaaggacagguaccugguacuauagcugguuuacuggcauuaucagcaucacaggccuuagucaccauugcagcuggcucuggaggcagcugcaagcuugaggucugggagaaauugaucugcgcugagguaagcgaugguugagggaucucgugggacaacucgauagcagccugacugcuagggguguuuacaugagaugcgguacucugcacggcaauggagacacaaucuggauaacacuguguuuuuuccaggaguucaccacguguguucuccucagaaugggcagaaacuguagcaccauuaggcauuagcacaaucuuguuuuuaaguaauguaacgcuccugccuuuuuccccuuccugcucguugagaaccugaauuucaacuccauuguaguuccguguugggaaagcaucugcaccugaacuuuccuggguggucgaggucacgggcucuccauuaucacuuaguccggagacauuuggcugacggcugcuuuuaccgugguuucuuucuuggcuuuccucgaagauauugcuuucucccuuagcuuuuuggucuaguuucaauaucuuguuuggauggagcccagagagagaugguucacugacugugcguuuuaucccuccauucuguaagcaccuggaauacccucugucuucauguggacucucaugacugcucuggcugccuuucaugugggauauuccauaacagcuuugggaagauugccacuuggugucuccauuuacuucuggaugaggucucucugcuaacgggcuuccauucuggaguuugacagccagagguucuguauggcugaugggagaagguggugcuaucaggaauggacucagucuggugcccucagcaugggugguucuguccuguuccaucaggcuugcuucggggccauccacaaggcugcccuuugaaugaauccuaaagacacagaaaaaaguaaagacacagcauuacaguuacaccaauaccuagaucuagcaagcagaugcugauuuucaucuuuagcuacucuugucuucccugcauggagcaaaggaacaaugggaugaaucccagauguuuauaccuccccaguaacucauaucagagaaaaauccuuuucuuuagcccuugcugagcuaucaugcugcuuccugugugauccuggaaucaucuccauuauugcuggaucggcucucuuaucucauaauccccagaacagcuucugaaacuggacccucaaguucuucaaggcuaccuccaauuuguuaucuaucagaagaucagaaacaauguucuagagucuaauucugguaucuuuuccucuuuaccauacuugauuggcucuggcaggccuguagcaauucuuuaacaaauucuuuaacagggacucucgguucaugucagugcugccaguggauacuguguggugauggggugaaagguacggcuuaagaaaacccagaaaccccugaacuagggaugugacagugugaggugaauccugcagcgugcaggaaacucuccucagguucagcauucaguuugaaacaaauacacacaccuccgaccaucuucaagggugccacuucuaggugauuucuccacagaugcaggugaaaugauucaacacguaaggacacgugucacaaaugcugaugaguugaguuugauuccccccaguauccacaugagaagggugaacuccuacaaauuguccccugagcccuacaugccugucauggcacccauguauguauguauguauguauguauguauguauguauguauauauguauguauacacacacacacacagaggacaaguaaauguaauuuuaaaccaugcaaaaccuaucaauuggucucagaugcaaauaugcaucuacccuauuuuucaguuuauagucuagcaaugacauccauguugaggggcuaauccaguucacuugcccaaauguacacucucucacacacacacacacacacacacacacacacacacacacauacacacacacacacgcacguacacaccuacagaauaaaaacaaauguuuagaucguaauacuucucuacucaucuaguuauguuuuugucccaccauuucuuuaaagguauucacaguagggaagggcacuauuggucuggacuaaaaugguguuauguuagauuaauauuuaccuacuuuagaccagacaaaugaagcagaggaguaauagagaaaugcugaauagcaacacugagguuauuacauuuaccaggacauggauuuuuacacuuugaauuccaacauaggcaggaggaucugaguucuaugacagcuuggucuauacugaguuccaggccaucuagagcuuuacagugagacccugccucaauaguaagacuguguacaugugucaaugaagagaaccaagugaaaugcugucaugguuuaaagauugaguaaaguauaaaaaaaaaaacccacaaaaguaaguauagcuucaaaaucuaaaaucagucagacguuuugacaauuauauugcaguuauaacaggauaaacuccaaaguugacaauuauauugcaguuauaacaggauaaacuccaaaguucuaugugcaguaaaaugcuguaggcaagagggguggagggcuuaggugauauucugagaaggagagcaguggccugugggguccccaggugucccucuagugcucaccuggauccugucugcuaacauucaggauggcuaaauggagcucuauggcuaucgcaacaauuuacaugucuuauuuauugaugaacuuacaugguuccuaaacugcugaaaggaauccaguugaaauaucagacacaggcuucauuuacuaucuacuuagaagugaauugaugagauuagacacuuugguaccaucauuuauuuauuauaccuauguuuguuuacuacaugaagaaaguugucaugauuacuaaggauuguuaucauuagaaucacuacuauuuugagguagggucucucuggaacccaugauggcagucacaccuaacuuggaaagcauuguuuauaagagggguuagccaaugucacuuaugaggauauuggccaaugaaaauuaggauaccacuuuucaaaauugguuacacacacacacacacacacacacacacacacacacacagagggaaguauaagccaaaggucccuugagaaaccuggaaaguaugacuaguuaagcuucccauggaugcuucagaucucacauaguaacagcuacacuuaaaacaacucauuuuaaacauauuucacuuaagacucauggcuaacuguaagcugcugaaguucaucaugaauuuuuguuaggaauuaauaccuaggguuacuuaaaucaagcccaaacucccugagccccacauauauuugaugguagccauucuggcugucagaauugugcugaaaaagagcucagaaucacagaaugacauuuuaccuuuuaaagacugcaaaggcuuuaaaauggcauucaaaugagaugguaugugaucauaacuguccuaaagauguauggaacauuucagagaagcaggaaggaccacauuguucucccacuguacauacgugaauacugagaaacuggauccuacuggggacaaugcagcucucugaagcccuuccccucacagaauacaaaggaaaucacaguuuagggagauuuuuacuuuaagugcauauuuuguucuuauuugagucuaucugcagucuuaucaaugcucugaaaggcaguuugcuacauaucuaugaaccuuaguuauuaacaggauuaagaacauuugcuuaucuuuaaacagggccuaacuuccucauguggccugaaauaaaugaaauauacagcacuuagaauaugaaaugugaaguuccugugaccauuuauugaacugaagaucccuauggccacauugugauugcuagcaucacaggugugacccacuguagcggcugcugcucacuccccuaaaauauaaacaaauacaggguuggguucaaaaguuugaauaaauuauuauucacgggcuggagagguggcuuagcaguuaagagcacuggcuguucuuccaggacugggguuuaauuccuagcaaccaaaagggaggucagaacuguuagguauuuaacucauuuacauuuccaaugcuaucccaaaagucccccauacucucgccccaacuccccuacccacccacucccacuuuuuggcccuggcguuccccuguacugggguauauaaaguuugcaaguccaaugggccucucuuuccagucauggccgacuaggccaucuuuugauacauaugcagcuagagucaagagcuccgggguacugguuaguuuauaauguuguuccaccuauaggguugcagaucccuuuaguuccuuggguaauuucucuagcuccuccauuggggguccugugauccauccaauagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuuggcucuguaacuccuuccauggguguuuuguucccaaaucuaaggaggggcauaguguccacacuucagucuucauucuucuugaguuucauguguuuaacaaauuauaucuuauaucuuggguauccuagguuuggggcuaauauccacuuaucagugaauacauauugugugaguuucuuugugaauguguuaccucacucaggaugaugcccuccagguccauccauuuggcuaggaacuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuugcagaacuguuucuaagucaaguuccagacagauguguaggucaaacaccaaugcacauuuaaaaaaauauauacauucacucucacagacauaauuuagaacccacuguccauauuuuaauauuuaccuguuuauucaaguagccuaauauuccucacaaugacuggcugucuggugguuccucagaaaauugggcauaguacuaccggaggaucccgcaauaccucuccugggcauauaucccagaagaugucccaacugguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaaaaugaauuuaugaaauuccuaggcaaauggacggaccuagagggcaucauccugagugagguaacccaaucacaaaggaacucacacaauauguacucacugauaaguggauauuagcccagaaacuuaggauacacaagauauaagauacaauuugcuaaacgcaugaaacugaagaagaaagaccaaaguguggacacuuugccccuuccuagaaaugggaacaaaacacccauggaaggaguuacagagacaaaauuuggagcugugacaaaaggauggaacaucuagugauugccauauccagggauccaucccauaaucagcuuccaaacgcugacaccauugcauacacuagcaagauuuugcuguaaggacccagauauagcugucucuugugagacuaugccggggccuagcaaacacagaaguggaugcucacagucagcuaauggauggaucacacagcccccaauggaggagcuagagaaauuacccaaggagcuaaagggaacuacaacccuauauguggaacaacaauaugaacuaaccaguaccccggagcucuugucucuagcuacauauguaucaaaagauggccuagucagccaucacuggaaagagaggcccuuuggacuugcaaacuuuauaugccccaguacaggggaacgccagggccaaaaagggggaguggguggguaagggauuggggguggguggguaugggggacuuuugggauagcuuuggaaauguaaaugaggaaaauaccuaauuaaaaaauuaauuaauuaauuaauuaauuuuuaaaaaaaaagaauuuauuuguaaugucauucaggcuucaucggaauuucaacggccuguaaucaccucuucuuuuuucuaauuaguguagauggguagauuuggaaggagaauguugauucauuucuuucagaaacaugggucuaccccagcagcauuuuaagaaguugucuguuucuggaguagaaaguagaagcaucacucauauuguguacuucuugucuucaaucagagauuaaaaaugaggcauuaaaaaaaacaaaaaccuaaggauaauagguauagaaaagaucaaagauucccacuuuaaagggccaguaaaugcauucauuauagaagaagaagaaaacuucccuaaagaaagagaugcccagccgggcagugguggugcacgccuuuaaucccagcacucgggaggcagaggcaggcggauuucugaguucgaggccagccuggucuacagaguaaguuacaggacagccagggcuacacagagaaaucuuaucuugaaaaccaaauaccaaaaaagaaaaaauaaaaaaggaaaaaaaaaaagaaagaaagaaagagaugcccaucaacauacaagaagccuacagaauuccaaauagacuggaccaaaaagaaauuccuccugacacauaacaacaaauucacuaaacaaagaauauuaaaagcaauaagggaaaaaggucaaguaauauaaaggcagacccaccagaauuacacaccagagacuaagaaagcuagaagauccugggcagaugucauacagacccccuaagagaacacaaaugccagcccaggcuacucucaauuaccauagauggagaaaacaagauauuccaugucaaaaccaaauguagacaauauuuuuccacaacggauaauagauggaaaacaacaacacaaggagggaaacuacacccuagaaaaagaaaguaauuuuucaaaaaacccaaaagauagccacacaaacauaauuccaccucuaagaaaaauaacaggaaguaacaaucacuuuuccuuacuaucucuuaauaucaauggacaaucacuuuuccuuaauaucucuuaacaucaauggacuuaacuccccaauaaaaagacguagacuaaaagacuggauauguaaucaggacccagcauauugcugcauacaagaaauacaccucaguggcaaagacagacacuuccucaguaaaagguuggaaaacaauuuuccaagcaaaucgucccaagaaacaagcuggaguagccauucuaauauggaacaaagucgacucaauagaaacagauguauaaaagaguuggggucauagacagaugcacuuggcacuuaaaaugagcagaaugcauagaaacaaacacuuaucuaggacuaauuggcuacucugggucuuuuguuguuucauaucuaauugaggauuuucuuucuauuuacgugaagaaugagaugaggaugcugauugugauuuuauugaaucaguaaauuguuuugguaggaaggucuuuuuucacaauguuaauucuaccaagguauacacuugggaggucuucaaauucuuguauguuucuuaaucccuuucuucacacauuuaaaguuuucauuguagaaguuuaccucuuuuguuauguauauucuaaauauuuuauuuuauuugagaaaauaaaauauuuagaauauuuuagguccaugaucucuuucucagcaugcuucuuacucauguauuaagacugguaaauuuuguaagccaauuauguaucauaacacuuugcugaaauuauugauaauuucuaauuuuucuagucaaauuagaaauaaaagaacauaagaauauaaucuucaauugaaaauaauuugaggggcuggugagauggcucaguggguaagagcaccagacugcucuuccgaaggucaggaguucaaaucccagcaaccacaugguggcucgcaaccauccguaacgagaucugacucccucuucuggagugucugaagacagcuacaguguacuuacauauaauaaauaaauaaaucuuuaaaaaaaaaaaagauaaaucuuaaaaaaaaaaaaaaaaagaaaauaauuugacuuaauauuuucccauuuguaucccuucucuugccuuauugcuccaacuaauguuucaaucacauuaugaugggaguauggagagugggcaguccucucccacugcugauuuuaauggggcuuauuaaugguuuuauucauuuaggaugauauuggcuauggguuugucauaauaaccuuuauuauauuggaauauguuuucuacagaccuacuugguucuacggcuuuuauuaagaaggcauguugaaucuuagcaaagguuuuuacuuuucuuuucuuuuuugcuuacauugagaugaucauaugauucuuguauuuuuuugucaauguauuugguucauuaauuuauuucuuauauguuaaaaaauaaaaucaaagaaaaaaaaguaucuucguugaaaauacaucucuugauugauagugggcauuuaacaaggaaggguuucugcagucacaguucuccuaugaguuuaauuuuguacuuucucuugccugugacaauaauuaugaauucaagucacaucaacagcaucugugaaacaauuacugcacggagggcugagucugcagucuaauccaucauaauuaugacaguccucuuucaagacgcuaugaugcaugacuuaaaaauagcgcguuagcgugcaaauggaucagcaucucauuucaccaaugugcguuuagugcuguaaugcagcccagcaccguuugacuuucucugaaucacucagaugauacccauaucagucaccauagaaaacugcagauggugcucaaaauuuggagggcuuuuuguuuuuguuuuuuggauuacuggucuuguacaaugguauguauuuuccagcucuaaauguaaaaauacacuuacacaagaaguacaauaaggcaguaauuuuuacuauaaauacuuucucuauauacuaauaauacacacacacacacacacacacacacacacacacacacacacacacagagagagagagagagagagucagugaaucauguuugugugugaauuuauccagaauaauggaggcaaauaauuauaguuacuuaugggcaggaaauguaucuacuuuaaaguccaugucccagaaucaaauuuuuuugggggggucauuguuugucacccuguuauuuccagugacaagcuuuauucuuuuugguaaacucauuuauuuuugauuuugagacagacuuucucuguguaguccuggcugccuuggaacuuacuuugcagaccaggcuggccuugaacucagaaauccauccuugccagugcugggauuaaaaccaugcaggaccacugccuggcuggcuaggaaugaucucuuggcauggagaaaagcuuagaaaccauacauagcaaucaauaaucuccagaacaauguuuuauucuuauuaccaaacuggaacauuauuuauaucuaccauacauuuauuucaagauuaugugcagugacccauuguaaugguaaauuuccauuaccucagauccaaagcucaaggacacacuguauuacccaguaaguccccaucucaaaguguacaggacaguggacaugauuaugcacuggagugcccuugaaaacaagcuucuugugaccaaaaugccacuuuuguguucuuauguucuaaaucuaccaaaucccuccauuuaguuuucuugcucucuuuuuagaagauacguauuuauuuguccaucauccaucccuccaucccucuauccauucauccauccauccaucuaggaugucagggcuccuauuugacuacuuccuaccuccuucccuugaagcagggucucacuuauauuguauuugaguuaguggccagcaagcuccaggaaucuuccugucuccacucccucagcacugggauaauaggcaucuauguaaacauaggugcccagaggcuagcagaggguaucaguguuguaagcuauuggauaugaugaauguugggaaccaaauucuguugagcaugucuagccugagccaucucaccagcccuaguucaguuucuuaguugauuugucuguaugguccuacuuuuuuaguaagaaaaauauaugggaaucaacagcuaccuauauucccagacuggucuuaaacucuguucagcagaggaugaccuccggccuugaccuccaagauuacaggaagcugacuuuacuaucuccuuccuuguaagaacuuucuauaguggagcauugggaauguacuuucaucucuugaaaaaggaccugugggaauagagaaauggcuuaauaguuaagagcaauuguugcucuuccaaguucacuucccagcacccacauggcucacaaucuucucuaacucuagucccaggggaucagaugcccucuucugucuacuacaggcaccaggcaugcaagugguaaggacauauauacauauaaaggcagacagacaaccacaaaauaaaaaaaaauuuaaauuaaaaaaagaagacagaugguaggggcauauauucaaucuuagcacuggggaaaaaacagaaguaggcagaucugugaguuugaggccagcacuucugucuaaaguucuagaacugccagggcuacacagaaaaccacugucucaaacaaacacccaccccccaacccaaaacaaaacaaaaagaaaaaaggggaaaagaccuguauaucaacauccuuagaagucccuagccuuuccauagaaauacugauaagauaguacucauacacacacaaacacacacacacacacacacacacacacacacacacacacacacacacaucuauccuuucuaggguagccuucccuccaugcuuggagggaaggcucugucugucaggcuuuuuagaaauccucauuaggaccauuuaauuacugucuuugaaaauuaaaaauuuuaucuuaagaguugggauuaucuuaaagaggcaaauagagauggggguggggguugggggaugggaaccucuaauuccuaaguaagacugccacugacaguuaaguaaauguguuugcaguuuguaacuaacucagucucccaaguaggagcaugccuugugucaauccucacuuacccaugcaccaguuaauucuaggacuguuucuuacaauggguuuguuugacuuucugcuagcuggaauuugucacaaguacauugguaaaccauaaacuuaaagcuaaaccuguuuauuuuucacuccacuccucuagaaucuaccaccacuugguugucuuugguaucuucaagcauugcccaaaauuuucaauucaauucaauucaauucaauucaauuuaauuaaaaaaaaaaaagauaaaucuuuccagugugagccagugccuugagcagaccuugggugcuggcagucccacaacaccagaggaagcaugacucccagaugcucuauuaugcccaggaucccaggugagguggccacaacaucugcuggggauguaacuggccccccaggauccaggaaagcaggaacucccucccacagccagaggcauagguuccuucuggucugaaucugcaccuggagcagaccuggggugcuggcucugcacucacucuuaaaaccccccaugcucauggauuggcaggauuaacauaggaaaaauggccauccuccugaaagcaauuuacagauucaauggacuccccaucaaaauuccaacucaauucuucacagaguuagaaaguacaauucucaaauucauuuggaauaacaaaaauccaggauagcaaaacuauucucaacaauaaaagaauuucuggggaaaucaccaucuaggggccucaagcuguacuacagagcaauuaugauuaaaaauaaauaaauaaauaaccuguaugguacugguacagacacagucaagauuaauggaauagaauugaagacccccacaccuauggucaugaucuuugacagaggagcuaaaauccaguggaaaaaagacaacauuuucaacaaauggugcuggcucaacuggcauguagaagaauguaaaucaauccauuccuaucucuuuauauaaagcugaaguccaaguaaaucaaggaccuccacauaaaaccagauacccugaaacuaauagaaaagaaaggaaggaagagccucaaacacaugugcacaggagaaacuuuccugaacagaaagaacaccaauggcuuauuuaugcucuaagaucaagaauugaaaaugcggccugauugcaaaagcuucuguaaggcacaggacacuguaguaagaaaaccgcaaccaggauacugggaaagaucuuuaccaacccuacaucugauagagggcucauacccaauauauacaaagaaguuagacuccaaagaaccaaauaacccuauuaaaaauugguuacagagcuaaacaaaauucucaacugaggaauauugaauggcugagaaacaccuaaagaaauguucagcauccuuauucaucagggaaacacaaaucaaaacaaccccgagauuccaccucacacuagucagaauggcuaagaucaaaaacucaugugacagcagauacugucgaggauguggagaaagaggaacacuccuccaaugcuggugagauugcaagcugguacaacucuggaaaucagacuggcgguuccucagaaaauuggacauaguacuaccugaggacccagcuaaacuacuccugggcauauacccagaagaugcuccaacacauaacaaggacacaugcuucacuauguucauagcagccuuauuuauaauagccagaagcuagaaagaacccagauguccuucaacagaggaauggauacacacuggauacagaaaaugugguacauuggaguacauaauggagcacuacucagcuauuaaaaacaaugacuucaugaaagucuuaggcaaauugauggaagaucaguaagagaugucaauaaauucauugccuaucaugggcuaucuguuuaagacaguuuacuaugugccaguccuaaggcagccaggaaaacauuccacagaggcacagggagaagaaugaggucuucaaggucagacuagacaaagugagacuguuaaucuauucagagaaccgaguaaaagaaacccucuaagaagcauaggaaaaaacaauacuaagacauguuuuaaagguaccauggauaaucacauaaccaguaacaaguucccuuuacacuuuaagacaacucuuuaacuugaaaacucuaacauuuuaguauuacuaugugguaccuuuagauaguaucaaaauacagacagaaagacuaauacuuuguuauuaauaaaacuuuggucuagaagcaggagauggcucagugguuagcacuugcugcucuuccaggacccagguuagguuccuagcucucauaccagauugcuuacaaccauguauaauuccagcuccagagaaccuaaucucuuuuccuuccaaguucuccuucaugcuaauguauauauacauauacucaggcacacacacacauaaaacuuucuaucuguggagucucgagauauaaagaucucagccggguggugguggcacaacgcauuuaaucccagcacuugggagguagaggcaggcagaucucugaguucgaggccagccuggacuacagagugaauuccaggacagccagggcuacacagagaaauucugucucaaaaagaaaaaaaaaaaaaagaaaaaaaagaauuuuuaguuauagggauacauaagacaugcacaaguaugacuacucaagaguaaaaaaaacaccacuccaucuugauauuuuuaaauuagcaauuuggggccuggagcaaugguucagugguuaagaacaccgguuguucuucccaaggacccagauuugauucccagaacccacaugguagcucacaacugucuaauuucugucccuacuucuagguucuaagagcaccacacacauuuggugcagagauauacauucaggaaaaacauucauacacauaauaaaauagauauacgggcaauauuuuggauuuuaaaugcaauaguuaauuggugguguaauuauuuucuggggauucacuaaaauacagauaaguggauauuagccccaaagcuuggaauacccaagauacaauucgcagaccacaugaaacucaagaaggaagaucaaaguguggaugcuuuaguccuucuuaaaaggggaaacaaaauacucaugggaauaaauagggagacaaaguguggagcagagacugaaggaaugaucagccagagacugccccaccuggggaucugaaaggagaaccccaccuuguuuuuaaugggugagcauuggaauagcuacgaaaaagggauauaugaagugaguacaugcagaugaaauggaucaugggucagucuauggaugaguacauagcuguacucuccaggaaaaagugggauuggccagugagugcaaucccugggcaaacagacaugaaugaaacaaagaugugucagcaaacaguaccacugacagucagacaaugaauuguucacuaagacugucuggcagcagauucccuuaagaacaauucauuucccucaauccaggccagaagagggcacuugagccucuggaucaggacuuacagagggccauagccaucacgcauacuaggaaguagacagugaaugcucugauguaccucacagguacagguggagcaucaucuauagaacaugcaacaaaucuaacauuccacagaauagcauauaucaaaacccaaacuuagaugaaugcguuauguaguuuuaauuaagcagggggugggagguggggagggguauuaaaacaguuucacuauguagcuaugcuugcccuggaauuuacuaucuagacuagauacugucuauacuaguuugccuugggccugcugggauuaaaaguugacuucacuguagcuuaggauggucuggaauucacuauagccuugaacugguaagaauucuggcuuagcuucuccaguaccgugaauauacggaggccaccacgcauguuuuaaauacauuauuccugaggugcugagaagcuauggaugaggggaaugaauauaaauuaucacauuaaacuuagcuggggauguaccuauguaaauuaucacauuaaacuuagcuggggauguaccuauguaagcaaccucaaacaaacaaacaaacaaaaauuuuuuuacccauaaguaacuuuugaaauaguaauuguguugagauuauguacaaagagcaggcuuagggaagucugccacacuggaaauuaacuuuuaacauaauuuuggcuuuuguuguuucuguugagacuguuucuuuguguagcccuugcuguccuagaugaugcuuuguagacuaggcuguccuagaacucagguccuccugccuuuucaugugccaccauacucagcuucaguuuguuuuguuuugguuuuuguuguuguuguuguuuuguuuugacauuagcauagcagguauuuuguuaaaugccuguguuuuaacuuuaaagauaaaugagaauuuaucacuaacuuuguauagcucggguccaccugccuaggaaugguacugcccagagugggcuaguccuucauaucaauuaacaagucagaaaaaaugucccaaacaugccuacaggccaaucuuugaguucucucucccuggauaaaucuaccuuguuucuaucagagugauaaaaaacaaaacaaaacaaaacaugguuuucuaacuuaagguaacugccacacaacaacugcuugucuuauaaauauuuaaaaguaccaccuagauaauuaauuuugaaguaguaaaaaaaauaaaaucacaaggcacugaauuuagaacuugggcugaauuucaguaauaaacaugggucaagcaucauuguuuuaaaaguucuuucauuauuuuucauaugaguauuuauuuuaugggcugcaaguagucagaagucuguagaaauacacugaaauugcauuucuaguucagugauacccauuugaagaaaauuagagaccauaaggccucaugacauacuuuauggacagcauccuuccaauccagcacuauccaaagcaugcuuaugauauacuugacacauagccucacugguucaacugacuuuuauugaguuguauguaaguacuguaaaacaguguagccuggacagcacacauaucagagcuuucuccuaaguacagcugucaaucauggucaauaaguaaugcaggacccaaacaaaaaugaagccaugaacauuuacaguaauugucaaguuuauuggcaagugcuauuauuaaagaauucaaauuggcaaguuacagauagggggaaaaaaaucuucacuaaccccacaaccuauagaaggguaauauccaaaauauauaaagaucucaagaagcuaaccuccaaaauaccaaacaacccaauccaaaaaaaaaaaaaaauggguauagaacuaaacaaaauuucacaacccaggaaucuuggauguuugagaaacaccuaaagaaauguucaaaguccuuagugaucagagaaacucagaugaaaaugacccugagaauccaccuuacaccaaucagaauggcuaagaucaaaaccucaggugacaacacauguugggagaggauguggagaaaaaggaacauuccuccauugcuggugggauugcaaacuggcucaaccacucuggaaauccaucuggaguuuccucaaaaaaauuggaaauagaucuaccugaagacccagcaauaccacucuugggaguauacccaaaagaugucccaccaugcuacaggggcacaugcuccacuauguucauaguggccuuguuugugauagccagaagcuugaaacaacccagaugucccacaauggaagaauggguacagaaaaugcaguucauuuacacaauggaauacuacucagcuauuaagaaugaggacauccugaggcaaauggauggaacuagaaaacaucauccugagugagguaacucagacccaaaaggacaugcaugguauguacucgcuaauaaguagauauuagccaaaaccaaaaaguacagaauacccaagauacaguccacagaacucaaaaaggucaacaagcugaaaugcccaagugaggacaccucaguccaccugggagggagaagaaagaaaucacaaugggggaggaaaggaaggagagagagagugacuugggagggaaaguagacaggaaacgggagugggggguaugauuugguauugggaggggggaaaggaccaaagaccugagggccagcagaaagaauggaaacaggcaacagagguuggggggggauagaccuuccagaauauaccagagaccugggaagugagagacucucaggacucaaagggaaggaccuuagaucaaauguccaacaguagggagagggaacuuauggagcccaccuccagcagaaagacaggucauugagugagggaugggguugccaucccagucaaaacucugacccauaauuguuccugucugaaagaacugcagggauggaaauggagaggagccagaggaaaagaagguccagcgacaggcccaaaguaggguccaacucaagggguggucccaaggccugacuguuacugaggcuauggagcacucacaaaaagggaccuagcaugacugcaacuaggaugcagacuggcagcagugguauagagagcaguguagaccugacuggccuagaacuucuauggucaaaacuaaccugcuuuagucuuccaagugccuugauuacaggaaaacaccacaccauuuaauucccauagcuucuauacccggguagaacaucuggugccaggggaagagcccaggccuaagacaguccccuauuagaugccaguugaaagccuuacuaugcuucugaccaauaggccacaauuuccuuggguuugacucauuucucagagagcucacaaaacucaagagcacuguauaaaccacaaggcauucuauaaaccaauuuuccauuaagaaacuguaagaaggaaagagagguauggaagaaaagagguguagaaagaagagagagagagagagagcuugaagcucccuuaccugcuuugggagaucacacacacuucagugucuuccacacacacuccgcuggggcaugcuggaggacacuguccuuuacgggcuccuauaaaacuugcaaguguaaucaaugcuaaugagcuggguggagaucagggaggugccuuaacauucugggccucucccaccucccucgggcuggguggccgucgucgucacacucaagaaaguccaguuucuccgaccuacccuagggacaauaaacucagccugcuauggggaguuacaagcuagacgcaaauuuaaaaacugacauaucucauaaugucacugaauguaagggaaaaggaaauuucaaccaaaacgagaacacaaauauauuacucaacaguagaacagcauguuuggaaauaauuugcuuggcauuauauaaaugaauuauauacuugcgugucacccugccaaaggaauuagcaugcagcauggcuguagguagaaaauaugcccucaagugcaagcacaugcaugcaaagauacgaagagacauccacccacgacacacauagacacacagauucagacacagugacacagagagacagacauauagacacaccugcauaggaaggcacacaagaaaaaaauuuuuauauauauacuuugaaagaagugaaugucaaaaagaaaaaucacagggaugggguugccaucccacagucaaaaacucugacgcagaauuguuccugucuaaaagaacugcaggaacaaaaauggagaagagacugagggagaggauguccagugacaggcccaaauugggacccaucucaaggggagacuccaaggccugacacuauugcugaugcuauggugugcuuacaaacaggauccuagcauggcugcccucugagaagcccaagaaggagcugaaugagucagauacagauauuuacacucaaccaauggucugaaguuggggaccccugugguugaguuagggaaaagcuggaagaagcuaaggaggagggcaaccccauaagaagaccagcaguuucaacuaacuugaaccccugagaucucucacucagccaccaaccaagcagcuggucugagguucccaacacaugcacagcagaggacuuccuggucugaccucagugagagaagaggcacauaacccucacuugguggggugggacuuggugugaggacauccucuuggagauggggcggguaggggaugaggaauagucagaggguggacugggagggggauaaagucuggacuguaaaaaaaaaaaagauaaaagaauuuuaaaaaaaugaagaaggaggauuuugaauuugagccuugggcucaaaagcagggaaggauggggaugaugacugacagacaacagacagacagaugggaauauuaaugaauaaaugacucauuugccccugugcugggauuacagguaugugccaccacacagcuagcuacccaguucccuuuuugucguugucauuguuguuguuguuguuguuuuccagacaggguuucucuguguagcccuggcuguccuggaacucacucuguagaccaugcuggccucaaacucagaaaucagccugccucugccucccaagugcugggauuaaaggcgugugccaccacugccugguuuacccaguucccuuuuaaaagaacauuauaguguccagugggcauggggggggggugcaugaauuuacucugggaggcagagguaggcaacucuguuaguucauaguaaguuccaggccagccaggguuucauaguaagacccuguguauauguguauguggggagggggaacauuuaggaagggcaaaaugaguaggcuagcucauuuuguaugucagcacuaaccaaauugguguaaguacacuccuguccccacuugagguucagagcuacaaacauggcugcauuuggacacaauuuagaaggccuggaucugcuuucccugguuguaauccuguuuugucucaaucaacuuuaauuuuuguuuuagacuaaauuggccuuauucuagguuaacaaagauauagagauuucuguuuccuuuucuaagaaacuuuauuuuaaaaaaaaaaaagccuuugaaauaaguaccugaaaauagugaugagcacggcacaucuuaaagugcauggaauauucuacuuaguuuuauucucagagaaaggagaaccaaaauaaaauuuaggcauuccaagucacaaaagcacaaaagagagcuaagggcacuguacucacccugauguuaucacuagacaguuaagggccagaagaucagcaauugaaaugcaucuucagauacgcagccccagccuagaucaaaagagauacuaccucaaaagaccacaacaaaagcaaacagccccauaaaaacccuaaaucugcaauggguagagcuggagaaggucaaguugauugagauaaccagagagacaacugucauguguucucucugccuaggccccaucuccaaaccugcagaugugaguacagaucauggagcaaguacagaaaccagggaaguaagaagggaccguugcugguauggaggggagugggggauaacaggguccauguggucuaaccagagaaaugagaaagaggcgcuuuaauuagggaggagaaagagagggacagggaagcugggacuaaagaaaugacucaaugguuaggagugcuuguugcucuugcagaggaucugugacucccagcaccuacaauauggcucacagcagccugcagcucaaguuauagagaaccuaacacccucucugcccucuguggacacugggcaugcuccagguacacauauguacaugcagaucaaacgcuuauacauaaaaaacugccaugaacauauuucugcagguuuuuauguagauaaaaaaaucuucaguucgcuuggguaaauauucaaaauaaauaucaaguugcuguguuuaaaucuaaacccucacuaagauuuaaggagaguauauucauuggucaaaaauuacaaaagccuuaaauacaaauaggacauucacacgggaucagaaauucuacaagaaaacuaugauuggccugaucucaacauuaaaaucuaagaugauacacaacaucuuccuauugauaaaaacaaucugguaggcuaauaucugaaacgacgagcaaacacuucuacagccugccuuggcacucuggcuuuauuuuagaauacaaaguguuuucaccaagacucucaucucugcuuaaaauaucccaugagaucaauagaggcaaaugauacucugcugggagaggaagcugaaauccaaggacagugaaaaugacuuucucagugggacucuauuucagucugcuccacuuguucuaaauguucuuguugcauguggaucuguaguaacgcaagacuccugcccagcugcuggugaauucugagauugccaaauuucucagcugaauucuaugacagugcucauauucucuaaccccugagaaacgcaggcuacacaugcuagucuauaucucacagggcucuaacacaguucucccacagcucaaaccaggcugugccaggguggagagaggaaagaaaugaauacggacaaucaaaaccuuucaaauacacuucugcaguucauuugcuaaauuguuauaucuuauuuuuaaaauuuaacuaaaaacagggccagcaagacaauccaacagguaaagaaaggcuauugaguccagugagcuccacccccacagacggaaaggaccaacucccaagaccgcaugugugcauguguccauacacuacaauacacuuaacaacacuuuuaaaaaguaaaagcaguaacaaauggcaagaggugaaaagucauuuggagacugaagaacucggcaugagauaaucugcuguaucuguguugguuuuaaaauuuugugucagacucccucccccuuccccccacauccugugucagucaggcaauagggcgaccuagagucaagcuaccugggaacuugaggcaggaggauaacuuuaguuagacagcaauagaguuggaccucaagucaguaacaaacaaacaacaaacuaucccaagauucaaagggcaaguuaggcaaaugacuacagacuucaguucaccugaaugguuuguaaggaagaaacacugagaucuugcucauuugaaacccaggugacuuaaaccugaggagcaacaggcaccuuggcaagaacagagaguugucucuuuccagagggucaaggguacagacagacaugcaaacacucacacacauaaaggacuaacuaaagaaauaccagaaugaaacaaaauaaaaacugaagaaaucauuaagauuagugauaaauaaugacaguaauggugauaacaaaauauauucuaguagaaaaccgggaagucacauuguacuugacucgauagauagauaaauagauagauagauagauagauagauagauagauagaauccauaaaagaaugcuauuacuguugucuauuucuugauugccaaguaaaacaaaacuuaaagaaggccuuagucauaccugcagcgauguacucaaguauguccuacacuuauuuacuacagaaaacuaagucugacgcugagcugucccaucuguaaaaguuaagugugaacuaagauuaaggagggguuaaaggaaagaacuccucagcaagccaagucaccaacagcgaaaaauuuaacuucuaugccuuuuuaguuauuucucuuacaugcuuccauaaacuuguacacucccuuccucacccacccuccagcuccaagaagagaaccucugagucaugcuauaaucucacuaaagagaugaaaacuccaucuuagcauacauguucugggaccucaaguagagaacaggagugauggaguggucacaguuggcgcccacagggggaggugagcagcgauugggugagcaggagaggaaguaacgccugcuagguuuauaauuacccaagauucccaacaugaacagggaaagaaaucuaagaauaucaacaauugggggacaaucuuuauucugaggguucccuuacgaugacaucaaagccccaugguaaaaagguaaucuaggcagccucagaagccuggggcaggguggcaguggggggguauccaaggccagugcaaagacgguaccaagucagugacucagaagugucaaggggcagaguguucacuuacauccucaagcuccaagaaugagggcagagguucuagcuagcagcauaaagauacacugcagcugaacuaccugcucagaguuauagauggaauacugucaaaaaucuuccuuugcucucucugaccaccagcgcucucccacaugacccaccccugccacuucaccuggcuucuagcacaggaaaggguagauauagaaugcauuucauuuuccaaugagggggggcauccguuuguucuuuacuuuuuuaugcauauaaauacaugaaaaugguuuuauaaggaguccuuacuuuguggcucaguagguaaagguuucuccugacaaccugcguuugauccccaugaccuacgugguagaaggagagaacagacucccgaggguugucacuuuaccuucacaaaguacaaguacacauauaggcacacaugugcaugugcacauacaaagacauggcaggggagagugagagcgagaggaagagggagaaacccuaaacuucgucuacagaugacaagaugggcaagggugcuugcugccaagggugaaaaccuaaguucuaucuacagaacucacaugguaaaaggacagaaccauuucuacaaguuguucugugaccuacaaguacacucucacacacacauaauacacacacagaccacacacacacacacacacaucacacacaucauacauacugucuuaguuaggguuuuacugcugugaacagacaccuugaccaaggcaagucuuauaaaaaacaacauuuaauuggggcuggcuuacagguucagagguuuaguucauuaucaucaaggugaaagcauggcagcauccaggcuaucauggcgcaggcagagcugagaguucuaagucuucauccaaaggcugcuaguggaagacugacuuccaggcaacuagggugaggaucuuauacccauacccacagugacacaccuauuccaaccaggccacaccuccagauggugccccucccugaucugagaauauacaaaccaucacacauacauacaaacacacacacacaaacacacacauacaccacacacauacaccacacacauacacaucacacauacaauacauaccacacaccaccacacaccauacacacaaacucacacacaaacacacacauacaccacacacacacacacacauacaccacacacacaaacucgcacacaaacucacacacaucacacacauacaccacacacacauauacaacacaucacagacaucauacacacacacaaagacacacauacaccacuacacauacaccacauacauacacaucacacacaauacacaccacaaucacacacacaaacucacaaacacacacauacaccacacacacaucacacacaaacucacacacacaucagacacaucauacacacaaacacacacauauacacaucacacacacacacacacacacacacacauacacacacgcaagugauguagaaugucgaaugucuucuccccccucccgcaaguaaauaaauaaauguaauauauuuuuuuuuaauuuuaagaacccugcuuuaggaaacuuacuaguaguucagagcuuugaaagcaaacaggucuuuauuaagaucaacuuuaaaggcacaagggguucuucggauuuucuugcacccacugccuguguuguccucucaggagcugguaugaaugccugucaccucuacagcacacgucacaccuuaguucucugcuaguacccugcugccuacuaccacagcagcuuccacuccgaguacucagugcagaccuagcaacaaaugcaaaugcucgcucaggaaguggcuguccuugagucagaaagggagggagagacgcgguggcaauaacauuccucuucuccaugcuggcuaguacgccaagaagacuuuuacuucuuuuccagaaagauucagacauugagaaucugauaagaacccucuauaaaaauaacaauccagaaaaauagagauauguauaaaaucaugcaaauuagagauuuaucuuaaaaaucuaacccuuguuacuguuguaauucccagugugaccuguaauugaagacagagacgauaguauguauguaacugcagacaacuuugaacaugcaagccaagcacccaucaugagcccugccucacuuaccagcagcaccgucccucacugcuccuccuggaucauguccuguugaccgugagggagcccaucuccugcuuccaagcaccguagcggaacaggaacaaggaacaugaagagucuugggagggcaagcugcugaauguauaccagccuagagaagacagaguuugcaaauaagaucagggcaucuauacuuauuccuaaagguacacucugcuguucuaauuacauggcugaguguuuaaaaaaaaauuaagguuaaaacauuuuugucaaagcaguaacaccuucaaaugucccaauaaaaaucccgucuguguggagcacuuugcgacacgcaagaaccaacaagucaauccuggcgauggucaaguagguuccauacaguuccacuggcguccuuauuuuaucuguugggcucagugcccgaagacugggcugucagagcagcaucucggugcuaggaugagcccuucacccggacucugaucugaagucucugguaggacuuuguccccaaugauucuauggaaggcagaguugaagaccagucauuuaagccuuaguaauuacugaauggagcgcgagguuaacucuguauacaccaugagacggcagugugcggcugcuaaggaaagaaggccugguggucccucugcucugaagcguucauuuucucuaauacucauuuucaaauaaagauuuggauuuauuuaucuuauguauauaaguacacugcagcuguacagaugguucugagccaccaugugauugcugggaauugaacucgggaccucugcuugcuccggcccugugauuuauugauuauuauauaucuaaguacacuguagcugucuucugacacaccagaagagggcgucagaccucauuauggaugguugugagccaccaugugguugcugggauuugaacucaggaccuucggaagagcagucagugcucuuaacugcugagccaucucuccagcccaucuaauaugcauucuuaaaagauuaccugaaaagaaaaauacacugaaaacaacagaaccuacuccaccaaagacacagugaaagucuugaguguuagaaaauuuagaguucuacgguaggguggaguuacuugagagagaaauggggcucccagucuucuacaaccuuuccaacacguguugugguacauucuuuuaauuauauucacccucaugaguggugaauggugaaaagugcucugaauaaugaaggguaagacauucaguacuauauagcuaugcauggggugauugagugugaaaacaaguagucugaaauugagucugaaucgaaaggaaaugacuagcuggggaacuucuaauaauacauaaacaccaaguucagugacauccuagguguguagagaaaaaagaaugacucagugacaguaacaaagcuuuggguuugagugacaggaucgguggugacaucaccaaauaaaugcaucaugguuccggaaaggagagcugagagaagacacagacuucaucuuaacacacuuggggauaucuaggaauuuccaauaaauaaagauggaauuuaggaucuuucucucuucucuuucccucgcuaccuuaaccccauucuccaccccccacccccuauuuucaaagaaauuuggguaggaucaugugaugguuuguauaugcucagcacagggaguggcacuauuagaagguaaggcccuauuggaguaggugcggccuuguuagaauaggcgugucgcugugggugaggacuuuaagacccgaauccuaguuuccuggaagugauuauucugcuagcagccuucagauaaaaauguagaacucucagcucuuccugcaccaugcuugccuggauccugccaugcucccaccuuggugauaauggguugaacccugaaccuguaagcagucccaauuaaauguuguccuuauaagaguugccauggucauggugucuguucacagcaguaaaacccuaacuaagacagauuaaaagagggucauugucauuuccugacacacuuacuugagaucucuccagcugaguucagccacuuacagacagaacacgaaagaaggcaagggggauucugccuucuuguuuuuuuguuuaaaauuuaaaauaguaaaacuauacuaaauauuaccaggccuccaauuguaaacuucuugagguggaauacuucuuuguacaccauggggcucuggugcccucuacucucagauggacggaagagcguguucaaagagucuucccucuaaggccuggcacagguucaggaguccuagagggccgaguguugcuacagcuuguuaucugguuggcugggauuccagcuggcaaacugucaaagagagcuaugagguuccaguuuuccaugccccaaacaaugucucagcacacaacuuacacggcuaacaacggaacuacuagcaacuguauucuauaacgugcaauuguucugaaacuaauguaguuccuagacagauuuuucuccuugaauugaaaucuacucuaauuuuauucuuauuaguuauucgcuguuuuaaaaacagauuuucuaggagauaaaauuuuaaauaaguuaaaaagcuaugaucaaaccagcguuuuaaaacagauuuucugcuauauuuucuaaaagguaaaauuaaaauaguaaauuaaaaagcuaugaucuacugaaggccuuuggacucauuuagguucaacacagugucuccuguagguagguggcagagucccagagccucuacuaggaucaaccauguuauugugucagagccuauuucaaaccuuacaagugcauuuucuuuccuuucuuccuuuuucuuauguaugggaggugugugugcacgugcguguguguguguguguguguguguguguguguauguguguguguguguauauacacaucaaccuucauugcucuccaugcagugaagcaggaucucccacugaaccagcagcucugcaaaucuagcuagccagcuugcccugaggaucccugcgucuccggugcuggaauuccaggaagcuucuagcuuuuauauggauuuggggaguccucccacuugugcaguaagcauuucauccaccaagccaugucuccagccaaagcaggccuuuaacaaagaaaaagaaaucucuaaaagccagucacucaaacuauacauacauacaaguaauguacacugugaauaacaucuuucuauugaaauucuuuauuauuuuauuuuaaggcacugccucauucuauaucccaggcuggccuggaacuuacuaugcgggucaggcuugccuugaucgcccuucuucagccuccugaguacugggauucccaacauaagccaccauguccagggacaaagucauccuuggccaguacuuggauccauggcuagccaaagucaugaaggcuccacauuccgcccguugggucuggcccuucugagcggcccagcauggccuguuuccuuccucugcagaugcugucucugccugcugggauccuccaggucuaaauagggucagaguagaguacacugcccagcagguuacugaccucagcaggguguguccacaaaauggcucuccccuuccacacacacccagagcuagcaaaugaccucagcugcccaguucucagaagaaaacgcuauuucagaaucgcagcaacuuggcagcaauggcucuuuccuuauuaaugcuuugaaaaugauuacaccgagaacaacugcuuuaaagcaaagccaugagaagaaaacugaggaagaucucguauuauuucugcucucauuccuccuaacuuauacaaagugugccucugaaggaagaauucagcaggaauuugcauaacaaauuucagcaaaauaaaaacaagugugccccaccuacauccuuucuugucaagucuuugaagaccugaaaucccaaacaaaucugaaauauuagccagcauugaagauagugugaccaucacugcacugcacugagagauaaacaggagccaggcagaaugucagaaagaccuauagcaucuucucuaugaaaagaggagacauaagucaauuuacauacuugccagaaacaaacaaaaacagguugugaagaaaaaguuauaguggguauguuuaaaaauaaagauagcauacccgaaucccaugcacccaccggaagaagaugaagaaaaaugcagccgaaggccaggugcaguuccucgagcuucuguuaucucagcaggcaggaagcugaagcaggaaggucgccugcccaguuccaaaacucaucaaccauacaaaaggaaagcaugcggaaguuucugagucugaccuaaaagcauuugacacucugacacuggccagcaacugaccuccuuggucaaaaucugggccaauggcaggugugucuaaacauugaaagccagcaaaagauaugguguacuuuacauccacaaaauaaaaaagaaaacuuuguacaauggaggugccauugugauauccagacaucuugaggauucucucugacaaucccauauaaagacaaagggaagaagcuaggaaugaaggacaccuuuaacccagcacuaaggagaaaauggcaggcggaucucuaugaauucaaggccagccuggucuacagaacaaguuccagaacagccagggcuacacagagaaacccugucuugaaaaacagaagggggcuguggagguaccggaaagggcagagaggagaaagaagaggauagagcuuugcacugguuuuaaagguucaucugacauuuccuuuuucuucagacaaagaacucuaggcauggugauugugguuguuuaaaugaaaaucccccuuuaggcuuacgcuuugaaucuucagauuguggcacuauuugggggaacauuuagaagguguggccuugcuagaggaaguguggcccugugggugggcuuugagaacugaaagccaacugccagaucacucugcacuuucuucugcaguuaaggaugugagcuaucaguuuucuguuccugccccuaggccugcugcaugcagccuucccucccagcacgaaggucucuuagccuaaguugcuuuuggucacugcaucuuaccauggcaacagaaaccaacuaaugcagaggauuuaucgauauaguuacauacaggacaauaauucuccuggagggcuggagagauggcucagcaguuaagagcacugacugcucuucugaagguccugcuuucaaaucccagcaaccauauggugacucacaaccaucucuaaugagaucugaugcccucuucuggagugucugaagacagcuacaguguacuuacauauaauaaauaauaaauaaaucuuaaaaaaaaaaguuucaagccacccugugccuuggcacacaguccccagucccucagagagacugccaucuucacuguuaaaaaugaugaugaugauggccgggcagugguggcgcacgccuguaaucccagcacuugggagguagaggcaggcggauuucugaguucgaggccagucuggucuacagagugaguuccaggacagccagggcuauacagagaaacccugucuugaaaaaccaaaaaaaaaaaaaaaaaaaaaaagaugaugaugaugauaauucuacuggaaagcaauuguguagcccuggcuagucuuuaacucacacuguagaccaggcuggccuugaaccuugccgcagcagcucugagguucucaacccuuuaauacuacacuucagguguggcaacccccaacauucuuugcuacuucauaacuaauuuugcuacuguuaugaagcauaauguaaaugucuguauuuucugauggucuuagguaacaccugugaaagagcccuuuggcacccaaagggccugugacccucagugcuugcaacccacuggcuuagacgcuggcuuugauucuggugggacaaaugcaugucauauaaauagccagguguggcgauauacaccugaaaccccagcacucuaagagagagaggcaggaggauaaccacaaguucaaaucuaggcugaguuacuuggcaaguuacaggcuauaggcaguguuacauauaaugaugaaaaugaaguugaagcaggagcagacaauauguagaaauacaagguacuucauauagauagaacuaucucaccuuauucccaguuacaugauucuaaagguaacugguuuuuuaaaaacagaaucucauguauccuaagcuggccuugaacuugcuacauggccaaggcugaucuuaaauucccaguccucuguccccacuucuugagugcugggacugcagguacuucccacccugucuaguuuaugcagcacagaagagugaaacccaggacuuuuguguguguguguguguguguguguguguguguguguguuaagcaagcuuccucuacuagcugagccacaccuccagccccuaauaacaccguuuuuacaaagaauauucccuaagcagaaauguguaaccacaguucagucacaguguguaucaguggguucaaagacauuuuauaacauaagcucuauuccuuuaaacuugugaauuucaugucauaaaaugucaugguggacuccuggagaaaagcauguaugaccaaguuucaaccagacugaauuauugacugcaccauucauaauggacacacauuaaggaucagaaauacaagcuuuagagagcugcuucaaaucgguaacaugacccuagauauuaaaaauaguuuagcuuccaauauucugaggaaaguaugaggcuuguauuaacccuaccuuccaaugucuucaaaacauuaaacaagaaugaauguugaccauuaauugggucauaaauaacucauagcccugccuucaagugaaggcuuguucacaugagggacgauuuaagaccauugagggaguggcaucggucccaacaucaagccucaauuagcuggacucuacagacuggugcuaugcagaacuacauguaaugugaaacuucccucuccaacaccacauuauaaggcugguaaucuuuggucuauuauuauuuucuuugaaacagcauuacuuggcuggagagaugacuugacuuggccacuaagaccacauacuguuccuugcagagaauugcaaguuccuggcacauagguugggcagcuccagcucuugggaaccuguacucccaugucacacagccuugugcuauacauaauuaaaaacaaacaaaaaaaugaucuuaaaaaauguuauaaauaguaucacuuuagaaacacuaguguugaauuuuaagcaagcagguuuuaucaauuccuuuuuguuuguucugggacagggucuggcucucagguuguccucagagauuucagucucuugauucucccuucuucggcuucucuagcacucagaugagaggcaugcaacaccaccuccggguggauuuuuaucaaaccucacuucuaauaaaaaaguagcugggcagugguggcgcacaccuguaaucccagcacuugggaggcagaggcaggcggauuucugaguucaaggccagccuggucuacagagugaguuccaggacagccagggcuacacagagaaacccugucuugaacccccccaaaagacauaaaacaaagcucuacagcuauauuuaucuguguuguuaaaacaaauugugcauuuugcaaacuagaaauuuuauuuaagaugaaauaaaaauaauucaaucacaaucaugccaugguggcucacauuugucaucccacaacuuaggaggucaagguaggaggcgcaguaaguagaaauucaagauguaccccacgugugcaugccugugugugcaccaaaggauacuacaguucccaaacagaaagcaaagauaaaaguuugaucagaauuauuacuauuguuauaucaucauuauuauuauuucaucagagucucgguauguagcucuggcuggccugaaacuuauauacacaccaggcuggcuuccaacucacagaaauauaccugcuucuauauccaagugcugggauuacagguguaugguaucacacccaacacagauuguauaaaaaaaagcacugaauugucagggucucaggccagcauaguugggcuacauggcaaaauuuuaucucaaagggguaaaaagaagcggaggggaaaagcguucaucaacuuaaaacaaacaaguaaaugaggucucucuugccaugaccaauaguaaauggaauauuuagcaucuaaugugcaaagccugaggcacaggacagagcagggucccaguagucaucuagagcccacccauaagucguauguuauuuugguugcagggcaguggagagguccagaaguggcagggagggagguccagggacugaggcagcagaacugcccucucucucccuuggaagcacucgagugagcagcggcucagccacccucucgcaccugcugcacacggcggacacugcuucuucccacagauccuaagggauaaaaaaagcccggcuguugucaagucucuuugaaucuaacauuugcuggggagaaaugucacuuaucacccuagugacagcaagagaccaagaugagagggagaaaaaaauauuuuuugugggggagaccccaaacauuuaaauauaacaaacuuguaaaauacuuucaaaauuauacaaaaaaguauguucucaggccucaaugaaaauggaagcaggaggccaacuuuucaaauucuggccaaguuaacugaauuuaaaacuauuuuccccuaaguaacgaugcuagcuagcauaaggugguauaaacccagccaggcauaauagugcgaccuguacuuggaaagguaagacagugagacucugaaaaaacaggcaaaauaaaacaaacaaacaaacaaacaaaaaugccaaaaauacaagcacaugucauacuuaauguuugauaaucacauaaauggauaagaaauucaaauguuuauauaacaagcguauggcuauuuugaucaaaguaauuauuauuguguuauacaaaggaaguauaacuauuacuacuuagaaacuguuuuguuguaaacauuuuaaaaauagcacaaauugaaaaaaaccaaacuuuggauccugaugcagaucauaaauaggacauggccacacagaggugcauugugaagcuacacguaguucugagcuguuauaugggugcugggcaucaaaugaggucaacucuucagcauguaaaaaauucuccuuaaauguucaaaaucagacaggaagaugaaggcucaggagauaacgugcuuacuguacaaacugauaaucugaguuccaucccuggaacccguguaaagaggaaggagagaagagauuacacaaguuguccucuagccucuauacacaugccacuguauauguauacuccccuaauaauaacuuuuauuuuuuuacagucuagucauuauucucccgcuggucugcccucggacaguuccucaucucauucccccucacccuugucuccgagaggauguccccaccuccaccugcccccaauaauaacuuuuugaauguucaaaaucuacuuuuauuugauaaaucuuccaagauaccugaaaaaagacccugugccucauugauuguccuuuggugaaggaguucuagccaccuguagcuucuguguugcugaaaccaauauaagaguugucuauagggggcuggagagauggcucagagguuaagagcacugacugcucuuucagagguccagaguucaaaucccagcaaccacaugguggcucacaaccaucuguaaugagaucugaugcccucuucuggugugccugaagacagcuacaguguacuuauauauaauaaauaaauacaucuuaaaaaaaaagaaagaguugucuauaacuaugcuacagugaagaguggggcgggacagagaagcagaaaggacauucacuaccuccaaccaucaugggucaagguggaaaccaucaaaaguccucucaaagaauaugaacuaugaccaaauggagcacuuaugagccauauaaagacugauaggcauacacauaccuuccccuuaaugcaaauaauaaagauacaggcaccggcuaaagauuccgguggcuucugaccuuuggcuaaggucaaguauugagaccacuuuagaaaguaaugcugagaagcuguuugugagauggucucucauaccaacacucaagaaguugagguaggaggauuuuuauaagcucaaggccagccaaagaaacaaaucuaaacaauaaaauaaauaagcaaauaggaaaaaaaaaaaacacucccacuacucauagaugagaacccauaggcaagccucauugcagacggccuuccagagggaagucagucucacagcagcaagcauggaugaaguaagucccuuaaguaaagcacuaggugugugccaggucaggguguacaagucaccuccuuucacugccauggaugaagucauguuacacagaaugcaggucagagguagcauaaaucacguaggagucacagcugucaacaaauaacuuucuauuacaggaacucacuuucaaaugaugccgugaggcuaggagggaauuaaacacaaagcaggguguuuucaucuugaauacuaacugcaagcaguagagaugcuaauuugcuuuguagccuuuguaccaagagcaugguuaagaagguaacugaagaaaguccaaugucuccuguagacccuccuuuguagauccugcucuuaauaaaagaucagggcuaacuguuugucaugaauaaugcuaugggcaguuaagaaggacaguaggcuacuuaagccacuaaggguggggugcuccaagugaaguagaugagcauccuggauuuauaaccauguauuuggcaucaauuugagaccacucagguucuucugcauuuuucuuucucguucaaaguuacacuaugagcuuuggguguguccugcagcucuccagugggaugcucuacuugccuggagccuuuuuccuuuugcauuugcuuuaguguuugaaucgucuauggccacauccuugagcacagauucuuucuuuggucgcaugcagcguauuagcgaagccaucgaaggcguucuugacacuccugcuacagcaugcuugugacccaacaggucuuuaguucuuucugaaaacgucuaccucagucaacauuacccaccuguucuugcaucuguccaccuuuuauucauuagcaucuuaaucauuaaaaccacuucugggugcaacgagauggaccuugcuaaagcugacaucugggguuuaccacugagagucacaucuugaaaggagaacugucucauagaagucaucugaccuccacuggaggggugugugugugugugugugugugugugugugugugugugugacaugcucacacaauacaaaagucaggcagugguagcccaugccuguaauucuagcacucagaaggcagaagcaagcaaaucucugaguuuaaagccagccaggucuacagaguuccaggacagccagagccacacagagaaaccaaaaaaaaaaaaaaaaaaaaaaaacaaacuaagcaaauaaccuaaacacuauaauccccauauuggugcuaauuugcuucuauuuugaguacuucuccauuuuuuuuuuuuugguaugucuugcaauuguuuguucaauggcacacacgauauccuugguaacugcccucaagaagacuuugauaaugcaguggaggaacauccugcccugcugugacuagucugucuuuuguggggcugggucuugcauuaugaacugcaccacugugguucaaaguuacuucagccaguuggguaaaacuggauuucuugaguggucugcagcuggguaguucucuuccuucagguuaggguuagacuagaaucugcuacaauuccagaaauugcuaaaaucccagcagugggcaggacagggcgugggagcucagugaguuugaguauagccagauccacguagggaagccugguauaagaaagggaaaaagccagaauguagguuuuauuccacaguuccuuaaagccaggccuuaaauuccuaauggaauucucuggcauauuucaaaagcauuucuuuuccugccuugccaggaaguguguggugaugggcuacacuaccaacuuugaggaacugggagagcugguggcagaggaggcaccaagugggugcuacacugacugugugauccuggagucugcacuccucagccacaccaaggccccagcgagucacuaacugcccagguuuucccacccugacaauagguccugauaguucuuccuguggacugcugacaagcuauggcuuucacuaucagccuacaucuucucagcaucgggagaugaugguuuccucugaucuucucuugaaagaacugagcccuguugguuuccaucucacucauuuacgugucacuuggauggaguggugccuucucuguucccuacacgacagacugcaaacaggaaguuugccauuuuuaaaaacuauaaaacaaaaccaccaacucccacuccaacucuauaacuuuauacaaaguccagcuuuuaguuuauucuucucuuuuuccuuauuuuucucuuuuccuccugccccaagacuaggugucucacuguacagccccgaaugaguagaauucucuuauauagacuagucuugccuggaacucacauagaucugcccagcucugcccuuggaguacugguauuaaaggcauacccuaccacaccuggcaaaaauuguauuuugaaagcuguugaaaacuguacaugacaaaucacgcaccugugacugaauuaaaaaaaaaaaaaaacucuuuugggccacuuaagaggcagaaggagguauaucuuugugaguucaacgccaaccuagucuacaucgugaguuccgagugagugagccaggguuauguagagaaacccugucucaagaaaauaaacaaaaaauauuuuguggggguucaagagcuggcucagcaguuaagaccaccggcugcuguuccagaggaccuggguuuaauucccagcacuuauauggcugcuuacaauugucuguaauuccauuuccaggagauccaaaccuucuucuagccucuuauagcaccagauaccauguggugcaaagauauacauguagggaaacacucauacacaugggauaaaauauuaauaauaaauaagaaauguguaaaacacugggaagugguggcacacaccuuuaaucccagcacuugggaggcagaggcaggcagauuucggaguuugaggccagccuggucuacagagugaguuccaggacagccaggacuauacagagaaacccugucucaaaaagaaaaaagaaagaaaaaagaacagaaaagaaaagaaaaaaagaaagaaaacagaaauguauaaaacaaaauucaaaguuucgggguuuggguuuauuuauuuuauuuaauguacaugaguauuuuaucugcaucuaugccuaugagucaugugucugaucccuuagaacuguaauuauagauaguugugagccaccaucugguaugugaauucugggaaccaaacccagguccuauggaaaagcaacaaguguucaaagcuuuaagccccuaugacugcuuuuuguucuuucuuuucuuuuucuuugcuuuggaaacaaggccucacucuguagcucugacuguccugaacucacuauggcuggccuaaaacuuagagauccaccuccucugcuuucucacaaguacuggaauuaaaagugugcaccaccaaaucaagguagucugcuugccaguaccaaagacaucugaagucuaaagaaguuagcagagagauuuguaucucuuuaugagaguagaugccgagauaccagaaaccacaaucucaccuagccccaagguuaucaggcacaccuuggaaggcaggaaucaagggagcuccccucugcuuguaauuggguuguuuaaaacuucaaaguauugacagugucuuuugccuugcagcuuugcaguuucaugaggucccauuugucaauucucgaucuuacagcacaagccauugcuguucuauucaggaauuuuuucccccugugcccauaucuucgaggcuuuuccccacuuucuccucuauaaguuucagugucucugguuuuauguggagcuccuuaggccaccaacagauugggaaaggaucuuuaccuauccuaaaucagauagaggacuaauauccaauauauauaaagaacucaagaagguggacuccagaaaaucaaauaaccccauuaaaaaauggggcucaagcuaaacaaagaauucucaccugaggaauaccgaauggcugagaagcaccugaaaaaguguucagcauccuuaaucaucagaaaaaugcaaaucaaaacaacccugagauuccaucucacaccagucagaauggcuaagauaaaaaauucaggugacagcagaugcuggcgaggauguggagaaagaggaacacuccuucauuguuggugggauugcaggcuuguacaaccacucuggaaaucagucuggcgguuccucagaaaacuggacauaguacuaccggaggauccagcaauaccucuccugggcauauauccagaagauguuccaacuaguaagaaagaaacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaauugggaacaaaacacccuuggaaggaguuacagagacaaaguuuggagcugagauaaaaggauggaccauguagagacugccauauccagggauccaccccauaaucagcauccaaacgcugacaccauugcauacacuagcaagauuuuaucgaaaggacccagauguagcugucucuugugagacuaugccagggccuagcaaacacagaaguggaugcucacagucagcuaauggauggaucacagggcucccaauggaggagcuagagaaaguacccaaggagcuaaagggaucugcaacccuauagguggaacaacaauaugaacuaaccaguacccuggagcucuugacucuagcugcauauguaucaaaagauggccuagucggccaucacuggaaagagaggcccauuggacaugcaaacuuuauacgccccaguacaggggaacgccugggccaaaaagggggaguggguggguaggggaguggggguggguggcuaugggggacuuuugguauagcauuggaaauguaaaagagcuaaauaccuaauaaaaauggaaaaaaaaacuccaaaguagugcugaaaaucauguuuuuaagcucucaagguacuuggaauaccauaacauucuaagaccaugggaaaaaaagauacaguugccauugugaagagcucuuuagguacaauguuuccuuugcuccagaagcuccugggaaauuucguugagaggcauccauccgcaaagccagccucaccugcaugcacuggcugguuacuauuuggauacuauugaaaucaagugugaaaugagaggacuuuaacaaaccaaaagauucagcuggggguggggguggggugggguagggaguggguuaaggcacaauuagaaauucuacaaagauaagaaaccagauuuaaaaaaaaaaagaagaagaagaagccagguggugcacgccuuuaaucccagcacuugggaggcagaggcuggugaauuucuaaauucgagaccagccuggucuacaaagugaguuccaggacagccagggcuauacagagaaacccugucucaaaaaacacaaaacaaaacaaacaaacaaaaaaagaaugacauuuuaaauuauacccuaaagacuuuguaccgagauuuuggaguuaagagucaacugcuuucauaagaagcaguuggauguuuaacauguugacaugggauauuacacaagcaauccgagauagcuaguaaucuacuaauaucuccuaaacucuuaguuaaaugauuccaaauuaccagguaugguggugcauacuguaaucucuacuugguagucugaggcaggaggaucuagaauuugagaauagccuguauuacauaguaauacuugguggcuagaaaauaaauguuaauuacuccaaaugauuuuaaacacaaguguguuucuauuaaccaugcagaaaagcauuuuggacagguuaagagugcuauuaucuccuggacccccagagugcuucgagguauagacuggugugaaagaaaggagaagagauagauaggagagagugaaccacgauuaagcccacuuaaaguuuaaaaagaugacagaaacucuguguuuuguagcacaaaaugagaccuaaagaaaaauacacuuccuauuuaaaccugugaccuccccagcacucaguggcauagacccacacacagaugcacacuccugauuagaagcaaucauuuaaagaggaagacaaaguucacuuaaguugaugcuuaaaauaugaacaucugaagcaagccacauuccgugucaggauuacuccucuuguuugacauauucaccacaccuccagcugaguucuagacaucauaaucacgacuguaagcaaugugccuguuucaguuagcaguaaggaacagaacacacaugcccaaaacacuaguuauaaaugaguacuaggauauauauuuguguguguguguguguguguguguguguguguguguugcuaggaccaacacaauccacggaugaaaugauuccccaucucuucagagauuacaccacuacccugugcauucuuucucaggcccaauacugggaaaguuuugccaaguucaguccaaggaucauccaggcaauagagaaaucaguccuucaaguaaugauuggaaacuaucccaggaaaguccucagauacauagauagucuauaaauagcuauguagcuuaugcugaccucaaacuuauggcaguucuccugccucagcuuccacgaugcuguuauaacagacaaggggaucaaaacucugauucuuguccauuccauagaagcaaaggugauggucauuuuccuccugaucuagacaaaugcucagcacugaagagcaaaugcugcccacucaaucacuggaacuugaccucucacgggcuccucuuagcaacauuaucaacauuuuuagcuguucuuugcaggcggucaagcagguauagagagggcaagacaacaugauaaagacacacauaccuaaugaaaaaaauagagccacaguuugagaaguuuccuguggcaggaucuagcuuacauaugggaucugaggaaacagaagucggaagagagguuaauauugccucuaucagaaucaaauaccgccucuuaagcaacagcagcaaacuggcguucccuuacagucuucucuuggcucaccucaauccuuagucuauauccggucacacuacacaaugcuguguaugaacuaucgguuuuuuucccaaaucuaauaaauaauuuaaaaguggacugaagaugguuaaugucaaaggguaaucacaugaguguuugaaaagggauuuaaugugcacaugugcacauaaaauaugaaacagaggauauggcuuggagguaaaguggcccaaagcccauaaaacaaucauaacaaaaaccaaauucaaacgaacacacagaacuaaaccuauaguuuuauaagaauuauuaaaagugcaaagaacgagaaaaaaaucaaauauuugacaauuugucauaagcaggaaucaguugacagucaaucuugaguuuucauaacuagugacaguguuuauuauucacugggaacuauuaguguugccaugucugcacguuuuccucuuacguggcuagcacguguuuguguucaacacucgaugacucucaguugaauacucguacaagcacuucauuguuaaacugauuauaaaauucucucucacuuuacuuucccccaucaugauuguagcaaaugauuuagcuagguaauggauucuagcauuauagaagccaaggcagagcuaccacaaguuagagggcagccuaagcuaugcagcucaaggacaaucuaggcugcucaaggagacucagucuuaaacuacaacuaaacaaauaagcaaauguaucagauuaaaaaaaaaaaaacaaccaaacaaguuuuucucauuguauucaacccauugcuaagcaauguuucucgguacaaauacauucaguaguaugcagaaauaaaaauacugcauuuuaaaaugggaaaaggcagcuuccagucacuauaacuauuaguuaacuaaguuaauuuguaacagagugaguuugcaucggccuaacaauuaaagaguuaacuggcuuagaggcuacuuccccucagugguuugcauacaaaaguacuggucagagucaaaagcuacuacuacuacuacuuuucacucaaaauguaauucaggugcuaauagauucuaaaauagggcgaggcugcuuugggcaucuccaucucucuuucagacaaguuuacuauaccuucaggguuuucuuauucuguaccaauauuccaagagcuagcuagcuaaauuguuugugagauucaaccccacugccauuguuaaccgcuagucuucagaauucuggaagggucuauaaacauuaaacccgaguuguguuucagcaugugggaugcaaugagauuaaccaggagcugcucuagagccaggcacuaaucucaaaucacaggccuuugcuagugugagugcccaugugucuagcccacauaggguguuccuggacagccugaggugcacaaugacacccuaugucuuaggaaacaguuaccugccgcaucucagcuguguguguguguauguguguguauguguuuguuguuguuuuuuuuuuuuccuugguuuuucgagacaggguuucucuguguagcccuggcuguccuggaacucacucuguagaccaggcuggccucaaacucagaaauuugccugccucugccuuccaaaggcugggauuaaaggcgugggccaccacgcccggcuugcaacucagcuguuaacacaccuuccauuugcagaugauguaauguccgggaagccuggauauacaacacaaacccaacucuaaaccugcacauaccuuacauaucagaaccugccugcuuacagcuacagcagaccaagcauacaaaagauaaagucaggaugcuuuaaaaacaaaaccaaaaaaccaucaagacccuuuauggauaaauacaaaugaaaauccccagaaaucaacuccggaaagcaggaagucccaagugaaagcuuucuauuguguuaacccccaagggugaggagggucccggguagggcgggccagacauccaacaggaggauuucagaugccaguguggagguggggagagcggcuugguaagcaacaacuuuccuguggccauaguuccugcuuugggaaguaggaucaccgagaccccaaaaugaaaaaggauuuccuucuccuucuucuuuuaaguugaaauggauuuuuuucauacacuauguucugauuaugauucccccucccucagcuccuccaagaucccccuuugucacugcugauuguuauuugaaaagcauuugugagaagggaucauacuuaaugcacuggacacuguaauuaagagaaacaagacaucaccuacaaaaacaaacaaaaaggccagcaagaccggcuccgcaagccucgggagacacaaaagauuaaccuaagccaaggcaggcucagcaggccaggcuuccgcaaauaaacuuugaauugggcaggucucaccuaaacaccuugaucuuggggucaugacccggucagagccaggacaggagauuuuugacuauuaauuaaggggguggagaucuggccccagacacaaaagccaucucucuuggagguuggcaaaguguaaauagcucugcugagagcccagguccacgugucuaacuguguaauagucuccucugcuucuuuugcacacagaaaccuauuuccuuggccauaaaaauguacaugugcaugacaaaauugcucuaagaaggauuuaauuuauucuuucuuguuuauuuaaaucacuuuaaaauuaaauauacuggugcugaagggcucagugcuuaaaagcacuggcaggucuuaccagagguuugggguucaaucuaccacauguaauaucacaauaauccauaacuuacauucugagagauaugacauccucuuuugguugcuucaagcaccgggcaugcacauggugcacauacauacaugcaggcaaaacccuuuuugaaaaagauuuauuuauuuuauuuuauguauaugaguauacaguagcuguacugaugguugagccaucaugugguugcugggaauugaauucaggaccucugcucgcucuggucgaccccauucuggggcggccuugcuuagucuggucagucggccuaaagauuuauuauuauauauuuauuguauauuaaauuauaucauuauacuauauuguuauaaaauauguuaaauuauauauugaauauuaaauuauauauuacauuauauuuguuuauuauuauaucuaaguacauuguagcugucuucuaacauaccagaagagggugucagaucucauuauggaugacugugagccacuaugugguugcugggauuugaacucaggaccuuuggaaaagcaaucggugcucuuaaccccugagucaucucuccagcccaacaggcaaaacucuuaauaaauaaaauuaaaagaggucuuaagggcuggagagaugguuucaugguuaagauaaguaguugcucuuccagaagaccuggguucaacucccagcaccauuguggcagcucauagcuguaacuccaauguuaggacuuuggauccucucacacagacauacaugcugacaaaacaccaguggacauaguauaaaaacaaguuauuuauuaaaaaauaacaaauuuuaaauuuuuuaaaugacauguucuauaccucuuaacacuugaaauaugcacuuuguagaaaugauuucgaaucuauuugaaagaaaucuauaaaauuuuccacuugaaaaaaguaauguuuuaaaaagaaagagaucagccagaagugguagcgcacuccuuuaaugccagcacuugggagacagaggcauucuaaucauagacuggugaaaugaaaagugugccuuuuaaugcaaaagcuaugcgaucauucuacagccaacagccaauaugaagauucugaaacuucagaugacgaaugauuugcaaaguggcaacgugcagaaaggacagacagacaagaagcaaaugggcaggagugagccgaagugcugaggaugggaugcagcuguggcuggaaugggcaggagcaggccagugugaggacagacccagcuguggcuggaaugggaaggagaaggccagugugcggacagacccagcuguggcugggcaccgcugucuaccuuagaggauuaaggucuuguucuaaugggugaccuucuaauugcagacagggaagaaaaagagaagaguaacacagauaccauuucacaucacuuggcuuccauuauccucacauaggccaccgguguuuuguuuuguuuuguuuuguuuuguuuuuuucuaagacaaaauacaaaaauaaaaucaaacggagaguucuguggauagcucccauuaaaguguaauacucugugaagaaagucaguacuuugauaaggugcauucuagcaacguccacgaagccauggaaaugaccauuacuauggcugcaauacccacagaacaaucuuugguaacucagagcagucacugcagcaaaauccugugugcagcacagcacagcuuaaugaaagacagccuccaccugugccuggccagaggcaggguucuuugaagagaauaguccaucagcaaaaacaacccaucacuucuucugaauauguuuuauuuuuaacagaaauuauuuguaaaaguaaaguuuaaaauaucaacaacaaaccaggcaugguaaggcacgccuuuagucccaccacucagaaggcagaggcaggaggaucucuugaguuuaaggccagccuggucuauagagugaguuccaggacaaccaagacuaaguacauagagaaacucugucuugaaaaacaaaaauaaaaucaagggcuagagagauagcucaguggagaagagcacugacugaucuuccaaagguccugaguucaauucccagcaaccacauggugacucacaaccaucuguaguggaaucuggugcccucuucuggugugucugaagacagcaacaaugcacucacauacauaaaauaaauaaaaauuaagaaagaaagaaagaaagaaagaaagaaagaaagaaagacagacacugucucaaagagaaggaggaaagagagugggagagagaggggggucauguuuuaggucagucugggauacauaguaaggcaaaaccaacaaaucacaauguuccaauuuuacauuuuggggaggugucaaauuuuggaaguucagaaaaguaaaacuggaggacuaaaaaguagugacuaaaauuuacugucaguaaagugauucucaaguacuaagagaaacugcggagcuggacucagcagcaaaugccugcuaaccuggcaccugagaucucuaugagacugaggccagccuggucuacaugaguacauggugagauccuaucuugcaaagaaaacaguucaaacuuuaggaacugacgaggcccucuacugccuuucuguuuccagcuggauaagacccagaaauugucuagucauuuguugcuaaaauauucaaucuacagaugucauuucgagaccuuacuauucacuaagcaucauuaaagcgaugacagcucuuuacucuuucuuagguuccgccuccugaaugaacugcaaaaaggcuacauaacuggauauauuuugcuaaaauauaaugguacaaucacaugcaugauggagaauugugcucaacuucuuugugcucaagaucaugagguaaaaggguacagaacuagguauacacaggaauggaugaguggagaaagucaagacagacaggcagagagacagacaugaagacaagcauugcagcacacauccaugaccaaggcacaggagagguuaagguaguaggaagcuucauggacuacauagcgagaugcugucucaaaaaagacagcauuggaugugacaguuugugccuguagucacagcacuacagaagcuaggacagggugggcgugaguuugcuacccgcuugggcuacagagcauggcucuaccauacaaacaacaauaaaacacaaacaaaucacuacuucucaauggaaaaaaugauugcuuagcaugucugagacccugaguuacacacacacacacacacacacacacacacacacacaaguguaguuggaucaguugaaucaaugccagcuuccuggguaugacacuaaaguugugcaaaaugucaccacuagaggagaacaggucauauacauaggaccuguguauauugcuucacauaacuguacagauucuacaacuauggcaauaaaagcuucaaauaaaaauauguaauuccgggcuggagagauggcucagcaguuaagaguauauugacuguucuuccagagguccugaguucaauucucagcaucugcaugguagaucacagccauccauaauaugaucugaugcccucuccugguguguaugaagauagcuacaguguacuuauauaaaauaaguaaauaaauguauuaaaagccacuaaauccuacguugaagaugggagacuuuaaugggagccauucaucagcuuuuccuguagagcuuacauuaaggaaaaucagcaucacugcccaccgcccugaccgugccuaucaccaaggucgcucacauuauuuuccuauugugcuuucaguacagaugacacaugcuccaguaagaaaaaacaaguuucgcaccgggcgugguggcgcacgccuuuaaucccagcacucgggaggcagaggcaggcagauuucugaguucgaggccagccuggucuacaaagugaguuccaggacagccagagcuauacagagaaacccugccucggaaaaccaaaaaaaaaaaaaaaaaaaaaaaaaaaaaaaaaaaaaacaaacaaaaaaaaaacaaaacaaaaagaaaaaacaaguuucuacuagaucuugcuagugaauaaaaagauauagaaaucaguaacuacuuaacagacagaaagaaaucuaauuuaaaagaaaugcuugcaguuuauuuagaacaacaacaaauuuauuuuaugcucuaaaugauccuucaaaaauacuucagcccaguuuagucaccuuugguuuuaauucucagacuauuuagaauacgguuucacaucaguucuuuagaugggcaugguaagugcucagaagauggagucuggaggacugccgcaggucugaggccagucuggguuguagagaaagcaccagggcauccacagccagaccuuuucucaaaccauagcugaagagauggucggucaggcagugaagacacugacuguucuucccgaaccagcccuggguucgguucccagcacccacauggcagucaguguccaggaaucugaugauaccauuuucuggccucugcuggcacuguaggaaaauagugcaauauaaacagacaaauacacauaaaaauaaaauaaacacacaaaacauaucuuuaaaacuacaggcuaagauuauugaaugcauuuuucaaaaauauuuaaaaccucccauucugcuugcuaaaacauagaacguuuaaauacuuuuuugccuauaaauuucuuuuuuuaagauuuguuuauuuauuuuaugucuaugaguacaguguagcuauacagaugguugugagccaccaugugguugcugggauuugaacucagguuaagagcagucagugcucuuaaccacugagccaucucuucagccccuugccuauaaauuucuaaucugagauuuuccauuuuuaaauauuuauuuauuuauuuauuuauuuauuuauuuugagacaggguuucucuacauaacccuggauauccuggaauucacuauguacaucuaacuggucucaaacuugcaaagaucugccagccucugccuucugaaugcugggaucaaagccauacacucccaacauccagccuaugauucagcugucugcagagguugaaguaggguguuggaauccuuggacuuguaguuaauaaguguuuguaagccacucgguauagguaguaggauucaaacucccauccuuaugauugagcaaaguauucuuaacugcugagccuucuuuccaaccccuuaaauacucuuuauaacaaguggagaaagucaaaacugagaauuugcuacaucggaaauggcaacucaagaugaauucuguugagaaggaugauacaucuaucuuaagcccggaauuuucugcaaugucccuauuauagucagaauacacuuggaaacaagcaagaaccaagugcacacaagucuuccugcugauggucacagugauacacgugcucugcugauggucacagugauacacgugcucuggcugcgccuccuccccugccagacccuacacacaccaacagaugcacuguacaaccucauucaauaaugucacaguagucacuuaguuuuggcaguaaacuguaauaaaaaccagagcacuagacccaaguaaauacugcguguuuggcaaaaaucacuguggcuguguucuccagcacaguuuccaagauaaccaccagcucugcuuggcaacuggacucucccacaguuaaggcuccaacuguaaagcuggcuuacaagacauuuuccugcugcuggcuuuggucuguugcugcuccuaggaauugcuauucaauggcagcgucuucuuugagaaagcauaauuuuaaugaaucaauaguaucccauucaagaaacaauuauauuaagucuucaaguacuaagccauguaagauuaugaaguuugaggauggagagauggcucagcaguuaggcacucucacugcucuuggcagaggaucugggcuucaagcaguacccaugugccacuaacaacuaccugaccccagauccaggggaaucaacauccucuucuggauuccagagguaccaggugugugugcaguacacauacguaugcaagcaaacacucauacgcagaaaacaaaucuuuuuuaaaauaauugaaaaauuaggagugauggcagcauaaaaucagaucuaguauaaaauaccagguagccuaaaauacuggcauuucacaucaucuccuuguuuguuuguuuguuuguuuguuuguuugaggugucucauugcccaaguuagcucuaauuuuuuuaaagcaaucuuccugucucagcuugccaaguucuaagaugacagacuugagcucagacauuucuagaacauuuuaugugaugacaauuuuauuucuaaauugacuaauuugcuuggguaaugauggaaaauagaguuucuuucagauauaucagugauucuuaagaaagguuuccaaaugaggccagcaaacaaggaaauauuggcacuugguuugcaacagggucuggguggagcuagagaaauugauauggaauuucuagcuucaacaaaugaaaccaaaaagaaacacaaacccagcagccaaugaggacuguggaagucacccuaaagaguccaaagcaggugugcacauugcaggagaaguguuggugaugccaguaugcagggcauaugucaccacaugaaaacuacaccaucacccugguucccagaacagacuuaaacaguaaaucuagugaaagccuuaaagaauacuugacaaguaagagaguguaaauaaaucaaagccuggguccaacuuauuucugcauuuguucaagaugugaugagaugaaacaauguaucuuuuuuuuuuuuuuuuuuuuugguuuuucgagacaggguuucucuguauagcccuggcuguccuggaacucacuuuuuaaaccaggcuggccugggacucagaaauucgccugacucuguuuccccaagugcugaggaaacaauguaucuuuuaaagguaccaaucuuguuacuguuuuaauaguuuuuuucugaaguaaaaucaacuaaaacaacucuuaagaacuuuuggaauacuuagguggaacuuuaacacacauaguaaaugaaaggcuacuguagacuccccaucccauguuuguuuaaauaauuucucuaagaaaugagaaaguguuucuuuuuauucagaguguucaaugauguacaaaauuucccugagacccuuaaaguaauauuacagcuguuuucagcacaaaacuaaaaugcaccaagcaauaagaaucaaacuucacugcaagaaagaguaggccucuaugauaacauaaaaaauaagccaacuuaagcauucuuauugauuggaauggaaaacacuuuuguguaguuugagggcauaucaugaaucugaaaaguuccccacaaagaagucaugacacacuggucuacuagugaaacaaauuacuuauuuuuaauucuagauugcuggaauaguugaccacaguuuucucaaccaacaauagacauuuaugggaggggggaaaaaaagcucuguuuccucuaccacuucagggcaagucagagccaaugaacugcucuguucagggaugaguaauguuuuacccucuggucaugugaaugagucccuaguacccagccuuaagcaaacuuagccacaguucucauuucugagaaccaaaucagaaagacuuguaaagugaacuccuaaggguuuggaaacuugauuuaugcagugacaugccuuucccucuacccuguaaucagaucaacccauacugaucuuaaguuuaagccccaaucuuucacaaacacuguucugcuuaauaaaauuuuuaaaaauaauauuuauuauguuguaauuuauauuguacucaaaacacauuauaaaacacacauacagacauggagaagaaugcaacuccucuucaguauuucaacuuuccauuaaaaugcaaauguaaugauuucauuagcuaggcuacaauacccacagucuuaaaccaaaccaauauauuuucucugugaaucccaacuucccguacauguaaucuuauccuuaugaugguucuuugcugaugaauucugaguaugaauuuuagcauuauaauccuaauuagagcaaaguacaguaugugacuugugauuuuuaaaucuacagauuuauucugcuccccagauagacaaacaccacaacauuuugcuaaauuuuaagcaaacaacuugggaaaaacaacaaaacaaacaaacaaacaaaccuaauucuauuccaaaaauugcucaaagcaaacaaaaucuaucaauuaagccauuaacaagcaaguaucaugucuuuuaacaggaccuucucaagagucuggccaggccucacuugguuucgccaaacguagaaaacucuccauagaagaaacccuauaagcuuucuaacaguuagcaagcaggucuagggaagagagucaagcucugagugaagagugaggagggguguuugugaacgaccaaauaaaagagugagugccagagugaaggaaauuugggaugggacuuguuagagaucuucucugggauuggguuucauuucuucgggcgccccugaccuugccuucuccaacuccaaacgcuucgcccgcccccucccccggccugcgccugccuuugugugugccugucacuuaaggggaacagaacgagcugauucgggggcagcacaaagccaacacacagauuugcacagauucucuuacacacauuucccaaacuggaaggcacagcccacucugagcuugugaaccuugagaaaaguggguucuggucuuguuucagggagcagagaaacuauucuuuccccucucacuuagcgccaauaacaaaacgcgaggacucaagagaaaaaaagaaagaauggaaaaaaaaaaaaaagcccuccacguaguggauccugaaucuacacacugugacaucugucuaguguaguccacgaggggacaaacguguuggaagccagagacacaaacccagaacaggacccaaacaagcacuacuggagauaaaagagucaaacacaccgggucaguguucuuuccggggugucugaggaugaacuaggggcucccuggacuuauacuaagaacaggggagaggaggaucaaaagagaaaguggugguccccaaagaugaacucuuucaggaaggcagccccaagaaaacacucacuuuccugagacuaaaaggccagaagagcggcuggugggagguacaaagguaaguuuucuggguacagaggggagacacgcauuagcaggaagaagggaccacagaagugcaggucgcaggagaagggggugcugaauuaaaacuauauuugucagccauguugaagaagcuccuguaauuugugaggcuucccucuucccucuuaguauuugugggugacaugacaguccccgcaaggccgagagaaagagagggagauuggaaagggaccauuccgcagccgucaagagcgaggaaagaaagagagagagagagagacaggcgcggaccucagcgcucugaccugguucuggucccucagccucgcaguccaccgccgucgcagccgggucuccuuucuaacaaauccuacagggcagccaucuugcuuccuucugcuccucuacgaaagcagccucgccuccgcaucaauauucauaaggcaguuugacgucuguucucuaggcucggcggggccggcucucaggcggccgccgagggggcggacgugacuggcaugcgagcggagcgggcgcgagcgcgggagcgggccgugcgcucgcucccucgcggaggcgcggcgggacccggggccgugcgcucgcucccucgcggggacgcggcgggacccggggccgugugcucgcucccucgcggaggcgcggcgggacccggggccgugcguucgcucccucgcggggacgcggcgggacccggggccgugcgcucgcucccucgcgggggcgcggcgagucccggcugcgcgcucacucccucgcggggggcuaggggaccuccucugcucggcuccuccccggccuuuccugagccccgggugccgccggccgcacacccacgcgugggcggccuccgcgccucugucucccgcgggggccgcguaggcacuuggaaacucugcgcccuccugcgcgcuccaggggccccuggcuccccgcgcucccgcugccagcaccucaccagucgucuccccacucgcccccacacccugccacccccuucccugucgcccagccaagccgcuccccauuuccccaaaggccgugccgggagagcuagaggggccugggcgcuaaagucuccacucugcagcaauccggcggcgccggggcucuccccgcccaggcccaccuucuguuuacuuuggccacgugggccgcgcagggggugcugucucgcagagcccagaggagcggugucaccgagccccugcuugucacucgaaagaauuaagccagcaguuucuaauguucaaggcgcccccguaaguuccucuauuuugcacaaauuuccacuccguacgguaaaguaaugaagaaaccgccuugugggaagcugaauuccgaacaagcagagagcgcucaguuuucccugaaguucaaggcuugugcgcaccagcucuucugcuggcacuuccguuuuuuaaacuuacauuuuaaauguuccuuuugguaauuauuaacuuuugaagaugagaucgaggcaaauucauaggaaucaugagacaguaguuuaggaaauuugugcucacacauccacccacccuccuccugucuucaaguuuucagucacugaauguuacguuuuaauagguaaucugggaaccucuucugugggaucgguugcguucacagcaaccuuaagucuacuuuaacacuauuauauugucuguaaugcacccuuucuuuguguguguguguggguggguguucuuuagaaaugaggccuggaaccaacuaacucucucucuaacucucucucucucucucucucucucucucucucucucacacacacacacacacacacacacacacacaccacauaaauuuugaaaagaaagagcagaccugcaaucacagcauuuagaagucugaggcaguaggaugucugacaguuugaauuuagcuggguauuguaguuagauuguuucaagaagaaaggaaggaaaagaaaggagagagagagaaaagaaggaggaggaggaggaagaagaaggaaggaaggaaggaaggaaggaaggaaggaaggaaggaagaagaagaagcaaauagccauaacauuuucccuuaauuucaugaaauguaaacacuuccucuuuguaaaaucucauagauguauguacucacacaggaaaggccaggaccucuauguggcacauuguuacucuguguuacauuguugcagagaagauugccuaaaguaaguucuaaggaaacaauguuucuuccauuuagaaacaguuaccaaggugugaucucacaaaucaguaaucaaaauauuuaccugggcucuacagcaccuuauuuuuaaauuauuuuuuuuuucuuuuugaggcugggucucacuguguggcacugguucaucugaaacuauguagaccaguuggcuuagacucugucuuagucaggguuucuauuccugcacaaacaucaugaccaagaagcaaguuggggaggaaaggguuuauucaacucacacuuccacauugcuguucaucacuaaaggaagucaggacugaaacucaagcaggccaggaagcaggagcugaugcagaggccauggagggauguucuuuacuggcuugcuuccccuggcuugcucaaccugcucucuuauagaaccaagacuaccagcccagagauggcaccacccacaaggggaccucccuguuugaucacuaauugagaaaaugccuuacagcuggaucucauggaggcauuuccucaacugaaacuccuuucucugugauaacuccagccuguguuaaguugacacaaaacuagccaauacagacucaauagaaaucagcuugccuuguucaccugcuuugucuggccuuuuaaaaaaauuaugauuauuaauuaauuaguuuauuuguaugaguguuuugcugguguguauaucuguguacuguguguuggccuggugcccaggaggucaaggagugggagucaguuacagaugauuuugagcugcugugugggugcugggaacuaagacuagguccucugcaagaacaagugcucuuucuuaaccucggagccaucucuccaggcucguuucuauuuguuuaccaagcacugccaagagucuguugaguuccuguggaaauccaaaacugccagcuagugaccagagcuaaaauagccauacuauuccuguugaggacuuccucaaaaccagagucauugucagaguuaaaguuuagcaggggcagccucugaagccucaccagugucuacagugccccuagaagccagcuuuggaauccuccgaggauuaucuaggcaagccuguuguuugguccuguguucugucugccuuuucugcucagagaagcucaagccauggugacaggccugugauccaggagcuugggacggaaggaugaccugcccauggucauacucacguggcuacacuggauucuaggccagucugggauacacgagacccugucuuaaacaaaauccccauuuagaaacugaaauucucaucauaguucaggagucuugcccuggcuauucggcauuuaaugucugaugcauugagagucagagcacacucaggacuaacccagggguaggaaguaauaggauucccauccuaccacagccuggcccagaacgaagggcagcagauacuaugacccacaugugcugaccuucaucuugacuucucuucaaggcuaaacucuggaagcuuuuggaaagcuggccagcagguguuagaaggcauguaaaaggugcuugccacugaguagagcaaccgggcuuugauuuccagagcccucguggagauggaaugagagaacugauuuacuaaguugucauauggccacuacaauuuugcugugauacacacaugcacacacauacacaaauaagaaauauuauuuuauaaauaagguguguagggauggggagauggcacaucggguaagaagagcacugacugcucuuccgaagguccugaguucaaaucccagcaaccacaugguggcucacaacuacccauaaugagaucugacgcccucuucugguguguuugaagacagcaacaguguacuuauaauacuaaauaaaucauuuggcuggagugaguggggcaccgaccggagcgagguuaaccggagugagcagagguccuaaauucaauucccaacaaccacaugaaggcucacaacuaccuguacagcuacaguguauuccuauagguaaaauaaauaaauaaaucuuaaauaauaaauaaggugugugggggcaugauuguugagugcacacacccauguaucagaaugcaggaggagaacacaggacuuccauacucucccuuccuauucagguuccuguaccucaccuuaguuuagucauuaggccugacugcuggggauggcaugcaguuagucuuaaaggacccaguaucccugccugcacccuuucacagacugccaccaauuccauuucccagugagaaccuggcuccuaacagcacuaguugcacacuggacuuaugucuuaaagggcaaggaguuaugucugaacugugcccaugguaauuacuuauuuguaaacagaagagcagaaggagaaaagaaauaaaucagauuucugauuuuguauuaacugagcaaaauugucuucccauaagcauuuccuguggaguuaaauuuacugcugaauuuuaaaacacagaauucuuauauauuuuuuucuugacuuggaugugaaauucuacacggaccauugaaugcauuuaugucgugcauaguauaagaguugcuuaaagugugggguuuggaguugaauagacuucagaaaaucugccuggaucucuuucugugugaacucagacauguuacauaacuuccugaauuaguuuuuuuuuuuucucagcccuuaagcacuguuaaacacaguguuguugcaaggauuaacuaagacuccaaguauguguguggguacuuauuacucuuaucaguaguaagccaucuacuuccaggaguguuucuugacuaacuguaggaauauauacauaauuauauaucuuucuaugcuuaauaauagaugggaaauuuaauggugguauguauuuuuugaauggguaugugugugguccagaguguauguguacgcaucauguguggugccugaagaguccagaagaggcaucagauccccuaacaguagaacugcaggcuguugugggcugcccaaugugggugcucacuaagagaagaacucagauccucugcaagaacugagcaagauuucauaacugccuggccaucucuucagccccccaaauacucaaaucccuccaccgccauccugucucuccagcaucacuauauaaucuuggcuaggcuaggacucacuauacagacuaggcuggcuacagacuuagagaucugcuuucuagaaaaguuucuuuauauuaaaauuguuaaaaaagaaaagccuuuaaaaccaucuccuugguucaucuuuuuaaaccucucuguuguagcaggugguucuugucuaucuggaaguaugcuuggguugcaguugcuuuuucugaacuuuuucuugccaaauucuuuucuuuguauccccacccacccuuaaccaccaugacauuuguuacuuuaaaagaaaaaaaauauuauucuuauuggcuacugugacuuuucaucggaaaaaugaagugaaacuaugaauguaugaauuuuuguuuuuccuuuuuuuuuuuuuuuugcuuuguugauuuaaagaaagccuccuuucuuagcuacuucugggaaaggauggcucuggugugcauaaucacuuguuuacugacauuaggguccaucuguaggaggaauucagagccagcuuuugugaguacugugcauuuuuugagaucugccccuccccagguguggcuaaucuagcuuuuaaaagauaauuuacuauccgaaaaaaacagccgauuguuaucagauccugggcuaugucucuaaaaugagaacgaagaguugcggcuacccuacuacagagccuucgcuuccccacagaggagggaaacgugaguagcaggagcccaaugccaugcuacuuugugucaaagacuugacuugauuggccugagcaucugcugucucagucaguuguucccccaccaagcuucauggagaacaggcugucuccugucugcugcuguccacugcaguguacugcagguuugguuugguuuugacuugauuuuuguuuuguuuugucuuuguuuuguauugugcuaauaacaaagacaacagaccaacaaaaacuaugcacacucucgcuguucuuccugccugcaguguagaacauuguuuuuaacgaccugaauuuuuuucuuuaagaauuauguuaccuacagcuuugaaagaauuacagagauuucacagaaacauuaaauccuacccugucauuucauagcucugagaacauuuuuuuucugaaguauauacgacaugauagagggguucagcaaucuuaaaagacacuugacggucagggggcacagcacuuuugcuaggaagcugcggugcuguucuuccuaucaaagggaaguagauagauugauagaaugcuaaugagaagauauuaccaauagauaaaaauguuugcacauagccccuuagccugguaauaugaaugaauuaucaauaaugauaaaaaaguauuguuuucuaaaaccagagaucacaaugauaugagaguccagauagucucuuuuguuacuaugaucugaccuuguuuguccugguuuuuguauaaacuagugagauauuucccuauuccaaucauauuaaaacaucacuggagguauuaugaagacauuaagauaauuauugggacaaauaucaugaaaacucuccagaaauauuguaaauguguugcuaauaucaaucuccuguaacuuucagaacuuuuuuauuuuuaugauuucauguaaggaaauggcauuggaauuuuuauguaguccuagcgggcuuugagcuucugagccccuccuuccaagugcugggauuauaagcaugggucacaaugccugucuuuuucuuucucucucucucucucucucucucucucucucucucucucucucucucucuuucucuuuucucuuuaaauguagcuauguaggucuggcuguccaggaauucucuauguagaucucagauucauccagauccaccugaaucugucucccaaugcuugggaucaaagaugugugccacuacacccuucuugaacagggugcuaccacaaagcccgaguggacuuugaacucaccacauagaccaggcuggucuuaaaauugugaacuugcugcuaaccuucugcuucuuucucuugaguacugggguaacagcgauguaccaccacaucuagaaacagguaaaucaugguuucaguacugcugguaauagugagucaaucuuacccuccuccauuuuagcaggucucaaugcaacauugugugcaagaguauuaccccuuuguuuucuucguuguuucuuccuuauauuucuugccuuacuuggcagaauuuggcuuuuuguucaaauaucuucauagagucuuuguccauuuucauccuaguaaaaaacaccuugaggugaggacugcccaug

SEQ ID NO: 1723 - RNA, 2508 nt, Mus musculus
caguaaagaccugucuuccuaugauuuacucacucuguggauuaugauaucugauacagaacacagacaaaaacauuucugcuuccacaaaaucuacuucuccauauaaagaaguagaucucagagguccucaaagaugccaagugccagguggguuugacuuuccucacaggaaauuuaaggguagggggaacaagguuagacaggaacuuuaaggucaguaggugacaagggaaagauuuuaaaagauagcauuucacuuuggaaagaucuugauacaauagacugacaauaaauucugcuuugaagaguuuugauauucuuccuuuuucuucacacuuuguuaaguggauucuucuuuuauuuucaggcugggaccuaagauagagauggaacuauuuuagaaagaaaccaaaacacugcacaugguguaggcuuuuucacugagcauguguuugucagguuuccaucauugcaacaggaugccugagacaauccauuuaaaaagaugacaagauucuggaaguuuaaguccaugacugguuaaacacauuacucugaggacugugugggagggggggcacugaagcauggugggaagucagcaaguggcuaccucaucagaaacagacagagagaccagcacuuuccaaucuccuuugaggcgaugcaaugaccugagaaugucaaagaggcuccacauucagcugggaauuuuacaugugagccccaaacuuuagggguaugguacaacugacugagcguuugaaaaaaugaaaccaugaaggauguuggguaugaguucggcaugagacaauaucagcauagcuaggaagaaaauccauguaaagguuagaugaccuuauuacaggagaaauaucaaagacagaaagaugcagaaauggcuauacaucaugguaaaauggcaucaguguuuuuaacugugaagagcagggaggaaaacuggauuuuuguucacucuaaaggaacauacuagaaggcauaauuauugaggugucuaacacucugauuacuagugagaaggggaagacaggaaguggcugaaaagcaaaggaggccaccaacagaaaggaacaaaggauugcauuagagaggauucagaagcaacacauuuacagagagcaauuacacggcuugcagcaaagcuacugauaucagaugggcaauauccaaacccugggggcauuuuuacaaugagucagaugagugcuuguguguguguugaggggggagggacuauaaagcacagagggaucugugcauucaucaggccaggggcgggggagggggagcugcuuuccuuccugaaucaggaaaugcucucucucauuaaguuaacacauuugaucuggcaaagcuacauccuggaauccugaaaacaucagcuuccaucuaaacuuuccaguucuuguauacuugaauuagucagccugauggcacauuugccauauuauaaauaugcauauggccggguaucugccacccaucugauucuuacuuuccuauuggggggaaaaaaaaaagcauaagccagauaggauaugcaccgggcaagguuucagauuuggaguccagacuuguccuugauaaacauuagaaauacuuaacuuaucuuaacuucuuagucccuagagucuguggccuuucuccaucuucuaagucucauucucucagagaagggugcaaguucaaagaacaacuaacaaacagcccauucucagcauuuuuugagcuauuauugugacaagguguuuugacagccaaauaucuccgaguuugggggaaaccaacacuugcucugcugugugugguacaggcccugagcucuacuccuccugaucggagacacaugcaguaaccaucccacauguuaugguucaaagcugaaguuucuccucuagcacauguuuuaaacauuuguuccucagcugaguuacugagguacaggggguggugcuaugaaaucuugaggagguggcaucuagcuggugaaaguagaacugagcugaguggucaugcuugccuaccaucacacacuggagaccccagagaccgugagccagagccaaaugcucuauaaauuguuucuggcagguauuuuugucacugugacacaaaaaugacuaaaacaucacaaguguaagugaaccaccugagcccauaccaacaugucuaucuucacaggaaaaucucggcuucuuccaaaugagaccucuuguacccacaacaugcuguuucauuaaacaucucucuucuucugacaagugaccuggcuucuuuuuuauuuuauuuuucuauugaauauuuucuuuauuuauauuucaaauguuacccccuucccauguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagc

SEQ ID NO: 1724 - RNA, 1973 nt, Mus musculus
ugguuauuucucuggucagcacucacauuuuauuguucaccugccucuggaugaauuuuuuuaaaagauuuauuuauuacauguaaguagacuguagcugucuucagauguaccagaagagggcgucagaucucguuacggauggucgugagccuccaugugguugcugggauuuaaacucaggacauuuggaagagcagugcucuuaaccacugagccaucucuccagccaccaccccccccccuuuaaaauguaauuuuuuucaagguuuguuuauuuacuuuuauauaugaguacacuguagcuguccucagacacaccagaauagggcacuggauagcauuacagaugguugugagccaucaugugguugcuguagaaaguucuuaauacaaguguuauguuuaggaauagaaaacagauaaccaacuaauuggauuuugcuaugaaggaaaacuaaguagacugaagauggaaggggcucgggcacuggcuuuggaucgugugagcaguuccccauccuuaggccuuuucagauuggugaugcaggcccugaugagucugaaugaguaaaaucucauuaguuaaacuuguugggcagguaucgaguacaacagucaccugguucgguuugguuuuggaguggagcauuaaaauaguuuaggaauacagucugccauuucuaaucaaagacuaugaaacaaaaaugauacagaucagcagcuagcuuaauuggcuuccuauaaacuuauuaacaaauuagguuacaaaacacaaaagcauuucagugagugaaucaccaggaggcagcaaacucgcagcugaguugugacgugcuuuccacaacacaucuugcuuaauuauccacaccagugagucauuagcccaucacccugcuaaugcucccaggauaccugguauuuuguaaggcuggugcuuguuugcugaguaaggaaugaguagugcucuacuucagcagcuuaggugacccccguaacaaucgugaggaagcuaagaaagcuguuucucuaagguucuacaacacucaagugguuuaucaauucaugugugugugguuauucagugccuguguacagcacacgauagaacucugggaauuuacagaggauggcaauucuuaugcuccugugaaagcuuacuaaaaccccagccugcgcccagacguggacgucugggcagaguaacaguauguuuuaaaguggaaaauguggaggggagggaacuauuuucuucucagggcacuuagaauuacauucugagacaguuuucacuuuucucacuguucuuauuugacaaaauuaaagguugaccaucucauucuagaccaccaaucuccaauaaaugugccuucugugaagcccaaaaaggauggcagcagcuggaauauuuuucaaugacuguugcugugcauuguagcaaugguuuuacagagcagaauggcuuccacaaacaaggcauccgaacucaugcugggauuugaccaucugugggaaaguaccugguuaaucugauggugaaggcaggcgcuugggggcacugaaucaagagucucugaacaccccaccgccacagacgagaaaggcucuaccucuccccugccuauaggcaguuaugagcuuggagugcagaccuuguaaaacucccucagcacagauauuuuccaacucuaauuuuggaucuuucuguuggucacaagaaagguaaaaucacauagaggaauucacugacauuaugaaauacauuuaugggcccuguccaugcuugauguaaugucugguacacauaaauacucaauaauucuuagccuuauuacuacaaagauggaauguuucuuacaccuacaugggaagacuacggguucaggagauggacagaucaugagaaccggaguucugaucccuggcccucccucacugaggcacauagcuguaacccaacugcugaggaggag

SEQ ID NO: 1725 - RNA, 167346 nt, Mus musculus
ugguacacaccuuuaaucccagcacuuuuugugaguuuaaggccaaccaaagcuacacagcaagacccugucucaaaaaguaaauagagaaggaaauauaaacuauguccagaacauauuauuuguguuauaaacauuuauaguuuuccauuuccugcagauaagccuucuuccuauuuuccuuuuuucugcccuauguugagacagugagcuauagcuuaauagauuuucuacguuuuuuucccuaggcaccauaaacaccaaauuuaaaaauggcccuaaagauugugccaagagugaugacgaggagagucugacucucccugagaaggaaacugaaggugaagggcccagccugcccauggccugcaccaagacggaacccaucgccuuggcauccaccauggaagacaaggagcaggacaugggauuucaggguaggugagcuugcccacgagggcuuccagggacagcuagggugggguuucaggguaggugagcaagcccacgagggcuuccagggacagcuggggugggguuucaggguaggugagcaagcccacaagggcuuccagggacagcuggguaggggcaauucuagguacaggaagcugucuccagaagacagguuuccuuccuguuaaucuaaagcugaugagucagcaucuccucugagugcucugcaccgugcccugugcccugcaagagaggcguccuguggauccagucaucuuugcagccucagcucugauuauaaagugcagaaacuugcauguacauugccuagucugugcaguucuggguaugagaagaggcaacucacuuugucccuggcccagguaacaagucuccauguccuucgcgcaccucccucccagcagccggcucagcugccacacugaagacguuugccugaaaaugggaguuuuccuuuauucucuuguccuccuugaagaaguagaauugaaagggaacguuccaucugagcaggccucauuggcauaugagucaugauucucgaucagacgccaucuguaaagagauaguaacuauuuacacauaguggccguacacaugguuacuaucacauauuuuuuucccuuuuuucuguuuuuaaaauacuucuucugagaugcacaguauauguguacagagccauauggaaacaggguagauuugcccauuuggguugagguuagucugcugucccuugaccuuaagauaauaaaauuuccaaaaccccugggguuucugagacugccuggcacccaaggguguguuuccucacuuugacucagacaggauuccagaagagacuuuguuuguaaagugauuggcuauuuaaaauuauggcaaaagccaaguacccugagauugguugcuccccuucaaucauagacacugauuguucuucucaaaauagcagauguuucuagauuguuccucacagacacuuuaaaaucaaccucuuaacuguauuaucugucagugagacaaugcccgaaaugcccgauugugcuuguucuagucaacacaauccagaggcagcaaaaggagcauuuucagcuaaaauggugugccaugccgcacacgcggggcgagcaaaugacacucagcugugcuugugggcauuaccuugcagauaaccucuuucuugagaaggcucugcagcucgccaggcgacacgccaacgcccuuuucgacuacgcagugacgggggaugugaagauguugcuggccgugcaacgccaucucaccgccgugcaggaugagaauggggacaggugaguugaguggggacuguugcacagcaagcucuguuucaggacggggaaaggcaaggauacugcccccacaaacugccuuugaaagggagcugcccucaucugacaagaccucgaguaugcugucucccuaggcaagaaggcucagauguguguaaucaugcuaauuuuacaccccugcuuuguguacuaaaauaguaauugagaaaauuauugacagcccugcaaagucccugaaguguuauugucauaguguacccaagaaagccagguaagaacaacauuaguagaguaacuaagaggaaaugccauucucuccuagcuacuagcugcuucucuguggccucuguuaagggucacgaggaugugagugggucaggcucugccucagcuccaggccaggcugugugggagucugacauuccagaugccaugccugcugucucuuccugagguucugugcacauagcuaccuggcuccuuccuaaaugguucucuuaguccuuccauugagacuucugaaaugaucuaaaagccuauaaauauagccagagacagcagucuugagauucaagugcuuuaucuaagugauccuaaaauagcguuaacacugaaaagaagcccuuugcuguggaagcauucuggagugcugugugcugagucucaguuuaaaaacaaagcgcuuuaggagaaugccaaccucagggguuucguacaaggaccuuuguccucgucacuugcaguguaacuaaggaugugguauaaccgcuggucuuauccuacacaguacaagaggaacccagacgaccuucugugaaaaaagcucugaauaacagaaggcgccuuuagaaggaaaucauccaguuagcauucaauagcaaauaaccacaaaacagagcagauaaccagagcaggacaccggugcuccaagggucaucuuuaaggacuggcgaaauucaugaguagugagggcgaguggauuaagcaauuaggaagugagaugcugcugucugaaggagaggcuguggaaagggaugccaggcacaugcaguccagcaagugugugcagaggaaugcaggaauguguguguaaggaccuggguguucauggggcagcugagacacuggccuucauucccaaguggguacaauacccagagccucgucaagccaagacuuaaacaagcaggcuccguguaagguuagggguaugagaccugggagacacagaggacccacucaggaguauacauaagggacuauucugguuucucuucuuuauucaucuugucauauuuggcuuauaaucuggacccugucaccauuagucaucauagaaauacaauaaagagaaacuauagaacccucugguaucggggaacuucccccagggguaugaagaucugaaggggaggggacgugcuucugugaagugcugagcugcacauggaaauguugaaguagcuuuugaagcccuuuuacucgacgugugucuguccgcaucaccucucacaagccuccugucagggucccaucaggagcaccacaggagccugagguguggcugcggugcuucucgucaaagcgugcgugcuucacuugcaguuaacacaggccuggggucaucuaaagaggccaccaugaucuucccugagaaguauugcuaagugaaauaucucagggauaaauaacaagaccuuguuuagaaauagaagucacuucucauuguuacggaggaagagagcucggcagcugaguuuucccaagcugcuccuaagccuaggcauuaccuuucuucauggucuuguaugucagggagagaccagggagagcugccagggacagaggcauggagacagagcuggcuuggagcuuaaugccauuugguuuccgacccggcaggugccuuugcacuucaugugucuggucagauguuaacacuccgggggcaggugggcacgaucaguguguaguagccugcgauaggcaguggagaggaaguucuccagagaaauaaugucaccucugaucaguacauucaguacaugguagggccaaggaaagcuacacauaguagcuagucuucagcuccagucauuucuugacauguuuuuguuucugucgcuugcuacauccccaguuaauuauugccacugugugucauuccagugucuuacacuuagccaucauccaccuccacgcucagcuugugagggaucugcuggaagucacaucugguuugaucucugaugacaucaucaacaugagaaaugaccuguaucagguaagcagccaccacaaggccgucgagaagagaaaagguugccuuaguaacacgugcgugagcuguucucagugaugggaaacaggaaaacagcaucuucucagaaguggcaucuuaaaagcauccuuaguugggaaugucauuuuacagagagauggguugggaucacggguuugauggcaaucacacuccauggaaauucaccaucuucuagaaaaggcagacuuuaagaccuagaagucagaguugauaaaguuuugagggcaaaccuuagaggggaaaaagucacagcugucaggagagacauguuaaaaagaaauccaaguuucaaaagccagaguuacagagacaaaguuuggagcugagaugaaaggauggaccauccagagacugucccagccggggauccaucccauaaucagccacaaaacgcagacacuauugcauaugccugcaagauuuugcggaaaggacccugauauagcuguuucuugugaggcuaugcuggggccuagcaaacacacaaguggaugcucacagucagcuauuggauggaucacagggcuccaaauggaggagcuagagaaaacacccaaggagcugaaggggucugcaacccuauagguggaacaacaauaugaacuaaccaauacccccagagcucaugucucuagcugcauauguagcagaaaauggcauagucgaccaucacuggaaagagaggccccuuggucuuacaaacuuuauaugccccaguacaggggaacgccagggccaagaagcaggaguggguagguaggggagcagggcgggaggaggguauaggggacuuucgggauagcauuugaaaugcaaaugaagaaaauaccuaauaaaaaauuggaaaaaaagaauauuuucaaauuaaaaaaaaaaaagaauuuugaggucugcggaaggaaggguauucgcacagcaacuggaucaaguguaugucaaagaaaggcucugaggucagcuccuggagaggugaaaggcuguaagaacaggaagaggcaccucagagucccauccagcucaggugugagaagguaagggagccccgaaaacuccagaggaaacuaccuggagauggcacagugagcugaggacagaggcagaugguagggcaaagcaaaccagaaacuccacuggcagacacagucugggagcuguggccuggcccaggaugguggccugcucuacggcuccuuccucucucaccucuauuucucuccaacccuuuugugccccuaccccucucucugggccuguuggucuuauccucuuguuggcuucuaaguuccucugcacucucuugcccagagugucauucugauccccacagccaggcccaugcugagaccucugcuuccaggucauauugcuuucauugaaaaacuguggccagcaaccgugaauaauuuguuauuuagaagagaugagaugagaacuaguggaauucuuacuuguuuguuuguuuguuugugauguuuuuuguuguuguuguugguuuuuuugguuugguuuggugcuugggacuguacccaaagcugagcacaaacccuuccagcaaucuacaaccauguuacuccauuuuuaaaacaaguuauucaaguuguuaucucuucuuauccaugcuucucucugucucccucugugucucucucugucucucucuugucugucugucugucucuguguguguguguaucccucucuaucaaucucucucugucucucugucucucucuuucucucccugugucuguguaucucucucuaucaaucucucucugucucucugucucucucuuucucucccugugucuguguaucucucucuaucaaucucucucugucauucugucuccgucucucccccccccccaauguguguguaucucucucuguugaucucucucuagcguacccaggcuggcacugagccaucaguguccuaccucagccucccaaaucauaggcuugacaagcaugugccuggcauguuaucucauuuuuaauuuaaaaaaaaaucauuauuuuagaagaaauuaaaaagaaacaaagagaugacucaguggacgaaguaucugcuguacaagugugaagaccauguucagauccccagaccaucgccagccagauuuaguaccacacccccccacaccccgcccccgccccccccuccccagucagggcaggagacaagcaucuugcauaugcggggggggggggggggggacaaaagacccugccuuauaaccuugcacaaggcagggggcaguacacacguugcccucugaccucaugcacgucccugcacccacacacucagagaaggaaagaagggaaggagagagggaaggaagaaaggagggagggagggagggaggaaaggaaggaaacuaacugcacauacacacuaaaacaaaagagcuaaaaaaauuuuauuuuaaaggaaaucauuaaauucuuauuuuuuaauacaauauuuuaaaguuacuuugaaaauaugaauuggaggcuggaaguggcucacaugcuuaaagccuugaguucguucgcuccccacaccaaagaaaaggcugaagcuguuaguucguuggccuguagcucucagacuuuuccguuuucagaggagcacagcugcuuucugcacagcacucugcacuucucugucugcagugauuccuauccaggggagaugacuaggcuaagguguuauuuuagauguguucuucaagaucugucuuccucgggcuuccaugccaucuugggauacuauugguauuuggaaagucauugggccccgaaaguugaauucuccaaacuuuuaggcagauggcacuuuuuaaaaacuuuguauugauucucugugaguuuugcaucuuuuuuuuuuuuuuuuuuuuuuuuuuuuuuggguuuucgagacaggguuucucuguguagcccuggcuguccuggcacucacuuuguagacuaggcaucaugcaccccagucccacucaucucccuguccccucauaucugcccucugcccuugcagccucccucccacaaaauaaacacucaaguaacaggaaagacaaaaacaaaaaaagcauagagaacaucucgaugugggagcgauagugugucaccgggcaucccacaguguaucccucuguccacacaucuucacuugcaaugaguguuugguucucugugacacgguaauucugaguuccccaaaguauaagcuuuuauguuauuucaagauuaugcuuauacugaauuuacaauaauaacaaacauguggcaaaagugagagccugagaacuaacgacauaaaaggcugugucacaugccggagaaugcaagaagagaacgcaguuuaaagacucacacuugggcuagucuagagaguggguggguuccaacagggaucugauagugacagauggucacagaaauguacuaugguuaguggaagauguuuggggagaauguuugagauaauuuacaaauaauccaaauuacuuagagaacuguauacuuuucugccaagaauaguuauuaugucaugcaugauggugcauaucuauaauuccagcccagaggagucugaggcaggaggauuguugugaguuuugggccauucuggccuguacaguggguuccaauuuugucuguauuauauuauagggucuuguuuaaacaacaagaacaacaacaacacaaaaccaaacaagcaaagaaaaaaaacccuccaaauuaaaaagaaacuaguucccaagcuggguguggggcacacauuuguauuucuaacacccaagaagacacaggaggacugacagcuucaugucaaucugggcuacacagcaaguucugggccagccucaaacacaggaagacccucucucaaacaaaacaaagcaaaacaacuccacaaagccaaacaaagaaacccaaaaguuaugagaaucacaaacgcugccugucuauguccuugaggcuaagaagcugguauggcagggaauguuugugcccauuaacugagugaagccaaggugggaaaaacuggggagaaaggucugagggcuccaaaucagagcagcuuugccuugagcucaggggagagguuccauccacaaagagcugggucgcacacaauagagccugcuuccgcagauccuaucaccaacagccagcagggcuuccugaauccaaccuccagcagccgagggaagcagguuuugcaaagaggauugggaaguagcaacuuccucuucuucaguuuauucuuauacuugugaugguuaaaaaugcaaucugccacuugucugcuaugagguagccugggugcaggggugaugccuuccuccaccucgccucucacuaccugugcaggcagucaggagagcuggccuggggucaugcaagggggugagcuagcccuguccuucacaggcuuucgagagcaggccuugcaucuagccugugcugcagaguagagaggacccucguggagggagcacagugagcagcccugagggugugagagcaggagaacuggcccugccccucacucacaggcuguaguguaugggagaguggguccugcccuuugggcagcacaguggagccagcucuggaggcauagggagauccgacagcucccuauuuccagaugugacuguugcauguauacaggaagagugcucuuccaguguuggcuacagacagcugcucugggaagacauguauucuuuagugugcucacaugcacuccacacgguuuuauacauacauuuccuaucccacaucagccuuucccuuuaaguuucgauuuaaaauacuuucucaauucauaauuuuugcaaaauucaacugagaggaccuguauauuuccugagauugaaccagacgcuuaccuccuaaguucccccagcaguuacauccuacuuaacacaauaauacaauuaggaauugcaacagauucuaaucagaucucaauauuuguauguacucauaugcauggauagcucuguaagauuuuuuuuuuccuaagcugaacauggugguauuguguuuuaguuccuguuauucagguagcuaaggcaggaagaguccuugaauauagauguuccaauguagccugggcagaaagcaagacuguuucuaagcagagugaaugaaugaaugaaugaauggucaauccaugugcuuguggauguguauguagcauuguacugugucccugucuugggucuucacgcuguuuauccuuuaguuucauagacagcugguuuguucucauugcuccugaagagaaugcugucauguccccuaacuagcugcucacuguccacaggcugugcacugcagugagcaccugcacuguacccaugggugccacaaguggguuucaagggcagugugagcccugagcuccacagauggauucuagggauuccuugaggcacgcauuuuaugcguguguaaaauguaacccuuggguguugguggcccaccagccacugcuucccagcaggaagaacucccugaaugggaggucgggcaaguccucacuacacagccugggcuucaguguaaagcgccuacaacacagacuggcuggcauugagaguuggugcuacucucuaccagugaucucagcuuuuugacagacacuuuugugauuggguuagccccacuuguuucugaaaacaguuuuccaugcguccuacuuacaaccauggaagcacagcuuugaggucaggguagucagaaagaccucccagagccuauuaugcacagugccugggauuguuuucugccugaacuuucuuagggagagugcuguauuggcuaacuaugcccugaggaucugguagcaccugugauaguauuacaguggagcuuguaucugugcgucucuugaagccagccugcagcaguguguucugguuuagccuauguacuuccagaccauuguggaaggaugacaucuuucuugauugcuuucuuuuaauagucuauuuauguuuuguuguuaaaaacacagcauugguucgauuugcaaauguauagaauuaccagcuauagauagauaccuaucagaaauucagagaaauuaaauuuucuucuacaagaguuaaaaaaaaucauguagcaaacguaucccauaaccccgacuguugaaugcugguucucuccgugggccuuugagccuggcaugcagaacaggaagcuccuugagugacaaaugucccuacaguaugacuccauaacguagccugaagccaggggcuacagacaucccuaagcaauggcucucccucuccuucucuguguagacaccucugcacuuggccgugaucaccaagcaggaagauguaguagaggauuugcugaggguuggggcugaccugagccuucuggaccgcuggggcaacucuguccugcaccuagcugccaaagaaggacacgacagaauccucagcauccugcucaagagcagaaaagcagcgccccuuaucgaccaccccaauggggaagguaagagcagucgccuugcuggcuaaccguccccucucggcugcagcauaagggcuuggcauuugacaaaugcaucugacaugacuuucaccaugaauacucuccucagccagcuggaguuugucauaucuugugguuauuucugcuguuuauuacagcaaacgcccuuaaagaguauuugugaguauugcuuaguaaguggaaaagcaagcccgagcaaacauuagucuuuauaaagcaucguguguguguguguguguguguguguguguguguguguguguggagaacguuuacauaguagcucagugucucccgagaacacagugggagcuuguggcuucugaaaguagaacaguggaccgucugaggcuuugaagcacgcccugaacagaaaccggaagugcugcgaccugguggugucccuccuccccgcagcccagcucugucagucucacccacaucucugccuuuguucggccuuaggucuaaaugccauccacauagcugugaugagcaauagccugccaugucugcugcugcugguggcugccggggcagaagucaaugcucaggagcagaagucugggcgcacagcgcugcaccuggccguggaguacgacaacaucuccuuggcuggcugccugcuucuggagguaaaggcguacuugugaucuugaccuaaaucccccuggaaguuuuagggaagucuuuucaaagaaugacucuagggccagcucgcugucaguauuccacugucugcuuucugcauccccagcuccagcccagcucucaaccuggggaugccagugacagagccagcccaguauagcaguugggugaaugauguaaccugaggugcaacggagauguggagguagacaguggaggagagagccccugcuaacucuuucuuugugggcggauuuagggugaugcccacguggacaguaccaccuaugaugggacuacaccucugcauauagcggccggaagaggguccaccagacuggcagcucuucucaaagcagcagguaagacgcuguggucacugauaccagcaaagcaaacugccugcaaguucaaagcugccugcggaagcugcgguucugcccugggaaagugccgguaaaggagaccugcacccgggccacccugcagcggcugcacuggaggcucugcuuggccucggguuuaccuugaugcucacgcuaguucccacucucugguuaucuacguugccuuuggguuguugagguugacucgguaccuauaaaaucuugagcugugucagcuucuggucauauuacaagucucccagaaggaaaauaucuaaagacuuccuuuugcaaaaaaaaaaaagucucuuagaagcugaaagcaugggaaaagcaaaugagcccuguauuuguguuacugugcacgaggcacuaagacuugcuggccuccacugccuuuccucggcuccaggcaccaugcuggcaucccauauucacagucuccuuuaucacaucuacuccucaguaacucucugagauaagaacuguugcuauuaaucccaucugagcaccaagaaggcagacuacaaagaugaucaagccccacucccagugucccggaaagcugagucacagcaccgcagccugacugcagacucuuauucuucacgcugucuuucuuucugcucugccugggguucuaguccuuccuguaaagcacucagaaacauuccagcucaucuccugucuccggcgcuuuguguguucaguguuaacacaugcuugaugagguuggcuggccuuccgggccugcccagacacaccugauuuacuucagagguugauaagggaggauuugugaacgacacauuccuuauagauucaggcaaagaggccuugguuguaauguguugagucauuuuggaagucacugauuauacugggggaaaaaaaaaagguugucucuuagucagacaccugaaaucucaacauucagaaggcugaggcaggagaauggccacaagcuuaggcuaccuugguccacauaguucuaggcagaacaaagauacauagugagauacugucucgacaguaaauauauaaauguaaacacuuuuacuugaauucaccaugaaaagguagcaaauaauaucuugugugacauaaagaaaaccagacaaaaagccuagcccugaccuccucggagucacaaaggucacuucagggacauguguagcccucgggucuucaaacucauuucccagucauguuccuggccauguuuugcucacguuauaaaagagcaagugaggcagcagagaguggcaaggcagcaguguuggcccaagucagagguucugucggcagaacugaagcaaacacuucauuccaaaaggcugugcugagccugccugccugccugccacuguuggccaacccggagccggacacccauagguagaauagccaggaaggcaugacagguaacuccacuaacauuaggguuacguuuuauguugucuugcugggagcugaagaacaggcaauauccccaagauuuguuagcacauuuuuuccccauaacaacacauccugccuagcauagcggccuugcgguguccauuucucuguugcuuaggaacuagaacuagggccccaacaguacagcacucaaggacagagcugaccaagcaaaucugcuccacacaaguaagcgagagugugagaaguguguauugguagauguaaaugugaagguucaggacuuuaccccugugggugcauaaauugccaccuacuaguccuuagguuaaaauguauccuuuguaguauaauaauaauaagaauaauaauccugcagaguuacaaaucccaggaguacuugaagucuuucauguauuuacuuuacauccugaucacguccuccccuccucccagugcccuccacauggcuccuccuccccacccccucccucucucuucacaggguccuuggcuaccuacuuccauagaagugaauuaaaauuuuuuaaaaaguuguuuuaaauuucacuagaaaugaaaaguuauccuguaauugccuuaaugagcuagagguaaccugucccucgacaugggaauccugugugugauuggaggcggacaagcuuuuucuuuuacacaacacuguauuucccugacuccauaggagcagacccccugguggagaacuuugagccucucuaugaccuggacgacucuugggagaaggcuggagaagaugagggaguggugccagguaccacaccccuggacauggcugccaacuggcaggugagcccuggccagcccaucucauggguauuuacgggggagccaguggcucaggaauauaaaacagauggucuucuuggcaugcuccucccuaaagaacaugccuuuguuuuuaugaggucuuguuaccgagagggucuuaaucuugaaagauggucuucauccaugaaagaugaagguccggugagccagaguguaaagcuguuuccguaacuggauuagaguucagauaugagagguuagaaaagcacaaaaugcacagaagaguuacccugucagcacacgaccagaguucuugccauuucugucagaagcuagcuugcucagagcuuaaguaagagguuucugaacauaaaaauaaacuagaaauucucuuguggauuuccauaaacauauuaaaaaccuuccuuaaaacacaauagggcuuacacuuaaaggagaaaacgcuagguguuuggaccaagagaaaagagccagaaggcaaaguaggcaguguacggguccaacacagucggguuuguaggaaucuagacucucugugcacgucuaggaggcuguuugcuggcuggguuccuacagggaacacagaagacugaccccugaccugauuccuacccuguguaccaucagcaaauucaccucagagaacaccaggacuuuuaaaaaucauuucugugaauauuuucucauguuuuucuauccgacagguauuugacauacuaaaugggaaaccguaugagccuguguucacaucugaugauauacuaccacaaggugagguguggcaggacagauucucucagccaguguugccccaugcugugguuuacaggagaggagaggccagccugggcgaggguguacugcaaaccgucuagaucuuaucucagaaucugagaucccuggagguguggcccugagcugcuagaagcaccuacugcugcugcugagcagggccucuggacuuggcagaagcuugguggccuccaucagaaguuggacaaugaccuguccucucagauugauugucccuggaagguuaaagcagucauguuucuuccuuaggggacaugaagcagcugacagaagacacgaggcuacaacucugcaaacugcuggaaauuccugauccagacaaaaacugggccacucuggcacagaaguugggucuggggauacugaacaaugccuuccggcugaguccugcuccuucuaaaacucucauggacaacuaugagguaacgcgccgccguaccauuuagaguugucuguguaacuauugguaguugaccgugucagcuccacugagcagcacagccuacccccuuacauaguaacuuuauggaaggaaaccagucauugccuggaaggcaaagggagccaggccaggauggcgccuuuuucuugagaagacugguuacccgucucucggcauucccuguuuucaaauucucagagccuuccugugaaaauacuacugcccacaggauggggaccccuccaagcugugaucggugugugcaucccuguuugcaagagggagccccccagggccauggcuucauuguucugucgggugacuccuauuagagcaauuccaaacuaaaaaauagacaaacaugggcgagcuacuccgaaugaggcugucauugcuagcugcugucuucccuggauuucugugcguagacaucaccguaggcagucuccugucuccugucuccaugaacucacaggcuucuuucccuuccuuccccucuuuuuucuuuaucucucucccccuucucccucaucuucuccaucuccuucaucuucuccaucucccuuauccuccccuucuccaucucccuuauucucuccuucaccucuccugugauuuuucugaauggauuugauccaagaugggaacuagaaccuaagcacuguguuucuucagguuccuucccugcccucuccaaaccccccagcucucuggagcagacacagagaagggacgcuaacagccugcaaacaggcuggaacacacgaacauacucucccuuuuccuaccaggucucuggggguaccaucaaagagcugauggaggcccugcaacagaugggcuacacagaggccauugaagugauccaggcagccuuccgcaccccggcaaccacagccuccagccccgugaccacugcucagguccacugucugccucucucgucuuccuccacgaggcagcacauagguaaagaggcugagagaguuccuuuccucgcuggcaaggucuuugugcucugggacguggcacuacacucccuuucccuagucuuuuuccugacauguguuccucuguggcaugccacccgcucccuccccacagugcuccucugcgcacacaggaacaggcaguucccacagacacucacauuggcauauaggucacuuagaaucccaguagacacuggacauggcggggaggguuaaagaaacacuacuucucauauuuguuaaauuuggagaaagauucuaagaaaggugcacagcccugggccacaggacaagaaguaggacccaggaaauaugcauacuguaugacccuuccuuucaugccaccacccucaggucccccaccuccucccucccucggcacuccccguccuucagcucccacccugcucaugguccugccuuugucuucccacacuaacauccaccugucacccccaacacaugcauuuguacgaauggaucucgguacaggcuugaauuaugucauuguucccggcccgugcuuucucuaaccucugcacccuuucuucuuguucauuuucuacccuagccacaaacuccacugagaccaggaacaacuagcauucucccaucuuuguauuaugccagcacccggguggcaggccuuccaucugggcucaguagguuaugucugccuuccaccuggggcaguccuccccugggagccugccugucaccuucagcagguccuggacaccugauucuugccucuuuguccuguacuguccuuccuuccccaccugcuguggagaaccucuugcuaggauguaacuucucaucuuuaaacacuggcccgccuggccacaggcugcuuagccccgcuuugauuaauguuacaucucaaugaauggcuuuguccauugauagcgcuuugguuagcucauguuuucacguuuguaugauacaugcuguuauuuuuguucgcauuucucauaugggggaaucuacagguaaacacagccuccaaguucaguagaaaaaugucaucauuaagaguauuauauccaauaaacaguaaacagauuuuuuaaaagagaaagaaauuuagagaaaaacgagacaucacuuccuuguuacacccuuuaguugaguucaaacuucucagaagaauaugauaacugcuggucagcucaccaccucugucugccaucugcuucuguccccuccucuccuacacucuccuccacguugcccgauugacacucauccugucacagcugauagcccucacucaccaguguccucucagggccuugucacccacacccacccugcugccuccuccucacuccugugcauguaugugugcacugggguccuuagggcauuuuuauacauacuuaguucugguuuauucucaugacucccucagcucccaucgccccagcccuggacccucuacucccucccuccccccccccccccgcacucgcucccuucccauuuucacauguguucccuacccuuuccaucccuuuaaagccuguuuuccgcccccuggaggccuuugcuaguuuucuggccucugcucacgcucacuuccacaugaauauacauacgugacuguuggaagcuaggauccacacgugagagagaacgaaugguauuuaugucucugggcugccuugauuaguauucuccauuaaccugcaaguuucaucucucuuuacggccgaauaaacuuuuaucaucuucacacaacucuuggcucuugcacaaacucauacuggccaugacugucaaaaguauagccaggcuguaacaaaaucuaagaguggcaaugaauacuuucuggcauucagguccucaugcuuaacccugaaagggcaucucuucuuggcagaugccaaguuccacccauccucacugcuugccugaacuccaacaguggcuccuagucagccucuuugacucuuugcuugccccuccaucaguucucugcaccacggugaugugacaugauagggcuccagucacaauuaaaaacuaaauacuuagcagcuaggaacacggcaaguguccccuccucuaccuuugggaaagccagguagggugacaaauauguacaacccgguagcccacucauagaggaaaggacaccgagagagguggauccacgggacucacuggccagucucuaaaaacaagauggagaaggaacaaggaagucacacaauguugaccuccccacaccccacaccugcacaugagcacacaucccacaaacacaaagcaaauacuuaaauacuguauuaaauuuccaucauugugaccaacuuaggagagauuugguugggcacacaguuuuuauaggucccaugguccacugccuucgggguauagcaaaacccuucaucacggaggaagcacaugguagaggaauccuacucacuucaagguguuuggaaguacacagagauggggaggagccccaguacagaucucuuucaaagccacgcccuccaugaccuaacuuccuucugugaggccccauagucaaagaguuguaucaccuccagauaaugucacaggcuagaaaccaagccuuuacuuagcacacagccuuugugggacauuuuaagauccgaaccauaauacacaguaagccuuucaaaugcugcccagucccuguuacacaacagacaguugacuggaugagguaacaccaggacaccgcucuggcauggucauugagucucaguguucugacguuaagauucaaugaugagagucaaacauuugcuuaguaaguguuaugcuucuguuucuuuagucacucuguacagaaauaaucugcucugguucccaggaaugcuuuucaggcgauagaauuuaacuuaagcuuuugguauagacacauuuaaaaaaaaaaaaaaaagccucauuuucuugcaccaaaagaaaauuuucuaggcaauguguauucuuuaaaagcucauacagcucagagaaaggugccauuuuuaguuccugcuucuguuaugaguuuauuuugccuuguauucagcaguuugcccagccguuaaaaaaaaaaaaaaaaaaaaaaaagacaaaagguaaaaugauagagcaguuagaaaaauaugccucacuuuacaaaggaaaacauguuuauccugaaccaagagaauucagaacagauucuguucaacagaaagacugauguacccuguagcacucucuaaugucauuugauaacccugccauucacacagccaagcagcaccgguggcaugauggggaggugggaugccgugcugcgcaggagcuagcaagcacaacccuccauaccauaguccacacggagccugggagggagcccacugcuguggauggugcucuagggcacugugacaaagcucucuggguuuauaucagcccccagcuccuauccaucauggaagggauucagggcaggaacccaaagacuuugaaucugaaacugcugagcaccccggcuugcugccucaugggcucaugcuccacuggcuuucuuacacagcccuggacugccucucagggaguggugcugucuacagaggauagguccuccuccagucaguuaacugucaggacacgcccacagaccagucucaucuggcugggcccucccucaucugcaccucccuccucaagugauucuagacgugugaaguugacaguugaaggugacagggacagcaggcagaacaaagcccuugccauggccuaacucagccccucaugagucugugcuuucuccgcagaugaacuccgggauagugacagcgucugugacagugguguggagacauccuuccgcaaacucagcuuuacagagucucuuacuggagacagcccacugcuaucucugaacaaaaugccccacgguuaugggcaggaaggaccuauugaaggcaaaauuuagccugcuggccguucccccacacuguguaaaccaaagcccugacaguccauugcaucgucccaaaggaggaaggcaaagcgaauccaaaggugcuggagaaucgccggccugcagggucacucgauuucauucaaggccuuccgaauuuggcguccuuucuugguucugaaaugaaauguaguugccacgcacagacggugucuagcaaucauggcgcucgcucgcucagcugcacucuauggcucaggugcagugucuugagcuuucucugcugcuacuggaucacauuugcuuuguguuguuacugcugucccuccgcuggguuccugcugucauuaaaaggugucgcuguccccacccgguguccuuucuagccaucuacuguaaguugugcauucaaauuaagauuaaggaaaaacauauuuuuaaaugaguaccuugaugcgcaauaaaaaaaagacauuucuuuuuuuaaugugguuuaucugugauuuaaaaauaaaaaacacaugaacuuacaauauuuaaaacaugcuacaaucagugcugaaaauaguauuuuccccguuuuaugcauuuuacuauuguaaauauguuuucuaaaucaaauacuuuaaaagaagaaauguugaauuuauaaaugcuauuuacuuuuuuauuuuacuuuuauaauaaaaguacaagcacauuguugaccuaaucuugucugaucucugcaaaugcuuucucagaggagucccugugacugugggaacagccccacagcccguuugucacauccacauucuccuuuagacacauuucuuugaagcuagaaauguucaaacuguggaaauaaaaguguucuaacccaagacugagguuccgacccaggcaacaucaucuggacgccuagcaucaacauuccaaucucuacaccguuccucuccagcgcaugcugucugugucuaugaaggauaacagaccccagcuucagcacuucaucuucuggauacgauguggccguugcguucauagcuaacuacacaaaaccuguacaagaugugguccuucaucauguauagagagggacugaugaaauacacacacacacacacacacacacacagacaccacagcaacuggcuguuaauaguugcuaggggaaugggaguccuuucuucaaaugguauagcacauacuccaguaacuauucccuccccauguucaugcaggcagcccuaauuaaacuuacucauacacacaagcacagaagcaggaaaguaggaggcggaaacgagaaggcagcgggguuuguggauaugaucucaguacauccuauacauguuuaagaucaugagaaaauauacauuuuaauuaaaaacuaaauuccaacauauguaaaagauuuuccaguauggaguuuaguaagucugcauggcugaaaguagaaagagggaagauuaauggcuugaaagaggucuuaguuuggacucuggugugugaccaaggucauuuaguguguaguguaaagaucaaauccaaaaccuucuggugaaguggcuuggcaguuaagagcacugaucuuccagaggaccagucaguagguuuaauuccuagaaccccucacagcucacaaccaccuguaacuucggucccagggaauaugaugcccucuucaggcuucugugggcaccaggcauauaaauggugcacagauauacaugcaggcaaaacauccauacacacagaaagaaaaaaccaaaaaccuaaggccuugucaugccacacaagugaucuacuacugaucccacggaagggccuggaaacccaccagcuauuaccuuugggaacugccuucacuacaaagagcucucacccccauuuccaugguagucauaugaaugccuuucccauugcugggaccuucagauccugggagacaggcuaaagugaucugggcuaucucccucacacagcucaagguaccccaaauagacaucuuguaugucaguguccauaugacaaaauauuccaaacuuacaaugaagaaaauggagguccagagagcgcaacucaguuguggcuaaggugcaucugcguuuauauccagauacuuagcgccuaggcuugugaguuagagaaugauuuuauugggacaaaaaagaugauaaugacugaaucuauuaguagggauuugguauaagauuaaguaaaauaucauuaaugaagaaaugauuaauuauuuaaauauauaauacaagcuacuuaauaauacuuaaauuauuuaauaaauauucuaagugccuaaucaucaauuaaucggaaucccuuucuaccaaaaauuccauauguaugaaaauuuaaaccauacgaauuuuagacauaccaccaaucuuagacaaacacccuugacaucgagaaggcccuaaucgagacuucauucugugauguaaaagcagagcagauucuaccucuuagaaugcaucacaaaugaacagaaacugguuaaacagcaaauucuguuuuccauuacaguacccucucuccacccuaacacacccuuauucugcguuggaaacuuuaagacaaaacugucuugcuuugguguuucguaauacuuccugggacagccaugccaccaugccccagccaggacuuucuauggcuguuagcugugcgucuuaaaacauggugcugaagcccuucccacagagagacaccauuguuuccuggguuuaggcuccugaguccaggccaccuguggcaaggcaggaacgaugcugagugacuuccgaaacuagguccgaauuucugccaaccuucccggaacuaccuucuccuggaacucagucacccuguucagagggugccaagcagccaugaagagaaggccaguacagguguucagccaacagccuuaaccgagguccuagccaaagcuugccaagccgacggcugccaggugacccugccuagccuuugggcugucucagcagaugcugaccauaauagacaugggcuguucugcuguucuccucaaaugacagauuugaaagcaaauuaaauacuaguggggguuuuaagcccuggguguagaguggacaccaccauucuccaggcauuugaaaagacagcuugccuaccauaaguucagcagaaaagauacugacuggagggacaccaaccaggcugcccguaccaauauguaaaauagcauuucucuucuuuaauaaacaauccuggcucucuuuuguuccagaaacuuccccuucuuaccaggucucuacgcuaauccacaugaaggcagccagaacugccugccucucaauggaaggagaguccaccuucacgccaguagauggagauaaacaccagaggcaguacaggcgguuggucgguuggucgggugggaagcuacaaugagccugaaagaagcuugcccugaaagcuuuccucacagcaggccgccacucaaaaauagcuuccucagaacuucagucagcuuuugagguuucuguacucugcaggcauaacccaaaccuuuucaggaucugcaggccuuucuucuuggggguguggggggagggggaggaaucccugcuguuguucauuuacccaccuggguccccuggggcaacucucugcgacacagcagacacagcagucaccaguacagaguacagcccccaaagccuguuaagucuuggcuaagaacgcagaggggcagaagccagccagaaugggcgucuuuacacgccagccccuuucaguuuccaacacagacaaagagcucagauuugacccauucccagagucaaacacaggucagccccacuccaaagacugucuuugaggaugcuuucaaagucuuugaugaacaaccggcuuguuuuuuuauaccagcucugugcaaagauggagucauaaugugucaacccauaugcaguguggucccagaauaccacuaaaaggacguauugcuugguaaagcugggcuuguggcacaugucuguaaugccagugcucuggaggcugaggcagggggaucaccauauguuugaugccaaccuggacuacauagggaggagacccugucuccuaaguaaacgaugguggugaugaugaugaugacaaugauaacgacaacgaugacaaugauaauguugaagauccccuuuccuuucccaaagcaacaguguacaacuuaagugacaguaugacuugaaugagaagcaucauggcauggguggcuuuguucugcagugcgcgcgcgcgcacacacacacacacacacacacaccucuaucucccgaccacaugcaaaugucccuuaugcauuuccaauacauuucuuucugugaucugggaacaaccaccuuacauauuaaacaagcaaauaucuuuaaaaacaggagugcuuccacuuaaaaaauacuucccaaucguuauuuccauaacacucugagguaaauggggggggaaggguuacaccuccugccauaguccacaagaccgugugcuggugucuggcccucccuggagagagaggcuggacucucuguagagagagagacucagucaugagucuuuacagcucaggccucagcuucggucuguaaccucucacaggugcaaggcggcccugacggaacaaaucacacggaugugccagaagcaacagcuugccagucaggggcauugaaggacauuacucacagcuggccaaacagcuggaagacagcacccgugaaaccauuuccucuaagaacgcuaaaaccagacagaaccgcccccagacagggcaggaggggccuugagaguacaugccggucucucucucucauuccuucuccuuccagacccuucucucuagcuuuggagcuugcaggaguuucucaacgcugccuggcuuuaauuuccugggacgcaauccuucccuuaacaagcacauagcccucaaaaacacacccaugugcccagccauggugacacacaccuuuaaucccagcccuugggaggcagagguagguggaucucugaguuggaggccaaccuggucugaagagugaguucuaggacagagaaacccugucucaaacaacaaccccacccagguuccagucccauuagugcacaaucccuccucccaacauacccagagaggccaaaaggaccagacaggacaccucuagagaaccuuacugcagccuccuagacaggccuugccacccaagcuaguaaugacccauccgacucucuuccuggggcgccacagccccugcaccuguccuucaaccaccaagccacagaaauacuacccuuucccccugugugagggcagugugagcucacagcacauuagugugagccacccagaucuaugcgaaagcagcucuacacgucuuccauccuaguuucgacuccuugaagaucagagucacuauuuggcccugccuuccccaccauccagccaaaagccuauugugaggggcuggggaagagcauuugcacacagcgcgugggccagccauaggcacagggacuccuuaaagcugcaaagaggagcagacaggcgguugaaugucaucccuccccacaggcagcagcugauggccauaucuuuucuuugguuacgggggcuucuuuauauuugucaucuaacuucuccccuaucuauuccagagguuugugucaaguuuccagagagucacaguaaguaaauuucaauuagacaucacucagggccagcaaggugacucaaccuguaaggccgcccgcuacaggaaccuggcaaccugagucagaucccccaggacccacaacaggguagaaggugcgaaccggccccauaaaguuuccucugaacuacacacacacacacacacacacacacacacuuugaaaaucacuuggcugcgaccuguuugccaggguagcaggacagauagaagugaaguaaauuaauagagcaggaaguagcucugguauuggaccuugugacccaguuuccauucugccugccaggcaccuaagacagaagccagagcucuguuuuagagagcugcaggcuccuuccuucuuucuccucucccucccccuccccguuuccuuucucuaccacccucugucccuuucuucuucuccucucccuuccugacacauuccuccuugcccuuucucuuccugucucucauuucucucuucccuuuucucccucuguucucucuuccucucacugauucucucucccuguuucucuccauccuccacucaucauaggccuucacgacuuccuuuccuuccagagaacaguugcccaugccuguagucagggcaccaucagccagcuccugcaggcucucccucgcccuccccucuacuuacagcaaaaggcugcagaagccucccucccuccagaagcucacugaaagccagccuuggcccaggcauuggucagccaccucccugcagccuccuuuccugugcacaggagacagacaggucgccucugugggaagauggagagcccugcacaaucaccagcaggggccuggcucuugcagcuuuugcuuuuuuuuuuuuuuuuuuuuuuugauaaaacuggaccgagccauaccucugccccccaaccccccaaaaaagaggggguggauuugaaauauauucaucuuucuguuucuucacuucaggccagagagccugggaucaucacccccacccccaaacccuggaggggacgcuuuaaacaauuccauuugagcaagagacucacuccccaggccugauggcucccaccaucuuugggggaacaaguaccguaaggcagcauuuaccaugaguucauccaugccggugcugaacagugacuccacucgaucucacagugauguugugaaacgccuguuauuauugaccacaucuauaaggaaauuaaaguuuaaauguuacgcgacuggaucaaaauuaacacacgaggaguuaaaugaagugcauguaggcauggggagccggugacccagcauccuacagcugaggggaagccuaagugccuacccuccgugugugggacccaucugaaauguuaccguucuaucuaauguaaaggugauuucggcugcuugugagauuuccuaugagugacugcaagcaaauacaggcuuuacguuuucccuauagcauaaagacugguaacagagaaaucuguuauuuugcgggaacucucacuuauuaaacauuauuggaucauucaaauuccuagagcacucuugcgccccaucugcuaaccaaauggccucuguggccguuacccacauuuucuuuaccugcaucuucaggacagccaggcaggauagggaggugggugcucacugcuucuucuccacucucccugaaucccuggugacacuguuuacagcuacauccgaugccugccaaaauucagauuacccaccuccccacaccuguccucuagccuucauauggagguaggaaucauaauaauaacauuaauuauaauuaaccauaauaacuaaucauaaugauuaaucauaauagcacacauuugcuguauuugugcuaucauuaucuaccagucaucacauuucauucucacaaugacaugaggaggguuaaaucacagagacagacacagacacagagacagagacagagacagacacagacagacacagacauagacagacacagacacagagacagacacagacacagacacagacacagacagacacagacacagacacagagacagacacagagacagacacagagacagacacagacagacacagacacagacagacacagacacagagacagacacagacacagacagacacagacacagacagacacagagacagacacagagacagacacagagacagacacagacacagacacagacacagacacagacacagacacagacagacacagagacagacacagacacagacacagacagacacagacacagagacagacacagacacagagacagacacagagacagacacagacacagagacagacacagagacagacacagacacagagacagacacagagacagacacagacacagagacagacacagacacagagacagacaaagagacagacacagagacagacacagacacagacacagacacggacacggacacggacacggacacggacacagagagacagacacagacacagaaacagauggcucaguggguaaaguuccagugcucuaccaugaggcucugcguuuggaccuccaucacccucauaagagcauggugccacaugccuuuaagcucagagcggggagagcagaggcaggcagauuucagagcucacuggccucacuacagccuuccucaugagcaagcuccagguucagaaagagaugcugucuuagaaaacuaagguagagauguggaaagcuuugggggcuucuaggaauuggacaggaauuugacauugggcuaggacaaggacguagguucaaggugaauacagcuaaggaagguguucuuuguaacucgaugggucuuguuaagacccuggauacuguaaucaugggaccuuuguaugugccuucuuuguuccauauguuguguuuuauaaaaauagagaaggaauguguuugguggagguguagucaggugugggggaugagggugccucugugggcccaugcugaggcaucccuucccccugagggaccaaccacaugaugggauaguauagaauagaguuuguucagggcauggagaggggagugaagaggguaguagaggcagagaaggggagagagagaguagacaaguagaugccggccaugagcauguugggggagggggauugggagagguaggggaagaggcaagagaacagagugagagcaagaaggcaagagagcaagaaggagcaaagggggcaagcagccccuuuuauagugagucaggcauaacuggcuguggccagguaacugugggguggagcuuagacaaaaugcuaacaccuuaacuacucuguuugugccuuguuuguuccuugacuacuuugucuuugaucuaagaacugacccuauucuuuguaugcaccuagaaugcuuucaaagcagacuggaaaaaaauaaacccgauucacccucagcacuggcuggagucacuuugcaucauguugucuuuucauguugucaauccucacucccucccuagagacccugagcuggcucggucauggagaaagagcaagaaagacauccagcauugcccuuuggccuccacacacacagaugcuuacacacauacacaucuaccacacacacaaauagaaaauagagaaaugauggcacagaaaaacuugaaaccugcuaguguuggcccgguauucaaacacaaguaugaaguaugucugacguuaggagcucauuccuuuaagggugucaacuuggaugauuguggcugucaagucagaagaccugacugcaaguggacuaaacaaacgagaccuuucugguuguacccuaagaagaccugagauggaggguggaagguuaauuuagcaguuucuacaccaucacggugccugucagcacuguuccaucaacagucuuaagugucaaguccucaaauggaugcuucccagucacaccuaguaguuggauuaucucucuuuaaaaagaaucuuuuauguuuaugaguguugccugccuguaugagugugcgcucccugcaugccuggugccaaggucagaagagggugucugaugcuuggcaguuagaguacagaugaguaugagccacugugggugcugcaaaucaaaauccaggucuucuagaagaacagcaagagcccucacccaacugagccaucucuccagccccuccgguaucucucuuagcaggcaggaaaacuccuaucaagauaucaacguaugauacaugcuucaccguauagcaucucccugacaaagaggaauauguuugauauaacauguaugauucacucccuggaggucacagccuccucucagagcagacacucuggcuguuggccagccagucaguaauagcugcuccaaccagugagaauguauggauugucucucaggacccaauaauuuuuaccagggucauaauaaauaagggcagaauaagaagaggaugcucucaaguauguucaaggcaagaaugcaugccagcuuucaaauagaaauguuccccuuccugacaacucuggguaauuaauguguguguguguguguguguguguguguguguguguguguguguguguguguguaauccugcucagugcacagcaugagacagcacaagggagcaugcuaaaucuuguuaaagggauaaggaaucaaacugcaucauuauugcaaacuuccccuuuauggugacccuugucuacaaacaugaggaaggauauuuaucaaaaaugagacaaugauacaauguccuuauuucugcaaagccuauuauuguuuggcuccugcucaagggcucagagaugucuuggcagguuaacccucugcucauauaucagagcccagccuggcugaccagcugaucuuguauucuucauuauguaucaauuacaaggaaaaccuguagagccccauuugaaauguuuucauuuuaucauguuucgaaaaacauuuuuucuaaaaugcuggauaagauggccucauuaaaagauuucagguaugggguucaagggggacacugaauaagauuguccuacuguguaagaagcuauugaaauaaugauuaaugccgugggcagacggggcuuggaggagacucaggcguacaaggcaguauggggaagggcguggggucuuuuuacaguucucagagaaaguggggacaacuggaagcaccaucauccuucacccuucacccaggcugccucugauuccaggauagcagaagcuggggagggaauuccacagaaggacuguguggcucggaggguguagcguuagaagcaagggcugaagcguacccauuauaugagcagcgggguauguccccaccugccaccuguggaggucuguaagguccuugggaaaaggcaccuggcgccccucauucucagaucccagccccacccacuugggaugucccuucacagauucucugacaagcuuucaagagugugccccucucucccuguagcagcaggaaucucugagguaaguggaaggcugguggccguaagggcugucugcggaugggagcaaccugagcacugucuugugaucuggaauucuuucuucaaagagauuucuuguuucuauuucuauauuugcuuguuugugugcaccgugcgcacacaagugccacggaaccuagaaagucuuugauggcucaaggcacucauagaaacaugcaagcaaaacacacacauaaaauaaaaauaaauaagucuuaaaaguauccuaucugccuaauagcuccccccuccccccaaauccugauagaauuauuuuagucaaagcucggcccaggaaugaugucaaaggcucugaauuucccacauaaacaaugcuggucuguuuuuccuaaucugagaacaugccucgaauucugagguagcccaggagaauaacucuguuucagacgucuggcacuuugagaaguuagcaaacauaucuuggucucuccaguucaucuucaucccuacagagaaggacaucagucugcuuguuuucugagugacuucccaggugcaacaaugucucacaaugaaaagccaagcaguaaggaagagagaaaaagaacuacagugacugaaaggagagaguuaguugcccuguucccuguuugggaaugggaagaugcacuucugugacguggggccugccacccgaccucucuggaacgcacuuugcaagguugucuccuugccuacuguuccccaccaagacuaaggaaaaccucagaaacccaaacccaagaguuagcacgucagacuccacccacuacaguaaacaggacaaaaacaucugucaaaagggcacgaaggcucucugaagaacagcuggcuacuaucauuaccuaacggguaauacuguguucugccaaagaaaacuaaaguuacugcccaaagcccugcaguuaaaaagccuccaaauguggguuugaaucaugacaacagcccuguugucucggcagccacaucuuugagcuaaauugcuucauuuauucugaaaaacaaaacaaaacaaaacaagacggauuacugauccugucuuaccacaagaauagagaaugcagaaguuaaaccauuguguucagguugcagcauuaauuugggcauaaacacaauguaaacauuacaggguauggcuagcauugagacacaauguuaucaucugcaaaacucacacuaaagaaccauauaauaugauaccccaaauagcuacuuauuaauauucuuuugccacuuccacuaagccaaugaguuuaaauguagcccaucccuuuggauuagagaguucauuggaaucagcguuaagucuaaagcucacaagaacauucaggaccaggagaggugaaaaguucuacuuauucaguaaguuccucaaaaaaaucucauaauuuuuaaauguaugugcauguguguacauccaugcaugcaugcuguaugugugaacauacccacagaguccagaaauggguaucagagcccuuugaccugaacuuacaggcuguucaaaguugucuagcaugggugcugagaaccuaacucggguccucuagaaaagcagcaacuuucaagcuaccacucuaguccuagacuggagagcuauuuccucuggugcuaauaccgcagaauugggcuccacacauuuaaaguuauauaguuucacagugcugugcuggguacacacuucccacagggggcagauugugcauggcugccagucuaucaucgucaaaggccacuuuucaggcuucucaagggaacucacccagguaaaaaagagcaaaguccucccuugcccucagcaccuugcaagguguaguccuugagaagccuuacacgcgugugaagagucuauguuuguaugugucuguaaaaugaggaagcucuuggguauuuguugcaugaaauaugaaaaaagcaaauccacgcuaaugcuggcuuaggcacuggccagcggccucagucuguaugcagcccugcagacaaauggagaccacaguauuccuuuuagccagggccugucucacccaggcuggcucugccucucuggagcuccgaagucgcucucgacccccggcucucuaaguucccaaagcuggcugcugccacgucugcccugugcuuccaaauuccugcugcuggcuggggugcacucuugcacaucacgcucugccuccaucaccuucuggaaccuaguugagacgcccggugauggaaaacaccacacaauccuaguuuagaaucaacagguaacacaauggcugggcacagaaccuagcauccuaaauuuauaaacuaaucaauguuauaaauccucacucgaacggacagccuccggcuuccuauauuaugacugccuccuuugcucccgcaguccaaaaggaccauuacucguccucuuucuccccgagacccggaagucccgccuacucgccccgugauuggucccuugugauuuuuauucauuaggggaaaauuccaccucagguacugaagaaaaagacuaaacagcccguacuauuuaucuucuuuacagaguuccucagccuagagauucucaggguuaaaaauaaagccauuaguuaaugagucuugguuuuaaauaaaauacucaucaccaguccauuccacuaaguaauuaagaaugcuuuccaguaaucuucaguuauagucuucaaauucccucauuugucaagcagacaugguguucaaugcagcuuuguaugcaaugaaauguuuauuacaugguuaaacagagcgcaaauaaacuuucaaguugucagugcaauuuauauaaucuguggguuuuuauuuauauauauauauaguauauagaaaaaguauaaaagucauaccaaaaagcccacaaaccagugcccaaaauagcuacuuauuaacauuuuuugccacuuccacagcagagccaaugaguuuaaauguagcuccuaacuuuggauucgagaguccaucagaaucagugguaagccuaaagcucacaagaacacucaggacgaggagaagugaaaaauucaacaguauagucggggccaacuuugaauuugugguccuccugccucugccuccagagucugagacuacacaggugacagcacaaucagccuaggcugcaaagaucucuuggucuuuucagaaagagaguuauugccaaacuauaugaaaaagggaauccuaccuaaagauaguaaucagauacaacauucaggccccucagcugucuaccaacaaucaauauggcugccaucaagcaaucucuauuguaggaucugaguucccauuuccucuggcaauccuagccacacacuucaccuacaguggguagaauuccuggugcuaugaaaggccuacauuacuucagaaccuccacauuugguuccacacaaucaugucacagucuaguggucucccaaaaaggucauugggugguaugagucuucuggccgugcuuuagcugugggacaaaaccacaauccugggagauucaagaauccccgggcaugaccuugucuaaagacaucaccaggaugaacaguauucacugggaagucauagcaccccaggcagcagauacuucuugacgguuuuaucucaggcugccuucuucuccagccaugcuuuagaaagccuuuguccccaguguccacugaauuacaagccaugucccuucaguagguauccgucagggaggugacgcugaaggccugcugcagcucacucuugcuggugggcuuccaaggguaaaacaguaccgagaguuucuuccgaaucaugaggaagccguuaucacuaaaucucccggggauacuuccuacauccaaccaaacaaagggagcgaccgcagacguuuccagaucaaaaacaaaaacauugcccuucugagagauguugaccugaaaaaaauaaaaaaaaagguaagugaaaugaaggacaagaaagagcuacagucuacaucugucagcuagacauuuauguaggccuaauaaaaacuucauuucccaacacuuugggcuggacugccaaagucauauauauucugugcaggugugacacucgccaggaucugaaaaaugauucaaguuuguggaaaauuaccaaucgucaucucaaaccaagagaaugcauaaaugucaauuauuaaggaaaauaucucugagaagcugaaagccccagaaaggggcacuuagcauuuugguggccuuaagugacuguuucaaaggauuaggacuggaccucccuuuagagcaugacuacaaagcuccuaaacccaggaaugaagugacacagcauauucucaaaucauggcaccuuccucuuccagugaggaccccaacucagacacaagcaagcagaucauaugguuuaccccacucaggccaggaggcaccaggggaagccuuggcuauuauugcugcaaggccaaggccaaggcuaaaagaggcaccaggaccuggcuuucucugaugccuaauugagagaaagaagucacauccagugugccuuacagcagagccaagguuugacccuaagcucuggguucacagagaaagacacaaugaguaucccuuaaccauaacugcuaaucaacauuguuagaaggaugagucccaucgauaugcuaaugaaauagaacaaggagcccugcuaucugacucccaauuaucaugaguaaccaaagucuagcuaaaacaguaaacaaauaaaugaauuuuuaaaaaacuaaguguuggaggggggaguguucacgcaugcaugagugcaugugucugugcacgcacaaguaaccacaccgagaccacagaucaggggcaaguagccucuuaaguuccuuauucaauuuauuuucugaggcagggucucugaggcuaaagcucuccauuucagcuagacugguuggccagcaaggccuaggacuccucccuggcucugccucuccaaugccaggauuacagaaacaagcugccacaacuggcuuuuuacuuagguuucuggagaccaaacucaggugucucgguguuugcuagcacuuuaguaauuaugccaucucaccaaugacaacaacaagccacuuugauuucagagucauacgcugauagauguuaaauaugacgguuauuuagcugucuuggcuaucuguggcugucuaucaucagucauucugucacugugauaaaacaccaggguaacuuccagaaggguuuguucaggcucagaccugcagaguguuaagauuccauuguggcagagaagaguccuggcagcaagcaaccugccuggcaucaggaagaggaccugagggugcuuaucucgaaccacaagcacaaagcaggaaaggcaaacaagaaagggagugaguuuuaaauucucaaagccccgccuccaagaugacugaacuucccaaaccucugcuaaaagcaucacccacuggggaccagauacacaaaccuuugggggguauuuucgcacuaagacagaauagguuguuucuugcuuugcuguuuaaaaaagaagaauagaaauuggcauaagcgcauagcgacuuccuuaucucuguucuaucucgguguuccagagaagguauguuuucaguuguuuucaguucuuuugaaaaaaaaaaaaguaggccuuaaaaaauuaucuuuucuaaagccaauuaaaaaccucaauaaacuauguaacaaguuuaaauuugguuaaacagagaaugauguuucuagaaaaauauuguccuuuuguacauggggggagaaagggaaggaaaggguuuucaaucaccuagacagguaccaaguuuaccagaugccuucauuugaaaacagauaaacgugcucugauuauccuuucuuuuccucuugccaauuauaaagagauuuggugauuaagggacuuugaagcaaugaaucaaagacagagaguuaaugaaccacacuagagccaaacuagagugauucaaucacuguucuucccgggccaugggacacugggcuuccugccuaacccucugugcacugguuaucucacuugcaaaccaagaucacagcccgucugggauaucauggaaggcagagcuuaugcaauagcacgcugagaacagagccugcagcccaguggagacgcaaucuguguagauguagacgccacucucacuccaccauuguagcccuaccagggaaagguaacaggaaagguaacaguguggcagaaacugauugauuacaaacaaacccugacauagaaauaaaaaugacuuagcauccaguaggaagagaagaaccauccccaggucacaguacuaaaguaccaggcaaaguaccaggaaacagcucacuugcccaagagaaggaacaccccacaggccacugggagcccagacaagagacacuuacagugauguuggccucgagcagcccuuuagcguccuucagggaggacaggaagugguaguugguugggcugaagaguucuuugucaguugaaaaguaaaaggagaccacgcaugucucccucgugcauccccugcaucucuucagcagcucagacaccggcaucuggaacagaaccacugccucuccggccuuaaccacaauacuugaauucacgagggagcacaaaggcuucggggagcuccagugauggagccucaccuggggagaaagggaugacauggaccauucuugccuauacggcuuggcuugucuauuuaggguggggcaucugcuggacgguagagcagcaggaccgaucggcuguaacaccugccuuugcaccccagcccccccaaagcucuagccacgucacuaauuacuuaacuuccauuacccaggauccauuucuccguguauaaaaugaggagaacaacacugaagaccguacugccugucaggagaauggaaaauggcaagagcccagcacacggcaggucuucucuaguuggaaacuguuucuaguguuaguagcgucgucuaaacuagagacauccaacgguuucuaagucuuccuuuuuaccuaaacuuaugacacgcguuuauuuuucuguguucuggaugguuuuaccgacuucaaccuuacuucaccccuuuaaccccuccugugaaaggugggcuagucccagcuucucacagugauaaucuuacacuuacagagcacuuugcucuuugcacagugcauguaauucuuuuauucacuuuucauagauaauacuaagggagacagacuaguauuauuugacaacugagggaauugaaaccccaagaugauaacagcuuugcucggguuauauaauacacggcagacauuagccugaaucgcguuugucuacacagccaagcagaugcuacaaauauuacaagcgucuugagacagauuagcuucuccuuuguuuguucccaaaagaauaucaccaaacuauuaaagaagucaaucuaaaaguugcccucaacuuuagagacggggaaaaagacauauccaagugacucacggugagcugcgugugguggucuuugugaagaucugagacgccauagacguaaaaaacaccuucaucuucaaaucccacuggcaacaguggagcgaagaaacgccgagcgaaguaaugcagcauuuuccauuucccuccguacucugaaaacagccgagagagagagagagagagagagagagagagagagagagagagagucagagaugccaggagcaggcagccggggcaggguccgcacgagcaggaguuuguguuagggugaacuugguguucuaagggcucagacaucaguucuggagacuguuucaugcgaagcucacaacaucagaaagauaaagguagguaggaacugccuauuucccaaaggaagacucaagcacuucauugaaacauguuggggacagcaccguaagcccggaucucgcuccaagacaggccuuucucagagacagccuugcuuccggaagcucggcacaucaaugcacuuuugauuuuguuuguuuugcuuuguuucauuaugagauaagauccaaauuggcccuaauccccaggcuuucaaacuucagccucuucaugcuggaacgacaagaguaaaccaguaugcugguaaccaguguuuuuuuuaccacacacacacauaaacaagaggaucgguagcagcaugaauggaugcuugaugcaaauuuucauucauaagaauuaucuagacuccauuccccuuuucccauggcuacaaaaucuucuuagcaaagcaaaacaggcacuccacaaaaauuuguuucagaauuagauuaaacauccagauccaugguaauuaauaccuucucaauuauaaucugaaaguguuacaaccauguagaaucccgugccucguucagaugucuaguaggcugaaccuccuuugguuucuuugaauugguuauauugaaauugguuauauuugaauugcuauuauaaaauacuaugaccaaaaguaacuuacaaaagaaaggauuuguuugggcuuaaaguuccagagagagagucuacaguguggagaagccagaguaugguagcaggagcuaaguggucacauuuuagccacacagaggaagcagagagaaugagcaggaaguggggcaaggcuacacacccgcaaagccggccuccugagacacaguuccucuaccaaggcuacaccucuaaaagguuccauuaccaccccagcuaguacuaccagugggggacuaaguguuuaaauacaugagccuaugggguacccuucucauucgaaccaccacaucuuaccauucaaccuuuuaauuuuccuccguucucaaaaucugucugagagugagauucuccccagugaagaaccacuucuggaggccagaagaacaagacaaagaaaaaaggguggggaaaaaauaaccccaugaaguggauguauaauauaaaccuuaguuuuguuaaaacagggaacaagcuuucuagaaaauaccauuagcuacugucugaggaggggggggugaaguaaagauuuaauuaacuaaacacauaacaauuuuuuccagcuacaugguuuuuaaaaaagcauccugauuauccuuuuuuuuuuuuugucaauuuuaaagcaauuuggugacuaagccauuuugaagcaauaaaucaaagacagugcaaugauuaauaggcuguccuugauugaggcaaaacuggaguaacuggaguaacucaaccagccuccgaagcucgcggagccucgggacccugagcugccagacuucugcgaacugcuuuguuacuugcaaaagcagaucacagcgcuagaaccuaggacauagccuggaacacaguggugcccaguuaccuccacugagagagacagagacgcgaagguaaccacacgguauagggugcaggcuguggaguugaaugacagauaagaccccaauucuuucuaguuuuacaaaauuucaugucugaagaucucauucccaacgguuccuguuuucucguuuguuuguuuguuuguuuguuuguuuguuuguuuguuuuucgagacaggguuucucuguguagcccuggcuguccuggaacucacucuguagaccaggcuggccucgaacucagaaauucgucugccucugccucccaagugcugggauuaaaggcaugcgccaccacgcccggcuugguuccuguuuucuuaaagcagugauuggugggagaagcgugguacagacgagccacucccguuggauuuuuacuggggacguuuucugcuagugggagauggcuccugggguaauugacaucucacguaugacaugugacaaccauuagagcagauagacugcaagucagcaucgucacucuucccccuuauagcgucccaugauucccucuaccgaagaaucagagacccgucaugaccccuuaauuuuuuugagauacaaacauagaugaauucauucuaagcgcaaaucccacuccaggcaugugacccguugcuaguugagcugguucaggugccaagcuuuccuguuugcaguucugacuuugcuaccuucuccaaggcacagcugaggcacauaaugaggauuuuauacuguuaagucagauucaccggcuuugacacauacaugagguagguaaccuucugcucggcagaacucucccacgcagaacaagguaaaugcccuuuaggcccuguaauaaaaccucuuaaauaaaugcagaagccuaugugaugagggcuuaggggaggugccggggaggaggggagggcucacgcagugaggauggggaguugguaaauugcuugccaugcaaguucagaugcacagacccuguguaaacagcugggcacgucagcaugccuugcucugggaaagcagagacuggggauccucgggguuugcagacuggccagccucgaugaauccaugagcuccaagagcaccgggucuggguucagggugaggcaggagaggaagaugcagagugauugaugaagacaccucauauugaccuuugguccauacaccucuccaccccacaucacaccugggaucucuguacccgagcccgcuccuuccuccacagcccacugugacuuugcggagaauagcaagcucgcggaaagacuguuagggccagccggguucacggaggguucagggaauagccacuuuggcccaguucuccuugcgguaaucugacucuucaggcucugcguuuucccagucccucuccacacaggcauugcuuucucucacacaaagagauauacuuaccaagagaggcccaggaaggagccugccagauaucguucagcugccaguacagugcccccaugguguggccuuuuccguccacuaucucgcugcggcugcgcagguagaacucgguuucuguuuugaugcacugggcuugcaucaccugagcagggaggcauucacagacagguauuauuguucgauguaggcugucgagaugucagaaguuacaggcuuggggcagguuggcuguuucuuugcuuaccugcuuguguuucuuuuguuuuguuuuguuuuguuuuguuuuguuuuagaauaaauuggauaaacuagaguguuggacuugcauugauuaaggcuacauuauuuuucauuaauuaaauuaauaaauguuacuacauaaucuugccaugagagaaacugcugucuacaacagggccggggaggggcuugguguuuuguuguaacagcagaugacaaaggaaaugggaugucacgaaagccaaugaugguguaggaaacgagggagagaaaagcuaucauuccggaacaaacgcuguacgcagucaaagagcacacuguuuugcaacagcagauucugcaauugcauucacaacuuuggaaaacuuuauuaggaaaaaaaaaaucuacuacaagaaaaucagcaugguuguugugaguaaauuagccaaucucuguuuuucuagacuaacuuuucacaucaugguuuuugauaauuagcccgaaauuucuuauggcugucauuucuccauuagagcaggauaggccauaugaugccaacagaugaagugcauuuaguucuuguuuaagaggcauggaaacacugcaagcagguccuuagugaccgucaucaccacuggaaaaucgguucuucuuaugcaccgcugcucuuaaugacgcuguaccuuguggucuuaguuuggaauucugcucaggagggggguauggacggucugagagccucggagauggucagagcagcaagaucucacgcagagaacagagugaccuuagaacaggguguggaucacuccagaaagagaauaagaagccuuccuagccacuagaaaacuaagugcagauuacuucuuucuauaaacaaccaugcucagaccagggaggagauuucagacuguagggacuagaugagacuagucagagaacagagacacacguuuccggaagggugacaucacugucagcaggcuacagggaaggaaaguacucgggaucuuguaauucauauccaagcagagcgccuggaagcugggugguuuugcaugucauguuugcccugcugcuguauguacauuuuccuguuugguuuugcaucucuuuuuucuaggggggggguaguuuuucaagacaggguuucucuguguagcccugacuauccuggaacucacucuguaaaccaggcuggcuucaaacucagaaauccaccugccucugccucccaagugccgggauuaaaggcaugcgccaccacugccuggcugguuuugcaucuuauguuuaagccuuugauacauuuuuguuaaucuuauuucgguaugaaauaggaguccacguuuauuuauuuauuuuuuugcauuugaauaucuaccuguuccagaaccauguguugaaaauucuauccgccuccccucccccuccccccgcccacccagugcccuuuuauugccuugggaauggaaacuggaaaacacuauaaaagguccucaaaaauuuuaaaauagggcuccaguacagcuaaauagauacagugaucgguuuagaucccaaagaauuuaaauuacuuugucaaaaagauaccuacauaccauguucuguauaguauuuuuuucuuaagauuuacuuauuuauuuuauguauaugaguguucuauccaccugcacacuagaaaagggcaucagaucccauuacagauggcugugagccaucaugugguugcugggaauugaacucaggaccucuggaagagcaucugugcucuuaaccgcuaagucaucucuccagcccuguacaguauuauuauuaacagccaaaauagaaccaaccuaagagccuugucaauaaaugaaaagguaaggaaacuguggguuagguauccaguggaaagaagaaaagugugucauuuuugacgauguuaauuaaucuggggaauacugcguuaaguaaagaagcuacgcuggcuaguuuuugacaauuugacacaaaccuaaacauaucugguaagaggaaaucucaaccgaggaauugucuccaccagauuggccuguaggcaaauucgugggucauguuuuuugauuagugauugauaugaaagggcccagugugcagugccacccugggcagaugguccuggccuuugcugaagagaaagagaggaguggacagcgcagggagugggaggacagacauggaggaggaaagagagaggaaacuacaguugggguguaaaugaguaauuaguuaacaggcugagcaagcuauggggagcaggccagugagcaguguuccuccauggccucugcuucugucugugccuccagguuccugccccaagcuccuacuccaacgucucuuccugguuagccggaacugaaaggcaaaccaaccauguccuccucaaguuguuagugaucaugaaguuuuaucacagcaauaaaaaaccuaacuagagcagaagccagcuucagaagaaagaaaaucacuuagaugugcaauuauaaaaagcugaauccauagaagcagagaauagaaugguuaccagaggcugggagagagggaagaugcagauacacaaauucaguuagaauuaaauucaagaggucuguuguagaaaacaaugacaauauuuaauuagauaugaacccauucaagcucauuccccacaagacugcccaggcccacgccccagaugauucuagaucccacaaaauugacagucgagauuaacuuuuacaguguguauguaugucauguugcaucccauaauuauacacaauuuuuauuugucaacuggaaggaaaugaaaacuuaauuuaaaaauuaagaguucucuaauucuauucuuuuucaaaacuauugacaaaagcugacuauuuggauauccuguauuuccagaugaauuguggaaucugcgugcccauuuuuucaacaacaacaaaaaaaaaguacuaaaaauguugaccaacacugaacacugaaucagcagaucuacucagacaguacugucaucuuaacaauuaagcccgcugauuuaggaacucuaagaguuguuuuaacuauuucauucgcuucaaucauuuugggggggagaggcagggggucaauuugagaaccuuguacuuccuuguuaaaucauauuuccaaguacagauagucccagauaacagugguuugauuuaugguucuuuaguuuuguaaugaugaaacuaauguaugcucagcaaaaacugaaccuucaauuuuuauuuuuauuuuuuuccugaugcuaauacuacgugguacaauaaccucuucccaugaagcuauaagcacagggaguccgaaaaguagccagcugauggguggguugcagcuaauuguaguguggcugaccuaugacacuugguaggugaggugcuguccuagguagcuuuaauugucgacuuggcacaguauagggucaucugagaggaaagacuugauggaagaauuguuuaaucagauuaucuugcaggagcaugucucuggggacuugucuccauuaucuauuguugacgaaggacacaagccauugugguggcaccaguccuaggcaaguauccugugcuaaauaagaaagcuuguucacuaggucugagccugugagggagccagagagggagccagcaagccauuucuccaaggcuuccacuucaaguccuugcuugauuccagcccuggcuuuacucaagaauggccaggaaugguggugcaugccuuuaaucccagcacucaggaggcagaggcaggcgaauuucugaguucgaggccagccuggucuacagagugaguuccaggacagccagggcuauacagagaaacccugucuggaaaaacaacaacaacaacaacaaaaaaccaaacaaacaaacaaaaagaauggccugggaauguaagucaaauaaagccuuuugucuccuaaguugcuuuuugugacaguguuugucacagaaacagagugacauuggauccaguauacuuguauucaguguucuacuggacgucucggccaaagcguccgugaguaacugaagggcagaagggaaaugaagacaugaaacucuugcucucugcuggcugcugauuugauguuauacaugggacucucuagagaguaaaggagaaucuugcuagagcuaaggaugagguucuuuucaaguuuacaguguauaagaucaaacuaaagauauguucuacuuuucuaaaaucgccacaaaugagugaauuuaaauaauugaaagugaaguuaaauaaauaauaccaguuuuaauaaugccugaaaggauaaaauaaagauuaucuuugacuuaugaugauguuucauggauauaaacucaucacagauuaaacugaccauaaaguuaagaggggaugaaccccacuugguuaauugugguaggucuaaccagauacucuacuucuucaugagucaguuugucaccauuucacuaguaauacacucauuucuuuuaaguuucuugucaugccuuaucccaguuguccauacuuuucccuuacaaccauugcuauuccuauaaggcaagugguacaauuuccuccuccaguccuaguuuggucaugugacucuucacuaguccaugcagucuaucccaaacguuauccauuuugccgaucuuuccaaauaaaaauaaaaaccaacuaaacaaaaauccacuuuaugauacaaauagcuaauaugaauauggugucuggagauguuagaauuccaugagaaaugguucaaaacacuucguggccaaguaucagacauuuaguagacacuuagaggaaucuugaaugccugaauauuaaaucacacgaugucuugaaaagauucuauacaugccaugugcuguguuagccaacacucuuucauuucccucaaugcaacacacagagagagagagagacagagagagagagacagacagacagacagacagacaggccucuuuccuguggugccuggaacagaagccagagcacaucaggaaaguguuaugucacugaggcauacuccuagcuguaauucacauaucugaucagagauguccaaagguaagaacgucaauaaaacaaauaaguagaaaucuugaauaaacacuugacuaguaaagcuacccacaugguuacuaugcucugcagggcaguggugccacacaccuuuaauccuggcacuugggaggcagaggcaggagcaucucaaggccagccuugccuaaagagugaauucuagggaagccaaagauauacagaaaaacccaucugggaaaaaccaaaaaagaaaaaaaaaagugcuuaaucacguucuuaaaaaaaaauuauuugauauguauggguacuuugccugcauguaugucucuauaccauguguguuucuggugcccacaaaggccagaagagggcauuagauucccuggaauugaaguuaugagcaaccacuggguacugagaauccaaccugggcccucuagaagagcagccagugcucuuaaccaccgaaccaccacuccagcaguuucaucucauuuuuaaccaagcaagugaaaauuaaagccauuuaagacacacacccaccagaauucccauaaucaaagacugacaguaccagcugccaaagcgaagguaagccagcuggaacuguaaaacaauguucgacaacgugucaguuuguuuaaccacuuuggggagguuucugacaguuucugucaaaguuaaauacuugguuuccuuguauaccuaagcaagcacacuggucugcuaaucaucaucuaaaauccuguucauagcagcauuacucauaacagccuucggcuagaaacaacagaaguguccugugguagggaaacuguaugcagucugauuuguucccauggugagacaguccagcaauacaaaagaagacacgcucauuguauuaucagcuaaggcagcucucacagagugugucgaguaagcaaguggagcuaggucguguugaaaucuaaguguagggagugcuaaucaaggcagcagaggcagccgggcaccaguggaguucucugcuuguguguuuuagcagcgcugagcuuugccugugcguuuagcacucgcagccaacuaagccuugguucagaauuggagacuugcucucauucaguuuggcacucagccuugauccuuucuaagucuaaacuagggaguggaucucaauggaauuaaucuguugcuuuucucuuucccuuccuaucuccaccuucucccuacacuccccaccuccuccuucucuccuuguccacggggauaccugccccagcaagguggucaccaccagaccaaaaccaaacagaagcugcaaaugaauuaaguaauuaaguuaaaaaaaaauccuggaagugaaagccaggucuugccauggaagaaggaacggugcaaagaugaggaagcagcaggcaggaaucgaguaaucuuauggacaauucucaccaaaaccuguuuaaaggacagagaggagagaagcgggaguagggaaggaaucuugguuaauucuuucccuggcucauccucucuaagcucccucccacucacuguucucguuuauuauuagucauucauaagguucugaagaacaggaugugugcccacgucacuuuggaagacucuauugguugaacaaauuuuguaacugucaaagauguuugaaccgagaaggcuuugcagaaagcuuccucgugaacauguggagagccuucccucccugcuucgucuuacagcaacaagugaguucuucugccuccagaucuuccagucuuccaaagucucuucucacucuccucucuucucggguuauaucuauuccaaauggccacacacccagcaugcucucuuaaucugugacucacacuaccacucccacagguugacuaaacuaagcugcaucaggccucucaaugaccaccuacaccaggaggugacuucagucuucaccaagcccugagcuuagagcccccucuacugcuuucauuugucucuagcauauauuuauugggcguuugaugccaagucgugagaaacugauucucaaagggcaccuuuucccuuccugcuccucugauaacucaaguugucugugggaauaaauaacuauucuauuaucuagggggaaagagcuagguugugccugcaggcucagguuugaauuagaugugauuuauuugguaagcaacagacaugauaaaacacccaggccagaccaauuacauauaaaugauuguaaacauugauccucaaucuauagcuugccuuuuucucuuuccugguagugcuuuaaaaaaaaaaaaccagggcuggugagauggcucaguggguaagagcacccgacuguucuuccgaagguccgaaguucaaaucccagcaaccacaugguggcucacaaccaucuguaaugagaucugacucccucuucuggagugucugaagacagcuacaguguacuuauauauaauaaaaauaaauaaaucuuuuuaaaaaaucaaaagccaaugauuuuagugaaauacaauuuaucagcccguuuuuuuuuuuucaugguuaguguccucaagcuuuaagaccucuucuuugccugucucugagucuuguguucuuuccaggacuuuuauuguguugcuuccucauuucaggggcuuuguuuucuuugucucagggaucagauccaaagccuggagcgugugcagcacggcuaugcuccaaacccucccauuugaaucucagguccguggugaaugcaaucugcaugcauggagacuuucauuucccuguaaagcgaucuucuugguccagcacauuucaucaacgacucuacccuuuuccaccugaauugccaggacauuucuguccuaauaggagauucuccuacugccuucauugcugaaacuuuagacuaaucuuaaacaacaaacaucuuaguacacaaauuuuagaauuucauaagcuguucuugugaggagaaacaaagccaagaauuagauacagguuuuauggguuugcucgucuguauugugaagaaaacaacaaccuuagcaagagcaugcaaaccugaccauuuuccaccauacaaaggcuacgaaagcugcaugauugcacacacucaguguagaagcccagcagcuccagacuagaaguggcuuaccugaguaagguagauagugucuuuaaaugugcgcaaugggucuguccccugggggaguuugaaaugcaucuugaccuggugcagcaucugaugguugccaucuucaugaugcugccgaugaagggagaagcggcuguuguaagcccaguccuccugagaugagaccuuguggauaaaggaagagggucacagacccuagccgugaagcuacuuuucucauacauuccugacaagccuggagagugcucuacacaucggaaagaacuuaggaauuguucugugguauuaaucauaaacauuaaagaaaaacguucuggggauugaacucaggaccucccgaagaguagucagggcucuuaaccacugagccaucucuccagccccgucauucucauuauuacugguaaaggccagccuugugcaaggugggguccgauuugguaacaacggucugcuuucauaccuggaaaguugcauuauauuauuucucuuaaaaagccuggcauaccaaaacauuauucuguucauuaaaacacauuaucacuuguugggagcuauuaagacaacgcuauugcccugaucucugaauugggccucucccuccccccccccccccacccccccaccccaccccacccccccccccccgagaagaaaagagggucaaaagcgggccaccgacacaccgcuccgagaacaaccacagaucguuccagccguaagucagcgccagauguccugaccucaagauacccugauaccgccaaguuccugcuuccccguguaacugccuaaagaaugugcaauucuauugccccaccccucccgcugauaagaaccuguacucccccuuuugcuugugcaauucuacugccccauccuuccugcugaaaggcacuuccucuuuugcuugugcauuuaaaccuugggccuggcuaauacauuggggccuugaugcaacucagaacauuuccgugucguuauucgcacaaggcucucgucucucucuaccccccaauuugguucuuaggagaagguccccucaagacccucgaauaacuggaccugcuggacaggucaaucacucauaucuucuuccuguuguuguugaccuuugguuuucugagauaggaaccccuguagcacccacaucauccucuccguguauguacaacacuggacugguucaccugccucccaagugccaaucguaagaaacuggcuucgcuguguacaucuugcaaucccauuucauuuauuugggguaaauccugcaauuagguuuuaaaaacugaacgaugggcaacaauugauauucuguuuuaaauaucauaguuuuaaauaagaaucaaauacugauauuacaguagucaauguuuucgaauuugcucauauuccuuagcugcgaacugccuagaccagcaguucucaacuugugggucaaacuuugagggucaaacgauccuuucaaauggguugacuaagaccaccagaaagugcagauauuuacauuacaauucauaacaguagcaaaauuaauuauaaaguaauauaauaauauaguaauaauaaaauaauuuuagggcuuauagaauaaguuccaggacuaaugaauccugaugaagacaaauaaaauugaacuaaggaucuuauauacaugucucaaaggaagauauguuaacugcaagacacacggaaagaaacaaucagaauaaucagccaucaaagaaaugcaaguuuucuguaaaacuguauuuccacaaaaaaaaaaaaaaaaaacgaaaaaaaaaaaagaaaaaacguuuucaaaaaaaaacagaaaaagaauuggaaaguaucgggaaagcuaggaggaaaacuaaucggugaagucaguguguagaaaaaaaaaaaaaaaaaaaagauucugagccuuaagagagucauuggaugauucaacagcugcacucauagguucacacccaguaagucugaaaaaauguuuauucaaaaacaggcacacugaugcucacaacagcuuucuucuugauagcuaagagauggaaauaacacaaguguccaucaacagacaaaaugaucaacaaagguggaaagacauccaauagaacagaaugagcaauaagaagcaaugaucuucuaacgcaacacauuaggcuaauuucauaacaccacacaauauauuaugugaauugugaagaaugcauaagcugguagacacagacaccgaguggggcuggagggucgggcggggucggaagagaguggagagugacugcuaacagggucagaguuucuaccaagucaugcaaaggcuccaaaagcagacauugggguuggauguacaagucuacacauacacuggggacuagcugaguuauacacacuuaguaaacaaauuauuuaccaagagaauugcauaucauuagagguaguucuaaaagaacacacacagugcuaaaauuaaaucuuuagauauaucgagaugagaaggaggaggaggaggaagagaaggaggagaaggaaaagaagaagaggaagaggaagaagaagaaacaacaugagaaauaaaaggcagacaugagggaggaggaggagaaaaugaaacuggguaauacagacuaggacuugcuucuccuguucauuuccucuaaugugguugaguauccaguucuauagcuauagaugauuagacugcauagaacguaucaauucaggaucaggaggauggcccaacugggaaaggcacuugcugcccagccugacaguuggauucccagaacuccagcaguaggagaggaccagcuccuacaagcucuccucugaugacacacacaugugguaagaguaaaaccuagauagauagauagauagauagauagauagauagauagauagauagauagauagaugauggauggaugcaugcaugcauggauggguggauagacagacagacagaaaaaugauuuagcaaccagaguuguuuucguguacaauuauaagucaagcagggcagugguggugcacgccuuuaaucccagcacuugggaggcagaggcaggcagauuucugaguucaaggccagccuaguguacagagugaguuccaugacagccaggacuauacagagaaacccugccucgaaaaaccaaaaacaagccaaccaauuaaacaaacaaacaaaaacaauuauaagucaagcuuaaguuuccacagguuuccauuuaacuucuagguguuccugaacgcacacaauuaaaagcacacuggagggcgggagagauggcucaguggguaagagcacugacugcucuuccaaaggucuggaguucaauuccuaacaacuacaugguggcucacaaccaucuguaacgaacauacauuaaauaaauaaauaaauaaauaaauaaauaaauaaauaaaucuuuauaaauaaauaauucuuuaauaaaaaauaaaagcauacuggaaaguuauccccucaaaaggcaguuauaccauuuuaucuccucagccaucauuaaggcgggauucuuuccuuucaucuccuuccaaaauuauaacaaaauaagaagugucucucaucugaacccaccaucuaccauuguaaaucagggggaaaaucaagagcccaguggcuuaccuuuucuagugugcuaaaagaaggccaggacugguagccauauucagacacuaaucgagcuuuugggaagaucuuccaauuccagcagucaucggcauaguuauaaaaaugaauaucaccauacuggaugcuauaagggucguaagagauccagccuuccuccaugguuuucaucccguugguugggcuggaugcaaugaaaggacggcucuugucuuccuggacauggggauaaaaugauuuuaaggggggaguggguggguaguggauuggggggguggguauggcggacuuuugggauagcauugaaauguaaacgaggaaaauaccuaauaaaaaucaaauuaaauuuaaaaaaaaaaaaauaaaauaaaaaucaauaaaucuuaaaaaaaugauuuuaaggauaauauguugguucggcaagauacaaacaguuaacuucuuuaaaaacaaaacauaccaccaauucuagaaaggucagauugcugggagaaaguaaacagggcagucaccacucucccugucaacacugucuugcucaucuuugcuauucuacaggcuagucuccaguugagcuggucugaaccccagaaauggugauaauucaccuucaugauacgguagguguucccucaugcuccuggaacucuagccccugccuaaguuauggccccccacagcccccacaagagaagcauggucaguagucacauagacaauggcccaaguuucugaccuucaggcuaaacuccuccccaguuaccuagcaacaguaaagaccauaaauggggcuguucagccccaccuugcucucuuaccuuuuacauaucucucuuguuucuuaccccucacucucacgcccucuuugacuucucuucucuccucuccucucuuccucucucucucucucucuuacucucuuucucucuagccuucucugucucugucuccgucucucugucucucuuucccccugcauuucuauaauaaagcucuaaaaccauagaaugucucugcucaucaaggcccacugcacuuggaggaugggacaggcuuucucuuaaugagccguuucuaaucucccguuagaaggccuuccugugcuccagucaagauccgcugcccucauucuuguagguauugggaaccucucuuuccucaucccucucucccauaaccccaguggcuuuagcaaaguagcuucgggguucccagauaggguugccccuuggccacccccugaagaaugggucagaggcuugaaugcccacccagggcugaguggaaaguguauggcagcucucccacgccugacagaccagagaauagguaaaacucuagugggguguggguuuccccuccuuucuccugggcccccuuuuuaguucccaacaguuuaucaucuaagaaaucuacacacaacccauacagacaagguuccuagcgcauuauaaugaaauacucugaauuuaaaugaucuuucaaagacuaccuuuaaaagaggcauacaauaaaaaaagaaagaaagaaagaaagaaagaaagaaagaaagaaagaaagaaaggaaggaaggaaggaaggaaggaaggaaggaagaaagaaagaaagaggccagguggugguggcauacaucuuuaaucccagcccucaggaggcagaggcuggcagacccgggugaguuugaggccagcuugguguacagaaaaagcccagucuacagguauuuugaauagucugugucuuuuuuauuucaagaggaagguggguuucuuuagcaagcaagaacagccaaagcuacacagaaacccugucuugaaaaacugaaaggcagacaacauacuacaacaauauugagaccuaugcauuuuaaaagcacacccuuaaauucuacugccccaaaccauuacucacugauaagacaaucuuccugauguucuucacauagagggucacguagucgucaauguacguuuucaugucccugggauuuacguggaaccaguucacgcugagagccacuucauucucauuauuaccacuccauaugaugauggaggggugagauuucagucuccugaccugaaauguaagaaaauauaaauuaauuuccccauacccaccacagaagaacuuggagcuguaaugguuaauaaaauuguaagcaguaccuuuucacauagacguucuugcccaccugacaccucacagaauggcuauucacgcucuauagcaauacagccuuaauaguucucggaaagacuagugggcauaguucagucauuuaagagcuugcuauucaagcgugaaaaccugaguuugauuccaagcacccaugucaaaaacugugggcaggguugaacacaucuguaaccauggugcuggggaggcagagacaggaggaucucagggaaggcuggcuggccuaaccucauccauaagucucagguuccagugagugaaauacauaaauaaacaaaagcaaacaaacaaaccucucaaauaaacaaacauguaauaacugucgaggccuguguggaauccgaaacaauucauggauucaagagucacauuaaaucucuguccugagcuggacugguguccauuugcugaggaaaacuccaggagccgcaggauuggggaagagaugauguaggguuugcauguguuacacugaggggcccacuaaaccucugaccacaccaccaagcaggcagcuggauaugaggaggagggauucgucagggacuggaagacugagcauaaauccgggaguucucagcaaguaggugacguuucaggcaggacacuggguaagucacucagggaaugaauuaccagacugcaauuuuucagaggaguuaguaggaaacaccaaaaaugggcgauuuaacaaaagaaaaaaaauaagacguauucauuuccucucuuuuuagagguguaagaauagcauaccugauacccaagauauaagauacaauuugcuaaacgcaugaaauucaagaagaacgaagaccaaaguguggacacuuugccccuucuuagaaaugggaacaaaacacccauggaaggaauuacagagacaaaauuuggagcugggacgaaaggauggaccaucuagugauugccauaugcagggauccaucccauaaucagccuccaaacccugacaccauugcauacacuagcaagauuuugcugaaaggacccgauauagcugucucuugugaggcuaugcagggaccuagcaaacacagaaauggaugcucauagucagcuauuggauggaucacagggcccccaauggaggagcuagagaaaguacccaaggagcuaaagggaucugcaauccuauagguggaacaacaauaugaacuaaccaguaccccggagcucuugucucuagcugcauauguaucaaaagauggccuagucggccaucacuggaaagagaggcccauuggacuugcaaacuuuauaugccccaguauaggggaacaccagggccaaaaagggggaguggguggguaggggauugggggggguggguaugggggacuuuugggauagcauugaaaauguaaaugaggaaaauaccuaauuuaaaaaaaaagacucuuaaaaaaaaaaaaaagaguagcauaccugguaggugacuucuuuccucacggaggcuaagaagccaggcucaguuggauaaagggcacuggcaaacauaaaguccugccacaccuguaggacaaaggaaaaggcgaggucaucggggucacugcacaaagcaagacuugguucucacuuaggggauuaucuuccaaauaaaggaaaagcaagcucagcaaaugcacccaccugagcaucucugcagaggaaaaacgcccacgcacggaagggucuuugagcguugcacaaaaauguuuagaaaaucgagagaauguuaaguaagcagggaugaggauccagaugcuuagcccaguguggcccugguggggacagggugacuuggugacaugguuccugccccugggacagggcccuggugugaaccuccaugagugucaauggcugcugugggcguaaggcuuguuuguauaauaaugcgcauauuucacauuccuccuaggaaugaccuccuguuaauauuaauaacuccauaaaaauuagaaauagcaggagucgaggauguggcugucucugcaaaaugguaacugcugggacccucaggacagcccuuaaggcuaugggaaagagcuauaaacacaugaauucaaaaauauauauaacuucucaacuaugcaaaauauaaggaugcaauaugaguuaugggggcuucgugaaucuaaagaaacaaaggcagcuacacuccgagccagcuugucagaaagacacaaaggcaggcggauuccugaguucaaggucagccuaggacagagggagguuaggcccaagugugguggaaauggucuuuuuagagcacggucccacccagcuagccuagccgcaguguuuaacaaagguacacagaucucugaauccuuuuguaaaguuaagggaaaaaaccguaugcuuccugucucuuaagaaucaaagagcuagggucacaagaugcugauucacaggauaaucaaaaggaaaccaggaguaaacgacuggacugguaugcaaaauaaaagccuggacuugugcucugcaggagaugagccauccagagaacuuuuuaggauaaaaagagagaacugcugggagaauacagacacacccgagcaagcaggacaagucagagagaucccuuagaauaacaagcagcacacaugucauccuuggacagcuuggauccaccaucugaccuugagucauucuuuuuugccgcuccuagucaccccuucgguuggaaccccucuccuagcugguccuuagcauccggaaaaggaaauaaugaggggggggggaaggaagcucugugggucuucccucauuccgaugaccuucucauuucgccaggcauuuaguaauaaggaauacacuagacuguuaacucuauaguauguuuagaaauagaugcccacguuaauaaagagacugagaaguccuuucccaggaggccuguguggggcagcugagcagagcccagcccccagcagccugccuucaugcccagauucuacaguacacagauagugaacaacagggcgaggcguaggugcucuucccgggucaguuuaacucucuguaaaugcggacagagaacaagaguagccaugugaaggcuugaacaacaacaacaaauguauagcuccgagaaaaaaugccugacauucaaugaacaguacagaauguaguagucauuaccaugacgggaccucauuguugcugugaucccaacucucuacuggcucuguauuccuagaacuaaaaauaauauaugaucgccucuccaaauccaugaguuuaacaucugaagauucaacuaugggucaaaaauauccacaaaagaagacaaaaaacaaaaacaaaaaucacagagagagagagagagagagagagagagagagagagagagaggcauacacacauguaugcacgagcacacaagauauagaggauauaauauagacugaacacauacagauucuuuuucauaaggcuggaaagauggcucagggguuauuaaguaaggucacuugcuacucucacaagccccagcuccugcaugcugguuuacacccaacuuuaacuccagggcaaggagaucuggugcccucaccuagccuccacgggcacuaggcaugcgcgugccacacacacccauguagauauucauacuuacaguauguguguccagauguguguauugcauguguguguauguguguguguguuuaauguaucauggcauguaucagugguauaugaaguaugguaugugguucaauaauaacagaaagcacauagaaggauguggguagguuugugcaaacauucuguuucuuuuuuugugagggcaucaagcgucuagaaagcacaugcccacaggcuucguccuucucauagcaaaacuuguacucuaagaacaucuuuucuuugguuaacuuuauuauuuuuguuucucuccaaaguucaccagugcuccuuaaguuacuuaauaauguauuuuauuacauaugccuacacaucagagagaaaacuaugaagaaaguguauauagacauuugauuagcuauaacccaccuauaauggcuauacuuuuaaagugguaaagaauucuguuuucuguuagcaacuauagcucauuuacuccuuggccaaaauuaauaaauaaguagacaauggaacaugacucccugcucugagagaggugaugaagggguaauaauaucaacccagaacaucggccugacgacgagucaccugugguauaccgagacugcaucauguacucaccauuaucccaaguucaucacagagcgcauagaacucauccugcucguagaugccacccccccacacgcgcagaguguucauguucgcauccacgacggacuggaaaaggagcugcagccugcagaaggaguugcaagagcaaaugcuaagucagaaguuugggaauaggacaaaacuuuucaaaucaguuaagggaaugaaugaaugaaugaaugaaugaacgaacgaacgaacgaacaaacaaacaaacaaacaaacaaacaaauaaauaaauaagagcaaaaugauuuugcuccaaucaacaccaaagaaacagauaaaauaacaaaagagacucguaacaacaacaaacugaaaaaucucgaaugauuuccucauuauguaaauuguccacaaccuuaaacuauuucuugaaguacuuuuugcuuuauauuuuugaccuguaggaaaguguagcacacugccagggaaauggcuuagaaaguauuugaaaauguggcauguguaggcacgugccuuuaguugcagccuaugcguaugggcacauaacugcugcccaucaguaagcccagguucagggagagacccugucucagaagguaggguggaaaggaauugcguaagacaccaauauaauagacaaccuucagcccucacaugugcgcgcaugccacuaaacauguaaacacagacacaaaaaaaaaaaagaaagaaggaaaauacaggguaaacacgccauauauaugaacggacauuaauuucuaaauucuaauuucaaggccuucuaagaacauguguagucaucuuccagauaaagaacuuccauggcuguguuuugcuuuauacguuuucuuguguguguauuuacaguacauggcacagcauugugggagagcugcugaugguagaaaggucacuauuggaguggauuagcagagccacauucugaauuaucuaucucccuuugguuuugugcauaggaaauuguuauuacccagaacucucaaguccucacggugucccucagaucuccagaguugcucuccagacauaaugacuauucugugugcucuuauaugcuuacauaucccucucccaccaagacguguucuuuuaguuccuuggugaaguuuaagaaaggaggggagagcuggugagauggcugagugggaaguguuugcugcacaaacuugaaccugaguucaaaucuccaacccucacacaaagcuggguauucuagcgcccaacuguaauuccagggcuccuagggcaagaugaguggugguaacagaaucccuacaugcuccugggccagacagccugaacaacaaagggacccagucucagguaggaugggugguaaggauugacacccaaggcagaccucuaugcugcauaguuuucugucaacuugacccaggcuaaaguuaucagagaggagagagccgcaauuaagaaaaugccauuagaagaugggaggucuguggggcauuuucuuaauuagugguugauauagaaaggcccagcccacuguggguggugccaucccugagauggggguccugggugcuaaaaggaagcaaguugagcaagccguggagagcaauccagaaagcagcgcuccuccauggucucugccucagccccugccuccagguuccugcccugcuugaguuccugcccugacuucagugaugaacagugaugugaaaggauaagccaaggaaacucucuccuccccauuuugcuuuuggucauggugcuuugucauagcuccacaggccacguggcauacaugugauucuauauacagacauaugaacaaggacaugugcacgcaaacaaacacacacacauaucauauacaaaaaagaagauuaagugaaauaauauuuuaaauaauaaauauuuaauaauauuuuuaaaucuuuaauaggauauuuuaaguaaaauaguacuuaaauuaaaaaaaaaacaaauguagacccucgucccuuaaauaugcucagaaauauuuaauguauuucuugaagaacaacaacaagcuggauuuaaauuuuuucugagacuaauuagucuagcuaucaaugugucacuucuuuuuuuuuucuccagagaaaacauauaaugguuuucuaaaagguggauagcauaucuuuaacagucacaaacuaguuaucuguaagacuguaucuuaagagaaagaaugaccgauuaaacaugaucuuguccauccugaaauuccugucaugcuauuaagcuauacgagccuccaguccuucugcugggauuaaaaaaaaugauaugagucacuuggccuuugagcuugguggcauugcagagagaugggggagugacagggaaagaagcccauacucaccgaucggaagugacuuugucuuggaaggagucggcuggaauccaauuugagccuuucagaaauauaggaagcccauuaauuuugaaguagaaacucagaccaggagacccuuuuaugcccucuucuaucaguugcacuguccugaaauaaaccugccaugaaaagaaauaaacaucgaauggaaacuggaaggcguaagcaaacuguuuuuuugcacagggaaguagggaugugggaagacggcucacaagcaugagaaccccaguucagauccccagcgcccagcuagaugugaccauucccuucuguggucccagugaugagagggguggagacgggggaucucuggggcugcugaccagccaaccuagcugcagaagcagugagcuccagguucuaugagugauucugucucacgagaacaaaguauauaacaacagaggaacucaccugacauccucccuugaccucaauauaugcaacuaucugcacacaucuguaugcacacacacacacacacacacacacacacacacacacacacacacacuaguguacaaacacaccauauguacauacaaaaucucuaaaaggggaaguuuauuuauuuaaaagagauguucucuuccucucucccuuucucccucucccuccucccccaucucuguuugugaguguguguguguguguguguguguguguguguguguguguguaugugugcacucuugagcagugcccucacagccagagcaagagagaagcagaaagaagcauaaguccuucuaagcuauccuugcuacacuggaagcugacacuuccuggauuacucuauccaggcugauacuugauccacaggaaauccugggcaacaagaauaucucuuuucaucaaaaucugcuuccuuggcacaccaagauggcgcaguggguaaaggcacuugucugccagccugaagacccgacuuugaaccuggggccucacaucacagaaagagaaaacugagucccacaaguuguccucugaccuacauacgaauucacacacacacacacacacacacaugaaauaaacguaacuuaaaaaaauacuucacucuugccagccauacgaagaucaaggauugaauggcauggccuaugcuaauaaaccuuuaucuugagccagaaugaaacacuucucaauuuuuaaaaauaauaaauuaguuaccuaucucaugcaagggaaggagcuagcaugcuuccauguucucccccuuccgugccuuuguauugauauaagaaagggcacuggagcugacaucauagaaggacagaacgccuggaugaggacagucagacauugccacaaaagcugucgaggugaagaggucgcuugacauuuuuuguaauuaauuaauuuuauuuuauguguaugauuguuuugcuugcauguauguaugugugugugccaugugugugccuggugcccauggaguucagaacagggcaucagaucccuggaacgggaauuaugaaugguugaaaaccacccugugggugcuaggaauggaacguggucuucugcaagaacacucagugcuucucaccacugccccgucucuccagcccccacaggguacuuuaugaugaaaccuaggacaaaggcaucuuaaggugccaaacuguuguccaaguaaaacugacacaauugccuccuccucucucacucccuggaaagauagugggacuuuccagagacaggugacuaggaugaugccaucaaugacagguaauagauacuggcugcauacucugagugaucuauuucuaagguagauguuggaaguauaaaaaaugguuuuguuguuauugcuggugauuuuuguuuguuuauuuuguuguuguuuuucuaucugguugguugguuuuuuuaggacaaggucucacuaugaagcucuggcuagccuagaacucacucuguagaccaggcugaccucaaauucauggagagccaccaacuccuugugaguacugggaguaaaggcaugauccaccacuccugggugaaaaagcagguauaaauagauuaauuuaggcagggucugguggcacgugcucugagaagcagaggaaggcagaugucucugaguuuaaggccagcuaggccuacauagugaguucuagaccagccagagcugcguaaugaaaauuguuucaaaaagaaauaauaacaaaagauuaauuuacaggcugggagugguguuguacaccuggaaccccagaccucaggaggcagagauaggaggaaagagaauucaagaccagccuggaauacacagugagaccucaugucaaaaaaacaaaagagagacuuaguuuguucucuauagcuuuccugagaaccuacuggcuaucaguggccaucuguucugaauucuguaaccuuucuauugcucaauacauccuuauuuugagacuuaauguuuucccagcaaccuaaacaaaacuauaaagacuaaguuguauucauuauaaucaaaacucacuuuagaguuuaauaauauuuuggcucacucauuuauaacauuuuuucuuacucuaaagaugaauugcaaaaaugugaucagaaggcuuaaauucucaggcucuggcuaugauuccauuggaagccugccuuccuggcacgcagaaagcccugaguuggauuccuguguauccuaacgcuaggcaugguggcacauaucuaugauuccagaacucaggagcuggaggcauugggaacaaagguuaaaggucaucccucuauauaccaaguuugagaccagacuggguuacaagcaacggggucuaaugaacagaacauuucgacucucagugcggaaacuugaaacugacagauaagagaaacuggguguaauuauaaacaagaaauggaauuuugauaaaaggcaucuuucccuugacuuuucagaagucaauaauuuauuauaccuaaugcaaguguaacaucuuuuaaaaaauauuuauggguuauuccuccuuugggaguucuuucucacuuuugcuuuauaaaucuuuucaguuuaaaaguaaauaaguagauagacagguagguagaugauagauagauaagagagauggauggauagauaagauagauggauagguagauagacaguaauuaugggaucuggggagguuaugugcuugucaugccaucaugaaguucugaaauugaaucccaagcaucuauguacagaauaugaauauggcagugcacccccacaaucccagcaugucagcaugugccuguaauccuagaauuggcaaaguagagacaggagcaucccuggggcuggcugguccccaauucacugagcucaagguuuagugagagacuuugaaagauaucaaugaugaaagacaccuuuuaacaaccucuggccucuacacacaugaauauauguaugcaguggcacacacacacacacacacacacacacacacacacaagcauguauucagauauacaccacacauacacaaaaguguuaugguacagucgugucauucuacagcuaguuauucauggaauaaagcaguagaaaucagauauuuaaaacauagaaauaggaagcucuuaaaaagccaaggauugguuaaccuuuaccaaccaaaaaccaagacugcaucaaaguuuuuacaggguggacaugcuacacuggcugcagacguguauauauuaguugagaaagaaacaagcagccagcacugcugugugccuacaggaagaaacaauagugaaggaaaucgcagccccugccucucagcaaugacagagcaaccagcucauuaaaagauucagcugcaagagacauaauggguggccacguagucugaagauacuagguuucagaaaugggucugucucuggguguuaauagaccugucuuuuguuauauucccuuguuguaggauuaacacauuaaagauaaucaacuauaaaaauuguuggcaccaaaaaguaagaaguauugaacuauucaaaguauaagaugacgugugacccuugggguaaccuauccauucugggcuaacaucugcacagauguuacaagaacagacacggguggcauugagcugccuuaguaggaaucgcggcagcaccccuaaacugccccguuuaccaucacccgauaacaagaaaaauuaucaauuucacaugagaaaguccuugacaaaacaggaaauguauuaauuuuauaaacccuguguugauuugaaugagaacgucccacauaggcucauguuugaaggcuuggucccucaaugguagaaauguuuggaaaggguuucaaaagccuaggcuaaucuaucuaacuaucuaucuaucuaucuaucuaucuaucuaucuaucucugucccucucuaacucuuaucucucuccaacuuucuuuuuuuuuuuuuuuaaagaugggccacuuuuuauuuguuuguuuugcuuugcuuuguuuuucgagacaggguuucucuguauagccuugccuguccuggaacucacucauuagaccaggcugaccucgaacucagaaaucugccugccucugcuucccaagugcuggguuuaaaggcgugcgccacuacuguccggcccacuuuuuuuuuuuuaaauguaaguuuuuuguuauauguaaguacacuguagcugucuucagacaccccagaagagggcaccagaucucauuacugauggucaugagccaccaugugguugcugggauuagaacucaggaccuucagaagagcagucagugcucuuaaccacugagccaucucuccagcccucucuccaacuuucaaauaaguuguaagcuccaggcacuguuccagccucaggccagccugccuguugcccuauauacccugacagucaugcacuaacccucugaaacuguaagaaagcucccaguuaaaugcuuucuuuuacaaguugcauuguccuggugucucuccacaacaacagaaaagcaacuaagacaaaccccgaggccgaguuuguaucauuucaauauucgugagacaaaauggagaacagacacagaacaccgugccaacaauguccugagaggagagcagccgagcuaccaucucagcagugagcgaguuaaccuucuagcucagggagucccacauuuauuuaacugagcaguggaccaacaaccacagccacucagcuuugaggcaucuucuuaaaagugaacgcagaauacauugucaauuucuaaggccaauaauaaaauucaacagaaaaagcaaggcuugagccgggugugguggugcacgccuuuaaucucagcacucgggaggcagaggcaggcggauuucugaguucaaggccagccuggucuacaaagugaguuccaggacagccagggcuauacagagaaacccugugucgaaaaaccaaaaaaagagaaaaaaagaaaaaaaaaagaaaacucgaccaguauugggcaugcaagcuguuuuauuaaguacagguacaggugauuacaaccaaucuuuauauauauguauauauauagguuuauauauauguauauauauauauaccuaccaccuugagcuuaaaagcauccaauacuuaacagacaucucagaugacauccguggaaaaaccaagcauguaaaugugcuaccaaggguggaaauguuucagcuuugggaagauucauaacccucagggaagcuuuucaaacagcccaugugguauaguccuguuucacacauggggagacuccauuguaaguguaggucagggaggguucuaacaacagaaucaagaggacauugaaaugccuuuaauucacaguccaacuaacuuuaagaaacucacucuuugugguuuuacuuuuuaagugcuugguuuuuuuaaauuguuaauuauguguauggguauguucuguguggggguacgcauaaguacguggaagcauccaaaggggcgagcugaggucaucagauccucugacgcuagccauagggugcuggacgccaaaccagggucccauuuccuauccccaggaaccagcaguuguuaaacucgaguacaauaccuacaacuaucugaaaagacucuucaugucgucucucccuuuccagcuaaauaugaaugauauauaaaaugcauauuaucuuugugaggucagagugcuguuccaaaacaacacugcaaacugauuacaugcagaggcacugagaaccccauccuccuaguuaaaauauuagagauuugugagcaugaaagaugauguuauucacccccaauauuuuauucccuaacaauaucuuuuuugaaaaggagucacuggaccuucagaaguuuauaccacgaacuucugaugaauaaguaaauuaucuaagucucagcuucaauacuuaacaugcuaaacuauggaccacagaaacauacacauagcaugauguuuaauauuuuuugaagguaaaaaguaguucuaugucaaaaauaaauuugagaaugacuuauguaggggaaaugaauuauuucuuacuaucuauuaauauuacaaauaauauuaauuauaaaacaugauaguaucucuacugauccccuaaccauuccagcaagaacaaaaggaugccuuaaaguacccaagaaccuuugaggaagaaguucucaaccuguggggcgagaccccuuugggggucaaaugaccuugucacagggaucgcuuaaaaccaucagaaaauagauauuuacaggagcaaaauuacaguuaugaaaugauguuauggauggggggucaccacaacaugagggacuguguuaaaggucacagcauugggaagguugagaaccuggaggaagccgcaguuuccagccaccuuguucuggcacuuggucaucuuaaaggccagugcucucaggaugaaugucacuguccuccuguccccuggcagccuugacugauagcacaaaagccuucugcaacagguauuuuauuucccgggauacaauggccuuugaauagcuuuugaaaaaagaucccugagcaauacauauuugcauucagagugaucuaucaucgcugaugggacaaaagaacuuuaaacagcccaaagaaguaaaugcuauggggggggggcgguauaaauauauuuuaaaaaugaagagggcugcagagauggcucagagguuaagagcacugacugcucuuccagggguccugaguucaauucccagcaaccacaugauggcucacaaccaucuguagugaggucccaugcccucaucuugugugucugaggacagugacaguguguucauauacauaaaauaaauaagucuuuuuuuaaaaaaaaaugaagaaauguaaaaucaagcaguuuagauuuuuaaaugauuuaugguuuuuuuuuauuuuauuuuggggcaguggguggggggcauugugugaguggcaguaaaagccagcagagggcaucugacccccuggaagagcaguuacagggcuuaugagcugcccagugugggugcugggaaccaaacucagguccucuagcagcaagcacuucuuagccacugagccaagccccaauuuuaaaaucacauuuaaaucaaaauuuagcauuccaauuuuucaaucucuucuugguucuauaaacucaucacuugauuagauguuuuguuuuguuuuguuuuguuuuguuuuguuuuguuuucugagacaggguuucucugugcaguccuggccggccuugaacucagaaauccaccugccucugccucccaagugcugggauuacaggcaagccccaccacugccuggccagauuuuuuuuuuaacugcuucauacagcuguuaaauucaacucauaaaaauuguuuuuauuuugcucuguuuuuucuuuugaggcaagguaucacaaagccccaggcuagccuugaccucacuguguagccaaggcucaccuugaucuccucuugaucccccugccucagccuuccuuccaagugcugggaugacagguauggaccguuauggcagcuauggcuucauuguuaaaacagaaaugcuagauucaaaugugcaguccucaaugcuguccuccagauggggcucuggauacugagaccaaaggccagaagagcucaugacugauaagcaaauaccacacgccucacauuccucucucuugcugaucagacagacagagugacucacaagccuggagccacuucucagguguguauaagcagauauuuacgaagauguccggaauuuucuuuucuuuucuuuuuucuuuuuuuuuuuuuuuuuuuuugguuuucgagacaggguuucucuguagucuuggcuguccuggaacucacuuuguagaccaggcuggccucgaacucagaaauccgccugccucugccucccaagugcugggauuaaaggcgugugccaccaccgcccggcuggaauuugauuaacaacaaaacugcucguuucuaaacuucaucaaaccuugugcuuuccaaacuucuuccagaccuaccacucugagcuuuagagauaaagaccaugugguuugcacugaaaaaggaccauagugugagggcacgggguggggguggggggugaggggggugccuggucuccacaaauaacuccagccuguaaaaaaugauagguggccuucccuucauugcccccuugcuaagcacacagauggaagccaccagguuggcauucacacaccugcagaguugucugaucacguuuuagccagauguguauugaaugcaucugaugucaaacaaccauuccgacgacgccucccuuuuuuuuuaaugugacaaaaucagacucgguuguaauaauaaaauggcauaaaugauguggccaacaugacaugcagauaguaacaucaaucucugauuggccuuuguuugaauaguuucaccauuuuuuguuuuguuuuguuuuguuuuuguuuuucgagacaggguuucucuguauagcccuggcuguccuggaccucacuuuguagaccaggcugaccgcgaacucagaaaucugccugccucugccucccaagugcugggauuaaaggcaugcgccaccacgcccagccacacccuuucauuuuguuuggggugaagcaauaauaagggcuacuuacuagaacaucaaugaagggcuacaggagcaaggccaacuggagaaaaugugcccccgccaccagcuccagaaccaucaccuauaauaggccccguggcaugguggcuggagcagagagcugagagcucauaucuuuuauuccaaacaggaaacagagagggaacuggaaauggcaggagucugugaaagcucgccuccagugaccaagagccgccaccaccagccucccagaaaagugcuaccagccggagaacuaguguuuaaaacaagagccugggaggauauuugagacucaaaccauaguauugaucuuuggacauauauauauauguguguguguguguguguguguguguguguguguguguguguguaaagaauaccagguuugccaaucgaccacaccauagccaaaagcaaaaacucauugguuagucuuagggauguucucaugugacaucaaagagauggggauaucuuaaacacaacgguaaguucguuagacaucccuggcuuucuuucuuuuugauacauuucagcaacuugcuaaaauugcuugccccugauauuaaaauaaacaaauaaguucccaaguauuucuucuacaaaaucagagaagcacugagugagagagagagagagagagagagagagagagagagaaaugauuuuccacuucaccgauucagaacaggugucuaguuccuggugcaaugcagggugcucuguaauccuagcuggaccucaacccagcugcacugaguguuauagcucagcacacacuuccccacaccgacucugcucucacaaacgaauaucuauuuccuuccauguuauuguuacauaguaaguuguuucuaccaaauucccugugcaccauuaccaaagacucggcuuaaaccuugaugguccaagacaauguauaauuaccaaauauacucuaccugauggcccacaccuaaaagaacaagaaaaagauaauuccaaaaagaacaguucacgcagaccagugcaaaaucaucugaacugaacugcaauguguauauauuuuuuuaauccaugucaaaguucagaguaaguucucaggcugugucccucuucugccccagguccacaguaaacaucucacuuagggaggaacuucuggacuuuauagaauuuucccacugaugaguuaagguuaaaaagaaugaaguguuuccaaaguucugacagguucacaucugaagaaaugcucccaaaagagcaaguuccaugagguucacaggacgagcuucaggcagccaaggucaguuugggaguugauagcuuugaccucugccugaccuccacagggauugguggucuugcuagcauuuucaucuuggccaauggcagggaauuaagaaacaugggaugcaguugcuugaagauaccugccucugccuccccaucauuuggaccacagacaugggucacugcacccagcuuuuaugugagugcugccgaccaaaggcagggccucaugcuugccugucaagcacacugagccaucgcccagccccuucacuuauuccuaaccacaucucaaaaugaaagaacaugauacgaaggcaacaacuaaagacaccaguuguguucaaagcaagcucacacacagugacugcuauaaaaggaaugaucuggggcuggagagacagcucagcggcuaagcacuccuccgcucuuguagaggacuuggguugauuccuagcacccaugcguggcucacaaccauuccuaacucuaggaccaggggacacaaugcccucuucugacccccuccagcaaauaucuccacacagcaccaacacucacaaauaaaauaaagcaaacaaaucuaauuuuaaaagcuuuuuuuaaaaaacauaugaaaagggguaaucaugagacuagggauacuauaccacugugguucucuaaacaaacguacauauauaacaaauauuuauuaaaggaggaauaagaaagagucagauccaguucuccacacauauucaagagugauggggcuggugagauggcucaauggguaagagcacugacugcucuuccaaagguucccagcaaccacaugguggcucacaaccacccauaaugagaucugaugcccucuucuggugcaucugaaaacagcuacaguguacucauuuauaauaauaaauaaaucuuuaaaaaaaaaaagagugaucaccccacauacaaaacaaacaaacaaaaaaacuuagcagcccaacaacagauguaggagaaacaguauuuaucacuggcauuuucuagaacucccaaaacgugguaauaauuaaaauuugaugacaaagcaagccucacacacuuaaugcaugugcuuggguggacugcucucccaggacgcugaggaagccaccgacagcagccuguuugucaaucuuuaaguuuuugacaaugagacugaagggagguggagugacuuaaacauuguguuccccaaaggucaggucuaccucaaaccccaaaaugggaccuuauuugaaaauaaugcuuuaaagacaucaaucauugaguuugaaugaggucauaucaagcucuaacccaacagauaagaaggugggcaugggggcuaggaagacggcucacaacuuaaccgcaggaaagcaguuaagagcacugacugcucuuccagagguccugaguucaauucccagcaaccacaugguggcucacaaccaucuguaaugggaucucaugcccucuucuggggugucugaagacagcaacaguauaaucaaagaaagaaagaaagaaagaaagaaagaaagaaagaaagaaagaaagaaagaaagaaagaaagaaagaaagaaagaaagaaaggugacuugugcugugauuccagcauuugggaggcagaaaauuaauaccccagacaacacugcauagccuucauucuucugaauuccacgcugucugccugggugcuagugaggucuucagagagaucugagcagcacucagaaaugauguaaguuucagaccagccugggccacauagugagaccuugucucaaaaacacacaaacuucagaagaaagagaaaugugguggguaggguugggaggggaaagagcuauacggugaaggggacagaaacuggagucaggcaccuacagaguaaagcaaaggaggguuucaggcagugagggggaagaggcaaggaagggccuucgacaagucuguagggaagccuagcuccagaugcaccuuggcugggauuugcagcauccgccgcugugagagaagacgcucucacuguuucgagcaacccaguuuaucagaauuugcucugacaacacuggggaaauuaauacacuggaaaacacagcauagccucggggacugugugugaaaauacaccuucauuauucugaauuccacacugucugccugggagcugguggggucuucagggaauugugagcagcccucagaaagaaagagcgagaauuccaugggugucacauucccuuucugcccuaggaaacugcaaagaugaaaauggggauuuaaaacucaaagaaaggacuggaguguauuuuacauaaaacugaagaagucccaaucgcuuuucuaauuagaacagcuauuggcaaucuucugccucuggcuugggaauaggagacacaaguucuaguuggcugcuuacauugucuuaccgccuuucgaaaauaauuuauuuuagcugaacaaucuugacaccagagacaauacagagagccuucagcaagauuaguuauucugcaugaagagaugcguuaaagagaaauggcaaugaagugacuuucuaucccaaaaaagcaagcuaugaucaucauucagaaauagucggugagccaggcagugguggcgcacgccuuuaaucccagcacucgggaggcagaggcaggcggauuucugaguucgaggccagccuggucuacaaagugaguuccaggacagccagagcuauacagagaaacccugucuugaaaaacaaaaacaaaaacagaaacaacaacaaagaaacaacaacaaaaccaaccaaacaacaacaaaaacagucagugggucagugagccagcuuagcagaucaaggugccuacuacacacagcugauggccaagucuggcuccccaggaccccaguguugggagaagagaaccaacuccaccgcacuggccugugagcaccacacaugagcuaaaguaaaccuuucugucucuuacucuuucucgcagguccuuuagucacagaaauguagaaguagcgcccccucccccaccaaccauuaugcaaacucugguucccaguucaucaauacauccagguauuugcucagaugccaauauguggacaaucuccugauccacagguggucacuauuacacugugguaaagucggacccggcagugguaguaguugccauagccaucaucuuaacugcagucacggcuagaagaacucuggcaguuugguuuccauucugguccaagcagccagugaccuccucacggccaacccucaggacccuucucagugucucuccaucaggagcaccucugcaauggcugaugcuugugagcacugucugcuccuagaguacccuuccucgggcuccgcacaccucuaccaagugacucuacuucuggccauuccuuguguagauuuaucuacagacuuuucucuuccacauccuuauuuauuauaauuccucaggguucuguccucuuugugucuuccccuagcacaccuacaauuaucaauauuuugcugauuuccauguuccuaauccaguucaaaugcuuauguaguucuguuucuguguuuccuuuacagauugggggagaggucauacuagauagcccaggcuggccucaaacucugaccccuuugccucagccucucaagggcugagaugacagacaucugccaccaugccuggcuugcuuccaaaguucucuauuucucuagcaugcucaucaaccauuauuauaagugcuugcuugcuucaugaagucaccucccaaccaaauuauuagcauuaccaaggccucagaaagaaaugagcauagcguauaaucaugaacauagcagccaaaacacaauagcaccccaagaggcaacugaaugaauaagcacccacaaucacgugcuccacagaagccaccgagagaggguacacgccacgucuacacaugagggagcgacaugucaucgcucuccucaaaggcuggccucuucaugcagaguaaacaacaguacagccacagugagucuaagugaaaagaaacgguguaccacaaacagaagcucuuuugcucugcagugagcuugggugacucaugacuucucacauuuuuaugaagaccacacucaauaagccagcaugugggagaacgcauccccacugccaagagggugaggggaaaaaaaguccaagagucguccucaaacaugcuguguaugugugcacacacacaaacaugcuuccucuuguagaaauggguagcacaguuaaacaaaaggagcaaagggugugucccacacucaggaugccaccugggcaagaggagaggugagaccuguugugagaggugacaccacagggcgcccucuaucaaccacagacaccgaagguccaggucaggggaaggaaaacuguaggaaaggauugguaucacugugacauauacacuguggcugugauaggcuagaaucgaguuaugccauuccaauggccccuucuuaacauaaagaaauggcacuggaaggggugacuuaacccauagagcuaagaaguaagaaagggcagcucuuugcacuucuauuuuuuuuuuuuuuuuuugguuuuguuuuuuuuuuuuuuuuuuuuuuuuuugagacaggguuucucuguguagcccuagcugucauggaacucacuuuguagaccaggcuggccuugaacucagaaauccgccugccucugccucccaagugcugggauuaaaggcgugcaccgccaccaccaugugccaccaccgccuggcuagcucuuugcacuucuaagugcucaaucccaaagugggcaggagcgaagaauuauaacgcaaucaggagaagugugucaauuuggaaaguggagacaaauggcugaagaaguaagcagaaguuauuuugggggacuagaaagauggcucagagguuaagagaacugucugcucuuccagagguccugaguucaaaucccagcaaccacaugguggcucacaaccaucuguaaugagaugugacacccucuucuggugugucugaagacagcuacaguguacuuacauauaauaaauaauuaauaagucuuuuuuaaaaaauaaaaaaauaaagaagauauuuuuguuguugcugcccugauaaguaaaaugagaaagggcagggcaggguuccuucugaucauaggaccuuccagcaguauguacacuuuacaauuacauagcuaugauguaagagcacauggaagaaggccaaggcuuuggcguucagggcgagacguggucugaggcccuggcucaaacccuagcacuaagaaagaaggaaaacgaguuggaggcaggcgcucgcugaggcaagaggagggcacucggcccuuagcccacagagaccggcccgcgcgcgcgaccccacacccacccacucguccaccuacccacuccccgcgccgccuccucccacccugagaagagccaccgaggaugauaaacacccaggacaguaguauuuugccguugaguaacuguacccagcuccagugcugcaaggcacaugguuccagggccucuguggugcuccugaugccccucacccacugucgaagauccccggugggcgagggggcggcagggauccuucucucucagcucuaauauauaaggacgagaagcucacuguaacccaggaccuccccgugaacgaugggaaaccucacaucguccacuuccaguaugaggucacccaggugaaggucucuuccugggaugcaguccuguccagcgagagccuguuuguagaaaucccagauggauuauuagcugaugggagcaaagaaggauuauuaacacugcuagaguuugcugaggagaagaugaaagugaacuacgucuucaucugcuucaggaagagccgggaagacagagcuccacuccugaagacguucagcuucuugggcuuugagauugugcguccaggucaucccuguguccccucucggccagaugugauguuuaugguuuacccccuggaccagaacuugucugaugaggacuaauggucacagaggaugcuuugccuaagagccacagugggagaagaggggauguuaggcagccuugggacagaggagagggucucuggcugucuagggaaggacauugaggggcucagguugaggguugcccauuguguucucggaguugacucguugaaauuguuuuccauaaagaacaguauaagcauauuauucacauguaaucaccaauaguaaaugaagauguuuaugaacuggcauuagaagcuuuuuaaacugcgcugugaugugcuccaucuacccuaggggaggacauugccugcaggggcgggacugccgggcccaggacaggccuggagggcuggugggcaggacugucaggcucaggucuccuuggaguugggcuuucuucuuuugguuuugaagacuuagguauuuucuuucuuugcuucuugucauccaggggcuccugaguauaggcuuuagcuccugggcaguguccuuggguugucuucaacacuccaccuugagcuucuggcauuuugugucuggccugguguaagcaggucugaccuugcuuucuuuacaguuuaguguuauucuggcauuugguuaagcuggcuuaaucuguuuaauguuaccagugcauuuuaaauagggacauugaaacucacucccccacaccagggcuuuuuggggggugccugggccuuaagaaacuagccaaacuacaucucaaguuaccaccagagcucuugccucuguggccuaggccccaggaucucuuuccuugcaagagcagagaggaagaauaccaaacucagggccugggguuugugggggagccuguucuuagcgccuggaugccucuggcuggccaagcacaguacugccugccuccuuaacagauucagaacagugccugcgcugcagagcugagagguagggcuggacugcagaaauggccugccuuuuacugcuuucaccaaacagcuuguucuaaagagaaaagggagagagaucuacacugggugugggggugucagggaggcaaguguguguuguguuacugugucaauaaacugauuuaaaguuguaaaaaaaaaaaaaagaaaagaaaagaaagaaagaaggaaaacacagagagggugugaagcacaagaagcuauggccaaaauagaagccugaugcauuuaggaacccacaaugacacacccggaaacuuugaccgcuauucauuacuguaggugguagaaucguaaauguucuuaauuacuacuucucuuucaaaugucaauguagcuauguuaucaaggaauaaucuccuuuuucacaaaauaguuuauucacucaccuuggcugcuuucucaauuuuuaagccuccauccagagcaaagagaauugucauguuguacccagucugguucccauguccacgaggccaccaggucuccacagcaacguccuuuuaagaaauaagucauucuaaguaauguucagacacauguuaagaaaaacagugcgaccuggagcuuuauaugaaauucucaacgcugaagcacaaacuguguccugaaagccguacgagucucgcacccacacuaugccaaagcuuagccacagaaucgcugcuuuaaaaauguauauauucauuuguuugcuuauuuuaagucagggucuccuguagcccagguugacuucaaacucuuuguguggcagaggacaaccauaaacuucugguccuccugccuccaccuccagaauccuagggcuacaguuauguggugccgggcaucaaacucaggaccucaugcauacuagggaaggacucuacugacugcgcucucuucccagccccuccacugauauauuuaaagcaagaugcugggagcauagcagauuuccacagcagaacaccacgcuguggaaacccagcuguugccugcucuaccucuccaggagugucuagucucuagucucuacaguuggacuuggacguugacuguugcucuaagcccaagacagagcucuuauggaggagucuugcuuccuucuaaguugcugucagucuccaguucaucaucacuaaccagguucauaaaacaacgaaagcuaaaaccugccccacccaccuaaccaugagggaaccucaguccagguucaguccagguuuagagcuuuacagaaggaauaaaugccaauacucagagcaagcgaaaagaacggaagggauccacgcugaacccugaaacguagaaccaguuagaggcuagggcacugugaguaacagggaaaaaaaccaaagacguaccugacuccuuagaagacaaacuggcaaauuaaccacauauuuuccauuauauuaaucucacaugugaaaaaaacaaccauugguuaauacacagaauauaugaaaaguuaaaaauaaaggcaaaaaugccguguguggugguacacaccuguaaauaugaaauuucaucgcucaagagagccacaggcaagaugaagagcagccugagcgacaggcagcucuuggccagccugggcuacaauguaagacccuauaucaaacaaacaaacaaacaaacaaaaagaagccacccugggcugcauugugagcuuaauuuuguguuacagugugcaaucuugucuuuaaaaaauaaucuaaaugaaacucuuaaaaauaaaaaauagugagaaaacgacuuuuggaaaauacagggagaaaguugcuaggcacucccacuccgccauuucuucccuugaacagcaaaugcaugcaucuagcaccucccaggaagugaggucacucaccuuccuaauuuugaccaguaguuuaacaauccuuugcucuuguugaaguucaaugucguuugucugcuguguuuucaguugagggauggcuacugucaccugaccacuaacggacuucgagcuggcgacaucaaaagaagccucuauuucaauauuccaggccugagaagcguuaucuacagcacagaggaagaaaacaacaggcgcaucauucaugcacaccucagaagucgugcaaaaugagaacugagcaguggcuaagcagugagcaccacagcaggggcuggggggaggggcuaagcagugagggcgccccacagcaggggcuggggggaggggcuaagcagugagggcgccccacagcagggagcaggggagggauggggaggugggaaauggagacugcauggggaugacacauccggaggaaacgauccucguucgaaacaaccagaauugugcauuguauacagauuuguaguagcacauggaaaauuaagcaacucgggaguuugcaaaaccuuaaguagccagugacuuuuuauguuaucaccagaauaguguuuaaagcugucugcuguccucucucuuguguaccgcugggagcugugucuagagcacagcuucccaguggaucucuucgggaaucuacaagucaccagccccuucauaaccccacaaucuucaucucucucucucucucucucucucucucucucucucucucucucucgcaugcaagauaauuuugaaaguaguucugggaggcgagaacagaagggaagcaagcaucccagaauccuguacggcuccugccccucccaaccugacuaagccuggugcccucccucauucuuacacccuaggcccagauaagaaacuuuggacacuugaaggaacagguagguggacaggcaaggcuggccuucccucucugugaggucaaccuuggccugaagccgccuuccucacugguguccugugcccgugaaggaggggcugcagcuuauuuuagucuuaugaccucaaccaggaaggugauccagaggaaggcagacugugguuccaaacaaugacucaugcuaggguuuucccaaggcuggcucgugcacucucaugcagguucuugaaaggaaggagggaaggaaagagaagggaggaaagagaaggaaggaaggggaaggaaauagaagggaggggaggggaagaaaggggaggagagcggagcggagaggagaacucuugcaucuggcuuggauggaaaggcauaguaacacuaagcagacauaccuauccaaagggucgaagagucccuaguaugugggccacacauuugacugaaaaaaauucucuaaggaaaaguggagacuguagcuaagcggaagagugcuugcccugugcguguuugugugugugugugugugugugugugugugugugugugugugugugugugugugugaagcccuggguuucuccagcauggagguucaagaacuucuccauccauguacaggggucuagcuguacauagugaucccagcacucaggaggcagaggcacucagaucucugugaguugaaggccagccuggucuacagagagaaaggaguuccaggacagccagggcuacaagaagaaacccugccucaaaaaaaaaaaaaaaaaaaaagcaaaagcagggggguggggggggagggcagaaauucuccaaagauucccagcuuuuauauuguaauagaguccaugucucuaucaggauguggccugacaggaaagaaaaaagaguuagcucagcagguagaagaacugccacauaaccugcugaccuggggucuauccucagaccccacaugauaggagggaaucaauucucacagcugauuccccugacccacaaaugccugcgugcacacacgugugcacacaugugcgcacacacauccaucaaaugaaugaauaaaauguauuuuuuagagagagaaagagcuuuauucaucugacugugaaagaaaagaagcugucauaagggcuggagagauggcuguguuguuaagaguacugacuacuauucuagaggaccugguguggguccuagcacucacaucaaguggcucaagauuucuauaauuccaguucuaggaggcuggcuuucaugauacccacuugcacauguguugucuuagucaggguuucuauugcuggacaaaauaucaugacccagaagcaagcuggagaggaaaggguuuauucagcuuacacuucuacaccgaugcucaccaucaaaggaaaucaggacaggaauucacacagggcaggaacuuggggggcaggagcugaugcagaggccauggaggcaagugcugcuuacuggcuugcuucccuuggcuugcacagucugcuuucuuacaguaaccaggaccaccagcccagggauggcaccagccacaaggagcugggcccuccucccccuggaucucauggaggcguuuccucaagggaggcuccuuucucugugauaacuccagcucgugucaaguugacacacaaaaccagccaguacacgcaugauguacacagacuuaugcagacacacauauauaugcauuuuuaaaaaucuuaaagagagaaacagaagcuugaugauauggaccuuuaaucccagcacucacgaggcagaggcaggcaggucucugugaguucaauggcaaccugguauacuuggccuguacaugagcaucagauggggcugaugugauaaugggcaacauacuugccacccaagugugaggacccgaguuggaauuuucccggaguucugugaagcugggugcuguagaacaagucuguaaccucaccuuucagugagacugaagauggaggcgggaaacuccucagcagcucaaggcucgauauccugacguacaacccaacaaaauggagacuaacagaacggaaaaccaggacagacacccggggcugucuucuggccuccacgucugugccccagugagagaggguuuaagaaacaacaaggagcugggaacggucagguaggcaugggauggucugcaauccgugaccauugcuuguguaagaggagggugguucaucucaugggcagagaaggcuguucaaaggcagcuagcugccuggagugacuuucucccgauggcccccucacgggcagccucccgagcucugaccuccugaaucauuacuagaaaccgagaggccagagggaacugugguccugugcauuuaaagaagguggaggacaggucucugugaccucugaaucacggaaugugucaacuccaacacccugcauuuucccagacucccaucagaauuacaggacagaugcaagcagcugauuuucaggaagcugccagcuaaacuggccaggcaggcaggcucgcggcugacuaacacagcccugugaccugacucaacaaccagaacuccuugccaauuuagaggaaauccucaaaauuguacugaaagcaaaacaccucggggcagaauccacucaaaauaaggacaagggaggacacuggcauuuuaagggaaaaauaauucaaaagugaacaaaaaauagaaacuaagggaauagacagauaacaucaacaacugccaauaagacacucagcaggaccgacaaauucuugucugguuuuuuguucuuuuuguuuuuugggguuuuuuuuguuuuuuguuuuuucaagacaggguuucucuguguagcccuggcuguccuggaacucacucuguagaccaggcuggccucgaacucagaaauccaccugucucugccuccugagugcugggauuaaaggcaugcgccaccacgcccggcuccugucuguuuuuacauuucccaagugaagcuguuaguaaagggcagcuguacgcugggcaggccacagucaggcugagaggacagccuauuucuccacuccuaggcaggucaucuagaacgaaggaggagcccggggcugaggcaagcaucuguguguggacagggcaagaguggagagagccucuuaguugguggacauggcuuaaacacuaaacagagaccaacagcccugcucagcucagugaguccaaaggcaggcuggagagauggcucgcugggcgagcaaaaccaggaggaccugagcucaggcccuagcaccuaugucaaaagcuggcugugaguaaccccagugcuggggggcaggguggagacaggaggguggcuggagcuugcuggcucccugcauagcuccaguuucacugagagacaccaucucaaggaaauaggguagagaaugguaaaccaggagacucagagguccucucuggccucugcacagauauucauucauacaccguauacauacucacauaaaauacauuuagaaacaaauaaauauacauuaucaauaagacauuaagaaaaaaaaucagugugaaaggaaacugacaguggaaacugcucugacagagaguggugcuacccggcauggggugaggagggagcugggguaggguagcuggggugggaggcugucucaggugugagguggggggcggggggagggagcaugagugaaaggaaaucaaccuuucuuucuuucuuccuuccuuccuuccuuccuuccuuccuuucuuucuuucuuucuuucuuucuuucuuucuuucuuucuuucccucucucuuucuuucuuccuuucuuucuuuuugguuuuucgagacaggguuucucuguauagcccuggcuguccuggaacucacucgguaaaccaggcugggcucgaacucagaaauccgcuugccucugccucccaagugcugggauuaaaggcaugcaccauuccugccugacgccccuucuuuccuuccuuuccuguuggguucccucccuccccccaaaauaaauacuuuagcagguaucuaucuacaggccugguuuaugcuguaaguuuucaugacaaaccauuugcauguauuucagacuuuuauaaauuggcuauucugcauuauuuuaagaagauccugaagaauauacuuauauuucaaauuauaaacagacuuuuuguaauaaaaagaagacucaaaaauuuuuuuucaagaaaucgcaaaucuugacuuaccauauacuggcaaaaacgugagguaauccagaugagcaauguuauaggcuucgauucuaacaucuuuccagauucccugagaggggaaggaagggccccagucccagcugaaggaacacugugccuggaauuucaggggagaaaaggagaaguaggcaaaggauaagauauguguguacgaagacacuaugauacaugcuaaaugaaaaguuaguaaaagggggcaggagagauagcucagcggguaagagcacugacuguucuuccgaagguccugaguucaaaucccagcaaccacaugguggcucacaaccaucuguauugagaucugacacccucuucuggugugucugaagacaccuacaauguacuuauauauaauaauaauaaauaaaccuuuuaaauaaaaaaaaaagaaaaguuaguaaaaaaggcaagauucuaucuuuaaaauauuauauauacacgcguacagcaguuuacuaaugaugccauagcaaaacgcuagacuggaggggguggggcuucacccacugaaauguguuugcagauagauggcucccuuugucuuuccucgugcaccagccaaugggagccaaugccuccucaucccuuccacugcuguccacauuucuuuacucuaaacaccuugcuuaacuuagucaccuugaucaggacuccaaauccagucacaguuacauucuaaaacacuugaguagagggaguguugcaacuucaacguguaaguuuggggaacacaguucagccccuaacuaauuguguuugggugucaagcaugugugugugugugugugugugugugugugugugugugugcaugagcucagagucucccuucuggcguccgugcucucuugugcucaccaaccuugcgcaugugcuagauaaagagagccacuuccuaugaauagaauauggcagaggugaugucauuuccaaaauuagauuauagaagaagggccccuucugcuuggggcccugucccgugcucucucuuggccaagagaggagccagcugcuguguccuggagcagcgcugugggaggccugagugagagacuuggacaauagaucuaaaauuucucaacagccauggugagcucagagcucuugucagccccagucaggcugaggugauggcuugauuaaaacgccccgagcgacaggugcccaaccaaacuguacguaggcugagaaaugcagacuuaguuugcuguacauuauuauuacugucauuugcuauacagauggugauggcuauuaugauuauuauaaccaaaaaugcccacuuuagugccaugguuaaauuuaucaagaagaacagaaaaucuaguuaugccuuguuucacauucauucuucaaaaaccuacuaugucagagcacugcuauuuauuguuugcuuguuuguuuuguguuuugcuuuucaauugucacuaugaaaccaaggcuaccccuaguccugggcuuucaggacuacaagcaguggccaccacacccugcaaauguuuacucucucucucucucucucucucucucucucucucugaaguucuccaaaacacugcgaugccuaaccacuccuguauuaaacaugacaacucgaugaaugaguaggcucauugaaagauaaagauauuauuaacauguaaaaaaaaaaaaacuagccuuauucccuaccucauuaaguaugaacucaaaaguccucguuuaggaguaccaaauacaaaccgaugguggcauuugccuuuaauccuagcacucaagaggcagaaaugaaggucugcaaguucuaggccagucuggggcacauaaugaguuccaagauagccaagguuauacugaaaggaaaaaaaaaaaagaguaccaggugcacagagagagacagagacagagagaaagacgcagagagagagacagagagagagagagauacacauaaacccacaaacaaucacuucagacuucagacucugacuggaguagcuaucugagagacaugaucuugucugccaacuaccugucugagaaccaggacacuaaaaaaaaaaaaaaaaauccaauuaugaaguuacaaagguucagauucaacuaccaagaaaugauucucugacaaucaacuucucaaggaaacgggaggaaaagaaagaguaauggaauccaagugauagaaaaagaaagggaggggaccagcuaguuggggaggggaccagccagggccaggcuggggauccagugagacccguggggaagggaacacggagugcaaaccagaaagccacugguguacacacugccaaaaugaaaccuuugugugcuaaucugaaaguuuaacuuaaaacaaacaaacaaacaaaaaaaacccagaauuuuuuuaaagucccaucaaacagaaaauuuucuuuacuucuuaagaauaaaaaauuuuucaagauuaaaaaucuaugacacugugaguucagcuuugaaaaguugaguuggaaaagacgcccucugagcgaggggaugccaguguguguagggggaggggggcggcaauguggguguguguacaggggauguggguguguguacaggggauguggguguguguacuggggauccagccgcacugcucucacccaagaauggcuuccuucacuuuguauuuaugucagaagaagauaaguacguuucuacuacagagaaaaaugaaagugugccucucaccccucaccaaggaaacuugucuuuugcagcagacagagaccaccucagaaaacuacaacuagucaaaauacagagaucaccagaauucccaggcacaaugaggacagccacagcacggcuccugcacccgggcccaggagauauuaaggaagaggugguggccaauuugaaagagccggaagaucugcaagucugcugggacugcugggacccccguacccaugaaaccucaacagugacaauauggcucccuaaacaagacccggacaaugaaagaccaaaugaguggggacauuuucacaggguccuaccccuaagcaaaagacaaccgccuucaagugacuguggagagagggaggauucacuuucccaggaaggggucccugagugguuaucccugacaucauguacacaaaagcaacagacucaucaggccaggcagugguggcacacgccuuuaaucccagcacuuggaaggcagaggcaggugcaucucugaguucgaggccagccuggucuacagagugaguuccaggacagccagggcuacacagagaaacccgucuuaaaaaacaaacaaacaaacaaacaaagauugagcuauacaggcaagaaagcagggcauuuucuuaauuagugauuaugugagccggcccagcccauugugggcaguuccaucccugggcuugugguccuggguucuacaaaaaaacagguugagcaagccaugaggagcaagccaauaagcagcacccuccacagccucugcauccgcuccugccucccacccugcuuggauuccugcccucacugcuuuugaugaugaacuguuacaugggacugugaguaaaaucaaccccucccuccccaggaugguuguggucacgguguuucauugcagcaaugauaaccccagguaagacagcagcaaggagagaacaaaauauucaacaccacaccaagcuucagaucacuuaauucccucagccaacgaggauguucguucacugauucagaaaguaccugugacgcccugugacucgggcugggguacaucaacgcacagcgcuggaacacaaaaacuuuuaagcugaggauguggcucagcaggggagcgcuugcuucuauacacaaggccccagguuucauacacaggaccaaacagucaggcaucucucgcaaggaagccucuuucuuccaccuugaguuagggaaaggaaguggaaggccucuaucagaggaaaugcuugugcaaaugucaucaggaugcagccugcuccaacgggaggagguggggcgaagacugagcuaggagcuugggacauuagccuccugauggugccaagcuguugaaagauaaaaauuaugaacuuugaaaagcauaucuagucuuaucagccccuaccucaguacauauggacgcagaagucccaguuucuguuuuaaggauagggaugcugggggcauuuuuguccgaagagaccaugccaacugcuccguggauaauuacuugaaagaaggcaaauggaguugugggaauaccggcuaggugacuagggcaacgugcugugcaagaagugacuggacccagaggcaaagaauaaagguugucuuggaaauuggcaggaacuagaaugugggauccaguuggaguaaacagaucacugauggcgugcccuugaggguacacccuaucucagucacucccuccguaucccucugcuuccggggcgccacgagguaagcagcuuugucccgcacucccuucuaccuugcuguuccaccucaccacaggcgcagagccagagagcaaggacugaguaccuuugaaacugaaaaucaaaagagaugcuccgccaacccccaaucuguacaacucagcguguuaccauggugaugagaagugacggacaagaagggaggagggaaguagaaaagauagaggcgacuaaugugcugagcagaggaggaagcagagauguagagacuuuagaagggucaaacacuugaugaagaaaguaacauuugcaagcaggaccaguccgagaagggggcgggggcggggaggcggggcgggggaaggcaggggagaagaagaguaacauuuucuucuuaaaagcuaaaaugucuuccagaacuuuggaaucagaggcaggaagaucccugugaguucaaagccagccuggucuauaugaugaguucuaggcuagccggggcuacauagugagccacugucucaaaaaacagaaacagaaacagaaaccaaccaaccaaaccuaaauguuacauacaguuauaauacaauaaucaugcauuaguauauguucaaguaccguagaacagaauaagccucaaagaaaaaucaucuguggaucauaccuucccauucuauauuuuaagguucuagcaguaaaauaugagaauaucucaggaaaaaauuuuuucuuuuuuucuuuuuuuuuuuuuuuguuuguuuguuuggugguugggagugggggugauaggauguuucucuauguaguucuggcuguccuggaacucacucugcagaucaggcuggucuccaacucacagagaucuaccugccugugccucccaaguacuagagcuaaagugugcaccaccacacccagcugaaaauauauuucuuucaagcagguugcuagucacaagacucacuaguaaguuuucacgacugguaacagcuuugauaaauaucaaugcuauaaaauaacuuauagagaugggacugucacgcaguuggaagaauuaucucagggcucugccuaacaugcacagagccuuggguuucauccuuagggccuuauaaaagcaagcaagauugugcauaccuuaaacucagcacucuguagagaggugggggauggauuggaaauuggaggucauccuuggauacauagcaaguuugaaacccaccagggcuagaggagucccugcccgaaaaaaauauaauaauuuauaaaguccuauuagcagcuccccauauuauuaauaauauuauuauuagcaguuguucauauaaguaaucccaaggcuugggaggcuaaagcaggagaccgccgcuuuuaacaacauaguaaguucuaggcuaaccuaggauauaacaucaaguucuguuauccacagugugugugugugugugugugugugugugugaaccuaaauucuaaaacacgcuccaggaagaaaaccuagaagaaugagaauccaccacaaaaauucagaaaaucuuguuuucaagccuucaagucugccagccacaacgcugcagcccacacacacuugagcgaacgaacauucauuaccuuucggaugaaguugacgugacauucacccuucugcuccaccggggggcacucugggggcacccgguagcuagugugagccuugcucugacacucugcauacugcacugcugaccggaacugcagcuuuaaggaguucacgucuuugacuacguuggugacgucaaagcucugcaggacagaggaaggaaacacagcuccauuaggaagaccuagucuuguguauaacauuuuagauaaagguagacuacaugaaagauacacacuacagccaugucuagagcuaguuucauuaacagaaggaaucccucugaaagagaacuuaauggacgccuuuaguuacaccuccaaucuccuguccaagcacagauuccuaggcuucuccuauuuuuacaggaauacggcccuagagaacuaugcagaacagaaaguaucuucaucccuggaacgaccuguacacauggccuugagcugccaaagauuccuagacacuauauaacaaccugacccacugaaacacacgguguguauuucuaagucaucagugaguuuugcuuuccaaagcacacccuugaaacagaagggaagcacaauuucagaacagauuuccuuuuaaaauugucugucacuugucauuucccacggacuuggaucaccagaccacugaggagugaacagccaagcuggagcuguaauuuccuuccucgaggcccacagaaccaccaugggacuggcacugccccuaacagccuucaaacggggcaccugagaagcccggucauuuaccaguguuucaaaggccuugaccuugacguauggcaaauuacacaacgauccuucccgguucacgaacauaaaggccagcucuugugagucuggagcccuguacucacguauccagugaacauguugucugucuucccaauggugacauuguugaacaggauuucugcaaccgugucaacuccaucaaagaucaacuuuaccuucugccauucacuaagagacaacaaaagauuuuuaaaacauuaacccauguaagucucuuugucaucaguuaagaacuaacaaaguaaagauuccacaggaaacuauacacccuuaaccuuaaggccaucaaauuucaggaguaucaguuugacauuagcuguaauaauuucuuugagugauccaguccuaugauguggcugucagagcuuugccauaaaaucaagagcacaaauuauaauuuccaaaugaguugauucucccaguuauuccagaguucuuagauaacccagaaaacauuugucaaagcuauugaaucuuagauaacacauuaaccaugaccuagugucaaugauggagaauccugugcucgguacuuugcucagccuuacaaggaacaaccuggaauuugaaguuuguacucuggauggcauucaagcccacaauacacaggacucaaacagaaacuucuugaucuacugggcaagggcuagcggaggcucaccguguaagaaagaagagaauaggaaagaagugaauaagaagucaaagaagugaauauuuuucaucaguaacaaggaacuaaaucaugaugaacacugcuguacugugguuguuuaaucaaaggaagccuugauaaaggaccaaugucucuaaugugcuccaucaguuagcagugcuacaucccaucuacagauggaaagugaguuaguuacugacugucuaggcugggauaggaacagugaaugggaacgggaaaugauaacuaaugaguaacugaugauggcugauuuaauuagggcuucuauugcugagacaaaaaaaaaaaugccaugacuaaaagugacuuggggaagcagggguaaucucaguuuacaauuuaggucacucuccaccagugagggaagcgaaggcaggcucuggaggcaggaguggaagcagacgccuuagaagaacgcugcuucauauauauauauacauauaugaaaguguccuacauuuucuuacaccacaucuaccugugauagcgcaugauuuuugauccuagcagggaggcagaguaaggcagaccucuguaaguucaaggccagccuggucuacaaauugaauccaggacagccagggcuauaacaaauaaaaaccuugccucaaaaaacuaaagaaagaaagagagaaugagagagagaaagaaauugugguucucaauugugguucucccuuagauaacuccgguaugcaucaaguugaaacaaaacaaacaaacaaacaaaaaccaaaaaaaaaaaaaaacaggauaauggugaugacugccaaacucugaauauacuaaaagccauggaauuguucuuuaaauuaagcaaauuucauguuauaaagaucagaguucaauaaaauuguuuuuguuaagauaaguagaagagucugggucucagagaaccaugccaccccaccauacaaagcccuaauagugucaauuacuuuaaagacagacucuuuauucagacacaucauuugggcugaguugcugagaaggagaaauugaacaaguuggggguccauggcagggccaggggugguggggccagugucacagguacgcagugaagccaguauuuccuuuaugaagccaugaaacaggcuuucucuuccugaggaaaagcaaguaauguuuucucacaccaucagagacuaaaaggcaaacccaagacacuggauucugcaguuucuggguaaagucaaaaccggaacgugaggaggcucuacuaagagaaaugccaggcaaacuuagacauaaugggagaaggcaguggagaaagaucgaggcggcaaauccacaucccuuggcacaagcuugggaagaggcaccuguguuacaugaagaagagcaaugggcuauugggauguaagcuacuugaguagggaugucagcuggcuggauuugggaugugcuauguucaaagggaaaugggauuuugucugggauuuuugugcuauuuguuuuucuuuuguuuuguuuuaagacagucucagggagcccagaguaaccuggaacucacuauguagugggagacaggauucuugugagaaauauuuuaagcauuaucuggaaagaaaagccugacacgcaguagcuugcaccaccacuuggacuaccauguggcaugguucuccuaauauauugaucguaauauucuggcuucauuuucaacacugaggguugaacccagggucuuaugcacacuaaacgggcucuuuacccuauccuguggcuuuagauuuuaaagcgauaauaaguaauauaacaaaaaaaaucauacacaagaaaauuguucaaauuuaguaauaaugguggcuuguauacuugcuuacagucugcuucgccuagaaauauuuucuuaugauaacagaacacugcugaaagcaauacuuguaguuuucuuuauggccacaugaguaagguuaaggucauaguuuuguauuaccaaaauuaaccuguaagcuuccccugcccaaggaccaaguaaccuccuggaaugcugggaguuguaguucuuauaacaaaagccucaugggaaaguaugguggccuauggguuugucuuuauaaaccccugcaacagugucucagggccauucagcuuggaaauuccaggaauggccuugaccaaaguccaucucuuagucaguacuuaauauuuaauaaagcuugcuucaaauuuggcccaaaaugguggaauugguuuuucuccagagaaucucgggauugacaguaucaaugguuguauagcacuaacaacacuguagaugggggaaacgugcuucaaugccuaaggcucuaggcucagauccuaguaccauccccguacacacacacacacacacacacacacacacacacacacacacauacacacauacacacacacacaacacacacacacaccacacacacacacacacacacacaccacacacacacacacacacacacacacacacacacauauacacacacacacaagcacugugguggcgagggagccugugaagauaacuuggucaguaaggugcucgcuugccauggaagcagaagaauuugagcacaauuuacagaccaacauaaacgaugggcacaggcacagcagcacuugccggcaagcccagaacgggggaggcagagacaggaggacccuugcgacucauugaccagucuagcaaaauuggagagcucaaaguucagagaaacaaaaagcaaaguggacaguaauugauuaaaucgccuggcauuucuccuuuggccacacacauacauacacacacgcacacacacaugcacacacacagaauaacuucacaaaaaguacugcugaucaauacaucaauacauucuccaagacacuggggaaguccagggcauuuauauaaaaugggauuuaggugacuucaguauaaccacuagagcaauuauucccuaaaacgcaaugucaugacugaugagcaguggccccauccucacauauaaaaugaaaaauaaauuacacagucacuucgauaacacaaaagucuaaucugauuuaacucugauugauauacaaccuaagcagacauaaagcauaaaugaaaaucuugucauaauacaguauauagcacauaguauacauaauauaguauauauaauauacuuuuaaaaaaauuuauuuaauguaaguacacuguagcugucuucagauacuccagaagagggcaucagauuucauuauggaugguugugagccaccacaugguugcugggauuugaacucaggaccuuuggaagagcagucggcgcucuuaaccacugagccaucuugccagcccuauaauauacuauauaguacauaguaucuaugggcauaguauauauacuauaguauauauggacauaguauauauaguauauauggauguaguauauuaguauaguauauauaaaaauauacauaccugagauuaaaggggauuuuaaauuccgugcuguagguccaguuaucuaaggaaauccaucuauaguucaggucauuaaaucuguaguaaggauccuguugguacaagauaaacaugguagccaaauaugcuaaaaauaaacaauugaaauagguaacaaacaaugacuauugaucaccuaaaaauuaaugaacucuuggccuaggaaagucagacgauuaacacugagaaugugggcuguggaucagaggcugcagauacggcccaguggugggauaugcaaggccccgagaacagugcccagugcuguaaaacgacgaggaugugggagaaaauucccaacaguaugcgugaaaugaaagagcucugcgguacaaauaauacucauuaucagagaacguguccggagauagauaccggcucccuuuguauugauuguuuuuuauuauauauuuguuuauaugugugagagugcucaggcaugcaccaccgugggucucccuucuccccagggccaucggccaucggcccacguggacgaagugggcagagugguugaacaggguauuggauggccugugaguacaaaagaaaaugaagucauuccaggaucaguuuuagggagacagaccaacguuuuuaggggugaaucaaugguuagauaguuuaggggaaaggaguaggaaaauccaggauggacaaaggucauuggcugaaggcuaaacugagccgccucauuagccuagagaggcaucccaggaaucucaggugcuugccgauccaguucuuaucaggagaaaggaagcugaaccuguaaucuaaccaaagacauuccacagauagaggggagaugggggaccgggguggggguugaacucuccggagaaggucagagaaggagaagcccugcugguaaagagaguccaccauuuugugagagcucagaaggcuaucuggacaaugguagacuuugaccuuaauuagcagggcaacacuccacagcaccuauguggguggucagaggacucggugggagaaucaguucugcguuuccguuguguggcguccgagaacugaacucagccaucaggccuggcagcaagcgccuucacccacugaacggucuccaagagacucuggcugccucuuuuaagccaaacauagaaccuccaaaguccuggcaguaaauaaaaucugaccgcccugggacacguuuccuuucucucccagggcccaguucuugcucuuugcuuccacuaccccggauagccuccagggggcagcacaucuccugcccucuacugcccaaaguucagcagaaacucccauuccuuggagaccuuaagcauuuccaaccuacuuuucacuacgcuuucuaagugagcgcugcugggggcugaguagagaccacacaggcaguaaguacacucacugccacacucauaggauccagcuuuccuggauuauccauguuagcaaacugcagcccgugggcuugauucuguguggcagccagucaagggccaagcgcugacagacuuacuaggaguuguggauauggaccaacaggcaaagcacuguugcaaaggucuaaagaucucaguuugauuccccagcaacaucguaaaagcugaauggaacaaugccuggaaaguagcccaacagcuaagagcacuugguuuuuuuuuuuuuuuucgggggaccaggauaugauucccagcauucaacugguggcucacaaucaucuguaauuccauuuccaagggauccaagguccucuuccagccucccugggcacugggcacacacuaaacacuaaugcaaauaaaauaaaaaaauuaaaucuauccguuuuuuuaaaggacaaggagccaagcuuuguagcccuccugggcuguugacauagccgauagcaaagucacagugaccccgacuauaauacaaagaggaaugauuuauauaaaucuauuauccaagccaaucaguugcuguagcaccaauuuuuucccuuugagaccuauuccacuggugcuagagagaagacucaacaguuaauaguuuuuguuuguuuguuuuauuuuguuuuuugagacaggguuucucuguguagcccuggcuguccuggaacucacucuguagaccaggcuggccuugaacucgguuaauaguucuuaguacucuugcagaggacccaaguuugguucccaguagccacaucaggcagcucacaaccaccuguaucuccagcccucuucuagccucuguagguuccuggagaugggugguacacauaaacucacacaaacuuagucauagcuaggaagaagggaucacaaaugaggaaaugccucuaucggagaggccguuaggaaggucugugggguacugucuugauuaaugauugaugugggagcacugagcccacugugggcggugcuaucccuagacaggugguccugcuuauaugagaaaguaggcugggagagacacgaggagcaaaccaguuaaguggcauuccuccuucuacacuucugcuucaguuccaguagacugugacucaggaugugugugcugacgacuuuaugucaacuugacacaagcuagagucaucugaaaggagggaacuucagccagguguggugcuguacaccuuuaaucagaguacuugggaggcagaugccagugcaccucugaguuugaggcuagccuggucuacaugagucccagggcauccagagauacuagguaagacugucucaaaaaauaaaacagggcuggugagauggcucaguggguaagagcacccgacugcucuuccgaagguccggaguucaaaucccagcaaccacaugguggcucacaaccaucuguaacaagaucugacgcccucuucuggagugucugaagacagcuacaguguacuuacauaaaauaaauaaauaaaucuuaaaaaaaauaaauaaaauaaaauaaaauaaaacaauccgggcagugguggcgcacgccuuuaaucccagcacuugggaggcagaggcaggcagauuucugaguuugagaccagccuggucuacagagugcguuccagaacagccaugacuacagagagaaacccugucucaaaaaaccaaaaauaaacaaacaaauaaauaaauaaaaauaaaacaaacaagaaggaaggagucacaauggagaagacagcucuauaagacuagguuguaaggcauuuucuuauuauuucuuagugguuagugggagaaggccuaacccauuguggguggaaaugggucagagcuguugguccuggguucuaugauaaagcaggcugagcaaggcacguugagcaagucagucagcagcacuucuccaaggccucugauucagcuccggcuccagguuccugccccguuugagucccggaccugacuuccuuggaugguaagcuguaauacugaagcauagucaaaaaauaaacccuucccuccccaaguugcuuuggucaugguguuucaucacagcaacagaaccccuaagauagagcuggaugucaucuccuggagggcaguaacuccaggaguagaagaaaaagccaguguuguccaugauccucugcaaugagaguggaauggccguguuugacugguagugaccaucugggcagcuguccaggcuucccacccaugaagcagcaucauaaugacuccaggggaguacacugccaucaagguuucaaccugccacacaucguuccuaacuaggguagcuugauaagccaccucgggagagaguaaggugagcuuuaaagcuacgaaacagauuuguauuuuaaguugugcuucggggugagacgcugucaacugguguguggaagucccaacuaccuugcuucccuuucugcugcucugagccgccccggugaagaaacacagaauaaauauuuaagaacucaggcuggaagagaagcccaguuauuaacuugcccaaaugucuucacucagcccuauuuauaacuccgcacuguggacuuaaaccaagaugguuaaaaauaucaugaaagaaaaagacuagcaagcuucgagggcagcucagccaaggacgucaacacacugcaccccagggcuagcgggggcagcagggcuugggucuccuuccugugucuguguuccuugcaggaagcuacgagggaagcccaagaaggcaaucaugcuagauguguuuucucacaugaagagaauuuacaggcuaguuucucccacuuauacaauuccaacuuuuuuuuuccauuuuacugaugggggagggggacccaagugccaggccucacguauggagccagaggagaauguauaggaagcgacucuuuccucccacuaugugggucucagggauugacuuaaggucguuagccuugguagaaaucauguuugcccacugagccaucuugucagcccuauuccaaucuuuucuuuaaaacaacaacaacaacaacaaaacaaaacucuaguuuuuaagguuuauugcacaguagggaagguggcagaauuuagcuacaaacacaauggaaaggcucuugucauuccaggcacuagcagaugucacacagggccaggauauagaccucugaggugucagugucaagacuuuguaugccagaaucucccaugccugaaccaaaugaaaaguugaaccaugauggcuugagagcagagucuccaaugucacuuugugugguaguccugcugucuacacccuggcucuccgguguccauaaauaccuugcaagcacucuguuccgagcucauccuaaaacccggagggccgcugcucacacacacauggcagagaguagcugaguuucuggaagcagcacaccaagcccaacagaccuggucacaauggggccuggcgcugacuugugcagcuuacagaaaacgcugcauuggugcacuagcuggcagagagaaauagaaauguaagaaagaacacuccaaaacucaaggagcugugagagagaccccaaacagggcggguuuauaagggaagagccacccuggaugugaacagcaccacaccauggucugcagcagccugaaucaaaagagggaaaggagaaagacaaccagccucuguguucucugcucucugaguccuggccagcccaugugaagggaugcuuagccaccccuacuccugccccauaaaugcugccauaccugccccgcaccuaacccaucgacuccacucucacaaacuguaauuccaaaagaaauccuccuaaauuacuuuauaucagguucuuggucagagccaccaggaaaguuccuacuauaaagcucucucugcuugaacucucuagaggaaccuaguguuacccaauuuguuuuuaaaaggcaaaugcacagcaacggaagagagugggcagacagcauacagaaaagaaggaaaccuuugucagcuguacuucagagggcaguuaauagaugaauaucuaaagagcuacaaaaauuaaacaaaaaaaaaacaaaacuucaaguugccaaugaguucucaaaacaagaaauaugaacaacuaacaauguuucuagaaguguuuagccuccuuauuaaccaugcagacauaaaugagaaguacuuugagguaagauggcucaguaggugaaaagagcuugccugcucaaacuggaaaaccuaaggccaguucccagaaucuacagugggaggagagaacugaccuuugaucucugacccugacagcaugucaugguuaggcacacauauguucaaauucacuucucucucuucuuucucucucucccucacucccucucuuuuccucucucuuccccauuccucucucucuccuuuccucuuucuuugaauaaguuuuuaaaauuaaaaaaaaaccaauaauuuuagaacaucagcaguauagcuauuguggaagaaagagaugccgguggggauaugaggaugagaagugcucggcccuugcuagugaggaugugauugguguggccucuguggggaccacugugacaucuucucagaauguaaacacagcugacccggauauaccacacuucugcacaucuacaucuauugccccuuaauucacagcaucaaagagauuaaaucagccuagaugucagucagcagaggacugaccauuaacaugugguaauauacacaacagaauuuugcucaacucucaagaagaacuaaacuugcagcaaaaugcauggcacugggaaauacaacaucaggugagguaagccaggcucagaaaguuuucuuucacgugcagauccuagggccucauguuuacauauguggaugcaugugcgagaaaguguguagaagcuggggaagcugggaaggggcccaugagggaaaagaggcuuuaaggaaggggacaacggaagaguaaagaauacaugugauaucaugugauauaacaagucggcggggucgggaauguguguguguguguguguguguguguguguguguguguguguguguguguguguguguguguguguguaggggggagagggagugggaggggagccacagcaaaccuguuaguuuaaucugcucauuaaacaaagaacggggcagugauaugcucagcugggaaaggcaccugcugucaggccgggccaccugaguccaauccccagaaccaacaugguaggagcugaauguuaacuccugcaggugcccucugaccuccacacaggcaccguggugccugcgugcccacauguacauacacauacacacacacacacacacacacacacacacacacacacacacacacguucacacaaaauaaacaaguaagugugcaacuuaaaacuuuaauaaaguaagucuuaaaaauacacaugcagaaugcagacuuaagucuccccucacauccgcaccaaaugggccugugugcuaaaacaaaacaguaaaggaaaaaucacuuuugguucuuaauaagggacuguauuaugaaaaaauuuucagaggcuuagauuauacauaguuauaugucuauacacauauauguguguguauauacauguauucaauacacauauacauauauauauauauaauuaguuauucuaaugcuaaucaagcacuuaauuuggcuccagauuggcugaccugcucugagccacauuaaaacuuugaguccugggcuggagagauggcucagcaguuaagagcacuggcugcucuuccagaugucccaaguuaaauucccagcaaccacauggugacucacaaccaucuguaaugggauccgaugcccucuucuggugugucugaagaccuacaguguacuccucauauauauaaaauaaauaaauaaauaaaaucuuaaaaaaacaaaaacaaaacaaaaaaaacuuugaguucugcuuaacaugaacaacgguuuagggucuuucaugaccaaaaaagagucaggcaagcugcugaguugcuaaacaagcccuggaguucucaggcugauauacuccagccuuuaagguaaggacucaggcugauauacucuagucuuuaagguagggacaggcugauauacuucagccuuuaagguagggacucauaucuacaggaucaaacaaauaucaaaaucaaagcugcugaguauggacuuauaguagaagaaaccuaaaacccaaaaggugggguuucuaagaccuuacacuucuaugucagaugaacuuuucagcaacaguaauaguagcuagaagacgcugucugugacucugcugggcaggucuuauuaucucauucacuaacacacaauccgaggcucaaagucaaacagcuguuaaccaguggaacagugacucacccagggaaauguggcaugcuuacucaugacccaggacuuaggcgaugccagggacaccacaggaaauuccagugucagugugcauugagagccaagagauaaccacaccgcauacguguaaguuaucuguaacuccuacuuaucauacuuacagccuccagccucaauccauauuugcaaucucagcuacuaggaagcugaggcaggaaaaucacagcaaaguucaaggcuacacugugagcuccaggccagccuggacugcagaauaagauucgacugugugugugugugugugugagagaggggggggggggugaaaaucaaagcggugugugguggcacgugucuagaauccuggcaauagagaagcuaaagcaggaggauugccaugaguaaaaggccaggcauaaugaguugagcugcuuggacuagauagcaaaacacugucagagggagagagggagagaaagagaggacccucaaagccuccuccuucccuuuagccucucucuccuggaugaacgcuacuagcucugccauacacacacacacacgcacacacacacacacacacaugcacacgcacacgcacacgcacucggcaugccauguguuaccacaggccaaaaccagcaaagucaagugagccaaacugaguccuuacaaaaccaggagccaaaugagccucccauguuuccaagguaauuaguucaaguauuuguuacagugaugcagaaaaccagugggagcaacgaaaaggcaggaagugggcaggugaccucagaaacgcauggguguuacucaguguuuagaguuuaaaaaucauaaaccccaggggcuggagagauggcucagugguuaagaaagagcacucacugcucuuccagaggacccaaguuugguucccagcacccccaucuggcagcucacaaucacauguaacuccagcuccaggggauccgaugcccucuucuggcuucuaugggcaucacacacagagacauuuaaaaagacacugaagcagucucaauuugcacagcgaaagugauaagcacuguggcugggagucaaguacagcugaaaaagcccugcugagggucgauugcaaauggagcucuuaaaggggcaggcagccuuuugcuuguaacagaaaguuagcuuaaaauugggaacucagggggcuggugagauggcucaguggguaagagcacccgacugcucuuccgaagguccgaaguucaaaucccagcaaccacaugguggcucacaaccacccguaaugagaucugauacccucuucuggugugucugaagacagcuacaguguacuuacauauaguaaauaaauaaauaaaucuuuaaaaaaaaaaaaaaagaaaauugggaacucaggguuggagucauucuaaacaacaugaacaaauacaagaaaacaggucuuuaaggauacuucaaaauagggauaaucaggacuggcagaauguucagauugagaaaaguuugcauuuggauugaggcugagcucggaggggagcagccucagcgcgacuuguguggcacuucuuuuguuuugcaaacccggacuagggacaccuggaacuucaucucucccucccuuucuuuuagcuaaaagaaccuuguuacagaccuagccagauguuguucuaaauaaaauuuaaauuuaaaguuuaugaaaagucaaucagguugugaaauuuaucaagacauugcgauuuggcuugccuacuuuauauaaaguuauaguguacagaguuugcuuauauguaugugucuuuuccuuguuccaaacagccauuaauuugguuauugcagaauauugauguuugaucuauugcauaccaucguauuaaguaaaauugauaaucauuauccuaagauaguuaauuuuaugcaugcuuguaaauucaugcaugcaugcaucccauuuacuggauuugaaaaauagcauuuauaugagagaaaaguauaugugaauugaaucacaugcuuauucuuuugaguuuccuccuguuucagcauagauaauuaaauuaucuuuaauccagccuuuaaucccagcacucgggaggcagaggcaggcggauuucugaguucggaggccagccuggucuacaaagugagcaccaggacagccagggcuauacagagaaacccugucucgaacccccccccaaaaaaaauguugaacaaucaaacuuuuaaguuguauauucauagucaauauuauaucucagagcuugcaauugcuuaugcaacuuauaagaaaaaauaauauuccuuuaagaagauuguuuuugggcaguuaagaaauuguccuggguugccgggaaaagacccccaggauuugcuuuuguguuauagagguuuaaauaaagcuuuaacugauaaagauuacagauagcuccuaaaaggauacagacucaggauccuuacauuuauuuggguuuaagacuuacuacucaagcuguuuuuucauagaagauaguuauuugcagagacaacuuaaagaauuucucuuauuucugauuaauaaauaaauaaauaaauuauacauaugugauuauaauaacuuuucaagcauuuuagucacaaucucucuucaagagaaacaauugaaaguguaauuagucacuguccuuguuauauuaaaacugacuaaccauccaguaucuaaaauuuugaugaaaauacaagauuguauuuugaugcgugagcaucccuuuuauauucagcauauuagagcacauacaucauuaccuggcuccuauucaagggagaaauuccuaagcugaaguuagccacuggcaagaaagacuaaacagagaaguccuagcuguuuauuuuauaaaucuaaauaguauauaugacugacgcuuccuaaaagcucuaugguuuugggcuggaaaaccacccuggacauucaugaccuacaccuggcaucaaggcaaccgacucccacaggcuauguccuggggaggacacgguauguauaugaaggucucuaucucaaaccggucauuagguaacuaagagaauuaaaacuucuuuaaaaaacaaaaacauauucaacauuccuauagaaacagcacuuuggagugaccaguguuaggugcuagcaucaauuaaccauagaacaguauuuuccuucccacuuagucuaccaaacaaaccaauaccaucacacauuaagagccuggcucauggguccucugaagcuauggcagggagagaugcgcuagguggcuacgugagcaggagaagaaauagaaacaaauucccggaggauguuuuuagccaucucaauguuauugugggcaaugaccaaagcuuucugaauguccugguaggaauagcccugacuccugaggcguucaaucucacuugagaacugcggugagggcgcuguggccacaggguuagcaguggcaccuccgccuuguugauagcuacuagcuuuucguucugaguugauuaccuguaccuaugguuaagggaaaugcaauugcugauucagccaccagagauaugguuuuccuaucacaaaguucuauagaaagugcuaagaauuuucaucaacuuuaucaugucccugcuucuacacugcgacagaaguuuaagcucacaugaacagaagcuugagauauuguccuacagugugguaaauguguaaaauuuauuaaugcaccuucugugggcauuaauccucgcggauugcgaccccuagauguguggcagauggacgucacgcauauuccagcuuuugguaaauuacaauauguacauguguccauugauaccaguucugguguccuacaugccucucccuugacaggggaaaaggcaguucaugucauaucucacugcuuagaggcuugggcugcauggggcaagccccuagugcugaagacagacaaugguccugcauauacuucuucuaaauuuagucaauuuugcaaacaaaugcaaguaaaacauauuacuggauugcccuauaauccacagagccaaggcauuauugaaagagcucaucguauuuugaaacaauacuugcaaaaacaaagagggggaauagaggcuaugaugccaaagaugacucuaucccuuacaauauuuacucuuaauuucuuaaaauuggaugaugcugggagaucaccagcugaaaggcauggacaauggccucaaacugcccaaugaaauggucaaguggaaaaauguccuugauaauaaaugguauggcccagaucccauauuaaucagcuccaggggagcuauuuguguuuuuccacagggugaagauaauccacuuuggguucugacacgacugacaaggaccgugaaagagcaagaugaaucccaaaaugaucuuguuauucuuacuccugaggcuugagacagauaaguauaccuuugugggccauaguaagaucauggccaguaccuuuaccgguacauuccaauucuucuaccuugccuuuguuuuuugcaacggaauguuuuuuggaugcaccuuguacacgacaaacuccucgagagccacggguguauaauaguacaaguuuucauuuaaauuauacacuaugcuuugugcauaauauggauaaaccuuuuacacccuguauauuuuuuuucuuguuuuuuuucgagacaggguuucucuguauagcccuggcuguccuggaacucacucuguagaccaggcuggccucgaacucagaaauccuccugcuucugccucccaggugcugggauuaaaggcgugugccaccaugcccagcuccacccuguauauuuuuaaagaaaaagauuaucucuaauugggcagaucccauuuaccaaaauaaagugagcucuggaguguuauuuaaugcuuuaacgcaaauugcucaaggagcacaaucaggcucaggugauguuggaaauaauguaacuucaccuauaaacaucaccacuauuaugauaaagggaaaugugacuauucccaaaagaucacgauggcuuguuggcaaugcuacugcuauacgcagcaugccuuggugccaucuggaccuugcauuuccuacaguuuuuucaccuugucaaucaaauguuuuuccucagaaagaaauugcaaaggguuuuguuuugucaccaccauuggauuuugcugcaaugaaugauaaaggagaugcuacagggaaagaaaauauuuggccauauuaccaauggauuuuaaguaaugaggcaggugcuaguaccaguuugucagccuuugcauugcugacuggaaccuuucaugagauauugaauguuucugccacacuuuccaauaccucugcucaguuagauaaugugacaucuaauagaguuaucagaaauaugacuacuucuccaguagaaguuuguguuaauccuccauuuuucuuuauauuggcugaauuucaaaauaauacagaaugguuagauuguacaaaugucacuugucuuuugacgcaaugcuggaauggaaccaaauuucuuagccuuagugguacguacaucuaccaaccuuugucccugugccuguugaggcagauccagagaacuucccagucaugagucuuguuuggcagaagagagauuuuggaaucacagcugccauuguuacugcuauugcaguguccgccgagucagcaguuacugaaggaauugcuauggccaaucaaguuaauacugcugacaccauaaaucagauagcagaaaaaaacgucugaggcauugcuuacccugcaaagggcagauucucauaucgccucaggauuaacguuagugaaucaaagagagauauuuuacaacauaacauggaacagaugacggaugucauacaaaugaguuguguggcaucaaccccacaugugugcauuacucccguuagguauauuaacaauucuuucauuaaaaguacagauuuaccgaauuaucugaaggggaacuggucgaaggagcuggaaagguugcagacgaaucugcagauacagauccugaaccuuaauggaaccagaguggaaucagugacccuuggagacuuuaccucuuggcuuaccucugcauuuucuuacuuuaaggaaugggugcgagugauuuuguuuggugcugccauaugcuguggacugguguucaugcucugguugguaugcaaauucagaacucaacaaaaacgugacaaggugauuauaacucaggcacuuuuagccauugaaaacagcaccuccccugaaguuugguuaucuaugcucaagaauuagucggcaucugaguucucugcucuugcaccccacggauuuauggauccauugcacugggaugagagaaacucaacgaucauugaucagcccuugcacaucgcugagguuuccucauugcacgcgauaaggugaucaugauuucucugcuaauucauuccuuaaaaaacuuggcuggccucuuuuguagaguuugcccugggucauuuagcaauuacugucacacagcaucacgguauccaaagacaggcaacuuuccucgugcacagaccaaccuaagacacggggccugguggcgauaggguuacccuaugacggguaaggcugugacacagaggaacgaccuaaaacaggagccauggcggauggacauaauugcauaggccuaguucagcaucauuuuauuaaaauaaaaagagggagaugugggaagccgcaaacgccggcacugguggcaauaagccaacacccaugaauauggguaaacaaccaaugugcacaugugcauaagaguuuuuugccgagucacugccuggcccgacacauauuaaugagguacugguagcauaaccaaucagguauggacaugucacuccuaggccuauauaagcagugccauuucuggggcucagggucuuucgccuacgcaguccaugcucucccaauaaauguguugcagaaggauccuguuguggcgucuuacuugcuggcaagucgggcgucccacagauaucaucuaucugugcagaccugacucuucccugacccuauauugccauuuccacacauacgcuccuaucccacgcugggauggagaagacaauuguuucucaggaucacaaacacuggggagauaaaaauuguuggagcuguucucaacccaaagcuagcauccggucaugacagcuagcauuucuaaaugcacagugaccugaaaaacuuucuaaguuuugucagcuuacagguuaguguaaaauaauggucauagaacguuaucauagaacguuauuauuuguggggguggggggguagguggacaggcaagucuguauaagguauauaccuacaucuuucuacaaauaagauucacaagaaauuguucauuguggcuguuucugaagaauaaagcagugaucuagaagacaggcacaaaaaggauggcauugggucugggagaugacucagugggcaaaggugcuggcugugcuagcccaacagcucaaguucccuccuagagcccacagagaacuaaguccacugagccagcucaccgaccccaucggucuuuauuuagauaaaaauuaggaaaaguuccuuuacuccuauacaccuagggguuggugauucuaugcaggcaccucagagagucagcugugagacagccaagguuggucacagagccucucugugacuacaaguuggucacuggcucggguagaagugacuuggugcccugucaggcuccucuuuguccuaccgcucacauucagucuguaaacaaccccaacugcugguucgacacguaaucugugcacccacggccacuccagccaggugugcaggcaggcaagcaccuggaaucccagcucuuaggagccuaaagcaagaggcucaccugaucucccgagugaaacccugcuuggaaaaacaaaacagggagggccagcaaggugacucagugaacaaagguucuggcugcugcaccugaccaugagagcuugaccccugggauucaugggaaggagacccauuucuacagguggcucucugaccuccgcaccugcaccauuugugaguuugcagauacauaaauacacaguaacagacacacacacacacacacacacuacaaaaagagacauggaacaaacaaaccaacaaacuccuccucuguucauuuccuugcuccaauaaagaaaccuccaggccccaaggccacaguggacuccaugcuucuaucgugcacagcagucuggagaguggccuuuuacaugguaaaaccacccuggaagacugucuuccauaggguucaacugcagugaagagauaccgugaccaaagacaacauuucaguggggcugguuuacagguucagaguuuuaggccauuauugucauggcaggaagcgugguggcacaccagcacacguggugcuggagaaggagcugagaguucuacauguugauccccaggcagcagauggagacugugcgccauuacuggccguagcuugagcauauaagacugccuucacaaugaugcacuuccuucaacaaggccacaucugcuccaacaaggccacccguccuaauagugccacuccuauggccaagccuucaaacgcaugaaucucuggaagccguuucuauucaauccaccacaagaacuguguuucuucaagccaaaacccucaacuuucucucaucauguauagaacgaagacaaacuguuccauuugcucuuacaccuugguugaucuuugaacucaacuuccugcagggcucucagcuuccugguccucuguccugccuacuauuaacgggaccugugagggaugccagguuuuccucuggaccacuccugcccuuuucucuacuugguuaaagauguauguuugcuuuacaguggaagaguucucugauaagaaagauccauauuuaagcagcuuuuuaaaaaaagcaaucuuucagccuucucuucuuuuuaccuuuuucuucagggcacccgguguauuguaauuuauuaacuugguagcugacuacuaacgcucuagaauguucacuggagcaaaacuucuuuucuuuacuguuggaguccaaguacuucaaacagagccugguacaaucagaggaaccagcuaaauacagggugauuaauuagguaaaugguuaaauaaacaagagagggagagguuucaaguccaaaucuagcccagugucuguagcaaacaauaagauguuucucaaagccaacaguaaaaggggguggcauaauaacacaggcagcaaugucaccuuacucaacagauggagucuuuccugauucaauaaacaucucucuuccaccagacuacuaccaaggacgccaacccucuuuauucaaacuuagcuuuccuaagaaucugggaggagguugcaaggccuucucaauuacucccacaaagaaguguuggguaguuacuucaaaacccaaucaaauguccucagucagaagcaaaccuuuuuccucucucucucucucucucuauauauauauauauauauauauauauguauauauauauauauacacacacacacacacacacacacacagagacagacacacagagaacaauaaccugcuuugcgcagguuacaauuuccuguuggcuuaacucaauuaguaaaaugagacucugcagaugacaguaagcugugucuugacacaugcacauggguuuuacuugauauguuuuauuguuugcauacaaagaaugaggugucauucugacauuuccuucaaacgauuuguuuuagucauuucuuuucccuuccucucuucccgucuuucuuccucuuuuccccugucucuacccucccugcugucucccuuucuccccuccuccaucucccuuccucuucuucccaucucccuuucccuuucuuccccugugaccucucacuuccagucacuccauuccaauuuugugucacaugucaccuuuuaccuucccuuguauacuuuguuaauuaugaauauacuacuuaagcuucagaaagauuuaccuaaaaaauacacuguaauuuuauuguaauucauugaaauuuauaacaauguaaauucauuguaaguuauaacauuuacuuucauugugauauaugggaugaaaaaacaaaagaaguaaagauagacggacagacagauagucaugaauuccaggucagaaauuuuacagaauccuaguuugacuaccauagcaucaagggaaacuaugaaugcuaucccaagcaucaaagacugugagugugugugugugcauguacauguucauguguguguguggggggugaggguauaguccaguccaguggcagggcauuugcuuggcaugcauaaggcuuuagguucaauggagaaagagagagagagagaaagagagagagagagagagagagagagggagagagagagagagagagagagagagagagagagagagagcaugcagacacucacacacacacaugcucaugauuucugagcuagagcuagacacgguaguacaggccuauaauccaagcuaaaggacgcuaaagcaagaagauaacaaguuacagguuaccuugggcuaccccaucaauucaggaccagccugggcaacuuuaugagauacugccucaagucaagaaaggaagaaagcaagaaaggaggaaagaaagaaagaaagagagagagagaaaggaaggaaggaaggaaggaaggaaggaaggaaggaaggaaggaaggaaggaaggaagaaagauuguuuaaaugcccuaauucuagcaaauaguacagacucuaggcuaaggggucaaggccagccuggguuagaauuucaacucugagcaaacaguggugguacccccuuaaucccagcacacagagacccuuuaauaccagcacacaggaggcagaagcaggcagaucucugagagucugaggccagccugcucuaccaagugaguuccagaacaaccgggacuauacagagaaacuugucaucaaaaaacaagcaauuucaucugucagcuggcggcugcuguaugauaccagccauguucuccagugcucccagaaaggaaucucgaacuuacucauaucuuagcuggugagagcuuuuggugccacuucuaggaaucuggccucagacaaggaaauaggcucagauaagaauaucagaaacagugagcaugggggguuuuguuuacuacuuugcuugacuauuuugucuuugaucuaagagcugaccgugaugucuggaugcaccuagaaugguacaaaagcugcagaaaacuaaagcugcuucagccucagcacuggcuggggucggguuaucauuuugucuaauugcuuuuucuuuuucaauccucacucccucccuugagacccgguugacugauugagcuggcuuggucacuuagaaagcuuucaaaauugugcaggcaaacguccuggggacgugguucagcuggugaagugcuuguccucaaggagggcccggguugagauuccacuguaauccuggcaaugggagaguggagacuguggcuaacucgucuaggcauucacugagcuugggguucagugaaagucccggacucaauaaauaagguaaauaugacugaugacagucaacaccaaccucuggaucacacacacacacacacacacacacacacacacacacacacacaauuaugcaggcuuacuauguaguucagcauggauguuccucaaaccauuaaaaauggugacacucaaccuguauuaguagcucaagccuuuaauccuagcacucggaaggcagaaacuugugaaguuugaagccagccugccagggcuacacagagaaacccugucuugaaaaaaaaaaaagcaaacaaggcaaauuaacaaagaauacaaaacaaaaacaacucugucucaaaaacaauagcaauaaaaagaaccacuaggaauaagccccccccucccccauaacagcugcaccacuccuuccgauaccugaaggauccuaggacagcauagugcagaaauaucuguguagccauuugguugcggcaugauagccaagugauggaaucagcccagaugcccacuaacagacaaaugguuaaagaaaaucacacacacacacacacacacacacacacacacacacacacacacacauuuuccauaggaaaaaugauguaauuaggcugugcaugaugguaaacacuuauaucuccagcacaugggaggaggaggcaggaggaucaggaguucaggugguccucaguuacauugggaauucaaggucagccugaacuacaugggauccugucucaaaagccagaaaaaaaaaagaagguaaggauaaugaagacaauaaaaauugguaacaaaacaacaacauaagacaaaugagaaugaaaacaagauauggcauguuuuuacucauguugacucuagauguaaauauauguauucauaaguguacguauauaggacaccauaauggaaagaaacuccuugaacgagggagggaucacgugguggcaagacccaguaaaaagugaauaugggcagagaacauggugcacucacaugaaacuaucauaaagaaaccuaccacacuguuggaugacagacucucauuuaaaaaaaaaaugucagcacgguauucaggcuuuaggauugggguguaguucgguggugguacaaugugugcuuaguauacucaugguucugggucucucucucucucucucucucucucucucucacacacacacacacacacacacacacacaccacacacacacuugcacacacuccccucccaaauauuuaggcuccucauuagcaucaacaaccaaacuuuacuagugcucuccccaaucccuuguguuuauuucaaaccugacgcacgaggcuucaaagcagaaaaagaaaacccggacauccuagggucggcgaacuuugauuaacuaaaagcuacaagcauccagaugauugcaacaguaacccuguccggagggagaaagguaaguccucuuaggaaaugcuugagcagagaaucaccacaauaaguagacagcagacauaccguuuguuucauauacacaacuuccgccuuccaaggucacugaagacccagcgagggagggucaguguccacaacuggccugaacucccaggccauucccccaacugcccacagcugcaccuacugaccuggacccgcaugggggguguggggggugacugugcguccuaccuggaucagcccgugcuggugcagggcgcugugcacauagccggggacagucgccgguagcuccagggagccauucccguugcucacccgccagcucccgcucaggcuguagcuaggaccugccaccacgcagccggcccgaaauagcgccaauaucaagagcaggugaagaugcaugcugaccgcucgcaagcaggaacccggcagugucgcccaagccuugccaaggccuggacgcuguguccccgccccgagcacggacccgcccccaggucagcugagcgcuucccgcagcccugcagggaggaacugaagccgggacccgccacgcggguacaagcaccgcccagggccagggucucugcgaccugugagcugggcuucucgcuccagcucgauccuguaaguggggcgcucauccgaaugaugaaaagcgacagaaaagucuggaaagcagagucugaccauuugggagacgacaggugcgcguccacaauaguacgcaggcucugcccggggacagcuccuaccacgccugaccagcagauuguacauggucccccggccccaggauuugucaggcugaacgcucccucaauacgcgaccugcugggacuaaacagugcuaacuauaaacucguaggguugcuucaacuguugacugagaggcgccaugugcucccuguuagugguggcuacaucauggagcugcuucugagguuccuaugaaacugcguuaguguuacaggugagucugaaauucccuccuucacuguugaguugugggacugaacaagcaacagaauucccauucccugaauuuaaaagaaugcagaugccaagcgugcuggcgcacgccucuaaucccagcacuugggaggcagaggcaggcguauuuuugaguucgaggccagccuccucgaacaaagugaguuccaggauagccagggcuacacagagaaacccugucaaaaaaaaaaaaaaaaaaaaaaagaaugcagacgcuuagccgggccgugguggcauacgccuuuaagcccagcacuugggaggcagaggcaggcggauuucugaguucgaggccagccuggucuacaaagugaguuucaggacagccaggucuacacagagaaacccugucucgaaaaaaacaaaacaaaacaaugcagacacuaauuucagagacggagacgcaggcuggguucuucaucuucuuuuaaauaaacaaaacaccccacauuuuacuuacuaauuucauggaggaguugaauggggguuccugccacagcgagcguguggaagucagcagacagcuugugaggagucccagggcuagaacuuagggugucaggcuuagagacauucccccuuaacggcugcucuaucucauuggccccuggguucuucucaugaagcaaaacucggaauauauauauauauauauaucuacuacagcuuaagcaaggacauugagagacgcuucagaaaggacagcaguacccagaggacaaaguucagcugucucaaggcagaagagcaagcauaaggaaguugaaguugguguuuucugugcguuugaaguuacacuguuuaaaagacaggugaagggaggugcagguaguggcucacaaccuguaagccugaagucuaacgacacugugacuggcuauaaccuggaaucaaggcacuuaggagacagagggaggaggaucaggaguucaagacugucguugucuacauagggaccuugaagccagcuuguuucaaaaauguaacaaugguuggacgggagaggugacucagugguuaagagcacuuguuuuuuguuuguuuguuuguuuguuuguugucuuuuguuuagucggcagaucugcaacuucauucggcauucagcagguuaguucucauccacaccgaccuucuauagauuucugaaugugguaccagguagguaaguuaacaguuuguagaauuuguuuggugaguccccauccucauuauguuuucuggacaaacguacaugaauauaugauggagcauugagcccggcaucaguguaaacaucuggaguucccauuuccuucauggcaaaugucccaaggggcacgcuccuugaagccuacuucggugugugugcuugagaaugcuaauggcgcauucucuggucaucacuucuuuuauggcagaauggcucuucugcucgccgcuuuucuuugugggaaccauuuugccaggccaaguucaagaacacucauucuugcagaggacuugcauucaauuuccagcacccacuuugugacucacagacaccuguaacucucgucccaguaaauccaagguccucuacagaccucugauggcaugagacaugcauguccuguacauacauauagacauaaauacauaccguugagauauaaauucacauuaaauaauaaauaauuuuucauuaaaguaauaauagcaaguaagauuaagucuguagguguagguggggaaugcuccaauagaauugcucauggagauuaggaacacagaagagccuggugccucauuccaagccagaagcugcaaauguggaaauucuuaaacccauuauuaugcacucacugauaaguggauauuaguccagaaacuuagaauucucaagaugcaauuugccaaacacaagaaaaucaaaaagaaggaagaccaacauguggauacuucauuccuccuuagaauagggaaaaaaaauacccauggaaggaguuacagagacaaaguuuggaucugagacaaaagaauggaccauccagagacugccccaccuggggauccauccuauaaucaggcaccaaacccagacauuauggcauaugccagcaugauuuugcggaaaggacccugauauagcugucucucgugaggcuaggccagugccugguaaauacaaaaguggauguucauagucaucuauuggauggaacacagggcccccaauggaggugcuagagaaaauauccaaggagcugaacgggucugcaacccuauagguggaacaacaauaugaacuaaccaguaccccagagcucgugucucuagcugcauauguaccagaagauggccuagucggccaucauugggaagagaggccccuuagucuugcaaacuuuauaugccccaguacaggggaacgccagggccaagaaguaggauuggguggguaagggagcaggauggggggaggguauaggggacuuucgggauagcauuuaaaauguaaaugaagaaaauauuuaauaaaaaaauuggaaaaaagaauaaaggaaaggaggcagacucuccucucuuucucucucucucucucucucucucucucucucucucucucucucucucucucacacacacacacacacacacacacacacacacacacacacacagauagagagauagauagauagguagauaacaccugauaagauagugcuuggggaagcuugacaguugccacggucccuagacucucaacuaucacgaggaauaaaagugguagaaucucugccucaccaccacagugugucaaggaugcauaacugugguaaacugagaagaaucaaggcuugagcugggauccuggaauccugcccaagaccaucagagaugucauucgcaggacacauagacaacgucagcaagauacaagaauugagucccucugaaggcgcucccaaagagcaucaccguuugucuucaagcguggugaccuaacuggggaaagagggaggcccggaagcaagaacagcuauagaaggcaagaggauacaaaaggaaaccauggacucucuucuccucagcuggacuguugggaagagaaauauuucaauuauuugugagacugacauuuuaaacagaacuagacuuuuagaaucccugaaguagcuaggauuuuuuuuccagcuucacacaaggcagagucaucuggaaagaagaaccuugauugagaaaaugccccgugacauuggccuguaggcaagccugugggcauuuucuuaguuaaugauuacuguagcaaggcccagaucgcugugaacugagccacccugggaaggugggccuggguuuuacaguaaaguaggcuggauaggcuauggagggcgaaccaggaagcagugcucucauaucccaucuguuaccauaccugccuccugguuccugccuugaguucuuguucuguccucagugaugggcuaggaugaagacaagcacaucaaaugaacccuuuccuccugaguuccuucugggcagcauuuuaucacagcuaaggaaguaaaguaauacuugaagguaaggggggggguggggaguaaaacagaggccaggugugauggcucaguucuugaaucccagcacucgggaggcagaggcagguggaucucugugaguuuaaggccaagcugaucuauagagcgaguccaggacauccaggacuacagagaaaccuugucuuaaaaagccaaaaagaaaggaaggaagaaaggaagggagggagggagggagggagggaggaaggaaggagagggggcagagaacaccaccuaauaucaacagauguguguaacugaaggcagcaggcaagaaacuuaauuucaaugaccugguuacaaaaucauaggcuauucuucaggcuuccuaacuuuaacucucuuacuggaccuauuugcuacaccguaaccaaccuagcaagcagguuacaucaaggaagcuuaucucuaagggacccaguugaaaaaagauacuuuguaauuuuaauacaauuacuaucgguguucuugaauuagcugggguugaaggugaagaacagugaccaggaagugggucauagagcuugaggugugagcaaugcgauuaaaguguccuuaagcuaauagaaagacuucgaugugccugaccaccuuuuaauucacgugcaacacuggggaaaaaaaugacacugugucaagcuacaaagaaaauaccaacagauuccgaaagggaacauuagucacuuuccuccuugcugugaugugaugguaaggguuucuuugggcucacaguuugaggguacagcucaaagagcucgggagggugugguaacaggaaccaggaggcuccuggucucgcauucacagucaggaagcaaagagaaacauauguuccugcucggguggcuuucucccgucaugcccuccaggagcccauccacggaguggugagacccacccuucuggugggucuuccuaucucaauuaacccaaucuagagccucccucucagacauacccaguggauucucucuuccuuaauucuauaucucaucagguucaucaucucaacagugcauggcaaaacagcauucucagaacauagcacaauaaaacucaacagcaguaauaaaaagacccaagcaagccaggcagccacacgccuuuauucucagcacuccagaggcagaggcagaaccaaguggaucucugugaguucgaggccaaccugaucuacauaaugaguuccaggacagcuugagcuaaaucuggagaugcuaccuuaaaaugaaaugaacaagcaaacaaacaaaaauacccuuuugauuggugcggaccuguaaucucagcuacaggggaggaggagggcaagagaggaggaucauaauacaaggucuacuuuggugguagagugaguucaaagcuagccugggcaacuuaguaagauccugucucaaaauaaagagagaagugagugcuagggauguggcuuguuguuagcauacucacucaucuagcucuugggaagcccugggcuucuaucacaaugucacugaagcaagcaagcaacaguaaacccgaaucuacaaaaccuaugcgcuaaagaaacaggacuggagagauuggucagcggcuaagagcacugccugcucuuucagaugauccggguuagguuagagucccagcacccacuuuguuugugucucauaacaaucuguagcucuaguuccagggaucucacaucuucuucuagccugcacacacaagacacacaugcaguacacaaauacaugcagguaaaauacccauacacaugaaauaaaaauaaauagguuguauuaaagaauaauuacaauuuacauuuuaauaauuuuuaaaauaaauuaauuuuuuuuuauuuaaagaaaagaaaucauuccgguuucugaucuggagugucaggagugggugugcugacuuuucuuggugucuuggccagacaucugacaaggaacaacuugaagcucccaaguuuaagaggguacagcugacuguggaaaagggacagcacgguccacagcagcaggagcuggagccagggacuccuuacaucaaaaagcagugagaguuaaucccagcacucgggaggcagaggcagguggacuucugaguucgaggccagccuggucuacaaagugaguuccaggacagccagggcuacacagagaaacccugucuugaaaaaccaaaaaaaaaaaaaaaaaaaaucagagagaugacucagcaguuaagggccuggacuuuucuuccagaggacacgcauggguugaauuccuaacaugcauauaguggcucaaaacugcccgagaaugcucuguuccaggcaauccaaucaguucucucuucaggcaccaaucauacacacaguacagacagacagaccugcgggggggugggggggaacacccauacacuuaaaauuaaacaaaacaaaaagaauucuaaagcagggagcaagcaguguuggcgcuccauggugucugccuuuaucaucaucaccaucaccaccaccaccaccaucaucaccaacaucaccauucagugaagcacuucaggcccuugugauggcaggacuagcauuuggagugaucuucuccucaaacuucuugggaacuacccucucagacugugcaggguugugucuccuaggugacuggauuuaagucaagggccaguagguaagagggcuugccaccaagccugacaaccugaauuuaauucccugauccauaggauagacagugagaaucaauucucaaagguuuuccucuaaccuucauaugugcacggugauacacacaugcacacacacacacacacacacacacacacacacacacacacacaccaccuacagaagcuaccuuugaguacaauuaacucaguagguauaauaugggccaagaggaaaaacuucugagcuugaaaaugucaacagaaaauuuccaaaguaaacauuaaaguaagacaaauagacugagaagaagcggaccgacuauucaagagugcagaggcagcuauggaagugcuaagagacaggaaguagugaugcgaggcagcuauggaagugcuaagagacaggaaguagugaugcuuugggaaaaagacagacaggagcacacgacauguugaggccguaaugacugaggaugucaccuaaaucaaggucaggcaucccaucacagaugaagcuaagaggacacugagcaaaauaaaugaugacgaagaagcaaaucuaucaggacaccuuaguugaauuguacucaaucaaaaaguauaugaagaagcuuagucagguuucuuuuuaaagauuuauuuauuuaugauacguaaguacacuguagcugucuucagacgcaccagaagacggugucagaucucauuacaggugguugugagccaccgugugguugcugggauuugaacucaggaccuuuggaagaucgguuauugcucuuacccacugagccaucucucucgccauuggucaggguuucuauuccugcacaaacaucaugaccaagaagcaaguggggaggaaaggguuuauucagcuuacacuuccacauugcuguucaucaccaaagaaagucaggacuggaacucaagcaggucaggaagcaggagcugaugcagagaccauggagggauguuacuuacggucuuaguucccuggcuucuugcuggcaaaauaagcacaugguuguauaagagucugucuuaggguuuuagugcuguuaacagacaccaugagcugggcagugguggcacaugccuuuaaauccagcacucgggaggcagaggcagguagauuuuugaguuugaguacagccuggucuacaaagugaguuccaggacagccagggcuauacagagaaacccugucucgaaaaaccaaaauccaaaacaaaaaaaaaaaaaacaaaaaaccaaccaaacaaacaaauaaacaaaaauaaauaaacaaaaaacaccaccaacaaaaacagagguucaguccauuaucaccaaggugggaacauggcaacaucuuaagcagguauggugcaggaggagcuuugaguucuacaguuucaucucaaggcuccuaguggaugccuguucccaggcaacuaggaaaagggucucaaagccaauacccacaaggccacaccucccaacagugccacucccaggaccaagcauagacaaaccaucacaggaaggcaacaauagagcaacaggaggaaagagcuugcuagagcuacagaagagccaucuucagcucauagccagcuucuuggagggucaggcaaagggguguggagugaaaugucuaaaguggugaacagggaacauacaaggcaguucugugccuugcaaaaccaucccuccaaacccagagagacagacuuccugauuuuaucgagauucucuccgcuccccugucuauuucucuuuucugagaaucuggguauuaugcagcuuguauuuuuuuuuuuugauuuuuuuuucuccauucagguuaaaaaaguuuuuuggaggccuggagaugacucaguggguaaagaaagucaugugucaguggaaagggagacucaguuccuaaagguuguccccuguccucugcauacacaugaaaauagaggugugcuuggacucacaaacaccccccccccuccaacccuccuuuccucccucuuuaugagaacgcuuuuuauugucagauguguuuggacuuauagaagcaucauaaaacugguaccaaauaaaucccucugugucauucagccagauuuguuuauuacauauuauauaacccaagaagaauaaucaaaacuaaaggcuaauacugauauaaaucaaaucuuuuacacuucgauuuucauuuuuccaucaacauuguuggggggggauagucaauccagaauuuguaucccuucuaguucucaugcuccuaucuccuucccaucugugagauuucuguuuauaacucaacauuuuuugaggagugccgggaguucuuuugcagaauguccuuccagcugggcuucucuacgguuuacguaaguagauugaaugugugugucugugugaguggaaaggacaaaugaguugcccuucacuacagaacgcugugaagaugugugucacucaguguagccucgccuauguguuucagguagguccugccaggagaaacugcagucuccugcuuuguaaguaacacauaauggggauggagugauaguuugagccugugucaauauccuguuccuuguagacauucacccaugcacuuagcugccauuugcgggcuuuuccugcaaccaggguuuuauuuuagagaugaaucugcccuguuguucauccuucauaaacucacucccugaaauucccaaagaagguggaaucugucccuggacuacuuaauauuuucuccccuccauugcuagggaucuaacacacagccuaaugcaaaucugguuguuuccacaauggugcauuggaacaugccuaccuaccuuacuggauuguagaaauuaucacuuuugcccacucccaaauggucuuaaaacucucuaauugcuaucuuaugccucuccucaguucauaccuuuuuguucaguccuagcauuuuuaaaaaugaaaggcauggagcugcaugauaagguuuuuuuuuaauuuauuuaaucccagaaaauauugcuucauaguuaguguugaauuucucacuuucuauucuuuacaguauuucauauuucuagcuuuauuauuggugaggggcagaggcacaguggcacaucagccucagccauuuguguucuuuuucuaguguuacacacacacacacacacacacacacacacacacacacacacacacgcacacacacacacacacacacacacacacacacacacacacacacacgaguauuuugcccacaucuguacguccacaugcauggauuauccucugaguucagaagccagaauacccugaaacugaaguuacagaggguuguuagcuggcuugugggugcuggggacggaaccuguguccucuggaagagccgaguuuuaacugcugacccgucucuccagcccucaauucacuuugauuacacaaaguucuacuucauuuaggauuugcguacuuguagugccuuuacuucacuaaguuauuuccccaaaucuguugcuuuugcucuuaagugaacaugguuccagggaacgccucucuucucaggauguccagaggccaauucguucgcuccaagaggacagguugaaguccugaaugggugggguccacaguccaccucuucccucuggggagugugaugccgcuguacaccaggccagugagagugaagcagaguccgggacaagcaggauccagguccaguugggagcaaguaugccuguguguguugggggcggggggugggguggggugcuucuccaaggaucuuaguguuaaaguccuuuuagucgaaggucugcucugaccauccuuaaugaagcagcucucugagacaaucuuagcuuguuuuuauuuuuuauuggggguggguuugaacacauacacuguuuuucagggugcaccaagaguucuauaguuuuggggaagagcauggacauaguucggggaaggaaaaggucacgggcugaaggcuaaggcuccugagaugucucauuugcaaagggaagaauuccaggugcugugcugcaugacugcuugugaccaccugguugggguucucugggguaugugcucacccaaaggcaggugcagaaacagcgagggagcugguucucuccugccauucuuaaguuuugagauuucugggguuugaacaugccccauuucacuauuuccaugacaauuccucuuguggcacacuccacgugccccacaaaugaaugucccugucuuuuuuucuagauaauuuacuaguuuuugucuacuugcuuuacauuuuuucucugcuauucaucacaaugucucaagguguugaaaauuuccccuuucucuuugagcuucagguggauuuacuuaaucuguauuuuauguaaauucuauuuaaaaaauaaaaaaugugcccuuuucucuaaaauuucaaaagucuuuuugcuucauucccacauuuuuuaagagucuaaguccaaucaguaaagaaucacacaguggguuacauuuggaguauaauguaaaaauuaacuaauaugugguaauaaaaggaaauugcauguguccucaggcugcagaagaguauccaaguaucuaagugugcaaacuugaaaauggagacucagauuccuucaguggugcugagucuagucuguuagguagcaaacaaaacaaaacaaacaaaaacaaaacuaugcauuuagccagguaggucucgggacaagucuggaguuccuauaccagggacagagccccugguagauuagaagcaggggagcaguugaucacaacuggcaauguaggccugcugcaggaguccaaggggcucauuaagccugcacagaagcuugcagagggagcagagccuguagauccuuugggcacagucaguaugcauguauuacauugaugcucacagauagcuuuagaacuuugggugcccaggcaacaagcagcucuguguaggccaugcaaaaacuugucaaagcgguacagaaaggguaucuacagccagggcuacaaggguuccuacauagacuuuugcuggcuucagacuucccccagccaacucucagccccacaccagaaauuucuagagaauccuguuccugcagucuuuuuccaauauauauauuuauguaugugaacacacuguagcucuuuucagacucacccaaagagggcgucagaucccauuacagaugguugugagucacuaugugguugcugggaauugaacucaggacaucuggaagagcagucugugcucuuaaacgcugagccaucucuccagcccuccuauauucuuugaggaagucuaaccuuacacaccaacuuuaacaaacaagcucuuaaaggaauuugguacuccuaauuauauuggacuauguaaauaaaauaucuuggaagauauuguuggcugcaggcaggaaacugaacucaagccagcacucucugaguucaagggcuagccugaucuacauagugaguuucaggauagccaaggccacauagagagauccugucucaaaauaaaaagguggaagaaccauuauuuauaucuucacguuccuuaacgcuuuucuucauuucuuguacuauagucagaauuccuucuuuauauauugacauucucaugccuuagugaacuaugcuuaacaggccauuaaacuuauuuucuaagacuaauuauucaauuuuuuaaccgguaguuaguuuuaaccuguaguuuuuaguuuguaguuuuuauuagcauuauacuugcauuuugcucauuauuucuauauuugucuugagaaugucgaugacugugcauguguguagaggcacguguaugcaaaugcacacaugcaugcgugucagcaggccaaaagacagccuuaggugguguucacucucaggagccacuucuuuauuaagaaagggaccuugggacuugcugacuuaugguuagcaaguuccagggacccacucaacagucuccaguucccuagcacugagauuacaagcguguuccagccccuuacaugugugcugggaauugaacucagauggcaaacacuugacugaucucccuagcccucugguuauaguuuaaguucuucauacauaucauaaugguuaggugguaagauuauagaagaugaauaucucuguuuauaucuuaauuucugccauucaaugaguauuagccucuuuuuucucaagcguuuacuuucaaaauauagggucagugauacaaucauaucauaaucaucggacaagugacuagauuuuaaguugacuuacagggcuggagagauggcucagugguuaagagcauuuguugcucucacagaagaccugggcucagcucuaagcacccauguggugggcucacagucauccuauuuccaguuccaagggagagcugaugcucuuuucugacaucaggcacauguguggaacauauaccugauaugcaaauauucauacacaaaaauuaaaauauuuuuaaaaugaaguuuucagaugucauauguaaagaauucauaacagaaccuggaaacuaaaauaauauuguuuaucuauccuuugcgcugauacauuuuaaaagugagauugauauacacguaaccacuuaagauuauacagguuauauuuuaguguauucaaaauguuccauagccauuacuuaggacauuuucauuaugcacaaaggagacuccuguucucaguaggcaaucacuucccgcucuuucuuggugcugagcacacaucagcaugcaauuuuuguagauuuaacuauucugauuguucauauaauauggugucuuuauguuuaguuuucuuaaugauuuuaaauuuuacacacauucuaguauguauaacuaagaaauuauuaaaaauauaaaacucaaauuuguucauguuucugucuuucaaguuaugacaaaugcacauaugaacauuaauuccuauggacuuaaaugcuuguuucauuacccuuguauacguaucuagagauuccuaauaugaggcaagagcugugcaacuuaagcuguauccugggccuguuauugagaaaucaccaaaccccuuucacaggcaucgaaccuguuaaguuccuaugagaaaagcccaaguuuuuggucuccaaaucugcagcacuauucucuacuuaaaaauaaauaaauaaauaaauaaauaaauaaauaaauaaauaaauaaauaaauaaauguuguugggcagugguggugcaugccuuaaucccagcacuugggaggcagaggcaagcagauuucugaguucaaguccagccuggucuacagagugaguuccaggacagccaggucuacuacagagagauaccuugucuugaaaaacaaaaaauugugugugaauguuuuccugccuguuugugugccacauagaauuaggguuugauuccagaaggcaugagaucucuugggacuaguuauauagccuguuguguggugcagggaaucaaaccugcuuccccuccaagagcagucaagaguucuuaacuggugaggcuuuccaaccccacaacuacccuaaucaguacaaaguaauaccucauugugauuuuauugccacuucacugauaauguucagucuuuucaugacugcuggcuaucuguacuuuucuuuucuuuucuuuuuuuuacaaauccuuuauguuuuuggaucuuagauccaaaugugcacaguuuugcuauauaauguggauugaccagaaaugcaugguuccucauuucuauuucaagaccuaugcuuuuucccuccaauaaaccauuuugguuaguguaguagcuucugcugagucgugaaaacucaaguuugaaucuucugccuuugacagaaauaauacugagucuaaauugcuuuaagcauauuaccucaacacuauaaauuuaauacacaaacacaagaguuccaccuuuaaagcauaaauuuucauuuucagugugcaacuuuugcacaccuuugauaacuuauucucaaauauuuuuugaagucauuguaauuccuaacguuucacuuguuacacuuuuuguauccuauaacauuaacuaggugguaugugaauucucuucaaaguucucaugucaguuagaaaguuuaacaucuucccauuucaaauuagaauuucuuauguggauguguaaaugccguacuuggacaaguagucacugaagccagaaguccucaaaguuggugcuugagagcgaucaucaugguugcuugaucuuuguuuuaaauuuugugugggcuccagaaugcuccuagagccccgagggaucuugcuauguaaacaaagcuggcuucaaauuugugacggucccaccucugccucccaacugcuaagauuuacaagugugcacaacggagucauuucuuucagaugacagucucaaaauguuuuacaaaauugucaaguuuguaauuauuuguacuacuaauaaaaaguagucuaugcugugauuucauuuacaguacucuagagcugagacucaaacugagucagaaucccccaaguaaguaugggggcuacaaacaagaucaaucguaaacuuuuacaaaaacacagcaaccaaaagcaagcaguccagagccaagccugcaagaaaccuggguguuuuuggcagagugcccuccugagugagucacuuuguaccucacacugguucugugcaacaugcacugcauacagcaguccacacaaccagcaaguaguugcuuuauaaacuuuggucuacuguucaguuuucuacucuuacagguuacucuagaccacuucuuucucagacagcaccacaggaacccgggcgggaacuuuccuaccacgacucagcagguaaucaucaauucagccugugcuguuucucuuaaaaauuggcuucacuugccaacugcuuuaaaaacugcugaggaaauucggcuugagauuagggcaaacuuucccaaaaguugugaaaugaaccuaaauagacuuaugcuauuguuuaucuuguauuuauggauaucaucucacugccaaugaccugaaauuaaaaaccuuaacgcuaagaaaacaccgaagaugcuuuacaucuuguaacaauacccaagcaagacucaugcaaaagaacaguuaaaaugaaguuauguuugcuuuguacacauacauacucagaauaaaaaacgggggaugagaauaagcccuauuguagaaauuaaaagauuguaaccauaaacugucaucuguguauaaaacuaccuaaaaauauccaaagcacucaauacaaagguagacaaaaccugcccuccagaauguugguuaggguccauuccagaauggacccuaaccaacauuaaguaugcauuacacacagggcaguaaccccaaugcauuccguaguugauaaaaugcucaagaaaugccacucugacauuagagauauaccauaagggaaaaaagccacauagcaugugguguaaaacuaccaucugucuacacauagaggaagccaacuaugugucugcaggaccaaggugaacucaaccagaauagugauggaggugggacagagagauacacguuaaaauuuaugugauacuacagaugcuacugaagaaccacgacuagaaugagcauggugguguauaccuuuaagcauaggaaggggcagguaugucacagaguuugaggucagccuggucuacauuaagugaacuccaggcugucucaaaucaacaaaaaccauggcauggcacaccauuagucaaaacuaugcaugugagacuacaauucaaaauuuugaaauagcacuuuauaucacauuguuagaaugguuuauggcagaacuuagaauaauaauugauuagaaaggaagucaagauggcuguuuuuggaucagugcaacgaguacuuacauuugaggccuaagaggcaguuuugacuccagagaauuuagacagccagguauaugacaacaggaacccaagugaacagccaaagcagcaagggcauagaauguacuuguuuuuaugugacacaguccaaucugauugugguaaauuauaaauuagaacaaaaaaauugaauaaaaaacuggcagaaacggugucugagaaucaaagaaugcccuuaaaaacaaagcuaaaguccaaguagcaagaaacaggacauaugguggccagacucccauuuuccuugucuaagaaacacugcacuuuagaacauuugcugcugccaaaagccauuuccaaauuuuaccacugauuuuucucacuauacugggcaaacuauuuuacuaugugcuuuacaauuaacucagaacacuagcauucuucaaaccucaacuuauacugugagaaccucuacaguuccaaguauauauagccagucacaaacuuuucaaucauuuguuggucuuuacaagcuacuaggcuccacauuucaguuuuucaaucagacaguuggagcaggacccacuggcuuguguucuaaaugaucaaaaaugaccauggcucugaguaacuuugaaaaccaccauacuuaauucuccuuacaccaguuuaugacaccugcuucaaugcuauauucacauacgguauuaaauucaagugcagacuucaugguagcuggaauuacugaguaagaccaaaguguguuuaaacacagacuuuaaugguaacaauuccuuuaagcucaauuaacuuuagcuauuacaagucuuaugcagaugucacuauuaagacauuuagugacuugcauuggguuccucauaaaauaggagacaaauucacuuaaaaguguaaccaacagucauugaacaguuuuguuaugugaacacaaaacaugacuaauuuuaguauuacccaccccccaaaucacgaacacagcaugaucagugucuuaagaauacuucaacuaacccaguaaauaaaaagugaguguuucacuaccccugagaccacuaguuaaccgugguucauacuuuuaaaugugaguacacccacacaaggaaacaaucuauaaucaguuaaaaaaaaaucugauuaucacauugcaaaccugcccaagaaaaaaucaaaaggaaauucaccauugacaggccaacuggacucuaaagacauguuuaaauuuaggaauuuaugcauuaagagguauaggacacacaaauacucuacaacaauauucaaccuaauacucacuuuaguccuauacccagcacuagugaugccacacacuacugggaaggguagagagcaaauucuuagauucuuuuaaaaaccucaucauaggugaccucaaguccaguccagugucuauacauucagaauguugguuuuccagguacucuguucucuuaaaccuggagaagccucuauggcuuauucccuuagaagcgacauaugaaauguuguauaaagcaucaagucaaagauaaagagaacuggacauacccauuaauucugacaaugguuuaaggacgucaucucuguaaauaccaaaggugguagaugggaggaauuugaaagccaacuagagauccacugcuuuguaaaaauguuugucauaucuggcuuucacgacacaggccuaauaaagcuguuuugaguacaggucucagaaaggacuuuuuaagagucaaagaauacuguucuuacccuugugggaacacuugauuugaacccaaaaguuuuauuaauuagcgugacauuaacccugaagaacccacaauuuaagcaaaagguaaaauggguguguggaaaaaaaacuguauagcgaaauugguauuuuccaauguaaauacuuauuacagaauaaagccagaacaucuucagaaggcaugcacuucacuuccaguuuaaagaaccuuaaguaacaaaucauguccaaauuacauauuuaaauguuuauaaaaaauuaagcuuuuacauuuauuucuagcuuuccacaucugugugcggacaaggaauaagauugcacguaaauauaagcagugcaaaauauggaagugaacaucacaugugcuagaaaucaaauacaagacuaagaaagcaauggagaaaucaaagcuagaaaaaggugucaaacuacagguucagaacuugggugaaaaaugguaaugcccuuauuacuacauaagauuuaguggcacagauagcacuugucaaacaauccaauagcauugacuuuuuuauucauucauguuaagucacccgaaaugaucuguugcauuuaaaugcucauuaauguaaauggcugaacaaauccaucucaauggauagucaauaucccacaguuaagucacuucaacacagccucaugacaacucccacaccaaaacaguacuuuauuuuguaaauuuugacccauuauuacucccaaguuuuauauauauauauaucuuuuucagcuguuaaguguacaagaugaagaaaauuuuaguuagaaggggaugcaccuggaaaauaaauuucuuaaacuccauauacacguuucaaaacugcugagucccaaguccauuuaugaacucuagggcugccagaaucaugugcagcguauuaaagcuacacuauuugaauagcuuauuaauucugcauaaaucaggucaagcaaugugucaaccuguaacagacugugcauuuuaacugaacauggcaauauauucacucuuuugaacuuuacaucaucauuugaugucaaacaaugaagcaaaucccaacaguauauacaaaaacagcuuugcauuuacaaaggauuguuucccauacugauuaauccaggcagcuaacucauugguuuaugcaacuuuauugaagaaaaauaaaucaauuacuaggagagcuauuaguugaucacucauccauugacaacucgcaucauuuauucagugcuauauuaaacaguauuggaagauagauuaacuaauagcuccaagccuccuaacaauuuaaaugaaaauuacaaaauguuuugagacccuauuuuggaauacaaaggguguuugacuuccaauuuccauucucuguagaacaagaacaggucauuccuuuauugacaugcauaaaauacaucacauuuucuguucugcugaugcuauaauucaauaccaauucuccagccacaucaguuaugagcauaaaguauaucauguaaccucaaaccucuaacaguggaagguuuaaacaagaacggaugcugcuagaauaaugcugcuuccuuugaugugacagcugagcauccaucucccucccccucagauggcuucuucagcauguuagagcagugaggauugguuuagucucauaaccaaguuagagugaagacauuggccacauaauacacaugcuccaguuuuuaaaaaaauuucugaaucuugggcaacuguucucguguaacuacuuuacaguuucuaaaagcaguuauuguccaaagcuggaagaacuuaagucuucucagaugagcaugugaaugaauggagggagguaaacaaaaaauaaaauuaaaaaagaugaggucugauaggggagcagccggauaagaaaaucaaaaaaggaacaguaauuuaaaguuuauuccagcuauaaugcagguuauucugacuguaagguagcaucacauggcauacuucugaguccauucccgagauauucuguuguaccuguaaacaaacaaauaagcuauuuaaaaaauaaaauuaaagaauuacuaauauuauaaaggcaaggaaaauauuucuauuuuaccuguggauucaucuuacaucaccuguaaugucuaugguuagaauaaaagucaacaagagacagaaauagcaacauuggcauucaaagcaaugggggcaaugagagccauggacguguuaucuuaauaaacacaaguggugcccagauugggaggcuuaacaaagaccucucuccaucaucacuaagguaguauucuaacaagcuuucaaguugguuauaccaugcugacacauuuuuacauuuaaaaaacccuacuguacaguuuaaugauugucagaauaguauguauaugcauagaaaauuagaaauucuggccaaugaaggcuagaacuaugcaacugaaaaauucaaucugaaaccuagagauugagaaguuuguuggguauugagaaaaaaugccuuugaaaccuaggcagaauacauuagaaagaaugauaaaaaagcauuaauuuuuaaaugaaaguuuaguagcagugauugcugcuaauccucacugagaccugcugaaaauaggaagucucuaggagcacaccccauuuuuguuaaaaaagaucaauagauaacucauccgcgacccaggugacuacugaggaagacccaguacugacaaacaccauuccaucccccccacuucauuauagugcgcuaucauacaggcuaacuuaccccaaccaaaaaaagugacaauaccuuaagaaaugaguacauaauaaagaacaggggaaaaccuuuagaagaaauaauaccacuaaguuucaucucaaaccaaguaauggacuucaacuauuugaaacagcucaacauauaaaaaacucucuaccaauucagaauuacggcauuuagaaaacccucuucaaacagccagcauuuuaaaacaaacguguuuugguuuagcauaaaaagagccacaaaauauagcuagcauuaaugcaugcuugucagucaguaaugaacauuuaaguuugugagguuuaagugcuucccuuuauauuucuauuacuaucuuccugguaaaaacccccgaguaaaaccaccacauuccauauaguacugacacaaaauguuuacauuucaacaucaugguaacuuaaugaaggauaaagauacucuuacacuucuucuuacuaaagcuauauaacugcuuugccaugcaagaaucccaagcaguagugaagacagaguauaacuuucaaaaaacagagaucaagcaguuaaguaguuuucagaaaacugccauaucuguuaucuuugguuaguuaauacagugcuuuaaagcaugcagcacucaacugcuggcaguaccauaaauaagcgcaccauagaguacagauccucuuacccuacaacauagcguauuucucuguccacucucuugcuaaccuauuguaccuaauugaauaagcacacuuagcauuaauuauaacauaugaaaguuaaaugguuaagcugaacauaaagauaaaucaaauaguugauaaauuuagaccaaaauuuaaagguuuauuuuauauauauauaaaguauauauauauauauauguagugcacuguagcugucuucagauucacuagaagaaggcaucagaucccauuacagaugguuguaagcuagcaugggguuacugggaauugaacgaaggaccucuggaagagcagccagugcccuuaaccgcugaaucaucucuccagcucuagaccaaaaauuuuacacuagucuuuuuucuuuauguuuggaaaacaaacucagguuuauuuccccaaacugaauaauuaagcaaggcuuuaacacauuagaaaacaaacaucucaagggagcuacucacugucauguaugcuaugagcauauauuuauuuggcagggucucacuaggcagccuagacuaccuucaaacuucuaaugcugcagccuaagccauuaugcugguccuuacugcuuuuaauuauguuuuaguaacuagcuuaugagaaacaaacauaaaaagguacugucacaaauuucagcagaaauaagcucaacucacuaaauaaaacuguuuauagucauucauuaaacaauugcauacuuacuuaucucugucuguuuuauagauccgugcaaucucuggcacuagggggucgucuggguuuggaucacauagcagugaacaaauggauaaaagaacuaaaaggaaaaaaauccaauuucaggugucuggacaagcaaaugauaaaauuuaaaaauguacucuagaccucaucauaauuuuauuauucuauaauaucuccacagaguucuacagaaaauaaguuucuauaauuaacaguauuagaaaugaaagcucugauggcaccaaagucaguaaugauuaggccacaugcaagguggucgucacacgacauccuacuaguuugguucuuuaaaaaaagggggggggggcuauguaagagaggcaucagaauuuaaggauuuucuugguacuuucaggagauacaaaacucuuaguaguauaauagagucaaggcuuggcaaaaaaaccccaccaaaaccaaguaaggggggaaaaauagaaaaaacaagaaaacccagaggcucauucuuuguucuaccuuaggaaagguuucucacaaaaacuacaagagcugcuuuauuuccuggaaucagaagugaaaaccacugucccuagagacugugcaaaugacaucguuaaacagcauaaagucaaaguaacuaucaaagcugcaaacacagugucaaauucaaaugaggggacuaaguaaaauuggagaauauaauaacaacucaggucaguguuucuaaaucugacuugcaagcuuuuaaaucugucaaaaaaaucaaguuaauuuuaagaacaaaacaaaauccccaucaauucagucugcauuuguaaaaaauacaauucagaauuaagaguauaucaugccaggcauuggugguacacgccuuuaaucccagcacuugggaggcagaggacuucugaguuugaggccagccuggucuacagagugaguuccaggacagccagggcuacacagagaaacacugucucgaaaaacaaacaaacaaaaaguacauuccagcagggaaugagaaaaaaacaaaaaaacccagaaaccuggcauuuagauuaugaagcauaugaaaagagaauuaaaaaaaaaaaaaaauccaaagagguuaaaaaauuagucccaagacuguaagcucuuaaaagaguaauuggaaaaugcagccaaauccauguaaagauucaaaaacauuuuaacaagcauacggagaaaugccugugugguguagugugguguggugccgugccuguaaacagaacauacuuguuucacucuguauuuaccaaacucauaaaacauuuugguaaaaagcuaacaauuauuccaaguuuuaaaaauguuacacuucaggauugagccugaaaauaauaguuaacacaaauaccccuaagauuauaauuacuagcauuaaaaacaugacuaauauaaaaacauuaauuacccaagccuauaaauuacuaaaaggcaaucucauccuuaaaauguuuugcguacaauugaauuugcagaguagaaugucaaaaaaagacuugucauucagaauccaaaagaggacaggaggaacuuuccaucugggguauaccuggagaucuagaauguguuagacuuaacaguacaagaucagucuuuacguaacaaucuuuccccaaauucccuaaguauuccacauuuuauuagacacagaaugauuaucauaguuaaguaauacccaacuaaagacagguucaaaaucagauacagaaaaucuacacagaugcuuauuagaguagaaagcuguaaaugcuguaaaccaugccuggcuauauuuuccuauucucaccaaaaagauggcccaacaguuauaggcacauacuauuuguauagaggacaguuuuaguuucccaacucccacucuuggugcccccucacaacuguccuuuaacuacagcuccuggugaucuagcauucucuucuggacuccaaaacaucugcauucacgcgcacauuaccacccacaaacaguuuagcaccaaaauaaguuuauuaaaauuaauuuggaggcugaagcaauaguucaguagguaagagcucaggcuaaacaaaaagaccugaguucaaauccccgccgcccaugaaaagcugugcgugcuugaacccuagcauuggugguaaagucaggcagacacugagaguuacuaagaacuucugguuuaaugacagaaccuagccaagugaaauaaaaguauacaagaggaguuuaaugacagaaccuagccaagugaaauaaaaguauacaagaggaagauaccucuggcuucugauauauuacacuaaaaauaaacugccauuaugugaaaaaaaaacucacuaggaaaaugcccuaccaacauauuuuuaacuuuagacaaaaaucccuuuaaaauuuauuuucccugaugaaguaucaacccaaaacacccaaacccacuaacuuuuuuuuccuuuuuaaaagaucucagucuagccucagacucacucagauuaaccaaggacgaucuugacuucagauccucccgccccuauucccaaaagugccauuguuuaggcaugugccacaccugauuuauagaacacugggggugggguggggggugagugggagaagauugaacagugagcuuugugcaugcuaggcaagcauguuauacugagauacauccccaaucuugcaagcaacuuuuuuuuuuuaaaagauuuauuuauuuauuauauguaaguacacuguagcuguagucagacgcaccagaagagggcaucagaucucuguuacaggugguugugagccaccaugugguugcugggauuugaacuucggaccuuuggaagagcagucgggugcuuacccccugagccaucucaccagcccgcaagcaacuuuuaauuaaaauguuggcauaauaaagucacaguagcugaaaacuauuauauugaaauuaucauuuuaccuuuagaaauaguuaaagcaggagaccacugugaucuuagaauaucaagacaaaugcugccauuacuguuaauauuuggaugauaaauucuuguuguaaaugcaaccuaaaaaaaacaaaucacaugacacaaccuuuagauggcuuuugcaaaugaaaauaaguauacuuuaaaaagcaaggcuuaaaauacuaagucucaccagugaucauaguaaugagagaauauaaggagacaggaaaaugugaucaaagcacgcauaaccauauaaggaaauauuuauauaugggaaauuucaacaaaaucaauuuuagguaauaaaagcuaguuuuaaaaaguuaacaucagccucagcacggaaaaaguaauuaacuucgcuuugaagguuaacucuaguaguauagcuuaacuaucagaaggcaggcaaucugugaaagggaacuuaggacccucaauguaggauacaggcauauauucaaauucuauucccacugcugacacaacaaacugaguauaagcuuuauacccaaaggaacuugacuuucuuacuacacuguacuuuuaacaugacuaaagaggguuagaaaaacaccauaauuuaauacacauuauuuucuagucauucacauaccaugaauuugaacuaauaguucugagagaaaaaaaaaaucaaggacuauacgcucugaacucauuacucugcuuuagccuacagaauaccaggauuaaagguguuguuauagauccagcaacuuaaccuuuaacacuauagucaccuaagugcauuaaaagcaacuagaacauaaggcaaguugacucuacagcuuacuuacuagacuccaauacuuagcuuaagcauggaaauacuugagcuuugcaacuucaaaaaggcaaaucuuuucuacauuacaguguuaaaaucuuuugucuaaucuuagaaguuaggcaugaguaaaguaugugguauacugcuaaacuuagcucuuggaagaugaaagcucuuagaugaaaaaaguuccagaauagucuuuaacaggaguuaucuacauaaaugcagcucauuucucuauguauuacuuauuuuuauucaccaugaauacagggcuuaagcuucaauuauucagaaaccuaaauuuacaugaacauuuuauucuucuaaaacaauccauaaacuaacagauuuuggaaggacaauaauacuugccuuaggugguuugaagggguagucuguaggaaaaugaauugucaaaaagaauacaccaccuugauaugggcugucauucuguaaagagaaaaauaggcuuaauaugucaagauaauuccuuaaaaaaagagauggcuaaaaugccauuuccauacaagccugguaaccugagcucaguccuuaaaaccuauguaaaagguggcaggagaacugacuucaguguuguccuauucacaugucaucacaugcacacacccacacccacacccacagaaugaauaccuauuucaaauaacuaaagcaccuucaagaggcaaaacauaucugaguuuacuuuucaauuggcaccuugaaauucuuucauaaaaccaagaaaacuuuucuucuaaacuuaacacaauguaucauacucuugaaagucaacagcuagaaaacaaaauuucaaauuacuaguguccuuuucuccuuuguucauuacaaugugcacauaaauauucaaccaugcuaacuaauauaaagauuugaaacuacuuucuaugaguuuuaauaaaaacuaaaaugagaaauauacacuauuuccauucuaugaaauaaaggaccaaaagauacagcccauuacagugucuauagaucuauucucugcuuuuaaucugaccccucacauuuuacaguuuccacuuucuucuguacugugucuauuuacuucugagcacauuuucaagccuacuaaaauauacuugucuacuugaugagaugcauucaaaucucaaacuucuaugucaaccccauucuuccuaaaacaaaaauagaggucucauacaugauucuuuuauuuucauuugauucacaguccuaaaggacucaaagaaugucagauuuaguggcuucuuaugccuuccaucuaaggacuuugaaggccgaggcaagagaguuacuaugaguuugaaggcagcuugagguacaagguuguaauuucuaggccagccuuggcaagaugguaaagugaaguuccaucuccaaacacacacaccccuacaccuuaaaauuucuugaacuagcugcuuuuuggccauugcuauuuuaacugugauaguaugaaaugacauaaaaaugugaaguuggaucaauaacucuuuuaaacauaguuuuauuucagauuucauuuauaguugauuauccucuguccauacugacaaauacugaaaugccacagacuaaaguggaaguuauuauuuccaaaucuuuucuugccaacuaccuuucaaauuaaagaaaauuaaccacaugagagacagggaacuuauuucugaugacgugaagcauuaacgggacuacuguuaauauaaugcaaugacccucuuucccacauuuaaaucagauaaccagcacuucuuuaccaauucuuugugguuccaacuaucuuuagaaauuaaaaaaacagcauaccccauaguaacuucaagcauuuaugugugaauuuugaauugauucagagguauuugaguauaauuuaauaaaauucaaguuccccuuuucugaaaauuuaaguaaaauuuaaagaacaaacccaggaaucuccaaacacaaucugaccuaagguaguacuccaaaggaaaacauuuauuauccagauguagcggacaaucugcaacuugugugauguuaucacuucccccacuguuuuaguuuacaacugcaauuucacaaagacaugcuuacgcaaagcacaaguucuuuuuauuauuaguuuagucacuacagugaaaaaguaugaaugaaaugggcacaguacaguaugugacagauacauaagccacuaaaaaggagacagagcuguugucucauuccuaagucugagcaucuagucagaggggcaaguuuccccagcauuaaauuaaaaaugucaaauagucucaguaaacaagucaaugcuuuaacucuaaagaauauauucaacacugacuaaacaaaaaggcacuuuuaaaucaaaagacugaaaacaaagaccuguggccuuugugguuaaagauaaaccaauaccagcccgcuccuaugauuuuuagucuacuuuuaauuucaacauuucacaauuacucgugaaaugcugucagaaucaugaguuacuccuacuauguauuuuauuacaugaguaucucacacucugauaugucaauuaccugccuucccauauuaaaguuccugaaggcuaacagagauugguuuauucauaccuuuauccucaucacacagcaggugcuugcucacuuucauugagcuagaaaaugaguaagguuauuaaaacacguaaggugacucaugcuuguuaauucuaccuuucaggguccucaggugggaggggagcugaaaauuugagaacacccuguauuacagcauuauaacucugucuaaaacaaaacaaaccccaaauaacccagucauuuuuuuaauaaucaagaaaucuaacuaagaugugaauguucaauccugaaauauggguaaccagaaggcugaggaaggaauuuaagacaaacccaaaucuguugucucaaaaaaggucaauccagggcgucugaaauggcuccaugaauaaggugggguuucgggaaagugccacuaagucugacaccaaguucaaucccugugaccuacaccuaagcagagagcugacuuuuccaagugauccccugaucucugugcucauguacaauaaauaacuacaccuaaaaaguuuuauaaaaagucaauuuaagacugggaaguauuuguugauugaacccaucuaacuacuuacuaggucaaacucuuccaaaaauauuuucuuucagaauuauuacuacauaccuaaugacuauuuuuuccuacucucuacauuuacacuauugccccaccccaaaacuuaguaagauacaugugacuuaagagauccuaaaaugcccuuuaaaguuuaaaaaaaaaaaaaaaaacuuacucaagauguuuuagaucagucuaauucucugaaauucuuagaugguuauucauaauccugaauauuuaucuagcacacaguuuaucaaccgaagauagaaaggaauuuugguauaaucaagauauaaaguucucccuaaauaaauuaaaauuuuguauaaaucucuacaucuauaaaaaaaauuaaccaaacgaacacgauuauuguagauucauauuuggcaguuaugaugcuuugaggaacagcccacaguagaauccuuuccucuagauaagcucaauaacugcucuucacugccauaaagaagaaagaccgaggcaaaacaagggauuuuguggaugcagagaugguaccuaccccaggauacaaucagagauacaccauuuaaggaacauuucauuuucuuuacagagcaguguuaguaugucaucagaaacacaguaacuauauauuaaagccaaagggaaaaaaauugugauagagaaugcuggauuuucaaugaaaagcaaaacaaaaaaaagaauacuuacaggucccauaauuguggcuugccaaugaaacacuagaaagcggagggagaacaaaagaaaaacuucauuauuccaaaaacauacaaccuucugaaguuaaguuuuuaaaaagaaacuaagcuacuuacugucaucuccaacuggaccugcagaacauugugcuggagggucacgggccaaaucacuaaguuccuaaaccaagacagaaaacgguagguuauguaauuuaaaauuuaugaaaagauaugcaguuaaauaucaaacuuuuaaaaucucauuuaaagggacaugaaaaccacuaaugaggacaauauaugccaggggggagaaagaaacaagcaaucuuaaauccagcucuuggaauauagaaagaugcuaagccuuauuuguucagacacaugcugagacaaucaccugggcaugcauuuguguuuguaugguuaaacuuuucuuuuugguuuuucaagacaagguuucucuguuuagcccuagcuguccuggaacucacucugaagaccaggcuggccucgaacucagaaauccgccugccucagcuucccaagugcugugauuaaagacaugcacuacaacugccaagcuuaaacuuuaaaaacaaacaaauuuuuaccauacaaaaaugugaucucugaacaaaacaguaucaacaggaugcuuucaaguuuauaaacuuauuaggcaaggcuagaucaacaagucuuuagauaaacuuuucagaccaucuuaaauguucccuugucuguuuucuucucaaaagucuaauuucauuuccaugucacuuaagagcuaaaugcucuuaacauuuuauauucaauuuuccuaaauaagguacgcugcuaacucguuccacauuuaaaaaaaagauuuguuuaauuuuuuauuaauaugaguacucuguagcugucuucagacacaccagaagagugaaucagaccccauuacagaugguugugaaccaccaugugguugcugggaauugaacucaggcccucuggaagagcagagagcagucagugcucuuaaccacuaagccaugucuccagcccccucguuccucauuuuuuaccuauucuuaaaacucaaauuuggaagacaacuuuucuagguagaagauacaauuuucacaauuucauacaaaugcauuuccaacauaugcauuuauguacccaaucauuugaugacauacaaugcauguaacaaguauauaauacuuuguauaaaaaguaguuuaucuuagacuuacauuuacauuuaccucuaugggccaaaucaguaagcgucaucuccuuuuaaugcccugcccccaauauauuuaccauaccuaaguauagaaauagucauuaaaccaaaaaaaggcugaaugcagucauaauuagaaagcaguguguaguuugccucacacaagccacgccaagcaaucuaccaacuaccuacauuuccaguccaaaucaauucuaccugguucgggcucaaucuuccaauauuagcuaguugcccucuuuccuuccaaguagcccaauaauauguauaacauguuuuacuuaauuccugauuguaaaaaauacaaaaaaggauucaccuuggcugguaucaucaacguaucacaucaauucauugaacugaacauauuaaucuuuccucaauaaaguaacaaauucaagaaaacgcuaguaacaccaaagcaguuuuuaauaauguauuuuccagaaagggcaaaaaaugccuauagugcuugcugaucugaucuaauguuuuaaaucccugacaccuuuccccauugccuggaaauucacaauacagcaaaucuccauucuauugguuuaggaggcaaagcauuauuuaagaaguaaguuuugggcuugagaccauccuguuucugaagacaauuacacacacacacacacacacacacacacacacacacacacacacacagagagagagagagagagagagagagaagacugaagcugccaacuagggaaggaauguguuaaaagccuccauguaaaugaugaacuugaaacauaccucauacugaaaauguauccuuaacaguuuuauuucucacauaaccaagcuauuaugauuacagaacaacacacuauacagaaugcauacauguaugccauucuacucaguguucuagaaauccagagacuuucuguuuagcuuaaguacucaauucaguacuaauauucauuuuguauauuuuagauacgacuuauuguauaugauaugauguacaugaauaaaaaaacuccuagauuucaaguauggauacucuauacaugcccuacuguuaaacacuuuaaacccaagaccauauauaguuuuucauccccuugcccccacuugggaggcagaggcagguggauuucugaguuugaggucaccacacccgcucagaauucuuuaacauaugauuaacucuaagacuagcaagccucauuuccuaauccuuuucacacaagcauuccaccccuuaaaggacacaaaguucaaugauacagagguucagacgugagccuuauuagugugaaacuuauucuccaaccucugugaaugaaaauaacacuugcuguuucugcuggcuguaugguaugcaccaaccaggcuugcuacagcaauagccuauggacuaagaaauaagaaaugugauguaauuagaaaugugauaaggcuuaugagucaacacuuauggaaggcaugaugguacaauaauuuuaaucucuuuuucauaauacuaguaguucuauuauuucucuuuaacuguugagauuuuuaugcuuaugugaaagaauggcugauaugucaaacauaucagcaaauacaaauaguauaaugccagacuguacuagauggaaugaaaacaaggcugcugcuuuuucucuuguaacccuggagacagaacccacaacugcuucacauacccaaggcaagcucuuuagcagcuuaccaugagcuauauucucaucccaaacacaaaacugaccauucaagaguaugaaaaaaaaaucucauuuuauuucugugcauguauguguaucugcaugaauugaccuuggcuucuacagaagccagagggcaacagauucucuggaauggcaguuauaggcuguugugaggcaucugauauaggccugggaauggauucuaggccuuguguaagugcucuuaacaccagagucaucucuagucaccaacaauauccuuugaaaugaaggaauuucagaagcacuuuuaaacuguugugguaucaaaaguauaaaaaggcuggagagauggcucggugguuaagagcaccgacugcucuuccgaagguccugaguucaaaucccagcgaccacaugguggcucacaaccauccguaaugagaucugacgcccucuucuggugcaucugaagacagcuacaguguacuuagauauauaauaauaaauaaauucaaaaaaaauuuuaaaaaaagcauauacuaagcaaugcagcaugaaacaugcuuuucccauccuaaugcugaguacaauacagaguaucccaccaaaguccauaagcaauguuguuuauuaccucaguuucaaaagcuuacaugcaaagugacaaaguuccauucagacaaggauuuguguucuuuaaacuguuuuucagucuauucgaaaucuuuaaaacugccacucaacugguacagaaaaauauucaguuuuggaaacuuuuaguaaacugaaaucauuuaugugcacauauguuuguacacaggcaugcguuugugagcuaccauguaaaugcugugaaacaaaaaauucuccugcaaaagcaguguucuuaaccauugaguguaccauccagccccacggugguaacuguucuuauauugugcuuuggaaaagcaacaacaaaagccuuucuuuccuguguuacccagauuggucuccuguguuuaacuaauccuccaccucagcauccugaaaagugacuacaguugcgaccccaauuaaaaauuagguuuuaaauauagcuuuuaaaugccacuaaaaugacucuaguuguuuuuuuuuuuuuuuuccuuuguagcccuggcuguccuggaacucacucuguagaccagguuggccucaaacucagaaauccuccugcaucugccucccaaguucugggauuaaagaugugugccaccaggccuggcuuauuuaauauuaagcaauaguugguugugguggaaaacaugugaucucaguaguaagguuaaaguaggaauaucacuggaaguugaaagcaagcaagacugcaucaagaccugguucauaaaugaauggaucaauucaacaaugaacucauguggaaaguaaggauaacgcuaaaaagauuuuugauguaaaaaaauaaagcaugaagucagaauuaaauaaaucugguuagcaucugggugaaacaggcagguagguagaucccacccaguugaguuaucaggauaugaaaaucuuaguuggggaggacaccccaagauuaggauugguuggcauauaacucugaugauaaaguccaagaauguacucugaaauaacuaaacauuuaagaaaagacuggguacuacccucaaagugacuaaaaagcagcaagcaacagauuuauaaugcuauuaccaaugaaguaaacuggaccauuaaauacuguaagaagaauugcucaagaauggccaacuaagauuuaacuaugcuaacaagucaauucaacagacaagaauuguccugauauacaccuuugccauucugcuucucaaauauagagccagcugcuuauauaguaacuaaacagcaaaagaucccucaaccuacaaucuuaaauccuucaugcacuuugccaugagcauaugccauacuuucuuuuuccuuucuuauauuuuuauauuuuuuauuagguauuuuccucauuuacauuuccaaugcuaucccaaaagucccccauaaccacccccccacucccacuuuuuggcccuggcauuccccuguacuggggcauauaaaguuugcaugaccaaugggccucucuuuccagugaugacugacuaggcccaucuuuccauacuacuuucaacguauucaauaagauaaaauucaccuuacacacuuuagccuuugauuaguuuuacugauauuguauaggggaaacacacaaggggcuagagaaguggccuaguaguucccagcacucaacacuaggcagcucauaacuacaccucuaacuccagauacagggaaccuaaugcccuuuucuggccuugggaggcaaggugcaucucuuuccacaugcacucacccuaaagccuuaaaagaaaaaaaaccuuaaaagaaaaucauaauaguuaaaaauguuaauuaccuuagacaagugaguuauuuuauaggaauauuugacacaagaaaugucucagccuucauaugaacauacagcauuuucuaacaauugcauauaaagaagauauuuugaagccuacgucuaaaaacagaauucagguguuacuucacacauaccagcuaugccaaagguauuuuagugaaucugguugcagaacguuggguguacaaccuucaacaaaaagguauuucccuaagaagucaugaauuuuggacaggucuuuucaaguauuuaaaaaaaacuggacuuugcuguuuuuaaauuaaucaacuaucuaguauuaagcaaauaacuuuuuaaaaugcaucagguuucaagcuggguauagugauaaugccuuuaauucccaggaauggcaaguggaucucuauaaaugaaucucaguuugaggacagagugguucauauagugagucucagacagucagggauacagaauagaaaaacccuaucucaaacaagaaaaaguuaucaagucuuacagaaaaagcuugccaaucccaggaaaacccaaauguuuauuaauuauugccaacaauagcaaacuccauuaccucuacuaaauacucacuguacuuaagacucaaggugguaaaaaacaaaauuuguauacuaccaccaaacccuauggcugguccugucccauaaaauaaggaucugaauuuucaaauacuuaaauauuaccugugcaauacaaauggcaaaaaccauuuaaaaguaagguugggaguaugugcuuucuucaaauguuaucaguuuagaaccuuuuaaacuaccuaaccuagcuaaacuuauuauuuccuauauuguuuccucaauucuaaaacaggauuauuuuuuuugguuuuucgagacaggguuucucuguauagugcuggcuguccuggaacucacuuuguagacuaggcuugucucgaacucaaaaauucgccugccucugccucccgagugcugggauuaaaggagugcaccaccacaccuggcuaggauuaucuuuuuuaaugugaauuuugagaggcgaaaaagacuugaaagggacagcaggcacacaacauauucuaaaagaccauuugcaaaccacccauuuugaagccaagccuugcuaaggcuuuuugauucacuucuuuauuaaacaacaaaacugcuucugcuucauauauauaccaaauaaaauagcccuagcucauguaaauaaaucuucagacuauaugauaaauuuuguuaagcagucuaaaaugucguuuuagaucuuuaaucuaaaauuugaaucaaguguuaaaauguuuugaauguaaaugacauuuggaauaaucaggaaauagcuugaucaaaugccugcuucacaagcaugaggaggacacgaauuaccacuccucacauccaggcauagcgguuaacacuagugcuaagaaaaauauuucuaaaacuugcuggucaguccaucuaaccuaagcaauagggcugaaaaccgcaucaagauggagagagaagagaguaaauugauguugaccucuggucucuuuaacagguaggcauauacacauauauuuuacauauauuuuuauguaaacacaaaaaauuccaguaaugguuggccuaaacaaaauauccaauaaacaacuuuuaaauuaucuuacuuauaaagauggucagaaaauuguaaaguuaacuauaauacaucaaggugccauuugacaaauuuuaugaauaaggaaacuaguuuucuacaugucauuugugaaucaguaagccuuuacaacuucagaagguucagccuuuucuuaacuuuaggcucuuguuauucaaaucauuuucccccuuuaaaauuccuaaacgucuauuucccaaguuuccaugaccaaaagacaucucugcagcaauaaucaguaaguucauauacuaaaaucugcuuuauauucaauacaaacuuuagguugaggauuuaaauaacaaaaagcagcaguaugucucaauuuuaucauuugggagguaaagacggaaggauuaugcucauuuugggauaugugucuccaauuaaguggguggaaaugcuauucuaauccuacuuguguuuuauguaguacucaacaaucauaaucagaucaugcuuuugagauaauaguggcauuugaauucuuaguagguauugauggguaauuaagcaggcauuuaucaaacuaguaagagaaagauggguauuaaagagaaaaacccagguaauggcagggauuuacaaaguauacacagcuuagaaauuuuccuagaagaucaaucacuaauauaguuuaauaaucagagaucaguuaagaaaaaguuuugauuaggacuuuaagagcauccaagcauaucccaaaauuaagcaguuccuggaguuuuaagcauuaacugaauuuguuggaaauauacuagaaguaugcuauuaaaggugauaaucuuaaaucacaucuauuaguuugaucuacaaauauauuuuacuauagaucaaacaaaauacauaacaguguucacaccaucgauugugaauuccccuaaguuguuuacuguuaaaucuucaucacacuguacugagugcagucauacaucuuucugaaguuauauggacuugcaaaagacuauuuuugcaugcauguaugucugugcaccaccugugcgccugguaccuauggaggucagaggagggcauuggauccccgggaagugaaauuaaagaugguugugagccacuauagacacuggaaacagaaccaaagucaagaacagauugccaccucuccaguaccaacucauaugaucuuaaaugaaagcuaauugagacaauaauguauuucacacacagaacauugaaguguguuccuggccaauuauuauauagacuaacgaaaccagaaacauuugucuggcagauauuaguaauugcuaaaggcccuaccaccucuuaggagcacaaaauaaccuaucaguaagaagaaacucuauuaccuauuuggaaagaauuaucuuuuccucaacugcuucuuuugaaacuuggcaaucgcaugguuuaacagggagagcuaagcgcauuuccuccuggcaagcuauuuauuuuucugagagacccacuaagaagccaagaaggccacucuacccuuuuccaauccagaaaagauccuaaaagcucuccauggucuaauucaccucauuagguuaaaaccucacaaaaguauuuaguacugcaacuaacaccacauaucugaacuauauuuuuuguacgcuuaacuuguaagcagcacagcaaaacuuuguauauacuaaacaaaacucugaaaagagcaacagauauaauaauuauauucuuaaagguuauuuuuauuuuguuuuuugugcaugaguguuugcccaaggagaccagaagaguaaguuagaugcccuggaacggagcuauaguugugaacugccacgugggugcuggaacugaauaauccugucuucuauaaagagcagcaagugcucccgacugcucagcuaucucucaaacccucaaauuuuuguucaaaagaauuuuuucugagguauuucugagagaaagcucauagaauuuaaaaggauccuuacccuaaccauuaugggacaggaucucuugacaguucauuguugaaaauaggaaauggcugacagcaagacuuauacuuacauacaauagucugauuuuuuccccccuuuuuaucugauuuuugcaccuuuauuaucucaguaucuuagaugugauugaugggcugugcugucaauaagauaaccaaccuaaaacuauaauaacagcugaccaaauucuuaaaaacacuaaaaaacccaaaggaaaaauacuggaaaaacaauaugaucgguacauucagagcacuuuauaaauagaaauauaagauuugugaaugaagcuguacaauuauaucagguaagccucaauaaagauuccaugucucuaucauaguuuaucucagaccuacgauuuucaaugacaaacauuacuuaugugucauaucaacauagccaaaaggaaagcacuuauuaaagggaagaaucuauuagaaacccugucauuaagaccuaacuccauaaaccuauucaacuuuguacaguucuacuacaacccaaaaggccuaucaaauuuuaaauuuuaauucaauuaauucauuacaaagccaaauucauggauuaaauccuauauagaguguaucacuacugacccagcucuuccuaguaucaguuguuccaaucugacaccaccuuguauuucagcauaucaggauaaaagauaacaaauuuucuaucagaaacuguaauauuuuucaaaguuaauuuccuguuuuuuacuuaguucaguuuuccagaaguaaaccugacuugacuuacaacagaaucaagacagcccuugcuguaauacccagucugaguaacacuacuuaaagacaggaggcaggaauaaaaaaaaccucuaaaaauguugagauuuaaaaaaaccacccucagcuggucauuacaacugcauuacaaacugaauuucuuuuaucaauucuuauaaagaauugauaguuuaguuacuuacauauuuauugauaucauguaccuauuuguugguaucuauuauaucuaugucuacugguauuuacuuauaucccagaaauugauuucugagaaaagucucagaaaugugugguugcuugcaauaaauuucagaagguacuuggcaaaagauucugaucugaacaaacucuacagaauuguagacaaagauucaaaagggauuaucauuuaguuggcacagucuagacagggggaugaaguuugagcaagcccagaaagugacuccacugcaagaagccaaaacacaaaccacaacucacacccccuuuaaacccaguuuguuuguaaucuuuccagaggaaaccugaguuucuuuuauuguauggauuaaaagguagguucugugcacuaugcugccuuacaucacagacaaggcauuagcuuccuguuuaguucuaauuauaggugagacaaguauguuuauuagacaagguucuaagaauggccugagugaauaauacuacaguuuucuuucuuuagaucacccuugaagguaagucacuuaagauuauucaaaacuaggccuagugacaugcaaauuuagcucuacuaaaguuuuaccccagaaaaaucuuuuuguaagcaguuuugaauagaccaagaagaaagcuuuaauccauggaaucaagucaggcauuuaguagauaugaaaaacaaaaacuuagcugucuacugguaguuaauauccauuuguuaagauuaaugugaauaagcauuuccauccugaaacaucuaaacaagaaauacuaagucacaacugagagaaaucaaaacacuuuaggacaaauguagcuaugaaguuaucugaaaggucccuagauaauaaacucacaugucuaaacaagguauaaaauauaaacuuucccccuucuuuacccuacauuaacaagcuugaggacauuuuguuuuguguugcagacaauacauucccaaagugaccuccaauuuauacugccauaccuaaguguaugugucuccacuaguugccugaggaguuuuaaaauuagaauuuaaggcagacuuggcuggacacuuaagagauuaaaugcacucauuaacacuagugaaauuuuaacuaagaucauaagaagcucacaaaacuauucagauacaggguaacagaauuuugauaaaccuuugaaaauaaguuguacaaagcaauaaacauacuguguuugauguauuuuuccaaccaaagcagagauucuugauuucuuaaaugcaauuauaaccccagugaaauaccgauuaaguuaaccccaaagagguuucuuuuucuuuugguuuuugagacagugcuucuucuguuguuuuggaacucacucuguggaccaggcuagccuugaauuuacagagauacacaugccucugucacccugggauuaaaggugugcaccacugcccagcuccaucagaaguuucuaagugcaaguucagaauucucuaaugaacaauuccaugauuauauguuucuagagaugaagaccaaacauuguuguaauccuuaaaaaucuagaaucuucugaaauaaaaaauguaguaaugccaaaaacuuaucuaagcaauagcucuuauauucagcaauagaggaaauuuuuauuaaaaaccacaaagcagcuggauuugguggcauccuguaaucccagaugggagacagaggaagggcugcucuaaauccaaggccaaugcuuugacaauguagucaaaauucaucucagaaaacaaagugcaaaaauaaauuaaaccaauagauaaauauaggccgggacaggaguuccaggcaagccuuuaugugacacacugccucaaaaugcaaucugguaauuuuucuuuucucuuuuagaaagcuauggcugacgagauggcucauggcuuguuaagauacuugcccagaugaaaugacaucugagcucaaucuccagaagccaugguaaagguagggaucugacuacacagauguccucugaaccccacauccaugcaaagugcucccugaaacuaauagcacaccccucacgaauccaauaaagaaaaaauucuuugagaauugauuuggacuuuaacagacacccaaaccuaggaaguaacaaguaaaauuugacaauauaguuaaauuuauacaaguaguuuucaccagugcuaugcaggguauucaacuuaaccuuuaucugcauaacaaacacuggguaagcaugaugaaagauaaggauagugugucacaacugcuuuuaucaaacucaacauugggaucacugaucgucagcagcccucacucaccuaaguauucuuuacaguauaaauaaaccuugggaaccaaauaaaacaaaaacaaaaucaggaccacaggaaaagccuguuagccuauaaaacuuaaaauacuauuuuguuuacuuuaaaagaaucccagcauuuaaccaacacagcaguuucuaguccuuaaggaaacuacacaagacuacauuucauucaucuucauuuauaaauuaguugaaacauaaaaaaaaaaaaaaucagccucauauuuauaugagguagaagacaguauauuucacaaaacauccacauucaucuaguaggaauuuuaaugguccaaaauucagguuuuucuuucuggagaucaucuuauuagaaaucuaucacuaauagugugauugaacaagucaagagucaacuugugucuguuacuucagggaauaucucauauggcugucuugaggccuauuacacaugagaaccuaugcuaggucuuaacuaucacaaaaauccuaagaauaguauaaaagugcaguugucaucagaacaacuuggaauuagauagaaggccugggucuuaaucccaacucgguuacaucaauaccugggcgggguguuuuuuauuuauuuauuuuuugcagucaauuuccuuuauagugaagaugucaacuguaccuauguuuuuacauaagaaaaacuacuuaaagaguuaugaaacauuacaaauacuuaacauaaauuuuuguuugauuguuucaugcuugaucuccaaaguucucaaaauauguaacagucauuuugcuuuguagcagaaaauuucuuaaugcuucaaaaacacagguuuggaauucaguuucuaaaauacccauuuaauaacagcaccauacuacaauuugguccaaauaacaaaugcagcaaaagaauacauguaugguuauuugggcagcuaaaaaauagucaagcaaauacacaaaagaaaaaaacccguaucuaucuauauagaagauaauaaguuucaacuuacaccaguuuaucacuaaagcucacaguuuuauauguaagcacuuuaagaaauacuaaauggcuuguuaauuuaauacuuguuuagggggaacccaaagaauaaauucuaaacagauaauacaaaaaaaaccucaugacagugucuaacuggccccuuauuuuuagagaaguagccuuucaaaaauuaugccagcauuugggugcuuuuuuuuguuuuuuaagcagccucaugauucugacaauaucugaaggaaaaaaacccgauaugcuugaaaucagguugaaucagccauuugguacaucaaguuuucgaauauaagaaaauuuaccugugaaguaucaauacauaauucuuuaaacuuguaaaaucuguuuucccuugccaucccaguauauagaaaaauuccugguauagauuaggcaaauggauaaacuugcuuagagccugauucuaucucauguuauuuuacuacaaauguuuacacuuaaccauuacugccuugcuagagcuuuuaagucauuaaaauggugccagagcagcuggguaucaccuguaaaagaaaaaaaucaguaagaccucccuuuaaaauguucuguuuuacacuuauaagaagcuauagaucugaauuuugauuagcacugaauguuauagucuccauauuaguuaugcugcaaagcacaacaaugcaucucuaaaaagugagguugacccucaaaacugucacacuaagugauaauuuuaauguuaacuucuauuaucuauuugaagucuugaauacuaagguuuucuuucucuuugcauuaucaucaagaauacaaacaguuaaguguuuugcauaaaacuacaaagauuacccagagacagaauuuaagauuucaacaucaauauauacagguuagacuuaacuucaugaacagcuuuuccaaucaaacugaucaaguuauacauacuaaauaacuacaaauaaaguaguauuagauccuaccagucauuuuaaguccuugccuuccuuuccacagaacucuuuaaaaacuguguuacuaagccaaaguuucuaauaccgaaccuucccauuuugucuuuucuauuaagacugaguuuauucugcacaacauuuuuuucaaguuagcuguaaauacuccacccucucgauugugaaagaaccaaauacaaaacacacacacacacacacacacacacacacacacacacgcacagaaacuuagucugagaguuugaauuuagguuaagucuugggggcagaggcugugagagcucccuacaacagaauaaaaaaacguuuaacgcuaacagagaacauuaucuuaaauaguuagaaaaggagaugccggaaagaacccgagccaguuaaagcagccgccaucuuaaaaugcgggauagaaguuagagcaagaaaaugagacuaaaccaccggagagguggauccacucgcaaaauauuucugaaaaaaauucuaguucuugccaacuuaaauugacaacuuaucaaacuauaucgauuugcucaaacaagccuccuuaaagauggguuuuaagcaaaaacagucuccccauccaguuucccugcacugucaacccccacuccccccaggaucuuucagaaggcuuuuacaggguucccagugccucagauaaauagcuucgggugagagcagcgaccacacaacacaggaaguggcaacagugucgguccaccuccucccaacccuacuuacucuuguguaacugcccagauuugguuaagcuucugaacagacuucgucaccacauuuuagcgaacugagguauguuugucauacccagacucucagucaaguuuggaacaaaacguuuuucaucuguuacauuccuuucuuuugaaugccaauaagccuuagcagcuguaauaaguuuugaagaaccaagacuaggaagcagcaccaugacauuagccgagggccuguacacaauucuacuucccaaaccugacucuuaggcaaaaaaccgaggagccuaauagccacgcucccucacccauacuuacagauucuagugaaaaaagcuaacauuucgcuuacccaaaccauucaguucccuaucuuacagcucauuucaaagugcaccugccuuuccuuaacccaagaaaagguauuuucagaauuguauccaccaccagacccacgcuuuuuuuccucugggccccaagccuccuuucuucccacaacccuguccgcaccauuuaguccaaacugcucaccuuauuaauccguuucagcgccauagucugugcuuuucgccgggcuccucacuaucccgagguguacucaaagguccggccaaaauucuugauuaucccggcggcggggaaggguugucucuucuucucacaccggcucugccagacacaggcgccuuuuugcaaaaacggagcaggucagcgacucgccagggccucggagaaacccugcugacuccagaacccugaaaaccgccgcgaucccggcagggcggggcgggguggcggagccaccagcuaccgagauccgcgcuucgccccagagagggcgagagggugacgggaagcgccgagaggugguuacaaguuuaacuucccggccucuugaaaggaagacgagccccgggugggagaggaagaggcggaggagaaaggggugggugcggggcaggguccagagccgggcagaggaggagccggggccuagucggcgcuaggccggcgucacucgggcagagaaaggcaagggggaggggagcgggcggcuccggaccgacgccgggcuccuuucgguuucggcuccaagggacagcgagccagcacaaggcaaugggccccgggugcgcucccguccccacggcgagggcuguucugggucgccccugacaccaccguacucuccgccucgcagcgcgcuccugcgugcgcgcgcccgcccgcucgcucgcccgccaccucgccaccacgcgcccggcggccgcggagcuccggcgcgaggacgcgcccaugcccccucccccugcggccgggccccggcuccgccgccggccucuccccacccuaccccacccagccgcgagggcugcccgcucgggccgcccacagccccccgggcaccgcgccggccccggcccgucucccuccccuuucccgagcuguccacacccacgcguacagagggccggggccucccucgagcugcggccucggccuccuccccgcgcggcagcuggugccuccccggcccuacggggcucacgcgcacggcacagccacaagauguccgcucugacggaacuacugccagcugccacgcuccgccccuccccccgccuauucaccgccgcguauccguccgccaacgccgccgucgcgagcgcggggcgagccgagggguucaggggggagcgguuugcuucccucgcucgggccgaguggacgugccgcccgcuugccgucucccugucggaacagcaccuucucgcuaaagcgaucggaggucgggccgggagggcgggggacggaggcgggucaugggcugagggggaggguaggcgaguggcggaaacccuuaaauucagagaagcaucgagaaccggaaggagaccuuaggaggaagguaauggaagcggcagcugcgcggucgaggccccacgccccucccugaguggccccccguuuccucacuugggauggagguggcggaucucgcgagaaccucguggcaggcucgcagcagcuccgggucugcaaugacuuaagggcaguuuugugcucucuuccuggcucgggacccgcccccaaauccgcaaguuaucgcgagaugcgccggcaacccccccccugggcucuuacugggcgggucuugcgagggaagcaccgccccugagug

SEQ ID NO: 1726 - RNA, 1839 nt, Mus musculus
cgaguuggaggcaggcgcucgcugaggcaagaggagggcacucggcccuuagcccacagagaccggcccgcgcgcgcgaccccacacccacccacucguccaccuacccacuccccgcgccgccuccucccacccugagaagagccaccgaggaugauaaacacccaggacaguaguauuuugccguugaguaacuguacccagcuccagugcugcaaggcacaugguuccagggccucuguggugcuccugaugccccucacccacugucgaagauccccggugggcgagggggcggcagggauccuucucucucagcucuaauauauaaggacgagaagcucacuguaacccaggaccuccccgugaacgaugggaaaccucacaucguccacuuccaguaugaggucacccaggugaaggucucuuccugggaugcaguccuguccagcgagagccuguuuguagaaaucccagauggauuauuagcugaugggagcaaagaaggauuauuaacacugcuagaguuugcugaggagaagaugaaagugaacuacgucuucaucugcuucaggaagagccgggaagacagagcuccacuccugaagacguucagcuucuugggcuuugagauugugcguccaggucaucccuguguccccucucggccagaugugauguuuaugguuuacccccuggaccagaacuugucugaugaggacuaauggucacagaggaugcuuugccuaagagccacagugggagaagaggggauguuaggcagccuugggacagaggagagggucucuggcugucuagggaaggacauugaggggcucagguugaggguugcccauuguguucucggaguugacucguugaaauuguuuuccauaaagaacaguauaagcauauuauucacauguaaucaccaauaguaaaugaagauguuuaugaacuggcauuagaagcuuuuuaaacugcgcugugaugugcuccaucuacccuaggggaggacauugccugcaggggcgggacugccgggcccaggacaggccuggagggcuggugggcaggacugucaggcucaggucuccuuggaguugggcuuucuucuuuugguuuugaagacuuagguauuuucuuucuuugcuucuugucauccaggggcuccugaguauaggcuuuagcuccugggcaguguccuuggguugucuucaacacuccaccuugagcuucuggcauuuugugucuggccugguguaagcaggucugaccuugcuuucuuuacaguuuaguguuauucuggcauuugguuaagcuggcuuaaucuguuuaauguuaccagugcauuuuaaauagggacauugaaacucacucccccacaccagggcuuuuuggggggugccugggccuuaagaaacuagccaaacuacaucucaaguuaccaccagagcucuugccucuguggccuaggccccaggaucucuuuccuugcaagagcagagaggaagaauaccaaacucagggccugggguuugugggggagccuguucuuagcgccuggaugccucuggcuggccaagcacaguacugccugccuccuuaacagauucagaacagugccugcgcugcagagcugagagguagggcuggacugcagaaauggccugccuuuuacugcuuucaccaaacagcuuguucuaaagagaaaagggagagagaucuacacugggugugggggugucagggaggcaaguguguguuguguuacugugucaauaaacugauuuaaaguuguaaaaaaaaaaaaaagaaaagaaaagaaagaaagaagga

SEQ ID NO: 1727 - RNA, 993 nt, Mus musculus
uagcuauaaauuuauucauuaccaagagccacaucccauuaauuuuagguaauuugguaauucccaguagcuucugcugcagccugagauccccucggcuucaugucgaguuguucuccggagagaugagaacucuauuauguacagacgcuccaaagggccaaacaauuuucagagcguucaccagcuuaacugcugcuuagauucuucaugaacccacacuuuaaacugcugccgucuucuggcuuugaguuuaagccucggcagaaacauagaucaugaagacguacaagccagugccucugggcgcuaggaguuucugaagaaucaguugcuguagccuuguuacccugaauaccuuuaaugcaacuauucuggauuauaugucauuaaaauccagccauguuugagucauacaucaugggggagcuacauuuuaauuauuauuguguccaaggaaugggauucuuggcugccuugacggguguggaauccuugguguaacugauuucuugaagacauaauuucuccaaugaguuaguucagccagugaugggcuggcaaggucucaccgcuccuuguucagggugcucgguucauuccagcuuggggcgguggagauggauuauuauugagggggcaguuuucagccuucucaggagaguguacguaaccaucccgcgcaugcgugcugucugcuuuucucugucuucucuuugcuucuccguagugguagacguaguuccgggucugcuccuggagccaggcagaacuggguucuucuagauugguacuucuguuuguagagacuggaauugaaaaaucgacuuuguguagguuguuaguuggacgguuuauccauugggucagucaauuccauuugggaaaaguggcgcagucaguggugcugacgcaguacugaggggcucugaagaaugaguuugaggaaaacauuuacauuuugcugaaaagcagcaugcagagagagagaga

SEQ ID NO: 1728 - RNA, 3306 nt, Mus musculus
uagacuuguauacaugaacuuuccuaggcuuguguaaacuguucagaccaaaccgccucuggucaccuggcccuuaaacagaggagcauugcagaaaaaggggacuccacacggaaggacaagcagugauuugaggccuuccagguuugucuuucuuucuuucuuucuuucuuucuuucuuucuuucuuucuuucuuucuuucuuucuuucuuucuuucuuuuuccuuuucuuuucuuuucuuuucuuuucuguucuuuucuuuucuuuucuuauguuuuaguuucagcaaagauuucuuucacaguuccgucugacuuuauggagacgggcucucuagccaaagcugguguauagcugaguauaacugauucuccugccuccacauccugagucccaggauaacagcugugugucacaaagcccguuuucauaugugaugcuuaugaucacacccgaggcuucaagcaugcuaggcaguguccaacuggacuaagugagcgacggccucagcucuuccguuaugaaucuuaacaugcuuauagguuccuauagaagaacaauuugcuccaacgguccaacaguucuaguuccaacauuuggaugcuggugguuggugagucugaguucagccuaguguguacagcacguugcaagagagccaggccuguguuauggcagcaucccaucgaaguggcaguuuucuuuggcucacacucaggaauaaaaaauggcucugucaugucccugcugccugucaccuccccccgcccccaacccuucuaaccccauugaagcaaugaucucugcugccugucacaaaaucuuggucuuuugccgaaggccauaaaaacagaauaaauuagaucauuuuaguaugggaacuucuggggcuggggcuacuguguucugugacagcucuugcuguagacuccuuucaaggcuguuuguuugcugugggaguuucaaggcuuuuugcugagauagagguggcuucuuacucggcugcuggagacagauuuacuuccuggcagauaacaugggaaugcucuccuucucagguacagcuuaaaaggauugcucagggccaauuuuuaaggugguggugucuauauggaccaaaggccacuguguauacauguguuuaucugggugugacauugcaugguguccucagaucagggccuggaggaacagauuagaaaaugguuggcugagguacugugaguccuaaaauccuuugucacauauccaggauaguccuugccucuugucagccuagauaacaucauagaauacuaaacuaucaauaguuuguguaucaaaucccucaggccaggugguggugguggugcacuucuuuaaucccagcacuugggaggcagaggcaggcagauuucugaguucgaggccagccuggucuacagagugaguuccaggacauccaggacuacacagagaaacccugucuccaaaagcccaaaaaccuaaaaaccccaacccccccccaaaaaaaauucccucagauuuggcacauuuuuaacacuuccugcucugaucucacucauuaugucuuugcacuuaucaauaacauuggccuucaagcacugugauaaaaacaucccacaaauuugauggcuucaaacaacacaauguggggguucagugguuaagaacacuggaugcucuucaguggauuuguguuugauugauucccagcacccacauagcagcucucagccaucgguaacuccaauuccaggguacaugacacccauuucugcucucacaagcaucaggugugcacagggcacacagucauacuuucaggcaaacaacuggacaugaaaaaguaaucuaaaaagcaacaagggagcuuuccugucgcacgggucuggagguuguaauccgaaaugaagaaacuggcacucaggccuaagcucugugcagucucugggcgaacccuuucuaguuucuucauagcuucuugcagcuugucagaaaacacuaacccugaacuuacaagugcauaagcggagugucugcuuccacagucacauggccuucuccaggccugucugcaugcagcuguucuuuuauaaacugauagacuggccuagagggcuaucuuacaacucaccuagauccacauucaccauuuccaaaaggagcacauuccgauauuguaggggguggauauagugaggugucucccagggguacacaauucaaccucagcaagcaguuucgucuguuuguauuuguaggcugaauggacacacuuuccuuaguauaaguuuucugcacgaacacaaguguucauuucucugacguaacuauguagggguugcaguucuugcuggugugguuguuuuuaucugaaacuauuuaauuguauucuagaguguuuuccuaccgagacuauggugaagaucgcaucaaaugugugcugaagagccucugauguuauguggaguuuuuauguguauuugugugugugugcgcuaugcuguuuuucuucuauuuacacaggaccgucgugcugcagcauuguaugggccacauuucuguugcugagacagaaugccuugacagaaaggaacuuaggugagagagggguucuuuuggcuuauaguuccagagggaaaacuguuggucauuacaaggaagguaugacaacaggaacaugggccaacuucucaaucaggaagcagaggucauaugucauuugccuacauaaggaagagagggaaggagggaaggagggagaaaagaaaggaaagaggaagggagggagagagaagaagagggagggagggaggaaaggagggaaggagggaaggagggagggaggaaaggagggaaggagggaaggagggaaguggauccaggcuaaaaaaccucaagucccaucucacccagugauacacauccuccagcaagacuccauuuccaaaauguucuauaaccuugcuaccaacuggagaccaaguguccaagcacaagaccuuguaugggacauuuuauauucagaccacaacaaucuccauugcuuucuguuuuuccagucaccaugauauugaacagcuuuuaauguggacauuuauuuuugugcauaucuuauuugcugucccccacgcccccaaaucucuuaugcauuuaaauuuuguuuguuauugaguuuaggaagauuugcgcuccaaguucucugauagagguacaaucugccaccaguuuucuuccagacuacagcacucuaugaagcaagaggaaacauacuuuuaauaaaauccuguuaauuuguaau

SEQ ID NO: 1729 - RNA, 404 nt, Mus musculus
guuuguuuguuuguuguuuuuugaaaggucaagauuuuauugucuucauaacaaaaucuucuuagaacuggaucacuuggcccuuucucuucuugucgccucccaauucaaaaugcucgcaucuguuaacagccagcauccucuuagaucugcaguugggcucaacgcacuccagucucagcacaaucuucuuuguaguuuuagccuuuuuucggaaauagacuuagucugcccaccagagccacucucuuuccugucauagcgccgcuuucccugggcauacaaagaauccugcccuucuuguacugugucaccuugugggguuggugcuucccacauuucuugcagaaugucuggcgggucucaggcauguucaccauguucgcaggagcgcgagcagcucc

SEQ ID NO: 1730 - RNA, 2606 nt, Mus musculus
guuaugacuacagaugcacuguuuaauuaguaagcagagaauguacuuguugcugagugagaucuaagguaagucccgauuauuaagcaaguuuaaagcuaguuugggauaugaccuuuauugagcuuauccaccagaguggaaacaaugucuguacaaaaccaaaugcuuguuacuauaacuucugcaucacaauuaaaauccaaacaguuuuuuaaaaacagucaacucaaucaaaacccacuacuucagaaucaauagcuucuuugaagccacaguaacacuuaaauaugguuaagacucgaaugcagaaauuugguugguuggaaggcuaauuaagccuccaacuugcucaaauagaauuacaaaaaggcaaaauuguguuuuucacagagauacaguccacuggaaucaccaacacuggacagcuguuaggaauauuuagaguccugagauaauaaggaauccaggcauccuuaaacagucuucuguuguccuuucuucccgaucagcgauuuguggaugugugggaugacaccuaggagagggacacagauuaagucuaccuucuggauaaacauuuaaaaaaacaauacaugaacucaaagcagguaaaauucauauacaaagugaaaacuugagggaugaacaaugaucuuagcaaaaacuaaguggaaagccaaaccccaugaaagcacccuguacugaaaucucuucuagaaacaaugggaguguaggaauuuucuucuuaaauagaauguuaggaguuuagggaugacauaccaccaccagcaaugguagcuuugaucagagaauccaauucuucaucuccacguauagcaagcugcaagugacgaggggugauacgcuuuaccuuuaagucuuuugacgcauuuccugccaacucaaguaccuaaaaggcaaaaaauaaauaaaaaucugaugaucaauauuccaacuuacuuucaaucaagaucuuugaaccucaaugguguuauuuaccaacuguugucauucccuacuaccugaaugauaaaauuaugcagaauuaugcaaaaaaaaaaaaaaaaccacccaaaaaaccccgaaggggcacgcaauugcauuugcaggagcagcacacucuggcccagcagccuccucggcugaacgcgagcucccucuagcgcucccucggucugcgcgccgcucuuagggccugcgaguuuucuugcaucacuuuccuccucucucgccacuuucccccgcccccccagagcuuuuccagaucacaggcguacucccgcuuaccucugcggugagguacuccaggauggcugcgcuguacacagcggcggucgcgcccacacguccguggcugguuguccuagauuucaggugucgaugaauacggcccacagggaacuugauuuuuaugcacacaaacaaacgaacaaacaagaaaaaaaaugcacaaagauaggaaauucguuaagauaagaugugcgcgccaaagccaaggacggugguggugcaccaacgcgccccgccaguuaacacacaugugauccgacgcccccccuccccaaaccccaguauucacugucuccgcagggccaagucgcgacacaucacucaugcuaagauggaacacccauggagggugcagacaaacaagcaaggggggugcaaacauaaaggcccggucacccgacugcggcaguugcuacccaccugcaagccggcucgcugcgagcgggaaaccgccuuugucuuggccuuuccggaguccuuuccagccuuaccgccagccugcggcgccgccgacgcccgcgagcccgggagggacggagaagauagaauuaccaaggcggcgcgccccucccccaccacagcgcguccuggaggcgagcgagcgcgcgcucggccgcccgccgcccgccccgccggggaccccgggccgccgcucgccccccgcccgcccuucucccccgccgaccccugccgcgagcccgccgcggcugcgcgcccccgcgccggcucccagccgcgccgugcgcgcccccccaaccgucgccucccgccuggagcuccggggcuccgaaaacaccuccccuccgcucgucccgaccccguccccgcacgcucccacucgccgccgccgccgccucucccagccccggggacggcggccccgcccgcucggagccugcagcccgcggccgcccgccgucacucuucacguuaccaucucggaccgugcugaagcuccgacgagcgaggaagagacgaggccaggcggacgcucagcgagaucccagcgcccacuccuccgucggaccgcgauucaaacugcgccgucucccgccuuccucgcgcccuuuauacugcagaauguucccucauccgggaacucggccgguucggcccaccaaugguugccucccgcccucgggacgcguccuugaggcuccagccaaugggagaacgcacagcggaguggcggggcgggcgcucgggagcucgagcgaugauuggcgcgugggggaugaguuagggggggaggagaugcggcgggacgaggaccgggagaagaaggggcgccgcggcgggagggcagcaacaga

SEQ ID NO: 1731 - RNA, 42171 nt, Mus musculus
cggguuaccgcgucggcuuuacgguccgccaggcccgggagggacgcggcuggcgccgcugcggccgcggggggcggggaggcggccgugaggaggcggagcugcgaggccgcccgucgccgggccgccgccgcggugcccgcuccuccccgcgccgugccgcgccgugccccgcccggccgccucgccuccuccgcggcgggccccccucgcagcugcgcggccgcggacaccgaggcaggcgcgagccauggagggcaaccgcgacgaggcggagaaaugcgugcagaucgcucgcgaggcccugagcgccggcaaccgcgacaaggcccagcgcuuccuccagaaggccgagaagcuguacccgcugccggccgcgcgcggugagccccggcccccgccgugaccccggcccccgcgcccugcgccccgccggccgcggccgcuccagcacucagggacacaggcggggcgcuguggggugcugggugacggguccccuccccagaucagccuaggccccugugaagugacaggagcggggacuccagcggcuucucgggcuucaccauccccggguucuguaauuuguccguuccuuaagcaaguaucuucgaauaccuuagaugacacugcuuuucccagggaggagagagcccuuacaagacagcuccacuuucgaaagggauggugaaguuauugaugauuccuaaauagugucugguuugauauggcaccguaaguacccgcaaguucgguacaucgcuaaagaguaggcuauggacuuacccuacuuuaauucaccuuauucauugucuaacucuacagucaacacaacacucacaaagcgccacgaguugugccuaguauuuuauaugccccucuuauuccucagaaaaguaccguguuauuugaccaugugcagaaacuuuugccaaaugaaugaaugaaugaaugaaaugaaugaaaauaccuugcccaaggucguauaggaaugggcaaagucauaauaggcacugaguuuuaaucucuacaaggccuuuacuaccguuuuuugguuuugucuuuuuuuuuuuuucccaugcccauaggaugacauuuaacuguuguugaaagaauuuccagguuaagaggauuaagaggaaacuugauaagcagcccccuguuuuaauuuauuguuuucuuaauucuuuuuacaucguugaagccuuuuaucucugcugauuuucacuuuaccuuuuuguuagcauugggacagggcaggaaaagauagugaaagaaaaguuaauuguaaaaagugugaaauaaaaauuaucauuuuuagguguacaguuuaguaguguuaaguauuuucaugcguaccacaggaucgguauuuuuuuguuuuuuaucuuacaccaguuaaguaacccccuguacucuccuguuuccugguagcucccuugcuacuguccauucucauagacuagucuaauuugguaccugaucuaugugaaaucguacagaauuugacuuugcaugucugcauuaucuauuuacuuacuaacuucagauuucauccauauugcaacccgcgacagauuuccuuuuuuaaaauugcugaacaguauucuauuauuuauauacccaugugccuagguguggcugugcacauacacauuuaacaucaccuuuucuuuuuggaggguauuuauuuagcgcguugcgugcaugcgugcgugcagaggaauaggucucuccccacauaguguagagauugagcacaggucuaagcuuugacacuagcugucacaaauucuuacuuagucccugucaaugauguuuggguugcuuccaccucuuuuguguugaguaaugugccuaugagcaugagugucuacaagccugauuucaguucugcauauauacccagaagugggauucuugggucauaugguaauucuaauuuugauuuuugaggaaccagcacauuguuuuuccagcccggcugcaccauuuucguacgauccgcgugguuccagcuucccaaugucuggcagagcguggcagcuccguuuuuuauuugcagugauagucacuagugacuauggggacaggucgcuggcguuuugauaucauuucucugaugauuaaugauguugaacaguuuuucauuuggcgacuuguauuuucuugggagaaaaguccucuaaguuguuugcucauuuaaaaaucaaucuaagcuaguuccaggacagccagggcuacacagagaaacccugucucaaaaaaaccaaccaaccaaccaaccaaccaaaaacccaaucaaccauccaacaaaaucagacuguuguuauggauaucgaguuauaagggcucuuauauauucuggacauuaugucuuugucauuuauauuuuacagagcuuauuuguucuuuuaggucaucucucuacccuggggacugucauuggaggccugaguuuuauguagucgguuucauuugucaaguuuugcuauguugucugggcuuuuuggugccauauucaagaaaucauuagcaggaauuacccguagaucccuuuuacuguguagauauauuuaaaucaguugucuucugcucuuggaaggacacuuuuaauauuaaaguaguaaguacccugggcgaggcaccuuggcuuagaaggccuggcucuucaccaacugcuuuccacgcggucucuaguccuugucguuugugaggcagguacaguguacugauccuggguaugcggaggacuaaacgaguugauauaaagcaucuaaugaaucuuuccuauuuuacaacuccggucaucuaagaauccuuaaaucgugcccagauuuccagcggucacgcuucuacugugcaagcagcuccagugagucugcuaaaggacacugucaaagugcaggguaauuauggcucugaaagucauggguguagggaaggcgaaggcauggaagacagacagucaggggcaacgagauucuaaggggauaaucauccaauaaagugguaggguaccauugugaaguagucuaaaacaguucaaauacagacuuugccaucucuauaagccauucuaagcuuuaauuacaagcaaaauacaagauaacagcaaagaguggaugugacccaaaauuaagcaaugugacucuugugcgaaaaccauauuuuacagaguaucacaggagauguuuaugagaauaauuuaagaacucaagaggggaaaaucuggaauauuuaugaaaagacccuaauaaagaucuuguauaggaggaaauugguacuuucgagugacuugaaguuuuauuccugaauuuuaccuauucuagauguguaccaaacuaauagcucaggaagcugacuggauagguuuuagggucugccuauacucuucauuuccaucguucauuuccauggaugugaugagugggagaccacaagaucaaauuccagccuuucugucaucuuaaaauuucauaucaagugagaaggaaauuugauaaaaccuuucaauaaacuggcaagcucuucucuugagaagacauuugauauugagagggaagugcuguccaccgucuagcugagacucuucacuuucgacuagcaaggauugcagaugcucauccucuggguuacauuuguagguuuguuuaauugaugugguuuagcacuugggagagguguacaguuucacugccgugaggcuuugagcacauaguuuuaauuuuuagauuuuucuuuuuucuuucuuuucuuuucucuucuuuuuuuuuuuuucccgagacaggguuucucuguauagcccuggcuguccuggaacucacgcuguagaccaugcuggccuggaacucagaaauccgccugccucugccucccaagugcugggauuaaaggagugugucaccacugccuggcuaauuuuuagauuuucauaguaaaucuauagggauuguguaaaguguagauuuuuuuuuuuguuuucuauccuuccucuuucugauugacugacugccucccucccucuuucucucuuucuuucucucucucuuccucucucucucucuuccucucucucucucucucucucucucucucucucucucuuucucucuuucucucuuucccaggagacaggcuucacucuguagcccuagcuggcccagaacucacuauguagaccaggcugccugcuaacuccccaaagagcaccuguucuggccacccagucucuaagaugcugagauuaaaggcaugagggcaccaccauguuugacaaguuugcuuuuguuguuguccuuguuuguuuguuuagagaagaguguauuuuauucuucuuaagaacacagaggcaauuggaaucaaagaugaucaaccauggccauucagcagcuacucggaugcauuuuacugcguggaucauuuauaaaugaccccugcuucacaagaguuaaaguagccccuuuauuuucaucugugcuacagaugauauacauuuuucugucuuuuuuuuuuuuuuugguucuauuacuuuguauuuaauacaaaauagaaaauugucccucccuuugucucaccugaacugaaaagagauuuuaaaguaugugcaucugaaucauuauacaaccuauuuccuuaaagaucauuccauucuuucccuaguuggcuuacuuaaaauucagugauaagaacauuuacaacaaucauuuuuuuguacuauccaguuaaggguuggaaaaugacuuuggaauuucuguuauuagugagauacuugagguguuagcacugaagaaagaguuuggguuuggacucagcacuguguccauuagauacccauuuccacuugggaguugcaggcuucucacccaaacagugagggcauaguuauucaacagauguuuaucagacacgugcuauccucugcaccaggcagcaugguguuuaauuuuuauuguauuuugccuguuuggauguuuuuccugcuugcaugucugugcaccaugugugcccaggguccucagagaugggaagaggauacuggagccccuugagcugaaguuauagacaguugugagcugagccaucucccaagcccacugacaguguuuuagggauuaagugguaauaggacaaaaucuuuugccauggcauugacagucuagaggagaacuaaccaucuggugggcagaaugaugacaguaucauuucaauaguuugauuuuuuuuccuuuuucucccccccacuuuuucucuuucuuuguucacacucucucucccucccuccgccucucuucccgccucucuuuuagaucacaucuggccuccaacacuauagguagcugagggugaugauuaucuucugaugcuccugccucuccuccuccacugcuggggagcuguaugugagcaucaccacacaucaccacgcaucaccacacaugguguacagagugcuagggggcagccuugacucuaugccagcucggcacacacucuaccagcuuagcuagguuccaggcccaccauuuguguuugagccucaguuuucuuuuaaauaaaccauuauuuagauuucuggaugugucugagugggacuacacguguaagcguggguagggcagaagauggcauccuguuggguccugggaauccaacucagauucucuggaggagcaaccagugcucuuaacuguugagccaucuuucccgccuuaaagaagacuuuuauagguacaugcgauguguucuguauuaauuaacucacagguaaagcauguuuaaaauuaaauuaacuguaaaauuuauaugauuacgaccaauuuuuuuuuuugagaaagaaaaugucuacuagugagaauugacaaaacaaacugcauuuuaccuguggaggugaugauuagaauauauauugauugcuacaaaagaaugucuucagcauguuagcaagagaauggauacauguuauuuauuuguuuguuuuugauugugauaggcucuugcuauauagcucuggcuacccugaacucacuauguagaucaggcuggcccggagcugacagagagcauccugauucuacuucagccccauccccacauuaucaucuagaacuagauaauaauuauaaaucauuaucuucucauaaguguagaaauugcuaauacaaaggcuuuccuaauuccacauuuaagauaauaaaacuagauuuugaguuccaaaguaguagaauuuguuccaguuucauuuguuuaauuaaaaagauuuaucuccugauuuauguauaugugugcuuggauuaguuucuauguguuagguguauacuggggcccaugaaggguuuagucucagauccacugaaacuggaguuccaagcacccauaugggugauugaguucauuucccggcugugcugguuuuuaaguuaguggaucuaaggacuaguuaccaugugcgaacacacacacacacacacacacacacacacacacacacacacacaaaguccaagaacucagugcuugcucagucccacgaggcuggauguuucugcuguucuguauaagcuggaaucccaaagaagugggcuccagugccagccgaggaauggaugugccggcagugaggacaagcagccaaaggaucuacgaaugcuuccuccuucuguuguuguauguaggcuuccagcagaagguauggcccagguuaaaggcaugugucauccugccucaagauccgggucaaaagccugugucucaagaucgcuccauuucuggauuguaguuccuuccggauauagucaaguugacagcugagaauacuuaccccugccuucaacucuguucauagaauuuuuguggccacguguuaauauccaacaugaccauuucucuggcuccacagcuuuuacagauauuuucuucauuucuuaguugaaacacuuccguaaagaggcacucaguucauguuggagguacauacuaaauaaaggcuugguugguguaguggcuauuccugauugucaacuugacuauauuuggaaugaauuacaauccagaauuggaaggcucaccagugacccuuaucuggaggcuuggagauagaaguuucugaucuggagcuugguauggagaacuugaggcauaguggcuauggauuccagaagauuaaaucuccgaguucaaggucaucugggauuaaaggugucauggaacacaucuuuaaucugggcuacaccuuucaucugggauuaaaggugugguagaacacaucuuuaaucugggcuacaccuucugcuggagacaauauaaggacauuggaagaagggagucuugcucuugcuuucaccugcuugccgugugagacugaguaacugcuagauccuuggacuuccauucacagcuacuacugaaccauuguugggaauugggcugcugacuguaagucaucaauaaauucuuuuacuauauagagacuauccauaaguucugugacucuagagaacccugacuaauccaguugguuuuauccgguuuuggugguaguggugauggguuuugugguuuuguuuuuuuuuuuuuuuuuuuuuuuuuuuaacuuucuuuuuuuuuuuuuuaaagauuuauuuauuuauuauauguaaguacauuguagcugucuucagacacuccagaagagggagucagaucucuuuacggaugguugugagccaccaugugguugcugggauuugaacucuggaccuucggaagagcagucgggugcucuaacccacugagccaucucaccagcccccuuguuuuguuuuugagacagggucuuaacauguagcuuuggcuguccuggaacucacuagggagaccagucugaccuugaacuuggcugcuucugcuuacuaagugcugagguuaagguggacaucaccucaccuggcuacuugucucuguuuucaagcaaagacccugggucucucucucuccagacagcugcuuguuauuuuugaugucuuugguuagugggaaucccuuuauaauaaacaauuaaagcuccugguucuuuuuuuuuuuaaaagauuuauuuauuauuauucauuaguacacuguagcugucuucagaugcaccagaagagggcgucagaucucauuacggaugguugugagccaccaugugguugcugggauucgaacucaggaccuucggaagaacagucagugcucuuaaccgcugagccaucucuccagcccccaagcuccugguucuuauacaugucuuuuuagcugucuuuaguuaugcagcucuuugguauaacaguguuucggcuuccucuguauauuuccugugcuagaucuggaaucagcccuaugucuuauaaucuugguuucuuuuagggaaaaaugguguuucagcaucaccguacagguacaaggaacacugccaccuagguuguucauuguuugggguucuauucaaagcauagcguugggaaaugcauagugcguuguggguguggauuuguguguguaugucucuuugucuguuuugucuguuugguuuuguuuucuuuguuuuuuuugaggcuggcugaccuggaacuucagagaucugccugccugucuaguaagugcuaggaguaaagaugugcacugcugugccuagcuaguaucuugucuuuuuaaagguaguuggcuuuugaguguauaucauuccuuccaauucaacauaagcuuucagaguucuuugcuuacacaucuuagccuauguuucugucuucuugaacuguagaccuuguucuugaaaacccaugagaucccagguuacauuugaauuacugucuuguuucauguuguaucaugugcguaauaguuucagaagaauguacucaguauuaaccugucaggauaaugaucaaaaacaguuuaacauuuuaaaguguuuuucuccacauuuaugcauuuuaaucauuuuacaaagcagcaccugagcuugggcaaacacaccuguguucccacaguggugaaaccacuucauagcauuauaggaccuaucccuguaguuaaguaauggcaacuaggacuggagagguggcucagagguuaagagcacugacugcucuucuagagguccugaguucaauugccagcaaccacaugguggcucccaaccaucugaaauggggucugaugccuuuuucuggugugucugaagagagcaaugguguacucauauacauaaaauaauaaauauuuuuuuaaaaaaggaauggcaacuauaaaguaagacaaggcucuccugaguacuauguacuucauaaaugguuagcuuagacuucaggcuuuuaugaaacagucauccuguguuuuacacauauauacauguugucuauuuccccugagaugauuagaguaguuguagaucggcugucccauugcugaauaauucuggauauauuucauaagauaaggacaucuguauguaaccacauaauaaucacauuuaggccauugguucaugcauucauuuaaauucuguagguggacccauuguaucccuuacaaagaaaaaaagguagguguuuuguuuuuguuuugcuuucuaacugggaaauauauagguauacuuguauguguguauguuguuuauguuggcauuccauuguauuuaauggcuauguuacuuuuauauauguucugguaucuguaacauacauauacacacauaaccuauauucaccucucauuuccaguucagugcaacauuguucuuucucccugucuuaguuauuguucuauugcugugcaaagaaaucaggaccauggcaacucuuguaagagggagcauuggggaguugcuuacaguuuagaggaguccauggucauugugacagggagccuggagacagacauggcaagcagagugcuggagaaguagccgagagcugcacacugaucuggcagagagaaggcauggggcuuggcaugggcuuuucaacccacaaagccagugacacacuucuaccaacaaggccacaccaacccuucuaauccuuucaaauggugccacucccuagugacaaugaaccucugcuauucacugagugagaagcguagcucccacuuuuguuuuuguguauuguaaaucaacuccuugaucacauagaugcaggcuaugucaguuucagccauguguuuggcaguggcugccaguuugaucccccaaaaauguuucuuggcccaagccaguaggcccugucaaccuuagcuggaaaaagcuucaggaggaaugaguaaucccauaaguuucuagccuauuauuuaaagaauauuugaagaggauuuauagcaucagaccacaguguuguuaugcacuaccuucucucaacuguccuucugucuuaauucaguaaguauccaugugauguuugccaccagucucaugccaagguauauguuuuggaauucugaagcuuguuuccuagugggucauggggagaguuuauggaacuauguuccccaaguucuagaaugcuaaagacaauuuacuugugacuuuacuguugaaguuuggugacuguauuaaguuacugugcauguugcugggauaaaauacccaacagaagcaacuuaaggaaggggguuuauuuggccucaggaguccaugagaaagcgcaccauagcagggaagacguggaagcaggaacuugaccuugcucaguaucacgugcaucugcagucaggaagcagagagagaugaacgcuaguggucaccuugcucucaccuuuuuauagaauguaggacccagcacacaaaacagcacugcccauagguagagcagcuuugccuaccccaguugagcucaucuggagacucccuccagagcuugcuuguacauccgucauccuaaaugcugucaggaagauagucagggcucacgcugucauugagucguuagcucacacuuucuugucuuagguaagcaaguacaauacaccagggucuuaugcacgugccaaugagaggcaaagucugaggacaguuuucucuguagaagucauuugacuuucugguuuuuguuauuguguagcugcccagcuagcuccccuugaguauaacucagguuucauuuacuuuaggauuucugauacuuuauuauaucauuuagauguuuuuguuuauaugucagaagucuucuaauuaugguuuauuuccuauauuuuucuuuaagcuuucuauuuuccauguguugucuuuuuuuuuuauauguuaaguauucaccacuuccuucaauguuuuucuauuuuucauuuuuaaaauuucuaaccuucagacaucuuauuucucuguguaguaccuguugaacuguuaaauaacuuuguuccuucuagcuuagcauuuuagauuuuuaaagacaggguugcguaguccaggcuggccuuaaacuugagacccuccuccuucagccucccaagcucugguguuucaggugugcaucuucaaguccaauuuagcugucuuggucuugcauguuuuaguuauggucuuacuauuagcuugggcuuacuguauagacaaggccccuugaguuaguuuuucuugucuguggcucugcuuucugugccuccacacccagccaaccaugucuuuuuggauggauucucccccccaccuuugauauuucauauucuuuuauuuacccugugugugugugugugugugugugugugugugugugugcacgacaacucuaaggagcuggcugucuccuccacuuuccuaugguucugggaguugaacucaggugaucaggcuuguugagcaagcaucuuuuucugcugagucauuccccacucuucuguauuuuucuccccuguggucuggguaagugauuucuuaguugcaguuuugacugucguuuccuauagagcggugucucucugucagcugcuggcuugaccaguauguguggugacauugauggucuuuagaaaucacauuuauuuaccuuuuacauaccaacucuuugcauaguguuugaacuugauuguucucuuucccuguuuaguuaucuaccuauuacuuguguaaucuuuguuuauuuagccuuuccaauauacagagaucuuccugguuuucuacaauauuuaagaguaugucuagcuagcuaggaaagaauccuucuugugucuuccccauuucucucugcaguuuccuuguucauuuguuguuguuguugcugcugcuguuguuauuguuacuguuguuguugcugcuguuauuguugcuguugcuacuacuguugcugcugcuguuguuguugcuguugcugcugcuguugcugcuguuguugcuguugcugcuguuguugcugcuguuguugcuguugcugcuguuguugcugcuguugaugcugcugcugcugcugcugcuguuguugugccuuaccuuccagucuguauucuguucccugaaguucacuguaaguguaacccaggcacuccugcuaugauaagugggugagacccauucauuuucgugcauuuccucgguguggccuguaaugcccguugguuauuuuguuucuuuugugugugagccauuccucuucuguauuuucuugucuggauaagugauuuuuuuuuuuuuaaucuaugagcuuggcagauggccacucacacuucucugcuucucacacagacacucaauacccacacaaaacuuuuucccuguugaugauucauucccaucaucauauaguaggggauuuugcacaugagguuaugacuuuacuacuuaauucucuuugguuuuauuugagauuuagagaaauuuaaauuuuaaguuccaagccuggcagggugguacguuccuguuauugcaacagugaggaacaaaggauuugggguuugaggauugcuuaaucuacauuuguggguuuuguuuuguuuuuuuuuuuuuuaaguuuuacuauuuacaugcugggacucacugcugcuacauacacuauucugauccauugugauuauauuaaaugcaguaugaacuccagcugaagguuagcuauaugguaugucuuauauuuuccuuaauaacaaauagguuacuauaucaccuacaauuagauugucaaauggccccuuaguuguuagccauggaaaauaaaugacagaaguuucuauaagaaauagcuauguuuuugcaaauuugccaacagcagcuggaauuauuaauauauaacuaugauaauauauguagaauuauuuuauugguaucauuuacaugcuaaauaauggauuuauuuaaaguacugaguuaaauagguuuuuaguggaaucaaaaaauugugggacuguuggcauaauucuggaacacuucccaaccuuggaaauaaaaugauucauuggaugacugucuccuaugacauuccucugacccacugacccacugaccccugccgaaaaacaaucuacauuuucuuaaaaaaggauuuauuuauucauuuauuuauuuuauauauaugaguguucugucuucaugcauacuagaugaggaacucagaucccauuauagaugguugugaaccaccaugugguuguugggaauugaacuaaggaccucuggccgagcuguuaacugcugagucaucucuuuuuuaaaaaauuauuuauuuauuuauuuuuauuagauauguucuuuauauauauuucaaaugcuaucccgaaagugcccuauacccucccuccacccugcuccccuacccacccgcucccgcuucuuggcccuggcauuccccuguacuggggcauacaaaguuugcaauaccaaggggccuuucuucccagugauggccgaccaggccaucugcuacacaugcagcuagagauaugagcucuggggguacugguuaguucauauuguuguuccaccuaaaggguugccggccccuucagcuccuugcgugcuuucucuagcuucuccauugggggcccuguguuccaucuuauagaugacugugagcauccacuucuguauuugccaggcacuggcauagccuuauacgagacagcuauaacagggucccuucagcaaaaucuuucgggcauauacaauagugucuggguuagguggcugauuaugggacggauccccaagugggguagucuauggauaguccauccuuucgucuuagcuccaaacuuugucucuguaacuccuuucauggguauuuuguucccuauucuaaggaggaaugaaguucccacccauuggucuucccucuucuugauuuucuuguguuuuacaaauuguaucuuggguguucuauguuucugggcuaauauucacuuaucagugagugcauaucuaaugacuucuuuaguaauuggguuaucucacuaagaaugauauccuccagauacgaccauuugucuaagaauuucauauauccauuguuuuuuuuuuuguuuguuuguuuuguauuguuuuuuguuuuuuucaagacaggguuucucuguauagcccuagcuguccuggaacucacuuuguagaccaggcuggccucgaacucagaaaucugccugccucugccucccaagugcugggauuaaaggcgugugccaccacgcccggcuccauuguuuuuaauaacugaguaguauuccauuguguaaauguaccacauuuucuguauccauucuucuguugagggacaucuggguucuuuccagcuucuagcuauuauaaauaagguugcuaugaacauaguggagcauguguccuuauuaccaguuggaacaucuucuggguauaugcccaggagagguauugcuggaucuucugguaguauuauguccaauuuucuaaggaacuuccagacugacuuccagagugguuguacaagcuugcaaaucccaccagcaguggaggaguguaccucuuucuccacauccucgcaccccuagucuacugucuuuuuuuuuuuuuuuuuuuuuuuuuuuuugguuuuucugaaacagaguuucuuuguauagcccuggcuguccuggaacuuacuuuaaagaccaggcuaaccuugaacucagaaauccgccugccucugccucccaauugcuuggauuaaacacgucaccaccgcccggcuuuuuuuuuuuuguuaccuagucuacuuucaaagcgugcauuugcuugcuguuuuucuguuuuguuguuuuguuuucuccucagucucucccuucucuguuuucguggccuccacagccaccaccccacuccagaggugcuagagauuaaauccaaggccagcuaggccauccucugccugugaacuauauuuccaggccuugugcuuuucacaugaugagaucauguaguauguggucuuuuguaccuggcuucuuggcuugguguaauguguucucuguuauuugugugauaaucauguuaaaauuuaguguccucuuauuuccaaauagauuuuuacugccuggguggcccaucuugugauggauauuugcuucugcuuauugucacuaugcaugaugauacgugcucugcuucucaaccuauuugugauuccaguuacguuuuccuuuccuccuucccuccuuucuuuccuuccuucuuugauuuugaaucagagucucacuugguuaacccuggcuaaaccagaauuugcuguggaaaccagauugaccucagacucacagaaguccucuugccucuucuuccagaguucugggauuaaagugcaccaccacuccagccuuaaauuauguuuuuguaauugauuuauucuuuaaaggugagcacaggugcuccuguauuguauaguucauaaugacacuaguuuguugagcuuugaagaagugauuuugugaucuaaauacaacacugucaauuuucguuccuuugugccagagauaugucucaguggauagcguguuugccuugcaaacaaaaacuuaaaccccuacaacaauuuaaauggcacggugguaaacaucuguggugugaauccugggugguugagguaggauguccuaagugagccuuuacuacagagcgaguucuaagcuggccugggcuacuuaaguccuugucuauaaaaaccauacaaagcaaaacaacaguuggacuuaacaucuugaacauugguuaguccaagcuguauaaauucgaaguuuacauuauuccauccuuaauaauuucugucaguuauugagauguguuaaaacuacugucauguuguauuuccaucauguuuuguuguuuuguuaaguuuaauuauuuacuguuuaguuuuaguuuuuaccgaaauguucaugccuuauacauagacacauaaaagaaaacaauacgauuaaucauauugcacugggaaugugugauccagccuuaccucuugguuccucuaugccugcuguuaagccucuguuuuccaaguuauuuuaaaguaaacccuagauauuauuauuguuuuguccauuugguguuuauauuuauucaucccgugauguauguuugugccucugcacauauggacaugauuucauucugucugaacuauaaacauuauaggauucuuucuuuagugcaugccuuuaaguggugcaaaagaaauacuuauuucuauguacguuuguguuuguauguacaugugugugugcuggugccgccaaagaccugaagaaggugcuggguucucuggaacuaagguguaagugacugugagccaccugaugugguacugggagcugaccgcugguccccugcaagagcaguacucacucuaacugcuaugcucucucuagccuuuuaaaaauauuuuuacguuauauauuugaaagaauauuacuguucaacucacguugacaauuggguuuguuuuuuuuuuuuuuuuuuuuucuacuuuaaagauccuauaccagugucuuccuguugcuguugaaaguaaacagaaguuuuuuguuuguuuuuuuuuuuuaaacguacuuuuaaaaaauaauucucaugaacuacuuuuaaauguuaucuuuuggggagguguucugcaggcucacuaagugugucauaagacuucgaugauagcgauuuccauucauuaccuuuacaugucuuugaacacucagaaacaaugcccuguagacaguuacuacuaaaagaaugagcaaaguuuguuuauuuguuguguuuuguuuuguuuuaagagaggguuuuacuguguagcucuggcuuuccuguaguucacaaagaucugucuguccagcucugacaagcaaccuguuacuuaaagagacauuaugaagccugaacugguggcuuguguuuguaaucccggcaccgggaaacuaaagcagaguugagaguucaaagccggauugggccacguaauucuaggucagccccaacugcaugguaaggucaugccuaaacaaagggaaaaacauaacaacaaucuccccucccuaauaaaaaagauaaaggaggacgaggccauguuuagucucuccagaagagcucaucuugucugcuuugucuuuuuuccggagcccuuugucucuguguccugaugugaguagguugaaguguccuuuaucucucuuuacacagcguuauuggaaauaauuaugaaaaacggcagcaccgcuggaaguagcacgcauugccgaaaaccuccugggagcagcgaccagagcaagcccagcuguggaaaggacggcacuucuggugcuggggaaggcgggaaagucuauaccaaagaccaaguagagggcgugcucagguaggugugaaugcgaguguguccgcaccaugaucguugacugugauuggacccaaucgacguuauaaugccuaaaauaaaaauguauuuauauauagcacaguuuaauagagggaaaugaaggaguuaccugggugcccuguccuucauuauuuugaagucagccuggagggaguuaacuuucuggaaguuuccacucauuuaaauuagcuauaagucacagugaguuuuuaaaauaaugaucucagcuuugagucuaugcacuguuuggacuguaguauugaauggauugcuuuguugugauacguaguugaaaauaggagaauuucauaugcgggaaggcuaagaauaagggcagcaauguuuuugauuuucagauuaaagaugcuuccuucccuuucuuuucggcaaggcuaccugucuucucagacaccguggugccccuuuuguggucucgcucagugcuucucucuaucaugggagucuccuucuccauauacgccugugugaggcagagucaguggagcugagcagcgaggagcuugguuuuagacauacagcuuuacuaacuuuuuuaaaaaaaauaagaacgaguuuucuugaaagaaaaucuuagguaugaagugcuucaaaauagauuuuguuuucuguggaaaguuaugggacgcgugcucuucugagcaacugaaguuugcaggugauggguucuguaggugacucaucaaggauucucagggagaucggauugaacuaacacaagcgaaaaagagccaaauaacucagcagagguggccuuugucccucguccuaugugucuuccuuuucugucuuuucccuuuguuuuccccaacaugguuuguauggcauauaccuugagacucagagucugucuaguaaggagagugacuugucaccgugucuugaaucuaauaucaauauauuuggaucuccucucuuuccucucugugugaaugcugaagguugguuguaucauuguguccgaauucauagugagggaaacagauuccugaaucaggauaaaaccauggaggagcaccuuugacugcugugaugguagcaagcacuuccaaggccuuaagugaaacugcugaucacuuccauagcacugcacugggccaaagucgacuuugggaaacgcuauaggaaaacucagccccaacccaagcuguauuuccugugugcuucacauuacauuaggagaccacucuucacggauucucccuuccuucuuuuuugauuuauuuacuuuuauuuuauaugugugaauguuuuauguaugaguauauauauauauauauuacaugcaugccugguuccuguggagaccagaaaagaaugcuuggaacagaaccuggguccucugcaggagcagcaaguucucuuaaacacugagacaucacucuagcugucccacccccugaauuuuuuuuuuuuauuacaacuuuaauuguaugugauuuuugugacuaccccuuucaccuugcagaauagaauuaccuauuggcuuggaagugucaccaagaaacaaaacuauaguuguaaguuuuggacaaugauaauauuccagauuugcuguuacuuuuuuguuuuguuuuguuuuguuuuugagauaggguuucucuguauagcccuggcuguccuggaacucacuuuguagaccaggcuguccucgaucucagaaauucgacuuccucugccucccaagugcugggauuaaaggcgugggccaccaugcccggcugcuguuacuuuuuuaaaucuauauauccucuccucuaccuguguguguguguguguguguguguguguguguuugugugugugggagagagaauacaugugugagaguauacacaggagaggaaguuaaauaaauaaaagaaauauauuuauuucagcacuggccugaguaugcaugugugcaugcccauguguacaugcgugugugugugugugugugugugucuauuugucugcaugugugugugugugugugugugucuauuugucuguguguguguguguguguguguguguguuugcuuuuguuuuucucccagccacaggacuugccuguaguaggugggagaaggggauggcacauccugagaguaaaacacugacagcuaauagccggagcagcuaugccaucagaguuggccagcagagcccugagcaagcuucugucugucccugagacuggaggugacacugucgaugagguugaaagcugaggagaguaggaagagucuuuacggaugggauggagugagugcacguugaggguccagccguacuuacgaucacaauuccugauagaccagcugcuuuagaaguauuaccuguauuauagauugauugauuuacuauaucuuaaauuccacauaauauacauuguauauaauauaaaauguauauauaaaauccccuuguggaauguuuuauauaauuaugaaccauucuuuuaagcaaaucccuaaguuauuugaaauauuucagucaguccguuguauguaaguugccuaguugcauaguguguacauauucauaguagacuucuuaaauguggcccagugagguagcagaugagaggucagaaccugcaucuugucguuugguguuuuguuuuauuuagacucaggggauuuuccucaggaaaguccucugucuugauagagaaggcgauuaugcaaacaaguugcucaguaacagcaggguucaguggggagaagccacgcaaugauccugcaucccuugcguaaguguaaacucacaggaagauugaaggaaacuuguuuaacuagcaaacaggcaguggagccgccgagcucugugucauugaguugaaaaacauuuaaaaauugaggaaaauaagcuuuauuggaaguuuuuaaugcaucauuguaaaagaacuaccuuguauuuaaacauaaaaggucaucucggaaucuaccaggcaauuauagcuacaucugguaccccuuucugugcagcucugucucauuugaauuacaaaggcuggaguuucagagucucuucuguccuuuugcuuuuguuuucaguuguucuuguuuguuuguuuguucguuuguuuuagacuagguccugcuuggaagccaagacugagccuaaacuccuucuccugcucuagccucucucagagugugggauuacaggugugggagcccggucuuucaguucuuuaaauuaaaggaagauaaauuacagugaagagacacaugaccacugcaguccuuauuuuaaaaaagcauuuaguuggggcuugcuuacaguuguagaggguuagccuucauuggagggaagcaugguagcaugcaucagacauggugcuggagagagagguagcuaagaauucuacauuuagaucugcaggccucaagaacaaaacgugggccugaccuaagcauuugaaaacccaaagcccaccccgagugacacacuuccuccaacaaggccacaccuacuccagcaaggccacaccuccuaaucucuuaucaaguagcuccauucccuaauggccaaguauucaaauauagagauggaggggggggggcauuccuauucaagucaccacguaagguaaggaauuuauguggaacaugacuggauguggauaauugauuguccuggcuaguucguauggccagcuugacacaacauguagaaagaggcaaucucaauggaggguuugccuagauaguguugaccuguggccauaucuggggggaauugucuuccuuguucauugauaugggagagcccaguuugagaguucauugauaugggagauggcuaguuuuaugccaucuugacacaagcuacaguuaucuaaaaggagaugaucucaauugagaaaaugccuccauaagaucugucuguagggcauuuaaaaaaauuuuuuuuaauuagugaucaaugggggagggcccaccauuggauggcgccauccaugggcugguguccuggguuuuauaagaaagcaggaugagcaggccauggggagcaagccaggaaacaguacccuccacggccuccaaauuagcuucugccuccagguuccugcucuguuuaaauuucugccuucucugcuuuugaugaugaacugcuggauggaucugugaguggaaucaacccuucccuccccaacuugcuuagggucaugguguucuucucagcaauaguaacuguaacuagcacacuggcccucagcaggcagugccgccccugggcagguggccuuagguuguauugugaaaguuggcugaucacgcgugagccggggugagugagcaggguuccuccauggugugcguaugcuugaguuccuguccaguuuucccucgguaacagauucacgggcaagcugauaugaacgguuuccucuccaaguuccuuuuggucccaacagcagaaaguaaacuacagugacaaucugcagcuaagcuguaucccacacagaggcuccuggacugcaccuggcacucagaugcucugcagggccaccucccaccaccacaccuucccucaauuucuaauuuaucugagaaaaagucuccagagauuaggagacuauuuagacuguugccucaggguuucuguugcugugauaaagaccaugacaaaaagcagccuguggaggagacgguuuguuucacuuugcagucuguaguccaucaucaugcagagaagucagagcaggaaccuggaggaaggaggcccaggccaccgaggcaugcuucuuacuggcuugcuccucauggcuugcuuagccugcuuucuuauagcuccuagggcacccagcccaagggguggcaccacacccagugagcuuaguccucuccauugaucaucaaucagaaaaauguaccacaggcuugcccacagaucaaucuuguagggauuuucucacuugagguucccucuucuaaaaugacucuaacuuaugucaaguugacauaaaacuagucagcacaauugacuguuuggucaacuaaauguacaaauaauuacuguuagaucauaacuuuuccuauuguucucaagauguuauuaauaucaauaucacaauauaaaaucuauuccaaacuuuuaaagucuuacaaucuuuaaaaaagguugaguuccaagcuggagagauggcucagcaguuaagggcacugacuacucuuccagagguccugaguacaacucccaacaaccacauggugcucauaaccauguguaaugggagccaaugcccucuucugugugucuaaagacagcuacaguguacucauauacauaaaauaaauaauuuuuaaaaauucagucucuuuaaaauauccagucagucaggcacaguggugaaugccuuuaauucuagcacucuggagucagagacaagaagagcucugccagccuagucuauauagagaguuccaggauagccaggacuacauagacucuaucucaaaaauaaaauaaaauauccagagucucucuaaacuccaaacucuccauaaaaguuuaaauucugccaacuguggguuccuguuuuuuuuuguuuuguuuuuuuguuuuguuuuuucuucuucuuggguuuuuuugguuauuuuuguuuguugguugguuuaaaaaaaaaaaaaaaaguucaguacuuuucuuccucuaagaggaaagaauuaggacacagucaaaaucagaucaaagcaaaaccaaagucuacccagcaguguggagugucagacuuuggggacucacaccucgugugcuccaaagagcuuagggaucuuggcacagaacauggagggagucccacaggcucaggccagcucugggccccagcugcugcaguccuuggugaucagcccauaguauuggcaucuccaagaaaauugucauuucuggcaucuuagccuucucuuguguccucuccgugcacguaaggggccuucacuccagaagugucuucugagauccuguugugggccaagcacuguagugggaaauacauucaguagugaaagaaaaaaaaccuuccuaggcucuuucuugaauuggucugugagaggguuuuuccucuccuguuucucugcuccccccuccucucuccuuccccucccuuccccuccccugcauccccuccucuucacuccucccccccuccucuucccuccccuccccuccccuccuuccccuccucucucauaguuucuuagugucuccuagcucccagggaucagcucuucaaguuagcuuaucaguuacgauuucaagacgcagaccauggaauauaacuaaagcuacaaaggaaagggggccuuuuccuucccugcuggugcagaugagcacagaaccucaccccugcaggcugugugugcugucugccaugagcucuguagcgcuuaccccccuuagcuuugggaugccagguuguuugguuguaggaggucaucaacagaauccucacugcucgcuagcccgucaguaucucuugucuauuccugaacuguuuccagcacuccaagccagugggccgauguucugaaacacaaacucuauuaacugaccucuaggaauggauugauggaaaucauauacaacagauaauuuugaauccccauuguugcuuucaaauguuuuauuaacacaggaccugccauccuuuuuggaaucacuugguuacauuuucaguagcagugguguggagauagcuuccuugguugggcuucagaccuuaggccacuguggagcuccucuucagcuccuguguggcuuccugggcagccucuggguagucccuguguggccccucugcagccccuggguaguuccuguguggcccucugugcagcuccgcugugcggaccaugugcagucccuaugcagcgacuggcucugcucucaugcucaucuccaucugcacugugcacuaauaaguucucccaguguuuacuccucaguagugacacacuuuucaggccuuucucccgccucaguugcagugagucacugcccuucaucuguauucauggguuuaccucuguggcugauacacuaugcuguggacauucucacggguggaggagugagaauggagcaaacagccugcaucacacccacaaauauuccuuauaccuacuguucuaacagggugaugucaugcuccuuauaccauucuaauagagagugaugucaugccccuuauaccauucuaauagagagugacgucaugccccuuauacuauucuaacagagagugacgucaugcuccuuauaccacucuaacagggugauaccauguuccugcuuaaaauuuauauccuaucauuuuuguucacagcauaaacaaauguaaaaauuacuacgaaguccucggaguuacaaaagaugcuggugaugaagauuugaaaaaagcuuauaggaagcuugcuuugaaguuucauccagacaaaaaccacgccccuggagccacggaugcuuucaaaaguaaaguaacuuaugacacuucaugacagucuuuucuagauggcccauuacaguguuucagaauaugaaaucuguuuuuccuuccggugcauuuagaaagaagcuuaagaccagucuaaaaauccuuugaaucuuuuuuuuuuguuguuuuguuuuucaagacaggguuucucugaauagcccuggcuguccuggaacucacuuuguagaccaggcuggccuugaacucagaaaucugccugccucugccucccgagugcugggauuaaaggcaugcgccaccacuuugggcuaauccuuugaaucuuuaagacuagcuuccauuacccaguggagcagaugcaguauggcugcgaaagucugcaggcugguaaucgaaguccgaaguaauauccagguacugugugugucuucugguuuggugugaggagguagguugacaguuuguauuaccuuccaguguuugagauaugacccaagucaaccgaaaguaacaguuuuacugagguuuucuuggacguggccuagaguggagauuuccuagacaggccauuccaggaaugcugguagguagugcucuuaauauuucuaugaugcuggucagguuuuaugaugccagaggucaaacccagggccaugcguguguuagacaagcuucuggcgcugagcugcaucucuaguccuggaauuuaugagcucaggucuugcugugcaacucaggcuggcugagugaacuuggcaguuuuccugccucugagcgcugccaucacaagugugcacagcaaggcaaagcacaauucugcauccuuuauaucgauuuuuaguaaugcguuuacuuuugcuucuucaaacuugauuucuuaucucucgucuguguuaucuacuuuacuuccuaaucuucucuacagcuuuggugaauuuaguaacuauuaugcaaaauaggggugaaaauuagguaacggguuugauaauuuccuauuuuauauguuguaaugaaaguuauacaacugucucuugccuccccugguuggcagaggcuuccuuuuacuucaccuuuccagggaagccaggguagcgucucccuggcagacagaguggcuggugucaggacuccccaugccuugagcguauuauuaaguaaaagaacaauagcaauaguuucaugguuuguuacaguuucauuguaacaauuaauguguuguccauagugaaacuuuuaacuuagugauuguugauucuugugaauuugauauccuuagagccaggguuugguguuuucuguaacuugcugggguccgggaauagaacaaaggagggauuauguuaaaauguuucaagaaagaagacuugccuggcagugguggcugcaagccuuuaaucccacuuauucugaguuugagccuagccuggucuacagagugaguuccaggacagccagggcuauacagagaaacccugucuugaaccccacccccaccccccaaaaaagacuccauuaguuuuucauaaaaauaccguucaaguuguuuauaauccagccauuggggaacaugucuauaaucccagcuuccaagaggcagugccaggaggaucacaaguuugaggccagccuggucuacauagcaaguuccaggccagcagaguuaugugcuguaaaacucuuuuuuguuuucccaucauagucaaagagagggagaggcagggaggggagggaggauauuguuuacagaacaguuuuauuuguugaaggaaguugccaaggaaaauacaucugggaauuaauaauauauuccagugaaagcucugccaaaguuguucuucuggaaaaagauaaguuaacagcggcacagagagaggguagggaaccuucguggcucagcaggugaaggcacuugccaccaauccuggcaaccugagugugaggcucaggacucaugugguggaaggagacaacugauuccuacagguuacacacacacacacacacacacaaaugaaauaaauaguucaaaaaagaaauuauggaaaaaccauauuuucacaguucuacaugaguuuaacuuaaaccuuuucccauugucucaugagccugccagacucugaugguuggcuccugcuccgugaugacguaggaggcccugguuaaacucagucggucacgcacaagaaagacacaguauaggaugucuacaggaggggcauaagagagacuggaaagugucagcacacggaaugcauuaucuauguguguauaaugaucaggacagauuuaauaaaauuauaacaggucuuggugaugggugauccagauaacguuggcaauaguaauucucccuggacuggagggauggcacugagggaagagcacacaauguucuuccagaggacccagguuggauuacuuucuuuaacugcagcucuaggggaccuaucgcccucuaauggccuccacaggcacugcacccaugugcugcaagcauccaggcaaacucuuccuauacauacaaguaaauaguaguaggccgccuggcauacaucuggugguggcauacaucuuuuaucucagcacucaugaagcagaggcagguagcucuccuaguuugagaaauuucaggacaggcagggcuacacagaaaaacccuugaaaaacaagaaacaaaacaaaagguucauaguaauaaugcuuccuaauguuaagaauguuaggcauggcucccaggugugguucugcccgccugcaaucccagcacuugggagggagaagcagggaaucauggguucuaagucuccuuggcuacguaguaaguucaaggcuagucaaaguuacaugagacucugucucaaaacuaauaaacaaucagggcguggagaaauggcuuagcaguuaaaagcacuggcuguucuuccagaagauccagguucaagucccagaacccacaugauggcuuauaagcggcuauaacaucaguccuauaguaucugaugccgucuucugacuucucugggcaccagccaugcacaaggugcacagauacaugcagacaaaauacuuauacacauaaaauaaaaguaacuuuaaaaaaaaacaaaaaaagagugugaggcuggcugaaccuguuuguacuguagcugcuggcagaguaugugccuaguguguacaagucuaggguucggucucuagugccacgaaacagaaaaaaauccaaaagcuucaaagaauguuaagcuaauuucucccacugcaucacggucaggugagcauuguugcucuuauggaaaaacuaagacuacaggugucugugcugcagcauugcuguugcucuuacgaagcagcaagcagcgcagaugucucauaccagccagccagccggucaguggggucucacaaugauggugugaaggcugggugucaucauuaugguguaauguucugcuuuguaagggagaaauacuccuuacugaucagcagacugggagauuguagucucuaguggagaggcucacacagucagugugcaggcggugagcuauaaaucagaaugccacuuuaauuagucccaagggagaucagaauuaggagcuggcucaggagccaguuuucacccacuagaaaccgaacagaaaccccagccuguaacccacagcuuuucagugagcaaauguaguuaggcauccugcagccaguguggucacacaaagaggcaggcuucauuugucgugugcuuccuugagugucugacguauucuuagccagucuucugcuuggagacaccaagcuguuuuucccuaaucagagacaauguuuugauguuuuuucuucuucuucuuuuuuuaauaucuaucuaucuaucuaucuauccauccacaugcgugucuuuguacauacaugccuacacacgugcugaaguguguccacacagauuuguggagaucagaggacaguuugcagcacauucucuccuucuaccaagcggguccuggagcuggaacucaggucaucaucaguuuguggcaggugccuuuggcugcugagccaucucgccggcccccacuuugguccccacuuuauauggaaaauaggauagauaagaguuugaccacacugaaauguuauuuuauagaaaggggaagucauuugcaguuuauuuuucuauucuacuuuauuuucuucaagaauagagaaguaaccauagacuaaagacucaaguuaaaugcuauguuuguguuucucuaagggaaacaaguguuaccuaggacaguaaacaaaaccuggcuggguugucuuucccaggaaacuuguuaaguuuacuaaagcaaagaaauauuuauuaugcagaaugauuuuuuguuuguuuuuguuuuuuccagacaggguuucucuguguagcccuggcuguccuggaacucacucuguagaccaggcuggccucgaacucagaaaucugccugauucugccucccaagugcugggauuaaaggcgcgugccaccacuguccggccagaaugauuuuuauaacauaccuaaauguguuucccacaccauuccggugacacgcauucucucucuccucucggacauaaauaccauuaucucgguguugacuguagcucaucgguccuugccucucauucacaaagacguuaguucauuacccacuaucaccaucaaacaagcaagaaacaacacaaaagcaagccaccaaacuaggacacauuaucuucaaagguuggagauuguuucagugcacuguucuguugucagcauacacagggacauccuagcagagggcacaggguacccguguguuucauaaauaaucuugcgccaaagcuugggcuagguuuguaguuuaauauuagcaguguagacccaagggcaugacuugcagaacaaagauguuacuuccuccuuugggcuuuuucuuaucgaagugaggggaucugagauucccucaucuucaaagaaagacaugcuucacccaaaacauuggcacuguagcaaagcccagugucugccaaguguuuuguagcuuuuucauuccuguggaguuuuuuucuuuuucuuuuucuguuuaauguuuguuuaaauucuugugagcacggauggugggacacaccuguaacgucagcacuugggugacagaggcaggaggaucaggaguucugcuuaccuggagaugaacagccauucucguccccaggcgcauuaguuaccgucacuccagcuugaccaacuacuuggcacauauaacugaagggggggcaggguuuauuuugguguauaguuugagaaguguaagugucggucuguccugagagaaagggcauccaugcaggcaaggcuguucacaggaugguagauaggaagcacuggagagagauacagaaggaagccaggguaagauacagcgccaaggacauggcuccugugaccuccuuccuccgguuacaccucaccccuaccuuucaccaccuaccaauaauccucgaguccaucagagaaacccauguauucagccagagcacucauggaauuguggaaacccaucucagaugcuggcggcgcuuuaccacuugccuagacagcuuucauuuaauccuguuggcgguuuagauuuagaggcccaggcaaugggagguggcaaagggaccuuagcaccuuaccaccaucccaaaguaacaggcuguagccuccuggugucacaaaaacacacagacugcagcauugaggcgccccuuccccuagccaggagacaacuguaguccuaacaugagucuggagaccccaucucuuuccagcacugcuggggagcuccacacucccaccucacuugauggugucaaagucuuagagggaaggaacccggauguugcaaggaaguugugagacagugugugucccuacugcacuggaaugguaggagagaaagacguuaaagcauagcauuuaagaugcagagccucccaagaggcuaaauaagcaaacugcaauagaaaaucucuuaucauuccaagaaccagggcccuacaugguuaaaaugcagucuguuagacacccacauggagaagacagaaaaggcagaguuguguagcaaagauguuacuaugauauagguguccugaagaacaaaagugugugugccaaaagcaaauaagauggccaaagaaauacagagucugagcaaagguguaaagaccagaguggaaauucaucaucacaagcaacgaucugagaucccugcuaaugcaugaacgggagaaagggcagacggggcgaggacccgaugaacuagaaucauugcgcuucccauucaaacggccagagagucacacagagcagaagcagcagcuccuuagaacagcuucauagaacaugaagcugugacagaucucauacacaggucagcugcgcucugagagugggaaggaagacagagauggaaaucauuagaguuugaggcuucucaaacuugaggaagaaagaaagagagagagagagagagaggaaagaaaagaaaggaaggaagaaagaaaggaagaaagaaaggaaggaaggaaggaaggaaggaaggaaggaagaaagaaagaaagaaagaaagaaagaaagaaagaaagaaagaaaagaggcaaguaggcuuuuagauaugagacauuggaugagccccaagcacuuaaaucaaaagaaaucuauaacgagagacaucucagucaaccuucuggaaauuaaagacacacacaguaauuaacaacauuaaaaacauaaaaucuuaaggcgagaaagcggauggaggucccucaugcucagcuuaguccuccguggucuugucacuguuaaggugaggagguaucagggcagagggggaugguuagugacugccagguuugcaacagauguggcugucuguuaacacacacacacacacacacacacacacacacacaggcaggcauuccaagggaucuguagaaacuaguaauggcauuccauagguuacaagauacaaugccaagcuuauccucuggacuuuacacacauacacacacagcugcaugcacacacacacacacacacacacacacacacacacaaacaugcacacgugagcugcacaacaccaaacacacacaaaaggaugacauuugacugaagaugauugcacgugacaaaaaaguccuugaacggauuucagcaucguuggccauuagggaaaugcagauaucagcgugcugugcaccuaucauaauggcuaaccuagaacguagcaauggcuccuguccaagccgcucugggcgcagaaaauggauuauucauguauuguugaggagaaguaaaaugagagucauuuugcagaacaguuuuggaaguugaucaaaaaacgacuucugagcugccauacaauugagcaaugcaccccuggcgccugucccagagaaaggaacauuugcauguauacagaaaccugcgggaagggcaucgauagagcuucauugugguagcccuaaacuagaaagagcccagcugccauucagggaacgagcaguuaaaccagcagugcgguauccauguguggaauacuauguaguaauaaaacugagcacacuucugacaggaaacuagccuggucagucugcguacugugcucauggaaaacagccaggaguuucucuuacaugaaauaacccuauuuuuauauuguacuauuuauacaauguugcuuuguuauuuuuacuugugugacagagucucaucauguaaccuaggcugacuuugaacucaggguccugccucagcuucuuguguucugagauuauagacaugcaccuugcccacucugggcuuucagcacccuagacaugguaccauuugagaaguggccaguagcuuagugaucgccagggauugaagagagcuaugguaggaguugaaugggguuguaaaagaggaccccuuagggccagugagaugguucaguuagcauaaaggagcuugucgugcaaacacaguaacccgcuuucauucccagaacccacagaaagguggcaagaaagaaccaaguggaccagguuguagccacagccugugugcccacaacacacaucgugcacacacaaagugaagaacuggaguacucaagaggcuacagaacguucuaugcucuauugacugacugucaaugguaguucuccauuuaugauuuuugcuaugauggauaagauauuauuacuaggggaaauuagauaaaaaguacagaggauacuuuaaaauguacuugaaucuauaauuaccacaaaguaaaauauuuaaagcaaaauuaauugaaaggucuuuuauauacaguaaaugacagugagauagaaaugugcuuugcaauguuuugaacaccaaaauaaaauuuguacuuaauccucuagauaacaaggagcuguaaucauucuugauugugcacgugcacgcaaugagcuaauaguucaaggcuagccugggcuauguacagagaccccacuacaaaagcaaaacacaacagcaacaacauguaaggcuugaugccggacccuugagcacugccggggaggcauggacggucccuacucuccccuggggcuuucugacuuaaggaaaaugcacuguugagaaaugaaaugggagguaauauaguauccgaaaagaaagggagaugaaguggagaugucuuggagugguauauauauccauaucgugcucaguaccuggccgcaaacaacuuacuuagcaagugagucuugggauccuuaugugaaguccaaaguacuaaugagugaaguacggaaaugguaaguucuccacacaugguggagaccaaggugguuaggguggauuugaaccuuuuuuuuuuuuuuguccuuuuuucuuuucauccuuauuuuaaagacagggucucuuucugugguucagcaggcuguccuggaacucacaaugggacccaggcucauucccgccucaaccucugagugcuggaauuccaggugugugccaccacgcccggcuuucucuaugguuaaugauugcgugugauguugcaggauguacauagaauacuuaaaagaaacuguuacugguuuuuuuuuucuuuacuguuuuaugaauuuuuucaauuaguuucaaacaguguuuaaguuggugcugcugcaagcuggcaaguuuucuacagacuaaagacuuucuuuccagccuuguuauuuguugcuuccuuagagauuggaaacgcuuacgccguccuaagcaauccagagaaacgaaaacaguaugaccucacaggcagugaagagcaagccuguaaccaccagaacaacggcagguucaauuuccaccggggcugugaggccgacauaacucccgaagaccuguucaauaucuucuuuggcgguggauuuccuucagguacucgcuaacuuuauuucuucaacgagagacuucagaaagauuuccagaguucucaucugggcuguuuuguuuugagacagaguuucacucuagcgugggauucacguguaacccaggcuuauucucuaacuuacagcaacucuccugccucaguuacaggcuugagcaugcagaucucccugcauuuucugcagggcuggcuuucuaucaaaggagggagaauguugggggcugucacuguuacuaagccugccucuuuccuagagaguacuuuaaugaaaaaggaguugaugaguucagauaccuuguuuuauuaaagacugaagacaauggaaaucuggaagcaguguuaucauaaucauuaccauuggaggaagaaucugguaccugggagggugauugacguuagcucccuggauccucaaacgccauuauagacugcuaaugccaguguauggaaauguccucaucaguaucuucauuggaauaguagacagucugauugacacgugagccuuuuagauaucuuuuuuuauuguguuguaguaggaauaagcacuugaacgagaccgucagggaguguaguuucccacuaaguaaguagaucuuacagcgauagcguaaguagcauaaacucucguguuuacucccuguguacuguuucuguggaaaugaauuuaagaauaaugucuuuaagcucuaaacuguucacggcauugacuuaagaugcucauucaaacugagaauuugaccggauggcuccuuuaacaucacugagaaaggguuguuugucauugauaggacauuuuacaaaccauccuggaguuguaaaaauacaaaugaaugauccaaaccguaaccugugguuuaacaaauugagacacauuaccucuaagagaaguuacuaaacuagcaauuuugacugaaaauauguugggaacaaccagaaaucuuugaagcaacacuuuucuucuucauaguuaauuaucaguucucgguuucuuacaacauauuuugucaacaauagccauuucugguuuuucaccccauuugaaaagagcuugaauguccaucugugauccacuuuaguacauuagcauuuuaaaaacauuaauuauaauguugucuuuggauuucuagauggguuugauucauuuaaguacaguaaucauaauuuucagaauaaagaccaaagguuuguggaaacaaucaccaacaaugauggucuccuguguguggcguuauugaggaauucuuucccacauuuucacaaaggaauuuagaaagcugggucugguagcccacaacuauuuuggaagguggaggcaagaagaucacacaguaaacauucaggguucaaaacaaauauccauuauuuuaguaacucccaagaaggguggacaugguggcgugugcuuugaaucacaacaagaaaagcagagaaacagucauuuuuuucccccauucacaguugcuuccuaacuucaccuuguguuuaauuucccagguaguguacauucauuuucaaauggccgggcugcuuacagccaucaacaucagcaccgacacagugggcaugaaagagaagaagaaagagcggauguacguuuauaaugugauuauaaaucucaaaaugacaaauuccaguucaggaaagcaauuagaauugacuaaaaauagggcaaguuguuuuaggaaaagaaaugacucuucucuuagcaaguguucaaaagagacucagaaauccugugagaauaauguaggcacaggaguggaggucaccguagggguaacgacagcguugccguccuucugguuugcuacugcguaauucugacaaagguagaucuguauuugcacguucugaagguggcuucuuuuuauugaucauaaaagauuuagaaacgauacugaaaaaaccucacuuaaaguguguuaguuagccuuugcuugguucuaaggcagcugcuauaugcgauugcuugugcagauuaaguucccuguguagaaagcuggauagaaaggacacuggacuagacaugaggggaccugaggcugcuccaccauguguccagucccgucacacacccagucgucugugugugugugugugugugugugugugugugugugugugugugugacaggagggggcuuccuuaucucuaaaaacggggucaggugguaucauccuuuucaagcccuggggagcuuguacuuuagggaucguagcaggagguuggguuuauccagcagguuagaaagcucugcccucaauggccguggggauccucaguaccugugaguauguggcgggcacuggacugugacagacugauaccaucugcugcccucuggucucuucacagggaggcuucucugucuucauucagcucaugcccaucauugugcugauccuuguguccuuguuaagccagcugauggucucgaacccuccguacuccuuauaccccagaucguaaguagcuaagcaagauuugacagcguuucauuguugcugauucuuuuucuuuccuuugaggggguccugugaugcucuuaagugccuacucuuuuccaggaaaaucucuaauuuaaaaaguaguuagagaguucaaccgccagcuuaagagaugccaccgaaagggaaaagugguucuggagaaggaggggaaggaggugcagccccugggagugacagugcugacaagaagucucaggguccuaaaggugguggcaacgcaguaaagcucagacacauucugugugaaaaacaugggaaagucauggaagccaugcaaaaguuaaagucugggaugagaugcagugaaguggccacacaauauagugaagauaaagucagacaagggggugacuuggguuggaugaccagaggauccaugguggggccauuucaagaagcaguguuugccuuuacuguaagugggauggauaagccuguguuuacagacccaccaguuaagacaaaauuuggauaucauauuauuaugguugaagggagaaaaucaaaucacaugaaagacugauuaaaaaaauaaaaauaaaaauaaauguagaaaaaguaaguuaacauuagugauauauuucuaacauucuucucggugguguacacaucugucccaguguggguaaggacagaagagccauguuugaauuugaauuuaauauaguacuuaauacacugacaugaaagacaagaaggcagaggaaagaagaauuggucuuauacaaaugucauuaagugggagacaauuuaagugaacaggagauaaaggaagcuaaacuaaaaaaaaaauugugugcucuauaaaaacugguuuaaggcaguuucugagaauguaauacugauauuaacuaauacuaauguuagcuaaugcugguguuaacuaauacugauguuaacuugaaauuacuuuuauuuuugcuucuugaguugcauaguaggauauagucguaauuaaaagaauaaucauccaucucuuuugcaguggaucaggacaaacuauuaaaaugcagacagaaaacuuggguguuguuuauuacgucaguaaggacuuuaaaagcgaauauaaaggaacacuauuacaaaaaguagaaaagaguguggaagaggauuacgugacuaauauucgaaauaacugcuggaaagaaagacagcagaguaaguccgucacauguuuuuaacaucuuagaaaaucguuagagucuuuggaauuacuauugugaauuuccuaaccugagugcuccgaaaugacuugguuuguaauugggauucaguacaugaauaaguagucagccccaugucugaggccucacucauccauguuuucaaucagcuguuaaucaaacucuacagaaaaagccugcaugcugauguuccugcugucacugcaaucugcuccuuacacuguaacaaccagcugcaugacaccaccaccuuaggcaagguauagguuauaugcaaacacagauaagagacuucgacauccuucugucuuagugucuggagauccugggcgcaaucuaacauguuaacaugucuauugaggacugagugcagugauuuuuauccauguggcaaaauauaaguacuuggcauaguguaagaacuuacugagugguucuugucucacgguguuuaauaaacauuuuguugaguagauucccuuacaugaugcuuccuccagucucacauuacccagaaguccaaauuacuucucucuaaacuagauaccucaucaucacagcagaaggcucaguaagcauuuaacauagugguauggaccagucagagauaaauguuauuuugucaugcgaguguugaugcacccagugcugugcagaucuuacugaucacagcuacagcggguucaugacagcagcaauggcauccugcuggguggaugucgucccacacccuccagccuguccagcucuuccuucugcccaugcucccugagcuuugcagggacgauagcgacguccuguuuagaauugugccuuccucagucacuuaugcucauuauuuuggcacuguauaagucugcagucuuaaucccagcacuugggaggcagaggcagguggauuucugaguucugggccagccuggucuacaaagugaguuccaggacagccagagcuacacagagaaacccuuucuugaaacacuccucuccccuccaaaagagucugcagucaucaccacacauugcaaagagcaucucuuucuucaaagaugacagcauguuaaucaugggauguaaacaaguauuuaaaggcaaguucauuguguccauuuaguaaaacagcagaguagcuucuccaaucaggccuguggccuuuuagccauagguuuauguccagguuuacaguaccagaugugaauccuuuccuguccagugguccucaacucugaccagaacguaguuauugaccccauaacagcuauagcauuuauuucaugaugggcauauacuaucuaaaagacuccagagcugaauucacugucccugguaguucuuugucagccugaauagcuccuuuuggcaccauggaagcuaucugggaaaagcaggcuuccagcucaguuaaucugauuuuccugugaccaagcauguaauauguuuagccauaaggucuuaucaccuacuucuagcaggcagaauuaugguuauuucuucaaguugugcgugggggguagguauuugcauuuuugugugugggguauacauauauuccaaauuuuugccaugugugaaagcacacacaauccuggcacuuggggugcuggugcacaaggaccacaagugugagggcagcuugggcuauuuaaugaagcccauucucgagaagaagguggaggaagaaagggaggaggaacgaguuuugaguucuuaacuguugcaauuaucacaaaaucacaacaaauacagccacuggcagccuugcuucucgggugacagcuuagaaaagucccagagaauauuccagagcagccccuuaagccccuuggcucaggaagggcucugggagggguggcagggcucuagccuuauuuccuuuugauguugauucugugugcuaaguucaaaauaaaguuauauaaagaaaaagaccaaaaggugugguggcacaugccuuuagucauagcauucagaggcaaaggcaggaggaucucugaguucaaggccagccuggucuacauaguaaguuucaggacagccaggacuauguagaaacccugucccaaagagaaauucuuuuaaauaaaagaaaaacccugagugaaauaguuuauaggaaucguacuuccuuucuuucauuuuuaaaagucgguuaagagaauuauauguguguauauauauaugaaccucucuaaaguguuauuuaaauuuaagcaacuaaggugauguaaauaauuuuuaacuagcaaauauuugacauacagaaacagauaugcaguaugcagccaaaguguaccgugaugagcagcugcggaggaaggcggaugcccugagcauggagaacugcaaggagcuagagcggcugaccagucucuacaaggggggauaagcugggucccaccugcuccuuucuguguacucugucuucucuguaaauuucaugucgccaugaagcugaagaagauuugauuaaagacuaagcugaguaguugauuccugaaaucuuggacuguuaaugaccuacuggcucauuucaauaguaagaacugaaaacuaaauauuuuaguaugcuucugcaauuacuuuaacuuuaaaaucuuauaugauuccuuacaaagucuggagaggauuaucacaccgguagcaguugccagcuuugugauucuccauuguuccuuugccauguaaauauuucuaggaugauuuuguacacaugcgagcgcuugccuuuuauuuaaauuauuuuaguguuuagcuccaugagacacuagguucgggccgauggaauggacacagucacauuucccauuagguguuugcguguguggaguuuaaacaaugaacauuuuucaaaaagaaaaaaacaaaacuuuauguaaaaucuuauaucaguguagaaggaauugacauuuuaaauauuguucuuauauuccagaaucuguacugacauaagugaacugguguuuacucucagugugcucuuuaguuuuaugaaugcuaagccauacauaggaaugaauugcuauaagauagacuuuaaagaaaauaugaugauaaauauuaugcuaagugaguuuucaaugguaaguugcagugaugccauucacaauuccaguaauuaaaaguuagccccagccgggcagugguggcgcacgccuuuaaucccagcacucgggaggcagaggcaggcagauuucugaguucaaggccagccuggucuacaaagugaguuccaggacaaccagggcuauacagagaaacccugucucgagaaaaaccaaaaccuaaaacaaaacaaaaguuagccccaaauguucauuuaugugucuuucaaggcuacugaagcuuaugaaacaaaagaugaacuuucuuccuauggaaauucaguuucauggagauaacugaagcaggaccccaaagcaaauggauucuucuacaaauaaguaauaagaacaaaaugaccacuaacaccgggcuuugugccuuucugacugcagcuggcuuacuucacagcaugguguguugggccacaguagcccugugcagagauagagcagcagcuagagcagugauugacagcuagcagcuagagcagugauugacagcuagcagcuagagcggugauugacagcaagcagcuagaguggugauugacagcaagcagcuagaguggugauugacagcaagcugcuagaguggugauugacagcaagcagcuagaguggugauugacagcaagcagcuagagcggugauugacagcaa

SEQ ID NO: 1732 - RNA, 17561 nt, Mus musculus
auacuuuggauugauucugcaaccaugagaucaaauaaccaagucaaauuuggucacaucauaaaaaugaggauuuuucuccuaacuuaaaaacucuuuuagauaucaaggaugcuaggcauuaccucuaaaacuguaccguuauuuuaaagacagaucccauaagggcaacagaacagcugcugaaagaucuggcacaccacucugccagccugaauuuaaugaccuacaugugaagggcuccauauccaguuacuaacccucccucagcuacucucugcccugauacggaggcagccgaaaaaagaugcccuacuaacagcucauaaguggauucacauuuuacugccaauguucaguuaacagaaaucucuaagauuugagagauccacaacacagagcaugugauccacaucuuuuuccaaauaaaaacagaguuuaaaaaagaucucccccacacacuaaauucagagacgauucaguucauuuaagagccuguaacaaguucaaaaggucaagcaacaagaaaaaucuaaugaugggucuuuauuugaaaaauaguuuuuuaucugcaaauucuacagauucauccaucagaaaagccaaauuaaaacaaaacaacuacaaaaagaccaaccuacccaacuguuugguuuuucuuuuucccucgguugacuuggucuauauuuagcaaaaagauuauauaaggucaaguauuuacaaacgaugaaauaucacuaguguuuugcaaaacagcauaaacaaaaccucaaaggauggacuguaaaguauuauguuuuacuaaggacauaaaaagaaaacuuuaaaauuccuaaguucgaugaauuucuauuaaaaauuucaguuuacaauuuuuucacuuaugaaagaccauugguaacuuucuuacauaaauuagaaguacguugggcaauacuagaucauccucucaacgcagaaaaaaauaagagcauuucgucuguuucgcauuucaauuucuuucaguggggcgaucuucgccucgagacccgagcuuacacaggccuguggguagaaaugcaacgcuugaccgggaaaaacgccucgcgguagccacuaaccauucccgcaaaacccaggcccagaccccgcccccuacaggcuccuccucuuucuccgguuuggaguuagcgcaguccgaugacguaagccguaagugccguaaccgggcgcgcaaccaccgccucugccucugggaguugaaguuucugaaggaggacgaccgcguggagccgagaacacuucagaaaggcuuucuaaccgcaccccggcguuccccaccggccccgcggcacgguaaauauggcacugcggcugucgugccccugcccguugguauccuuucggaugccaaaggagcgugagcuacccuagccuccgcugcaaccaaggcuuccggaguagagggugagggccugggaaguaguugccgguuugcggaggaaguggcgucaggugugcguuuuccacgccccucgccacucacgugccgucuuccagagucgugauuggucagcugcgguucguucgcgggcgcagggccccgcucggggcgugcgcgcgcccgguugucgccgcggugugcgcuccggguuucuguuguuuaggagagucccuaccggaaguguggcagaaaggagccauguggagucucaggguagcuugucgcaacgcugcguugcgccuagagggcaggcgagccguuuucccuucuuuuccucuuuuuccuucccugggucaggccgucgcauguaagggcgccgaggggcaguugcugcccaggcggcucggccucguggucagcugaggaugagguuaagauggacgcguuaccgguugccacugaaauauuuuguguuuaaaaugugguugcguguccggagauguaaaauuacucauuuaaaaaaaaaaaaaaaaaaaagcucuccugagauucccucccaagccagaacucaagccaaagggacuuugacaacugaacaaagggcuauugcuacugcgguacagaccaacgcguuuaaaaauaaaaaaaaauaaaauaacauaaaaauacccugaaguaggcauguauugauuuuagaguuaccgaaaagaaagcuuaaagacuacgagggccguuuuagucgauuugauaacagccggguuuuugucuuuggcauuaagugacguaugcucuuccccacaccagauagucuuugucaguauuacucaguuuugaguuuuguaauccugucugauaacuuauauccaagaauuaaccauccagguuuuuucuuuuuaagauaugcuaaaguaaagucucagaguuguuuuaucuuucuguaaaauguucuuaaauacuuguuagacuuggauuaguggauuaaaaugugcuuuaagcaucacugcuggucugggagaagccucagacucgcugccauagagauucaccucgugacccaaacuaaagccguguguucaaaagugccguguuuuacauaaugcaucaaauucuuacucuauuacuuaguagacagucggagcggaagcuaucuuggugaagucuagacaaaacaagacagccagcuaguauuuuaucugcauucauguauuuuauaaaaugaaacauauuucauguguuguucaguagucuggcuuauuuaaucaaagcuuaggaaacacccaguacaguguuucaagaauugauaaaacacauuaauguuaggacaagcucacgauaggcugcucaaagauguuacuauucugugauaggucaaguuaaauuuaacuggagacauuuuagaugugaaagacaaaggcucccccuggugucagagagcuguaaaacacggcuuuuguaauucucacaguuaaggcagcucaacacuucaaaauuuugaacauagagaaacuacugaaaaguauugccacggauaaauauugcuuuguuucauaggaauuuaguacuagagaccagaggaguuaguaacuuugaaauuacucucuucguuuucuuuuagaauucuaugaaaucccauaucuacucaaguuauccucucgguuuggaauaagucaacugaguuucaaguuucagagcugugcucucuugaaaauauguuucauaaaauguuuuccuguuaauuucaauuuugcuuuuaaguuugcauuacugagucuuguuuuuuccacuauucaugccuuugggcauauacauuuuugaguuuuauuuaaugccuuuagagccaucugucaacagugugcaguagcacucucccuucagaauucccccauccucaggguuuuagguuacugggaaguuuugguguuggaucuggguuugaguaauaauacacaauuucaucccuuuaaucaguauauucucucugcuagauuuguuugagaugcuuuuuuucauaggaauuuaguacuagagaccagaggaguuaguaacuuugaaauuacucucuucauuuucuuuuagacuccuaugaaaucccuuaucuacucaguuauccucucaguuuggaauaagucaacugaguuucaaguaacgugacacugcacuuucaaagaaaucgagaagcauagaguaaagcuauuguuuaaguucugcaaaaguguuguccucauuauuacaucucgaagaguaauuguguuguuguuuguuuuuguuuuggcuuagauuaucguuuguuugcuuagauuaacuagcuagcucuguaagaaugaagaaucucagaauguuucuuaaggccacaugcuauuuagcagauuaugcuuugucugaggcagggacaaguaggcaaacacuuguaagccuuguuauuaagaacauauuaaagagaaaagauauuucaguguaguucgccuucccccagucagcaaguugaguucuagcuguuauggauaaaaaugugugugguuggauuuaaaugaagauugauuucggucaaugcuaagaauuuugcggacugauuacagaaucaauuuuuauauuuuguuuauagccauagcuaaagcauuuacagauauauagugacauuuauuagagagagaaagaaaacuuguaucauucaaguuagaaaauccagauacccaugaacagaaguggaagguaugugugaauaugugcuuuaauaaauaauauaaaaggaauauuaguauuugcauugucucucagauuuaaaauguaacuguuaccucucaucaguaaguaauuuuggaaauaccauuuuuccuggcugcuuagcaugaguaacuaaccuauauuauagaagaaccauugguuuacucucuaugcugacacucaaauaaguucucacuuuuuacaguuaaaaauguuaggaugaauaaauuaugaugcagccuuuacuguacauuucugacucgcuuacaggaauuuauucuaagaaaccauugcuagguaagaaaguaucuacaguaguucaguucucugaggcugugauaaaacaccauggccaaaagcaaguuaaaggaaugguaucuggcugaugcuucuagaccacaguucaucacugagggcagucagggcaaagcagagaccauggcgucugccuuuccgcuugcuccaucgcucaugcuuagugaccaggaccaccagccuagggauggcacugcccacacuaauaaggacagcuccuccucacagacauggccacaggccaucugggcagagccaguguuguuacccaccccccaauccccaauugagccuuucucacauaacucuggucuuggucgaugucaccuugacagcggaagcuaacuaguguuggugcuuuuauaacucucaaaacauuugcacgcuggaaagaacaugaagaccgucuauaguauauguaaacacucuauuucuucaguccuuccaggacagucaaugaaugguauuuaauucaugucaagugagaguuaaagaucuuugccaauaaaugaaaucuaacuaucuaaugugcauuuuuaucaaugauagugcuuagcauguagugaucucuauuggccauuuggccauuuggguaauuuuacuuuguaaguugccaguucguguaaaaaaauuuuugcuuuucaaauuuuucagagacaaugaauaugucaucugaaaugcugccagcauccaucgagucuacuaauguggaggaaaagcuggguacgagugacggugaagaggagagacaggagccuagaguggaugcaggggcugagccaauaucuaaacggcaacugaagaagcugaugaaacaaaaacagugggaagagcaacgugaacagcgcaagugcguacacagagcaugcacugcuguuuuacugagaaauggggcuucagguccuguuaaaagcugucuguccugaaacagaagucaugaaaaauaaggauaugcauguucuuagcuauaauuaaaaccauaugccuuccgaauuguuacuuugcuuuuugcaauacuaaugaacuuagacuccgccccuuuuuucuccucagacugccugaggagcgcaaaccugcuaggaugggcucugguauggguguccuagaucuaaguaaagcagccacgcaggaaagccagcuuuggccugacaugggugugccuaagacaggauuucaugaaagcauuucucauagccauugucuaaugccaacauuuauaagagauuagaaaaacuuggacuuuuguuucuguucuuuaguaaauuuagucaaauauucuuuuuaguauucccuaugauauugaacuagaaaaucguuuaguggaugaguugugaauaaauucuuuauaaaucaucuuuauaaaucucuuaguccuauaugauacuagugaugaaacuaucgaauacugcaguuauacauuaaagaaagcucuauuagcucugcaaaguccuucucuucaugugugaagauauuguauggaguaaaucacguuacuaaggucugacccuuuucccucacagaagagagaugucacagccaugacuauuuuaaaauguaauuuuuuguuuaauuagaaguuuugugaaugucuaaauauacagauaaugaaaaaaaaugucauuugauauuuuagggagaaacgaaaagaaaaacggaagagaaagaaauuagaacgacgccagcuggaguccaacucagauggcaacgacaggaagcgcguucggagagauguugcucgcagcagccuccgccuggucaucgacuguagcuuugaugacuugaugguguuaaagguaucaugaggucccugugugugaacuagguuaagccacuuuuauuuucuugaguaauauuacaguguuuauauacuagacuacaucguaaauuuuucaaacucuauuacuccuaaaugaacugcuuugauauguauagcauauucauguauauguuuauauauguguagauagacauuuccuccacaguuagguaauagagcccagugaucacauauugguuauaaagauuacggaguugcacgauggcauaugucuguaauccuaccacuuagaugacugaggcagagggaucucagagauuuaggccaaccuaggauauaguacauuuaaagcaaaccugcacuacuuagucagauccuaucucaaauuaaaaaaaagucuguagcauggcuggagagauggaacucaaguuaagacuuuuuggucuugcagaggacucaggauugguccccagugugacacagugacucacaaacaucuauaacuccaguuucagggcaucugacccccucuucuggccuccacuggcacugcaugaacaugguguacauacguauauccagguacacacacacacucacacacacacacacagaguuuuaaaucuggcauuuuaccagugccacucggguaaauguggaaauagcaugauucuaaagaaaguuuuuuuguuguugucuguuaaaccagcauaacuagcauuuugaauaaaaacuuuaacaggacgggugaauuauggaguguugucuuuauaugugucguuugguuaguguucaggaaaaucaaaugaaacuuaucacaacggcguuacauuaaaaaaaaaaaaagacuuuugccugccugaccaucucuucugcuuacucuguuccuguaauaccauagaaggccucagaugcuuuugauaacucucuuuuguuaaaauuaugcuauuuuauaggauauuaagaaacuucauaaacagauucaacgauguuaugcagaaaaccgccgagccucucauccagugcagguguguguggguugcaggcuccuuucccuucgccccagcggcccaccccugacggucuuaggcuccugcaugcuuguuugaugaccuuucuacaggacuauguuggacaugagugugcucccagacucccccucuccagucucacaccccacugugcaguguugcaugucuuuguuuuaggauaugugcacauuuucacaccaguucucagcuuugacuccuuccacugugggaaguggggagagaggggaaguaggcugccacugccuguuuguaccacaggcccucuuagacgugucugguuuacauuuccuuugagccacugacauuucugagaaggaaggguuuaacuuagagaucgaguguagacgcuagccaacugcugcucugaacgccaccucaugacguggagagccaggaacucccguggauguugaccaaguggaagcaacguggaacugagcgcuuauauaauuuuauacccuaccuuugugacauucuuugcaucuuuuuaaaaauucuaccgaggcccuuaacuuccuugguugagcuauagaggagaugucagggaaggcucagcagcagcaagaauaauagugacaguuaaacagcuuucccagggagguggaugagagcuuggugaaaaccagggagucugcagggugcccaucaguggcagacagagacaggucauaccugaugagccaccuuaacacgggcccuuucucccgaugagucaggcgcccagaguauaucacaguucuucuuuucuagcucagugaaaacuucuuuguguuucccuggugcugaggggauaaaauagugaacuuaacugaccagauuucuccuuuuucucugcuuaccaauugcucaucaguuuuacuugacaagccauggaggucaacugaagaagaacauggaugagaacgaccaaggaugggucaacuggaagguaggagacagacgggccacauucuucuaagcuucuaagggccuuuguuucugaccuaagcucuggugggucuuggugugcuacaaaacucugcauaucacuauacuaugucuaaaguuacaaggauagaagcuaaagaagagaccggcaugucuguucauuuguauuuccucucauaagucuuaucugcugucuuaagccacuuguuuaaaaaagaagucucuaaacgccuugauaagucuuugaagccuuuugcuucaaacucacucuaaaauuugaaacucuguacauuuguuucuucuaaauccauacuauccauucugugaccacuagcugaacaugguuguacguuccugagaugugaaaaucuggauugugaguugacauagguuguaaaugugagauauaugcugacuuaaaagggguggggcuauaacauggguauauuaugguaaaagauacugaaggucauuuguuuaauuuuuacuuuuuuagugcagcuucuagcagauuucaaauguauuuaugagauaaaauuucuguguucuagguauauguagagaugcacucagcuuggcucagugccagugugaccaccuugccuaugugcagauguggccaauuuggcuauguacagauacggccagcuuagcuagacauagauguggccggcuuggcacaggacucguguucaguggacagcuguauuaugccugucuguguuguuuacuguuuguguucaguucccacaguguccagcuuuccccacuagugccuacuaaucuacucgcugcauacauuaagagccugugugcauacauuugaagcaaagcauccuuagcaagucuucagauucgggucucuuucuaagaacuaacaaauguguuagacaagcauaccaugcaguuugugucuuuccaagcuuguuuauauccuuggguuucuagagaaauacagacucacuggcuuugagcuacucacauccuucucgaggccguuauuaauuauaagagucagauuuauagcauauucuuuuucagaaaaguaauuguauuaucuaagugucugcuuuauuugauuuucuugaagauuauuguauaagagucagagucuggaaacauaucauucaggcaguuagugugacuugaaaaaucuuacagcucuuacucacuccugugucucugaacugacaguuuuggcaaagaagcuuucagaugugucuccuuguagaaacagacacauucuauuaauuaaauugacacaguuuccuuuugauggucacaugggauccauaauuggaaaagacauuucuugucuggaaaacagugugaugaagaaggcaggaaaaugcauuuuuauuuuuauauuuagaauagagguuaugucagaaagguagacugauaccguauucaauccugaguugaggaguuggaguugacccuauaggaaaggcuagggaauccaagugagguuguagagacucggccugccauuagugugcgggauuagauuaggaacugggccccagccgagggagugagguugguagaauaugagguaaggagcggguuauggguuuugcguuacuacucuagcagcagccucucaagcuugauagcagguguuugggacaaguuuguuuugaggaaagaggacaucagccagcuuucagggcccugcuaaugauacacucucucaccuuuuguuguugaaggauauucacaucaagucagagcacuauagugaacucauaaaaaaagaagaccugguuuaucugacgucagacucaccuaauguacugaaggacuuagaugagucaaaggccuacgugauuggagggcuaguggaccacaaccaucacaagguacugugcuuugcuccucccuagaaccugacaaaauccuaagagugaacggucuuucuugagugccuagugaugugguggugaccuaagcuaagcaaaggguucaccuuaacuuaccugacccuccuacagcucagggaggucacugcaguuauugucuacauuucagcguugcggggucugaggaacaaagagauuacaccuaaagucaacggugacagguagcaaaguggauuauuagaaaugaccagauagcugcagggucugcaugguuaagcugugcuguguugcuggaagcucugauacuuggauugcugagccacugaaguugauaguaauuuuuaaaauaguuaauuuugauguguaugaguguuuugccugcauguaugucugcucuagugcuugucugauguccuugaaggucaggaaauacugucagauccucuggaacuggaauuacagacaguugugagccaccauguguguugcgucccacuugaccagcaagaaagacgcaaccacagguucuucuuaaagcaguuuacucaggcaacuucuuucuucuuaucccccagccucucuaguuacaaguguuuuucacuccagcuacaaccacgcccccaccaaucaccacaggucacaucaccucaccaggcaggcuugcucagccaaucagggauuaagggcgggccauccaccaagcaugggcuuguuuacuaccuggaacagauuuccauccagcugaccuguuuacagucuggaauggcuuccuacacauguggguccucuggaagaguaguuuacuaacuacagauucaucucuccuauacuaguuuuuaaauauaugauuucucaaaucauuuuuuucucaccuaguuuucuuuucucgccucauguuuuuauauagauaagaaguuacuuucuaaagaguacauuauuauguacuuugcaacaugcucaauucaucucaguuuucuaaagaaaauguauuuuuccuaagugaagaucagcauaguauaugaaguaauuguacacuucagcagcaguguguauggagaauuccucccaugucacacauggucacaucugccuguccaguggugacugcauggcuggggagcuccuagguguaauauggcugagaaacuggauuuuuuuuuuuuaauuauaaauuugaaguuggcagguguggcuaggcauuggguaaacaaaucuagaauaucccaggggccuugucagaauggucauuagccuuucucuugucagugggaaauucugauuuauaauauacauacaagcagauucucuguuuaaguuguaucuguuucucuaauaaacuauuccuauucaaaaagccccuggcuccucuaauauuuugccccuacauaggaaaaguacuuguugagaaauucagcuuacauuuccuggacagucuuuuuaucugggauagacacagauuuccagcauuucaaguuugagaaaauauaaaauccuuaucuaacaguaaguugguagaaagggaaaaauaaaauguaagaaaaaaaaugaaauacucuucacucaggguuuuauuucauugacauauuugugucuaaguguauaauugaaacugaauuuccuuuaaauguuuuuguagcagauuuuagcagagccaucguauguggccugguucugaguaguggcaccuaggcuuugacgugacgucuguaacuagucagugauugguaucugagaucuuacgggguugugcauuugaaggacucucagagccuuuacguaacagucugggagccuccuauggcugagaauugcuuagguaugguuuccuucagacagccccuagauuguauuagagguucugguauuuggaaauugaccugcuaacagugccuuuuauguuaaauaaaaaguacuugugcuaagcugguguuguccaguccuggaggggcggauucccgugcgcugaggagccgaaacucagcuuguaguggugccucugugugugggaucacauccugcauaaccuagaacacugacauaguuuacccugacagaaaggaugguggugcucgucuccaguucccauggaguguuucacugagaggaacggggcagggacuagaaaggggacaaucagagagcagacccaccgggauuuccuuguucuaccacugagaaguuuccuaccucuucacuccuucacaguggggugcuuaaacaaaggcuguaaacgcuccuacccgucuuaaacacaggcuauugagauguuuucugcacugaagaccuuucugaaaaagaucuacuuuuuccuagacugcacaacaccuaagucccagugucuuuauuuucagggacucacauuuaaacaagcaaccaguuacggaaucgaacaugcacagcucccucuugcagauuuugugaagaugaacagucgaaaaguccuggccguuaaccaugguaagcugcuaaggugcccuaaagcggaccuaagugaacacugcgaagguacauuucagauuuggacaaauaggaagaagucauguguucauuagaaauaaaagggaauacuugagacauuuuugagaauuuacaaaggauaaaaacagcuagcuauaaacugugacucacuuuagggugugucccucccaccucuuuuucucugacuuuagucucucagcuuuacucaucuggcguacuuaucucucacuucauuguaguguccauggcauugauuuuuagugacuaugugauacuccacccucuaaggagauaaucauucucccaugaauauuuuaauuuguuuuauaauauaaaauauaaauuuaauuauauuuuauuuuuugcuauuuaaugcccgaaauuaaccuauaauuuccaccugcccaggaaccagguaacaucauggaaugcugggaauuguaguucuuggaaaacaacaaagccucaugggaaaguaugguggccuauagguuuguccuuauaaagucuucauuccuuaaugaagccucguguucuuaaaugucuuucauucaacaaucucagcuggaaaauuccagggaaugguucucaccaaagcccgucucuugcuuaguauuuaauacguaguaaagcuugccuuaaauuuggcuccaaaugguagaauuuguuuuucucuggugaaucucaagauuaacagccaucaugaauaacauugugguaugguuaguuauaauugauugccuuaaguauuguuuauuuaaauuaugauaaaaauuuuuugagacaggauuucacuguguugacuagacuucuugaacucugagaaaccuuaccugccucugccuccuucuuaaacgcuaggauuacagaucuaucccaccacuuaauuuauaucaagccuuucucauacuucuaaccccagcacucuggagacucgggaaguaggucaauagugugaggccaauccaggcuucaaagaaaagaaauaaucauuuauugaaaaaaaaaaaaaagacauauaccaccaagccagugagcuuuaauguuuuuugagauucauuuauucuuauguuuuguguaugaguguuuugccugcauguauguaggugcaccuggugcaugucuggugccuauggaggucagaagaggaaauuauaucccuggaacuggaguugcaggcauuguaagcaaccauguggauauuaggcacugaaccccaguccucuguaagagcagccaguccucuuaaccacugauccaucucucuggugcuuuuaauuaauuaauuuuagacaguacacaauaauuuauguaauccuaaauacuuuuuauauagcauccuauauggaguuaaagaaaugaaauuaauuauucaaggacuaaauuucuccugaaaccuuugauaccuaguggaaauuccuuuucuggaaaauaaccuagagcgcccuuccauaguguggagaacauagggacggcauugguuuccuuucuacuacuaugaaagcaagagcagacagcaggcaaaagcuccucacaguggcucuuuguagugacgauagaagagacggacugaauguuagcugugugcgcccuagucaugagcuacuacauagagaugaagaagaugauggagcccucucuugauuauaacacacacuugacucuaggaaguuucuggggcuugagaacugacugaggaaaagcuggaaaggacaaggguuggagagccauggggcuguuugugccugauagauagccaaaaggagagagggaagaacugcaguaauuaggacaagugagcacacagcacagcucgaauuacacgccagugugcagcaucguggugccugugacuaacaagugucugcauuugcccuuguugcaguguuugaaauuauccuggaguucuuggaaacaagagacuggcaagaggcauucuuuacaaucuuaccccaacggaaaggggccguuccugcucacaaggccugcgaaagcucuccucaggaccaccagucccugccagaaggaugggacagugccagcgagggagagaguugcagggauaauccugucucaccacagaaagacgagcagggccagcagagcagcccgguucugcagugagccccgucccacaguaaccuuccccuguccuccucucgcuuaagagaaaccaggcagugcggugcuuuacagaaugcucagacugcaagaaaacuuucucuagucuauguuguggaauuuuaaaucuguuuuaagaguuaaauaauaaugaaaaaaacccuuuaaacacuaagaaaggaucguuugguuuuguguaagaagacuuaaagauaugauuucaaaauugcuuuaagccucaaaucagucauggaggacguggaauacgagucugccucgguucgucacucacuggagcauauccuucaggacgugucuucugacccuugagcuugguucuuuaaguuccuaccuguaucuuuuuaguccgaugucuauuugguggagcagauauucauaacugaccugugugucuucuagaauguugaacuuuggaagcuaugcuuuuuucuguagcuuugguguuuugucuaagaaauacauuaauucuaggagaacuaccaguuguuugcugggcucuacaauucauuccuuuuggacaauggagucuauuccugugccucccuugugauaccuuguuaugcuucugaaauagucacaagaauaaucuuaaauccuguaaugacaauaacuuauucaauuacacagcuaaguuuugcuggcuagauuauuauauaagcuuuuuuugaaggaucaauuugucuuuaccucaguuuaaaacaaaacaaaaaaguuauccuucucauauauuuuccauauauauauauaccauauauuuccauaauguuaucuuuuaaugugaauauuauacaucugccuccaacuaauauaaauguuucuguaaauagcauaugcauguaggaaaaugagcauguaauaauguuuacaucuguccauaucacauuuagccuucaugccuuaauccacaaugacaggacugaugcauucuuugcggaauggguguguugaauucacuaguuugaauucguuaaauggaauugaacagugguuuggaaaccgauggagacagagcagagggcacugcacuguugggcuucugcagagaguuugcagaguaguauucaggucacaagcccuucgcacgagugcaguggagcuccaggggcucucauuggucuuuucucuuuaugauacaaugugugcgcuguguuagcaucucacuuacacagacgcucaugacauuugguguugguggucagugccuauugcuuuauucuuaguuaccuauuguagcuagcucuuucaaagucuauaaaugaaguauguaaacagucacaguauaguucuaaaugaauaaaguucauguuguuacuguacuuuucuaaaauucagguuuugugagguacaccccaugggcccguguguuuggacacuuggucuccagcugauggugccguuuucgagguuguggggccuuucaaaggggaagcuuugcuggagggagcaugucacuuagggugggcuuuucuuucuuccuucuuucuuucuuucuuucuuucuuucuuucuuucucuuucuuucuuucucuuucuuucuuuucuuuccuuccuuccuuccuuccuuccuuccuucuuuccuucuuucuuucuuucuuucuuucuuucuuuuuuuuuuuuuuuuuuugguuuucugagacaggguuucucuguguaucucuggcuguccuggaacucacucuguagaccaggcuggccucgaacucagagauccgccugccucugccucccaagugcugggaucaaaggugugagccaccacugccuggugggcuuuucaacucuauagccaguccuguuuuuugugucuucuuuccuuuauacaggcaaaugugaucaccacguccugacauccaaaccaaccugacaaucccacugccaggccuccccugcagugagggucuguauaccuccucagagcucuagaccaaaauaacccucccuuccuuauuggccuuuugucaggguguuuugucaugaaguaacauaaaaguaucuaacaaaaacauaucauuuuauaugggagaggacccuauaaaagugaaggaaaucauuucaagugccacaugguuucagcucacucauugcaaaagcucuguugauuuccugggcaugcuauaagaaaacaccacagaccuagugggcuaaaauaaccacaacuuauuuucuacagugucagaggcugcaaguucagaaucaagccugguagggucaugcucccucuggcucacaagacguucuuuuuaaccuuaauguauuuuuuucugucaacuuuuuguuuuccaguacagcagcagaugaaaaggagaaaauagguaacaaugauuugaauuaauggcagcagagaccaugagcucagugagugagcuagcucauggaggucuuucucccucuuucuagcucauuucgagggcaugcgccgugagcuuaauaugugugaagaagacagugauggucgccucaagagucgggauuguugcuggggagaucaggggauuggaugaggcguaagccuuguacucuuaugcuuguauugugacacuggguauguuagaacucagugucccuauuuuaaaugugacuguuacauauugguccugucagcagcgugugagguaggcaauggggacuuggugacuuucuuccucuccuuguuucucuucucucuugaccuugccagcucuaaaauaucaguaaaccugcuucagacuuuuuguucuuuugggguacaagucuugacaagauuuuaaaaaucugcuuucugccagaacaggggcaaagaacuaaaugcauagcauuucauaaaggcuuuauuacaacaguaaaaacaaugcuaaaauaaaacacaaccaugaaagaccaaau

SEQ ID NO: 1733 - RNA, 893 nt, Mus musculus
cugagaacagcucuuucuguuguaaaguuugauaauaaagacgcucuagcuucuggaaaggggacugacaugcuggauggauuccuuggucaucuagcucugcuugaagcccaccaaucuuuaggcugaagaauuuggguaaucucuuucugucuggcaugaacccaugacaccagcauacaccaugggugacuugaugcuggguguggggccccuggaauaugggggcggggaguguuaguggaugcagagauagugugacaagugacuagggaucgcccuuuugcacacauugagcauacaguugugcugugcgaauuaagugugaagauagccuugguauaaacacaguuucacaaugagaugguugccaccuucauuucauucuuaugcaugggacacagguauagauuuguggcucugcucugcaaaaguacaguaacuacugacgaagacagcaaucccuugugugggcauagcugacuucgcuuuuccucucuucacagcagacuuucauuagguucacugaucccauccucugguccaugugcacugggccugugccaaaaaucagaggugugguugggagacugaaagcuugaagcugaagagggaggugcccuccgucacggagcuccuguucaacacgccucacugcucucaaguuuacccuucagccucucagggacguauugucuggguucaccauagccagugggugaguccaugcugcuaccgggagcugagucccccuuuccacaccucaccaagcaagggcauggggcaugggauuguaaauaaucucccuaagggaagugugugaugacuuggcccucccuuuuggucuugagaccucuaaaugcaaccaguauccugcucauucuauguuccca

SEQ ID NO: 1734 - RNA, 31754 nt, Mus musculus
cuaaaacagcagcggaggcggagggagcugguccuuaaggaaggcacgcgcuugcuucuagauuccgaagcguuuucaaagcugguuacaguccuuaccacagcacacccuugugagguaaguguauuaucaucuuugguucauaaaugaaaaaguugaggcacugagcguauuaagucacucgccuaaggaguaugagucaacgucaagagucauaguugacccgguuuaacgacuccugaccuucaguccagggcugagucagcggagccccgaguggcuucccuggcuggcaccuggacguaggcuauuuccguccacguccaagcagaauacuggaaccgauuggacagaacuuccaaacuuucacguccagcaagauucaccccugacgccuucaucucaggacugggaacaggaaaagccgacgcgugcacuccccuuccccaaacgagugagaggguaccguggggcaagcccgcccacccgcuugggcagcgaugguagcaagggaccacccgcguuaguggaccggggacuggggagacgcagaccacaucaacgacucuccaucgccgccucuuucagaaaccaagagaaaauggugggaggcgaaaagaaaaacuaaauaaaaagcaacuugucuuaggaccucagcuaagcaaaugaagccuucuugcgugugcugagccugcaguucucaaccuucuaggaaagaugggaggacugggcgacagaaggcacagcaggaaugccccgcagugagugcaaccggagcucugcccgcugcccagcagaggccuaaauccaacucggcaggaagcgcccgcggcgccgggagccacgcacccucgccagcgaccacgugaucacuuuuuuuuuuuuuggaagaaaaaaaaaaacuucuugccuuaagaaaaaaaaaaaaaaaaaaaaaaaaaaagacuccacuucccagaagccucuccuuccccaagcagcugcagucuugcgcaggcgccgcuagggccaaacggacacguccgucacgugggcaggagccggccaauccgguuugaaucucauuuuuuuccucucgcccccccuucaggagcgguugugcgaucagaucgaucuaagauggcgacuguggaaccggugaguauugccuucggcccccacccccgagcuccccgcgcuccggcuuccuccgcucagggacucccgcaggacggcguuaccggcgcgcacggcgccucccgccgcguccggucccugcccgcccccggccugaccuucggcgggcagccucggcgccgggaggcuggcggcggcagcguggagcgcacacgccgugugggggcccgggcaccggggcgguggggggaggggcgccgcgcggggccgcgaugcggcgggcggagggcggcucgggacacgggcgcggggaucggcguggggucccggggucucgggggggcguggggcgggcggcuccuagcgggcaccguggcuggugggcggcgagccggcccgagagagccggagagggagcccgaggcagcggcgccucgccgucgccggcgacccgccgccggggguccucgugcgggccgcgcucuggagcugcggaggagggugggcuggcggagcccaccggugggcgcgcgggagcugggcgggcgcgucccgcggggagccgggggccguggcguugaguaggggagcaugcucaggggucgugucgcgcaccucccggcgccggggacaggggccggcugagguggggaucacauuguccuggccccuccacgccgggacggggcugucauggaggagggaagggggaggagcgaggccuacagaucgccgccgcgggucggcuggccggagaccugcauuucacacgcgccgggcuuuccauucauucauccucggggcgcagcgcgcacgccuccgaggaccggguagauucuuccgcucuuaagccaccaccagaucgucugggagauagccaacgaacacuuaauuuuagaaauaggaacuuucaagauuaccuuuucuuaaauuaaaagaaaaaacauuuuuuuuuaaagcauggugggggcaguggcgcgagccgcgacuugcgaguggaggucagaggacagcuuuuagagucccgaggaucgagauucaggcgcuuuucucgaaccaucacuuaagcucaucagcauuugcuuuuccauuugauguuuccuucuuaacuuuauacugcuucccucuuaaugaaagcgcuauuuugaaauuaauugaagcaagaugcacauagagcaucacggcguaacuccgguagcccgaagguggugauuuuuuuuuuuuuuuuuucuucugucaugguuuggguuugccagcagcuggcucacuggccauccaucgcagguuuuuuuuuuuuuuuuuaaggaaugucacacaugugugaaagucucaggcgcauaaaggcauagacuagcaaccagaaaccucuguagaacaccuuugccagauguuuuaaaacucaccgauagacugaauaugaauaauuugauauguuugcaaaauggccuuaucuuggcaaaauucaagacaacuuuuugggaguggagacaugauuuacuuguucuuuauugacaucaguuuuccuggcauuuugcaaaacugcaucauaaguuguuggugaaauuaacuuuagaauaucaauguaagagcaagaggggaagcauuuaaauguaaccuagacucuugacaaguucuccugucuccugauugaaucuucuacuuuucucuaccaguguuagaggaaaauauuacagauaauaauagaggcaaagcuaagcaauaaacagcaauguguucuaugacaucucaguuccacuuaagucuuggauugugcuaaagccacaauguagucauuggauuuuguucugagucaguacuuaggaguugcugauaguuuuggguggguacagagugauaucuaggauacaaaguuauauuaaauguggucugugcuuuguuccucgucagugucugggucagaggugaaauacucuuccuagugauggcaggguugauguggauaguguguaaauuuaaggacaagagaaaccuagaaaccuaacaagugugaaggaugaaacuuggauggaaacuaguuggagacaguaugcgaaaugacauugcggagcucauuuucuucugucgguacccccuggcuuguaggauagucaugcagugcucuugguaacauuuguaagauuuccuuuuggaguugagugguugcucuggccuucuuuaaucccagcacucaggaggcagaaacagucuguucuacagaccuagcucuaggacuuccuccaaacuaaacgguuugggugcuugauuuuagcuugaguuuuagggccugguacguuuacuaauuucauucuaccacuaaacuacacuaguacuuuuucaguuuuaaguaauaaaaaaaaaagauuacuuauucuacuauuggauuacagaugaagcuuguaaaaauuaaaaaucuuauuuggucauugcuauuuucauuuagcuugugagguuuuuuuuuuguuuguuuguuuuuuuuguuuuuuuuuuguuuuguuuuuuuugguagugugcuuaauuguaaacacuuaucaaccuguagggugugacccuuuuggagucuaaagacccuuuaacaagagcugccuaagaccaucagaaaacacagauguuuauauugugauuuauaacuagcaaaauuaggaaguagcaaugaaaaugcuucuauaguauggggugacuacaaccugaggaacugcauuaaagggucacagcauuaggaagguugagcacacugacauagucgugaacuguugguuuuucuccccccuacauacccaaccuuuuauaagcauuggccaaauuuuuagucuauggaauuuucauagucauuuucaauuugauacuacaugguuuuaauuauuugagcuuaguaauggcuuacaaguauaaauugagaaguucaaaggggaacauuauauuguauugcuucacagaacuuguggacaaaggcugcucuccuggaauuguggcaaugucaaaauuagauugaguaaggauggcaggacagugucccccacuguuccuaguggcuuguguuuccuuuuagauagcuuguucuucugcugcucuacuuuuuuucuuguuauuuauuagagaauacuuucauuagagaauaauuucuuguaguuuucauuuuuugguuuuuguguagccauuguuggcuuggagcuuacuauuuaggccagacugguuaaccaaaaacuugaggugggggugggaguuguuccugucuucccaguguugggauuuacagggguaaccaucacaccuaguccaguuccuuuaugcuuagaaacgugcuuuuaaaguaagacuuaaacacagaagccugcuguggugcugugcaacuguaaucccagcacucagaagugcaggcaacagaauugugaauuuagcuuggccuacauaucaaggucuuaucucagagcaaaauaagauccaagaaaaaaagguccagugagauagaugguuuuagggguaaaagugccaagccugaggaccugagucagagcuagaacccucaagugcaaacagaggaccucaugcaaagucgcucucugaccuccagguccacaccaaagcaagcgcacgcauagaaaaaugaguaaguaaauauauacuuaaaacucuuuaaaaagggcuagagagguggcucaucaguuaaaagcaacucuagaggacccagguucaauucccagcacgcacaugguggcucacagcugucugacaugcauuccagcuccgaguuucaggagagccucgcacaccaggcaugcauguguugcacauaucugugcaugcagacacacugugcccauacacaugggggaaaagcuuugaaagaaaacaggaaaagaauaaaauguaaugugcuuaucaacaaaaagcagauggcuugguaagccaacuuugacaauuucuuuuucuuuagugagaaacccauuuucuuaguuuaguaauaaaccaaacuuuggguguuuauuccaaauuucacuuaaguuuauacucugaaucuguaugcuugacuuagagaaauuaaaucugaauguacaguuuacacaguuaucuagaaucauguaaaaugagucagguuggcuuaauucagauugaacauagaaagucccgagcaaauuauacuuucaugaaacaauuucuagaacagcaguucuuaaacuggggguugaacauaacccuuucacagaggucgccuaggaccauuggaaacauauuuccauuagucauagcaguagcaaaaucacaguuaugaaguagcaacaaaauaauguuaugguugggucaccacaacaugaggagcuguguuaaagggucccggucguaggaaggcugcaggccaccguagagcaaggcucugaagcucggcggcagcagcccuggacgugacgcacgugugcagaagcugcucuggccuuuccccuuuucaugcccaucacauuggagacggcucuucugugacagugaguugugccgucuuucucaggaaauggcugagaaguggaaaugagcuuggcuuacauaguuccauuuaaauuucccugugauggagaacauugagauuucucaguccugaaaaguaggaaucagauauccuaaagugauccugacuuuaaauguaguguuuauagaggauuguuuucacuguggacuuacuguuuacacaaucaagguucugcagagucggcacuucugcaugcacugaucuuuucugcugggaaauucaugacugucuuguaaguuguuggccauuaguaagcaaugggaagccugugaccacagccucagguacugucuccuuuccuguccuuaucauaaaaaucacuucuaaagagucuagucaaucuagagaagaaaagauugccuuucaucucaaaaauaaucauuuuuguagucagaaguaaguaguuguugguaugugauggugugucugugucucuguauuucuuuuccaccuauauuguaauuuauauauauaugucauuccauggaaacuggugggaagcguagugucacuguguugagugaauuuaugucuaaucaugacaagccugacuacuguuuccaggaauauggauuuaguguucuaagcaaauaacuuaaggugggggguguguuaauuacuguuuguaacaacuguuuacuuuuauaguagcuauuuuuaauguaggcagaucuuuauuaauugcuaacuuaguguguguuagacaucccaguggguacuauauucauuuaauguaguucuauaagauaaguggaagcguucuuauuucacagaugaggaaacuaagggaucggaauggcuugacuuuaaggcagccacuuccugaguguguguguccauccguccccuuaagcaucacaucaccaucugucuccuggggguacaggauaccuucagaaauggagcuugauaucaacaaacuuacagggacuuagcugcagcucugaacugaacguuguguagccaacauuuacagcauguugaaucaaacaaagcauaggauucuaagaaaauagcuggagacagcucaggccucaguugugcaaaugcacauucugcuggcuacuugggaugcuauccaauacaauacagauggcucagaaggauaugucacguguuacuuagggaauaaugacagaaauauguuuuagaaugggcuuuaccuucaguuugagguuuguugaauuuguugauaacaaacccacagacacagagagcuccuuguauauauaauaggcauguuuuaguuuuaguacuuggucuagagcuuuguaggucgauuuuuaaaagauaucaagugacugcuucccuucuccugacuucuuguuugccucuuagaauauuuuacuaguggaaccaauuucagugaauuguaaaaaagaaaccaacccacaaacugcaauuuacuugcuguaaacuaagcaauuuuagugaaacguuugcuagggugaaacaguucuauuugggaaaguuucagccauagugcauauuaacauuuuauuuaagcuuguuauugcaacguacuuaguagaaauuagcuauaaugcucuuuccuugcuuuuacagugggagauuuuaaugcuuugucaauguacuaguauugccgcgugaacucuuagggacaguggcuugccacuguaaugucuguucucuucauuucaagugucacugaaggcagggauaucugacuccuuauagaaagguaaaaaguacauauuuccuccauauuuuagauaaguuuguagguaaggaacugacauuuuuguaaauugcauuacuaagguuacuuaggugcugauugagcuaggacugaacaccaaagcaaacucucaaacuuuacugauaugcuauuaaggggaaauuaaaaacuacaccaaaauguagccauaauuaaaaugucuaaccuacuuuucaucaaaacuuguguauuaaggauaauaaaauugauguuucggucauaauugaacauaaauauguuaauauaaaaucauuccugugaaguuucuacuauauaguuugaaugguaaggugaugaauuauauguacguauaaugcauuuaaugcauauuuaaugcccuuuucuuaucauucuggcuugugaacucuaauggcauuuagcuuuuauuuugcuuguauacuuuuucuuaaauuacuaauccaugcucaugguccaaaauucaaauaaauuccuuuagccuucugaugaagucuguggucagauucuguagauuuguuucuuuuugcauucguauggauauaauccaucucucuauuuuuuuguuuuuuuuuuguuuuuguuuuuuuuuuuuuuuuuuuuuuuugggagggggagacaacaggguuucucuguauagcccuggcuguccuggaacucacucuguagaccaggcuggccucgaacucagaaauccgccugccccugccucccaagugcugggauuaaaggcgugcgccaccacgcccgccccaucucaauauuuuuaaaugcguuauauaaaaugcacauaguuacaggaaaaaaaauauuucgauguauaaguugcuguaaaaugccuaguccuggccuuauuucuguaauugagacaaagucucacuguaucucugacugacccaaaacucgagauccaccugccuuugccucuugagugcuaagauuaaaaguguguggaagauuaaaauuaucauuuaguguuguaugaaaaugauauucucugaguuaauauuuuucuucucuuuuuaaccaaaugggcaguuaaaaauccagauuuuguacaggguuguacaacuauuuaggauuucaaauguugcugugaugaauguaugggguuuuauguaaaguacguguuuuaacaacaaauugaaaaguuaaaauguugcugguuaagucaacgaugugauaguugguuguuaccuaaaaucacucagcucuccuuuaaaaaguuaacgcuucacauggaugaagggcuagagagguggcucagagcuuaagagcacuugcucuuuuucagaggaccuggaugugguuccaagcauggcagcucacaacaguuucaggguauacaacaccugcucuccacaggcaccacacacucaugugguacacacaccuguguguguguuuguguaugugugugcaugcaaaguguuuaugcacauauuaauggaauuuguauaagugccuaucacuaaggaaauuauguuuaaucuauugucauauucuaacacuuuuuaaaggaaggccuuuauuuaaaggaagguuuuuauuauuuauucaugugaauguuuguguauauaugugugggugccagaggaggccagacaaaggcauccgauccccuguggcuggacuuacaggucagguugugagccaccguguguguguguguguguguguguguguguguguguguguguguggugugugugugugugcgcgcgcugggaauugaacccggaucuucuggaagaauagcaacugcucuugccuccugagccacuucucugaccucauagucuuacuuuuugucuaccuacuaucuugacuagugacgaugguuccucuucucuugcugcagaguuuuauuaaaaaauaaugaaucuuuauacaauguuuugaucauguuuuuccccucuucugacuccuugaagauucucccuacuuuccugcccacacuacaugucuuuccucuuucaaaaacuccuacuaaaaugaaaaucaaaacaagcagaagacugaccuauaaaacaaacagacaaaaaugcccaaaaaaagcacaacaaaacaaaaauucgugaaaauuccacugacuuuguuuuuguguuggccacuuauuccuggguguggggccugcccuggagugagagagagagagagagagagagaguguguguguguguguguguguguguguguguguguguucuccauccguccuugacauucauuuggagaaaaaggauuuucccauugccgacugguaucgauugcagauagcuucuugguuaguaguaagagccagugucugcuucuccaucuuagugcuggggcacccugucuagcuugaaccugugcaggccuaguacucgcugccacagucuuuguggguucauaugugcgucgauccugccgaagacacucuucaccucuggcucuuacaguuuuucugccucuuccacauagaucccugagcccuuaaugaaggaaggauuuaaugaagaaaucccauccaggauucugcagauuguccaguugugggucucuguuaauucucugauauggguugagugagguacuaaucuugauagcaugcagcguaccuuccuguacccugaugcuggucagugcaccugcuggacuuuguguucagugacuuccaagugcugucuucagcaauagagcaaucagguguggagagcaaccaaggagagccuuggcaauagccugcgauauuuggaguggggguugggugucuuuaggaucccuuuggccaguggcucaacaagauguaacccauuccugucacuggagguuuuauuuguugaaguaagaucuauuuuaggcauugucucccuauuuuauuccucuucccuuuggagggaagggguuucaagucccuggcuguucuggaauuuucuuuguagcccagccaggccucaacuuagagaucugccuguuucugccuucuguguucugggauuaaagcuauaugcuaccacuggagagguggcucagugguuaagagcacugacugcucuuccagagauccugaguucaauucccagcaaccacauggugucucacaaccaucaguaauggaaucugaugcccucuucuggugugucugaagacaacuauaguguacucacauaaaauaaauaauucuuuuuuaagaaagguauaugcuaccacuguccagucccuuaguuuuuuauauauauauacuaaauuccauacuacauaucuuucugcuuuuuaaaauacuaauaaaauggaauugagucuaggguacuuguugaguaggcaaguggucuaccacuaaguucugauuuauucugaaacaggguaugugauaccucagucuggccuugaacucacucuagccuaggcaggccuuaaacuugacauuuuuuaguuucuggaauuacaggccuguaaaccaggccugacuuaguuguuuagcucuggggauaaaaaccaaaacccugaaaaacuacaugguguacaaggaaaagauacugcugccauuguuggguggaaguucugaagaaaaaaaaaaaaaagaauaauuugaguauaauuuugggcuuaauaguuuggcuucgucuuguagauggauucuucuauuaucugacuggucugucuuaugggccaggcaaagagucuucaguaauagagaguagucacucuguaggaaugggccacucuuaccguguuuuaaaguuaauuaaagcuagguuguuuuggucuaaguguacaggcuagcuggacagaaagaaacagcuccauugauacagucagaaugagugauguguaaaaaguuguguguuucaguuuuauuuuuauauuuuacaccacuauuacccaaaccuaggaccauacagaugcuggggccaguacucagccaucaugccaucgagcugguguuugcuuguguuuauuauaaagggcacgcuggcauuaugucacaucauuugccauuuucaccucaaccacacgccgcuuuauuucaucuaaugcacuguuccugguucugacuuauauaaguuguugcaccagucuauuugucuucuuccuguuuggauucuugucucacuuuguuagcucagcauuucuuuuuuuaaaaagaaagaaagagaaagaaagaaggaaagaaaagguacaugaacuggugggggugggggucaucuuaguguuaucgccacugagauuccccguguuccaguaaaucaccccacccgcccacccuccaugaucaugcacaguucuaauuaaacucagugugccacaaaacauuagacagaaaauagggagauugggaagagccucuuacucacugggagauaagagagggcagugggguaaaaaugucagaguaagugaauaaguguuuucauccaccaugcuggugcuucaguuauuuauguugcccauaacccuuuucccuuguaauugucaacuauuuaacugugccacuguuggucucaugagggugguagccaacagcauuacagccacagacuuaguagugacuccagaaaguucucugggauaacuuuguuaauaagaguucgucuccugugguguuuuucuuuuggcaauucuuuugagggguuuggugauccaggcaaaaccaaaacccccuuuaucuuggucaguuucacuguagugcucauaacucuucuauauuuuuacuuauuuauuuuuaguuuugauauggacccaggggcagagcagacugacauuggccuccgguguauuucagacacaggacuuggcuugaacuggguggcaugguggagguggcauggcgucugagcugagagauggaggacagaaggagaaaguuaaacuuaggccgccucaagccaaccuggggaagacugggaucaugacagcucaaauccaucauuucuauuaguauucauucauucauucauuuuuucuuuuuucucuuuauucuucuuugggauuuacuaggcuaauuuuuugggggggggaauuaucuauuucuagucuuuuagauauuaauuuuaguuagaagguguuauuuuucuucuccucuuuuuguccuuugaauauuuuuguuuuguguuguauaguucuggcuguccuaggacuugcuccguagaccaggcuggccuugaacacagagaucugccugccucugucuuccaaggguuaggguuaaaggugugcaccacugccaccuggcugaaugaucuuuuucauauagcuuccuguaauuguuuuauguccauguacaaucauaacaucucgggggggggggggcaguguggaggguggcugcaggagagagcaagccugaacacacuucucugccuguuuccucuaagauuuuuuuuauuuuugaacucaggauagcaguuccaguagcuugaaguagggaaggaaauugaggaaucuagcuucuuuaaucuuuaacuuaccuccucuuuaccacaguucuaaugaaugccagcuugaucugcauugauucagauacuauuuggccaucuguauucucgugucucuuuguuccuuuuauacuaguguauuuugaucacuuuguacuauaguuuuaaauaauuuaauaaauuuaaauguguguguacagacaugagugcagcugacuacagaagcuagaagagggcuuugaauccccugaagcuggaauuacaggugguuguaaaccaccccauguaggugcuggguaccaaauuucaguccuuuggaagguaguaaaugcucuuauuugcuggccaccucuucagcauugugaaggucgaauauaaagagauaaaacacauggagauagcacauugucugguaguaacugcuuaauaaugauuaaguaaaaaguuuucgggaggcuagauaugguggguuauauuuguaauucuagcauuccagaggcugaggcagguacacagugaggcccuauuucaaacaagaaacaacagaaagugaaaagucauaguuuucaugagaugugugguuucuuuggcugguguucaccuguccucauucgccuguugggauguugaauuuguaacuuaggugugcacuucugucuguuguaauagugcuuccuuucuaucauggcacuugaaguagagaaugaagaggggaugggaugcaggggggaugggagcuaggcugucaguugugcuuuguccauuaguuugaauaguggcauugaacuugauuuuacucaagguucuuugguagggaagaguuagcaucagagucauuugacuauaaugaucaugcagguagcuaguuccaaacaagucaccaguuucauuuuucuuucuucauguagccaccacacuugguguaugccugauugaagcuggaagaguuggucaaagaauugaggguagacagaaacuauugaguuuuagagcauagacucuaggcagguuaggucauuacuccugugauaaguuacugagauaugaaugauaaugauucagcuucuguaguuuaaauuuauuuucccuuaugguaagauuaaaaggacuagucagucagaccaccccagagcuugggaaggaaucuuguuugauaugccucaucugcugccucuucccaauucacagcacugaaacugcccauggcuaacuguaguugucagcuguccaucacuugcaugccagacccuucuuuauuuugcaauuaaggaaauugaugcuuagagggaguuuuaaucacuuaaaucccuguucuagaaaaguuucacacuaauuaaaauaaaaggaauugucaaauagggacuacaacuggauuugggcaauagauucccucuguacauacuuuguaauauuucccccuaguccgucagaaauagguagaucugggauugcaugugaugcuauuaggaaaacuguguagugagggcagggcuuggaaaacaaaaguuguuagauggagcauugcuuauagccacagaaugauaggugagcauuauaaauacaucaaacacuauuucuuuuuccucuuucgaucuuuaguguggugcuugacuucauuauccauuauauuccucaucaauaaauaguucagcuccauauuauguucuagccauucaauaguuuaucaaggcagaaaaauacagaauacaggccagaaguauugaagcugcagaacaggaaagaagggagcaggacagccacaguagagugacuucagugcugggcuuuuugcucugggagggauaaagugauuccuucuaguggcuggcuacccagagguauuaaguacacauuauucagagaggagaggugagcaggauguaucauaguucuuuccucuuuucaaaaucauaacauacgcaguacaaucucuacacauauagcaauaccucaaauauucgaagaauagaaagccaugugucuuaggguuuuacugcugugaacagacaccaugacaaaugcaacucuuauaaggacaacauuuaauuguggcuggcucacagguuuggaggcucaguccauuaucaucaaagugggagcaugguagcaucuaggcaggcguggugcaggagaagcugagaguucuacaucuucaucugaaggcuacuaugaggagaugcacuuccaggcagcugggaugagggucuuagagcccacacccacgacgacacaccugucccaacaaggccacaccuccuaauagugccacuccuugggccaagcauauacaaaccaucacaccaugaaaccauacaauuaguuuuguuuguuuguuuguuuguuuguuuaagaaaugguaaaggaagagguggaaaggugguuuggugguauagacuucuacaauaccugaguucaguucccagcauccacauugauacaguuuguaacaccagcuccaggagggauccaaugccucuggcuuugggcacugcauucaugugcacauaacccauaaguuuuguuguuuuguuuuuaaagaggauuaaaguuuauaauucuggaaccauuccagauacaaggacaugccaggucuguaauagaaaugcccaaagauuugucccugguacauucauugagaacugacagugguggaaggaaggcuuugcaucuauugguucaucuggacccagcagugauaggugcuguaauacccaucugaugaagagaaaaagaagguucagaaaauguuacauucucagaauuauacaaaaugaauggcaaagcugggguuccagauggcuguagauaugaauugagcccagcauaucccacauaguggugaaaaacuuguguuguugauagaagucagauuuagugaagugcacuuggaugguagagucucaucugaccucugcuaccuaaucuuuuugaggccagcuuuuuugagaccuuggcucuaaaaaaaaaaaaaaaaaagguacugcuuuuacaaaugacauguacucugaaaaauguaugugacugauuuuaguagauauauaauuacuguaaaaugcaguaaauguuuccaaauguuugcuuuacauuucaauagcuuaacuucccugucgaccaucacaaguauguagaccagcaguaaauauagugugcaggucgcacuuggaguuacugcuuugaaucuaggaaagccaugugccaggaaagccguggacugaacggaggaauuuuguacacuucaaaugaagauuaaaaguugugugaucuucccuaaaaugaaagagaaagccucaguucuuugugggauggagguaguagucaccaaucaggggcuuggagggcaauauucauuuccagaaaagaugguuuaaaugcauauucacauugcaaguuggugacaguuugaauauuaaaaccuuauaccagguuuuaagcauaccaggauuuugugaaccgacacaaaauugaugugaugaaagugagacuaaaauuucaucacauuuauuagagaaaacagcugcaggaaauacuuagccaaauaacauuaggacugugacacauugauaguauuaacuuguuggugugauaguuuuuuuacagaauguugagaaggcuugagguuuugcagcuagcuguuggauuuguccugcucuugcaaggcuuuuccuuuuuuuuuuuuaauuuuauuuuuuacaacuuucugcuguugguacagcagcuuacucaagcacauuacugaacauuguaugugacccauauaaacucagcugaucuaaaaccaggcuacccuuuguguuugaacugacgauauuuuucucuucccuuacuugccacugauauuuaaucucuuugaucugcuaguuaguggcuuccacugcuuacccaacagcugaggcgugcuuucuuagcuugacauccgaggccuucacagucacugcaguauaccauccaaacucaccccacuuucagggacuuuggauaugaucuucuagagaguaaacauaacaccauccuaugguuuuauucuuccuuaaggucuacccuuguguaaugcacuuauuauuuuauucugugaccuuucaagggcaggcugucaauuaggcuaaaauguguuagauuauuuugagaguagccaucuauuaaguuagccuuuacuuuuuguccaaaugauucacuuuacuuuaaaacaacuuuuaugaauuacuuuuuaaauuuuaugugcauugguguuuugccuccauguacgucuuuguaaggguguugaaucuccuggaacuggaaucacagaugguugugagcugccugugguuucugggaauugaaccuaggcccucuggaagaacagccagucagugcucuuuacccuugaaccaucucuccagccuuggauacauccaagaaguuugaagcuuguuuuuaaacauuuuauaaaugcaauacaguccuagcaucuguacucuguaggaaacaaccuuaaaaauaaguuuguauuuagcugcaugucguggcauauaguuuuaauuccagcaugcagaaugcaauagugggcacgucuuccaguccagccagggcuacccugucucaaaaaaaaaaaaaaaaauuuaagggcuggaaugaugcuuuugugguuaggagcacugguagcucugccagacaaccuugcuucccagcacccacacugccaucuguaauuuuaggucuaggggaccugauguggcuauugugcacauaaauauagugcacauacauaugugcaggcaagacacucauauacauauaaaguaaaucuaaaaacuuuacaugggauaauuuguaucucaaugcuaauugugguuaagucuuugccugauaacuguuaucugaauugucuuuagacuuaaaaaucuuuugaauauuuagucacuuaaauucuuuaccaugcaauauuugauuaauugguagauugugagcuuaauacauaggcucaagauuguguucucucugaagagugaaguuuuauuucuggaggcuguuagucuauagauagaagucuugacacuaucaagauuuguuuuauauuuaagacuuagaccuuacccauagugccaugacuuuuauuccuaugauaugacuuucuucugguuuaaucuggaagcugaaagagacucugacuauaaggacuugaauuuccccugaaauucaaauuucacugugccccagagaauuugacuguguucucuguaaacugcacaaagucacacuaugacacgcccuccgagucaccauaggaccgaggaucuaucuaugcauggcuuuuuguggcucacuuuucugccccucauucugucuagugcauuguuagcaaguccaucaccgcuauuccccucuccaaaaccauggagcccccaccuagugugugucuguacagcacugugauucuaagcuagucagggagagcaugcuguucagagcacucugcucuuugaauacuuaaguuggcuacugaggacauguuaaugauuuuacucauuaaggaguugacuauauguaaauuuuagggucuugguuagucuauauacauguuuacauuuguuuaguuacuaaguucauaauuuaugcuuaaguaccauggccgcugguaaucuagugagcaaaaucaaacauaguuaauguguuuguguaugugaggguggggugaauaucaagagaacuuguaggaaggagccuucuacgacgugggugcccaggguuugaaaucagguucacagacuugguagggaacauuuaaccugccaagcuaucugaccagccucuuuauuuuuaagauggugucugucuuaguguguuuauugugguguaugcauguaaugcugucuguacccauaccuguuuaacguagucucaaagcuagcuagcuuacaggccagcuagcuuacaggccagcuagcuuacaggccagcuagcuuugagacugagugguucuucugccuguuucucaucucaucugagaaauaacuggacucagaugcucgccaccauguuggacgauauguaaguuccagggauagaacuuugaacaucagguuuggguuuguaguaucugaucccugaauaauuuuuauggaugcagagaauaaagcuucugaacauauuacaggcugcuuuaaaaaguauguuuuaaauugaguaguugaagucuuuuagcacauacaguacuugucucgggucaguuuaaagcugauagauaguugcacugggaguauaauucaaguguuaucuaaggcauacaagaaaaggcuuagguuugaugccuagagccgagaagucuauaaauuaaauaaaaauauuaaaaauggaagcugagagauggcugagcauuuaagagcucuggcugcugcucuucuacaaggacccugguucaaucuccaucucucacauggcuggaaauaacagccuguucuggccuuuaguaaacauugcacucugggaauacagauacacuccaggcaaagcacucacacauguaagaauacaucuuuaaaaaguuucucuuuuuuuuuuuuuuaaaucugauaaccaaauauaguugugugugcaguuguguguguguacaguuguguguaugggggcggggaguguucccgcacucuauucuagccuucgcuuuagcuucugguggcuuccuuggcuauuaguuaagaucagcuuauagcaggccgaggaaacaacaagggaacaaaugggaaacacuuaaauuauucccagacuccuuuugcauaguuuaggugacuauuauguauagccuaaaagaagacugaaguucaagucaguguccaccuucuuacauuauugccuguugagaauuccaaacagcuguucuuucaagcaaugagucugacaugaaguuaccaaggacuucuguauuacugacuugaucacuuuuauuuuucaccauuuccauguauuuguuaaacuugucagaguauagcuuuaauccucucuaccucauuaacguagaguaugucuuuauuguugguagaccugggaauagaacccgcugcuccaugcaugcuagacauaugcuugucuguugccuaugccauuagcucuuauauaauacuuuaacaucugguaagagcgucggaucauugaacuuuauguauacucuuugauuuuaaaaaugugcaaauaggagggugguguacauuuuauaaaaucacuuaaguuugagaaacuuuuuuugucaugaagcaguagaguagcccgauucuccuagagagggucugucauuugucuuagaaguuaacuguucucugucguuggaucaaguuuguuuaugguauuguugucauaguuauauuuaaaaacuuaaaaauccuacuuaauauuauuucccauuaggaaaccaccccuaccacuaaucccccaccugcagaagaggaaaaaacagagucuaaucaggagguugcuaacccagagcacuauauuaaacacccucuacagaacagguaagcuuucugcugaguaguuuuucugacuuaguaauaaggguguggugaacaagauagguuuacagagaaaaguuagguaugacugguuuuagaugugaucaguugucagccuguagaggauucuuguuaaaggagaaggaaggccucugaaggagauagacauaaacacaggacaaagcggagggcucugggaacauggcuuauucaaggcuucaaaugcauaucauaaaauacaaauaucaauuuaucuuaccuuuuuuguguuauuuauuuuuagauuuguuuuuauguguaugggugguguuuggccugcaucugugauugugcagcguauguguacaguggcuguggaggccagaagagagcauuagcuccucuggaacucguuacaauaauugucugagccaccauguagguguagggaacuauauauggguucucugcaagaguagucagagcuuucaaccacugagucaccaguccagcccuucuugcuauucuuaaaaucuuuacagcuuaguaauguugauuacauuugcauuguuguauaacaaaccuauuucaucuuuaaaaacauaugcauuuuagagccugcuguggcagcacauaccuuaauccuagcacugggggaggugguggucuuuaaaguccagccugcucuguaaagagaaguccaggagagccagggcuacaaagagaaccccuuggaagccccuccacccccaauguauuuuauaaaaacauuauuuuuguguguauguguauaaaaaaugugaagguuucauguggcauagcacaaauuugagcuggcucuuacagagguucuaguugucagaguuaccaggcccccacugcaagugcuuuuccugugcaguuuccuugguaccauuuucaucuuuuaaacuaaaauuaguuuauuaaauaaguugcugucaccagcuguucaguccucagcaccacuuuugaccucuccaaaccugaggaccuuagguaccucauguaaguagacccaugugcauguguggggcaauucacauaggcuuaucccuagacuucguccuuguuaucugugucagauucccucuuuaacguugguuaguuuuccacugccuaucaguucuacauuuuacaccguuugccuacugauggacacuucuacucuuugacugguaaauaaaucagcuaugaauauggguaaacaacuuuauauacuggcuuuuauuuucaggugggcacucugguuuuuuaaaaaugauaaaagcaaaacuuggcaagcaaaccuucgauugaucucuaaguuugauacuguugaagacuuuugggcguaaguaacuuuaagauacuuauauauacuucuaaguugaauaauuuuuuuaucuuacaucauuuacaaaaugaaagaugaauaucuucaaaaguuugaauugguaguuaugcuuuauuuuacauuguugaguacacacaaaagcccuauguuucgguuugauuacucuguauuccucaucuucccgugagaauccucuauuauuguccuagaauuuuuugauagccuuuuggcuguccgucuccugugcagucaccuacauauauuuaugucauaacuggauacuaaaaggccuuacuaaacauccccauuucugcagacagcuuuuaguauaauaucuggaauuucccugcucaggcuaucaaaaggugaaacuuauaaaauuuaacuuucagggcuauaaacucaggaguagcaagacaaugaugugucuguaaucuuaggucauuaauuuuauuguaauuuaucaaagaguaaucaaaauguuuuuuagauuaguuuuuaguuuaggaagaaguuaacuuggaucauaaacuuuucaagacuuacaaauagaauauaaacugaagguuuuuuucgagaaguguauguuugagacaggauguagcugaguuuuugaggauguccuaacauuguagaacuuggaaucccccaccaccuuuaccugccaaggcauagcagaucaacacugcucaugccuuagauguuuugaaauuuaucuuaaaacaguaguuuuuguuuucugaggaucaaauuuaggaccuugaacaugauaggcaagugcuuuacaauugagaugcauccuacuucauccaaaaguugaauuuucuagauauuuuuagagaacauauagggaaauacuuuuugagaauaugagaggcaaauguuggagaagaguuuagaguuaccucacaguuacuauucuauauguuuauauuaggucauaggugcugaguuuagugaccaacauuuucauguaacuucugagucuguuuugcucacacaaaagaauagacuguagucauuaaauucauagcuguauuuuuuuaaggccacaaucaguauucaguguguuuccaaugucuguacugauauuucccugcaacagauauuagguauucauugcaucauugagaaaggcaacauauaaaauacauaagacugcugaauucaguuuuuuucuaagaacauuaugggguuguuuuuuuuuuuuuuuuuuuuuuuuuuugguuuuuugcuuuguuuuguuuuuuuuuaaugaaacaaguauauuucagcucuccuaauuacuaaagguggcugucuaaauuggaguuuuugaaagggucaaaugguuuuuguacucacuguguuuuuacugcaagacuuuugaauaacucucaagccuucuuuacacgcacaaaaaguucuccaguuucuuaauaaggaaaaaggaagggcuugaaucccaugcccacucgcaugugcucuuggacugcauuccuggcuuuuaccuguuuauauaagccugguuccaggauuccuuuaguggagcacagccccacauggcagugaguguaagcaaaagccccgggaaccagagcugagagauggggaaggacggagccugagccuuucuggauggauuaggccaccucuugauuucuuacuccuuucuagaagguuuuacacaaacauuucuucaguccuuuugcuuuagucucauccauguaaccuuaagauucuuagguugugguuugggaacugucagucauuagauacuuaauacuaucguauucaagguggaucauacugugcaaugugguaaggaagauguagacuucuuaaaagugucugaaauauuucuagacaaaauuaaggucaacacagcaagguuccuaagauaaacucugcugucuauuggaggagagcaaauacggaaccgacgugugcuucaguuuuacacagagaucagugacacagcccuucugccuuuaagaaguauauaucaaauaccucgaaaaccauuccgugguuuaaauauuugggcaauagcucagaacugcaggucuaccuguugguaaugccuuugauccuggccugugccugagcuccucauacugcggugcugacugauaggaaccauuuugaguuggagaaccacugcuguguuuauacuugcagagguaauaauguugauugacugagccaugcaguacugaugguuuguuuuaauuuucuuaagugcacauggcugcauugaguuaacaaauguaucaaaauauuuuuuuagaguagucauuugagauaguuguuuguauuaguuuacauuauaaauuucuuugaguguaaucauuauuuagaccuguuguguccauuucagaaauuaacuacauacagagucaaaaaaagaaaaacaaaucuacauacuuuuauguuuucguauuuuccaaaugugugugugucuguguaagcacccaaacccugcauuacauauuauguuuuuaauuauuauuuucuuuuaccuagucuauacaaccauauccaguugucuaguaauuuaaugccuggcugugacuacucacuuuuuaagguaugccuaaucaaugauuguuuauauuuauuacaggaccagaccauucagguauuuguaaaaacuggccacaaauucaggcaguuggcuuuaccaggcuugaguacagugcucugugguaauauuuaguuacucaugggaacauccugggauugacucgagccuugcuaauucugugcagcccuuccuggauauacuugaauagacugacuucgucagcuaauuuuaaacccaugagauauuuauaaacagaccuuugucaggugcuaggauaggacguuaguuagcucaaauuacauaguuuuuaauguagcuucuaaaagguuucugcucgggaauuuucagaaccuuuaggugacaugaagcuuugcaguuggagaauucacaaggaggugggacgcuugcgcaguugcaugccucuggcguguaguucuuguguauguuuaaaagccgugccaguggcagggguacagggaacgaaagaaaaguugucaguggugcuugcugagucuaauacugugucucggaguaccagugcugucuaaugcugccuucuccuccugcaggacgggauugagccuaugugggaagaugagaaaaacaaacgaggaggacgguggcugaucacacugaacaagcagcagagacggagugaccucgaucgcuucuggcuagagacaguaaggcuuuaggauauguuugccuuucucuacuuacagccccuguucuaaagaagcccuugugcucacguggcaucacauuuacuaaaaccagaacgaguagaaauugguaccacgcuugugcaaggaugacauuuaaaucccugaagcguuuugguauuuggacauagcuggaaaguauguuaagggaaauaagccagacuugggaagaagauggcacgucuucucucauguggaacuuagguuuuaaauacaugaguguguuacauaaucuguauuugcaggacagugaagacauguacuaggagugaagcacggaggaggucggggucagauauggggaggggugcgugagaacaagcuagcagagaugcugugaggaaacccacaccuuuauacuaaccugaaacuaccauagaaugcaaauaccuguacacaucugaggggaggaucuuaguguguucaggugugaccuuuccuguugaauaagucacagcccuugcuuuuugaggacaggguuuuacuacccagcuaggcugcuguugccgcucagaguccugcugccuccaacuuuuuaauuauagacaugugcuaguuggcgaagacuuuuuauccauccugugcguaucucaaacaugugaguccagugaaugauuucuaucauuccacaagucauaaaaaaugauugacaaacuaggcgcaguggugcaguauuuuuaucccagaacuuggcaggcagaagcaggcagaucucugugagaucgaggccagcccagucuagagaguuccaagacacccagggauacaaagagaaauccugucucaaaaccaaaaaacuaagcaaauaaaguaaaaagugaaugacauuaacuuuaccucuacaaucagguuccccccucuuaucucauuagucaaaaauaauaggacuuuauauugugauuaauguggacuuuuuauaacccauuuauaguauuacuguaauuaaaaauucugaaaauuugaaauuagugaagcaagugaugacauuguugguuaauauuuaaaacuaaauaauguguugugauauacuuuagcccuuugguuuuaugagcuauacuaugaaacuaggcauuuucuguggucaaguucuagguuguaauuuugggacugaaguucauaguuaaugcuauuuuuuuaaccacuuagacucaguacugauuuacaguuagcacugacuaagugaauaaguacuuacauggaucaguaacauuuuauuaaagcaaagauuuaaucaugcuuuuggaggagaguaugaguaaauaauaccauuguggaaugcccuaggccagugggucucaaccuuccuagugcugcaacccuuuaaaacagcuccccaaguuguggggaccuucaaccagaacauuauuuuuguugcuacuucauaacauaaauuuugcugcuguuaugaauuguaauuuauaugucuguguuuucuaaugguccuaagcacccccuuuaaaaggaucguuuaacccccaaggggguugugaccuacagguugggugcugcugcuguaggaaaaaggacauuucaguuugauagguugaaaaauaaugugauggauugaguuacaguugcucaguguauuuaauaccacugaacucuacuuugaaacuguuaggaaauggcaauuaaugggagcauaaauauauugcugucauugugaucgcugucugcaagguaacuaagcauccgagcaucugaggcuaaugaggucaccuuuuuugugcgccuaaugugcagaaagagguaaaacaguugacgggguuucucuguguggcccuggcuguccuggaacucacucuggagaccaggcuggccuccagagugccuggauuaaaggcgugcgccaccacugcccggcugaauuuuuuuuuuuuaagccaagagaaaaaacaaugcaaacgaguaaaauauagacauuuuaaaaauugguucuugggacugaagagauggcuaaauaguuaagagcacuagcuguucuuaaccaaggagagaugauggauguucaauucucauuacccacuuggcucacaacuguguaauuccaguucugggcgaucuggacacagacaaacacgcaggcagaauaccaauauucuuaaaaauaaauagguuggaguuuuuuguuguuguuuguuuuuuuaucaguucuuaagcugcucugugauucugcagguaagggugcuugcuuccaagucugaguaccugaguuuaauucccagaacucacacgcugugcguuguccucuucuugcauugauuugccacagcaugugugucuugucuccauucacaacaaaacagagucaaaucuuacucauuugcuuucuuuuuugucucuagaucaggaugacuucaaauuuggcaaugcugccucuccugaccaauuuaagaugucaguucuugacuuagaauccgauuuauuuaguuuuauaacuauacauagaagaguccuguguuugcuucuaaguuguugaugauauauauauauauauauauucgauguaauuuguuauuuuuuguuuuauuuuuagcugcugugccuuauuggagaaucuuucgaugacuacagugaugauguguguggagcuguuguuaauguuagagcuaaaggugauaagauagcaauauggacuacugagugugaaaacagagaugcagucacacacauaggguacguugugcucuccuccugcuuccuugacccuugguuaauuaaguguguagaugucuuuuaugugcagcuuuagacacuugguguuuauaaacuguuauuuucuuuguaaauguuuucacaaacaaaaguuuggauccuguuaauguugaauguguuugucuguuuuucauuaauguaaaaugguuuuugcagcaguggugugugcacugucugcagcagguguauuuccauaaaaaguaucaugccuuaguuccuguccauauuuagagcccauguguuuagaaguuucucucucuuuuuuuuguuuacaauucacacacaucaauuuuguuagaauucucuuugauuacaugcaaaucaguaagaaaaaccaagcuagauucuaagugggauuacagggauucauucauuguuagcuugucauuuuucaucuuguaguauaaacauugaccuguagcaauguuguauuuaaaaaaaaaaacagaaauuaaugaauuuguuauagaacuuuuugugucaauauuagauguuuugaaaucuuuaaaacauucuaaccucaguuauucaaggaaauauuuuuuuuauugcuuccaguugacacauuuuaacuucucauugcuuuguguguaugugaauacauuuuuuaauaguaaagaguuuuuuaaaaaaccuguuaugguaccauuucauacuuaaaaaauaccuguuuggaagaacugugauucugccggggguaaagcucggugaaagugggucuuccucauauuguuucugagaauuaaacauucagauuucuuucuaagauuaaaaauuaaguccucugcucuuuucugaggugcuuguuagccuuauuucauacucacaacccagccucacaauuuucauuuuuuuauagcacuuguuuuuuuuuucaaccuuuagaugugcuucauucccugcagauuaaauuguuaauaccuugacaucccucuauccaccucucuacucauccacccauccauccacuugaggcaggaucuuugcauaccuagcccuggcugucucagaacucacuagagauaucugccucugcuucccaagugcugggauuaaaggcgugugccacaaugccuauucccuuuuuuggucuuuuaaggagagauuucucuaauacugcagauaagcuuuagacucucugaauuuaguugauagucauacaguuaaaccuuguuuaguuaguauacaucacauuuuauuuuuaaaguaaucacaacuaauuugaaauugguuuguaaaguugguacauaaagcaaaauagaauucauauguaaauacaauuuuuacuuuaguuuuugagauaggcacuugcuauguuaaccaagcaauugcugugagcccauggacugaucguguuuugcuuguuacugauuuaguaauaauuguaucuuuuuauuaguaauaauaaaaacaaaccuggugagauuacagguaucuguaaugugauuaaagucuggcugugaaaguaaagacuaauuuuuaauuuugcuaguuaauacugagagaaaauuaacacauuucgacuugcauugcuaauguaaagacuaauauaugauagauuuauaaaauacauaugaagacuuuaucuuuuuuuuuaaaauauuguuucuugucucccaugucuuguaggaggguauacaaggaaagguuaggacuuccuccgaagauagugauugguuaucagucccacgcagacacagcuacaaagagcggcuccaccacuaaaaauagguuuguuguuuaagaagacaccuucugaguauucucacaggagacugcgucacgcaaucgagauugggagcugaaccaaagccucaucaaagcagaguggacugcacugaaguugauuccauccaaguguugcuaagauauaagagaagucucauucgccuuugucuuguacuucuguguucauucuccucccccacccccaauuuuugcuaguguguccacuaucccaaucaaagaauuacaguauacgucaccccagaacccgcagauguguuccuggcccgcucuguaacagccgguuagaauuaccaugacacacacauuugccuuuccacaguauucgaaaaagaacuugcauuucuauuaccuuagcaggaaagaucugguuuugcuccacuccaugcaggagcggacuuugcuggugugagagucugaguacagcuuucuagcaaccuucuguuuccuuucacagcauuguccuugcuguccucuugcugauggcugcuagauuuaauuuauuugcuucccuccuugauaacauuagugauucugauuucaguuuuucauuuguuuugcuuuuguuuuuuuccucguguaacauuggugaaggauccaggaauaugacagaaagguggaauaaacauuaaauuugugcauucuuugguaauuuuuuuguuuuuuguaacuacaaagcuuugcuacaaauuuaugcauuucauucaaaucagugaucuaugucugugugaucccuaaacauaauuguggacuauaaaaauguaacaccauaauuacauuccuaacuagaauuaguaugucugccuuuguaucucuaugcuguacuuuaacacuuuguauucuuagguuauuuugcuuugguuacaauggcucaaguagaaaagcggucccauccauauuaagacaguguacaaaacuguaaauaaaauguguacagugaauugucuuuuagacaacuagauuuguccuuuauuucuccaucucuagaaggaaucuguacuucguauugcaaggcagucucuugugucuucuuagagugucuuccccaugcacagccucaguuuggagcacuaguuuauuauguuuauuacaauuuuuaauaaauugacuagguaguaucacauguaauuacacugauguggcuaucuuuuuaauaaaguuaaggcacaguugcucaguccuagguugagugauggacuuugacuauguuacaguugaugaggauugggguuuuggugcaucaccauucgguaggaacagcggcuagaaacugauuguuggguuuaagauguuuuuacuuaauggccagaaaauuagcguaaggaaaguauauagagaaacaugcguuagggacauuaguguuacuaucugaauaaaacacaauaaacaaguauuaagaacuacuuauauuggucaauuguugcaguaugguuuucuguaaacuugaaaccuugaucuauucuuuguaucauuuaaagcaaacaugaagacauuuugucugcaguacguaauuguauaguucagauccugugagaugagguguggcuguuaacgccgaaggguaagcugaacuguggguagcagaguggaaaccauuggcugagagaaaaaugcucuuuaaguggugguuguuaugaauucacacugauaacuugauaaagauccuuauaaaauacauacggaauuaauagcauugcucuuauuauguacgucaagaauguauaaccgccugcucuuguugucacagauaacucccuguucagugcuuuggaaauagcgaugcucacgaucucagcauucuguacccuacaucuacuguguggaucauugagagaucuuuugacauugcaacaugauauggucuauguugggcugcauuccuggcugucuuguaugagaccccgguuggcucccugaagcugauugauacaguguacaggcaugaagguggcugaugaggcuuucuuaccaacaugugggauucuaguaguuguaucuauuagagauuaauucucauauuccuuuucauucauuuguaagaaguaucaacuuuagaagugaaaaaagaaucauaaaauacaguuuuuaaaguuaaaaacuuugaguaggauguaucuuuguuauagaaaguugaaauaauuuguaauggaugaauaauuauaauggaaaaaugaaaaaacuggacagaaagauuuagcauauacuauauaggaauuaauaacuacagcacuuacauaauaaguuaggcaguguuuuauucuugucacguguucauaauauauguagguauuucucccuuuuauaaaugaaugagaauugggauuugguguaucaccauuugauacauuaagauuuaaauaauuucauagcuucugucagauacagaguaugaacuugugaauaauucuuaaucacauaaaucaca

SEQ ID NO: 1735 - RNA, 649 nt, Mus musculus
uuugggggucuuuauuuuuaaaaauaaauaaaacauggacaaagaaugagauuaggaaaggcaugggagagcauccuuuguugagcaggauuguaaaucugagaguugaggcuauccuggccuauauagagaauuuuagggcagucugggcuacauaacuggauuuuguauuucugccagaaaaaaaaaaaaaaacaauugagggggaaagaagaaggaugaggagggggaagaggaggaggaggagaaggagaaggaggaggaggaggaaaagaagaagaaggaggaggaggaggaggaggaagaggaggaaaagaagaagaaggaggaggaggaggaggaggaagaggaggaagaagaagaagaagaagaagaagaagaacaagaacaagaagaacaagaacaagaagaagaaaggaaguguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuacucagucucacgcagcaagcaggcgaaggagcaagagcaagagcuagacucccuucuuccaauguccuuauauugucucc

SEQ ID NO: 1736 - RNA, 649 nt, Mus musculus
ggagacaauauaaggacauuggaagaagggagucuagcucuugcucuugcuccuucgccugcuugcugcgugagacugaguaacugcuagauccuuggacuuccauucacagcugcgacugaacaauuguugggaauugggcugccgacuguaagucaucaauaaauuccuuuacuaucuagagacuauccauaaguucugugacucuagagaacccugacuaauacacuuccuuucuucuucuuguucuuguucuucuuguucuuguucuucuucuucuucuucuucuucuucuuccuccucuuccuccuccuccuccuccuccuucuucuucuuuuccuccucuuccuccuccuccuccuccuccuucuucuucuuuuccuccuccuccuccuucuccuucuccuccuccuccucuucccccuccucauccuucuucuuucccccucaauuguuuuuuuuuuuuuuucuggcagaaauacaaaauccaguuauguagcccagacugcccuaaaauucucuauauaggccaggauagccucaacucucagauuuacaauccugcucaacaaaggaugcucucccaugccuuuccuaaucucauucuuuguccauguuuuauuuauuuuuaaaaauaaagacccccaaa

SEQ ID NO: 1737 - RNA, 1697 nt, Mus musculus
cuauuaggccucuuaacuguacucauuuccuggccaaccuucacuuccauuguccugggacacuuugacuuauugccauguuguuugaacuugccuagcuggucaaaaauaaggacuccacccugggguugaaguucuaggccugcaccugggcugcugagcacacucagguaagcgcuagcagcuaugaacucauccuucaccuuugauagacaucacugugauccauuccccagugagccuucucugccugcuaccacagcagcaauugcuagcaugcucugugauaagaaagaaaauccacccccuucucaucccgggucacagcccacugccagcaucacaaccaagucacagcaggguccaccugcuugugggagacacaaaaggacggaaauaaaucgccugugauauaugucucuggcucagcauuuguccauccuuucuugacaaaggacaucccugaaccuucugggccacacaaguuggggauggcguggggaagguuguugguuucaaaacugguccaagucucaaagggaaagguuacaccuggaaaugaguuggagacccagaccaaaaaaaaaaaguaaggcauaaaacggcaggagacagcuguuacagggcauacaaaccucuuggaaaacuuuugcccgucgccuugcagaggacguggggugguguuucacuggucuugagccugcucucuacagcccuggauuugccacggcuccugaauccacccaggcucugaucguaucucuccucacaugcucagaccuaaguccaucugcugugucuuuauuuucugcugaccccucacaaguggacuguguccacgccucuuccaucuuacauauguuuuguacuaucucuuccuccugggggcagaauuccuccuuccguuuuggucucuccucuguccuucccucucuucccuaccugucuugcuuuccauuagcaggaccuuguacuuguuuauaucccuuccuuggccaggagagacuaaaauaccaaccaaaggggugugugcugggugucagcuuaugggaaaggcugcaugaggauagacagcgggaaaccagaaccagagggucgagcagcaaguggccacuuuagcauguacuaggguggguuuuauggagggaacuuggaacuagacggaggaggagaagagcgagcuuguggagaucuuaagaauguuccaggucaggggaagggcugguguccacggucuucaaucugccucaggaggaggcugacaggggacucagcaauaggaccagcuuaggcucugacugagucuccagcuuacacuuaguagagcccaguucuccagugaagacucuucgugccugugcugguugguuuuaugucaacuugacacaagcuauagucaccuguaucaauugagaaaaugccuccguaagauuggacuguaggcaagccuguggaacauuuucuuagugauugaugagaaaggacgcaguccauuguggguggugccaucccugggcugguaguccugaguucuaugagaaagcaagcugagcaagccagaaagcagcaccucuucuuggccucugcaucagcuccugccuucggauucuugcccugcuugaguuccaguccugacuuccuucagugaugaacagcuauguggaaguguaagccaaauaaaaccuuuccuccccaac

SEQ ID NO: 1738 - RNA, 1697 nt, Mus musculus
guuggggaggaaagguuuuauuuggcuuacacuuccacauagcuguucaucacugaaggaagucaggacuggaacucaagcagggcaagaauccgaaggcaggagcugaugcagaggccaagaagaggugcugcuuucuggcuugcucagcuugcuuucucauagaacucaggacuaccagcccagggauggcaccacccacaauggacugcguccuuucucaucaaucacuaagaaaauguuccacaggcuugccuacaguccaaucuuacggaggcauuuucucaauugauacaggugacuauagcuugugucaaguugacauaaaaccaaccagcacaggcacgaagagucuucacuggagaacugggcucuacuaaguguaagcuggagacucagucagagccuaagcugguccuauugcugaguccccugucagccuccuccugaggcagauugaagaccguggacaccagcccuuccccugaccuggaacauucuuaagaucuccacaagcucgcucuucuccuccuccgucuaguuccaaguucccuccauaaaacccacccuaguacaugcuaaaguggccacuugcugcucgacccucugguucugguuucccgcugucuauccucaugcagccuuucccauaagcugacacccagcacacaccccuuugguugguauuuuagucucuccuggccaaggaagggauauaaacaaguacaagguccugcuaauggaaagcaagacagguagggaagagagggaaggacagaggagagaccaaaacggaaggaggaauucugcccccaggaggaagagauaguacaaaacauauguaagauggaagaggcguggacacaguccacuugugaggggucagcagaaaauaaagacacagcagauggacuuaggucugagcaugugaggagagauacgaucagagccuggguggauucaggagccguggcaaauccagggcuguagagagcaggcucaagaccagugaaacaccaccccacguccucugcaaggcgacgggcaaaaguuuuccaagagguuuguaugcccuguaacagcugucuccugccguuuuaugccuuacuuuuuuuuuuuggucugggucuccaacucauuuccagguguaaccuuucccuuugagacuuggaccaguuuugaaaccaacaaccuuccccacgccauccccaacuuguguggcccagaagguucagggauguccuuugucaagaaaggauggacaaaugcugagccagagacauauaucacaggcgauuuauuuccguccuuuugugucucccacaagcagguggacccugcugugacuugguugugaugcuggcagugggcugugacccgggaugagaaggggguggauuuucuuucuuaucacagagcaugcuagcaauugcugcugugguagcaggcagagaaggcucacuggggaauggaucacagugaugucuaucaaaggugaaggaugaguucauagcugcuagcgcuuaccugagugugcucagcagcccaggugcaggccuagaacuucaaccccaggguggaguccuuauuuuugaccagcuaggcaaguucaaacaacauggcaauaagucaaagugucccaggacaauggaagugaagguuggccaggaaaugaguacaguuaagaggccuaauag

SEQ ID NO: 1739 - RNA, 1615 nt, Mus musculus
uguguguguguguguguguguaugagagagagagagagagagagagagagagaaagagaaagagagagacucugugucuguguauguauguacaagcaggaguacaugugacuauggcuagucacaagagggaauugcaucucuuugagguauagguauuugugaagugcucaguggauucuaaaagccaaauuugggcucagcaucuuucuggcccccaggaucauuuucuuaacuauacauaaaguaugguaucauuaagucaucuugaaaccuaccuagucaccuuaagcaccaaaagucuugacuguauauuauaauuugaaacauauacuuucuuuguuguccuguuuuuucuuuagaaaaaguagguuucaauacuuaauauguaacccaguaagcauagagaugcugguucccucaucgauuguaggagaugcuaucauucuauggcagccaaucaggagucauaaauucuuaucugugaauguaccuguuacuuaugaauacugaaugaaguguaacuucaagagaauagucagaauuucuccuugacaaacauccaggccuguuuuauguaaacuuaacggauaaugauucguaucacaucaaaaccagaagagcagagacagaagcucaaaaaaaaaccauguguccuccaagcauagucgacaagccacuauguuccuuagcuuucaaacccacuucugcuaaccaacccuugccauucccucgagaggcuacaauggaaacuacuugcuccuucuuuugcagcugcugccaucacagcucuuccuccaggaucuucccccuucuuccugguuuaugcagauguuucaggugaaacagaaaaguguccccagcgcucuucuuuuuaagacccaugaaaacuaucaauggaaucagagcuuucugugauagcauacacacaaaguccucaauaggagcccacaugcauuuuccaaggccccucuuccuguacguaguuuucuccuggcuuuguucuuaggagccuauagaagccuuuguucuuguccacuaggauaaauccugugaccuccuucagacugaauuaaauauccccagagucuuucucugaccaucaacccucuccuuucuugguuagaaacauucuccccaucuguguccuucuguaauguucuccccaaaccauaguacacaucaugguagucugugucauguugucagucuuucucauguugggcagggaagagcuuuguaauacaugccuguguuaucauccaccugcuugaaguauccaaaacaguaugugccagagaaaauaugucucagaaagcauuacagacuaacgagugaaugguaaaaggaauaaugggggaaauuguauuaaaugaaugaaggacagguuugaaacugcucuucaauuuuuuuaacaacucaaacaccaauucuguugguauaaagaguagaacaugcucaacacaggagcacaucuggacuacaucucaguuguugggucuggaucuuggacagauggcuuagucucucaaugggauugagcuucuccaaaacagggggacacagauagaauggaauaaaaacaguucauagaacucauaacuggugaaaguau

SEQ ID NO: 1740 - RNA, 1537 nt, Mus musculus
ugcagguggaaauucucuaauugcaaucuuaggccuaggcaugauuggacgggcauuugauuaacgccagaucaagggaaaggacauguggaauaaacuaaggcuuauaugaccuaagccugucaaucaaaacagaaaaccacccacacucuacaaucuagcaaccaacuccuccuccucauugauuuauagaaggaagccuuggcaguuccuugugcaggugaccgcucuagugaagggagccaccacuccuuguaucuguccugugcuuucauauucuuugaccacaaucuuuugcuauguuauugauugugcuuuuucaaauauuugagaagaugucaagagaccccaucaacacccuuuaggcugcuuuaguucacauguucacacagcagauuaucuuggcuuuagcaaaggggaaaguagaguuggccaagcccgaaugacuuucccagaauguuggccaaugagguagagguuagguuaucuuacuccugucucuccuucucucacacuguucuggggagcaggugggcuucuuuuuaaccuccaaauaauuaauugaggaugggggaguggggguagcuaugugggaaacuucuaagaucacacucaacauuaagguggguuuugaaugacacaacuucaugugugacugaagugagagugccucaccuuccccuaccuagguaguacuuuagguuccuucuggauuaacaauccugugacagaaguggugcguuccaguccugagcaauaaaaaucccaagauuuaacaguguagaagaccauccaagcaccuguauguggcugcagucucaucugcaguggagaccaggguagggugcagacagcaacccccuaucccacaccccaucauugguaggauuuggcucauuguaggccauaaacuggggcuucaguuucccacuggcuguaccauggguucuugccuccugggcucccuuccagggcugcucuccacacugaagcuagcaagccugaggggccuccaggaacaaagugaaguguuucuguaggccauggaggggacaaccaugaugcugcugugcugugcucacuaaaguaauaucaggcagcucagugccacuguaggggagaaagcuguccagaguuaacccuccagagucacgggucagaaggcuuccugcccaucacaaagacaaaugaaaaagcacacaaaauaacuuaccaugcuaccauuucugaaauugguuggguucauuauuuugccucaaaaaauugugaaaucucuuuucugagcuguuuccugucuuuguggacuuaggcccacagagugucuguagguauguuaugucugcuuuucccauuggaagauuaagcaugugucccuacuguugcuacuaaucacaauuaauuaugauucauaacaaugguauuagaaaggauucccccagugcagggacugccacuaauguggcuuucccauccuuaccuuucuucuuuuccuaaauccaggucacgaguuugugugugugugugugugugugugugu

SEQ ID NO: 1741 - RNA, 1593 nt, Mus musculus
gagaacugagcggcacaggcugccccugcuaccucucggugauugccucccaggccuaugcaguugggcuugggcuccuuugccgagccaccaugucgcagaguggggaggagaaccugcagggcuccuggguagaacugcacuucagcaauuccaaugggagcagcguuccagccuccaucucuauuuauaauggcgacauggaaaaaauacuguuggaugcccagcaugaaucuggacgaaguagcuccaagaguucucacugugacagcccaccuugcucccagacaucacaagauaccaacagagcugaaagagacacacccacagcuauggcgagaaaaacagcacuuugucugaggaagauuauauugagagaagaagagaaguugaaaguaucuugaagaaaaacucagauugaauaugggguuggucaagucggccagaaaauauucacccccaaggaguuccuuuuuaaacacccgaagugcacaucuacucucaucaugagaaacacaagcauuaugaagaaagggggaauuuucucagcagacuuucugaagguuuuccuuccauuucaguuacugucucaucugcuggccauuggcuuggggaccuacauuggaaggcgucugacaacuuccauuggcaccuucugaugaagauuuggaucugaguucuguucacacagugaaggauucaugucugagcugugacagcuaguugaaaagcuagcaugguccuuggguguuugcacuauguguguuaauuuguucuguaaaugcgguguuccugauuuagugagacagaauagacucuugucaugaccuauaauuauaccuauggcaucaauuaauaagcaugucagacugaugccuaauguagcauuuacuaguaaauuucuuugaauauuagauauaaauaguauaaauaauuuuaauauaguagcaaugguguauuuaaaacugaucuguaaucauaguccaguuaagacacuuuacacuucaaaagaacaaguaagugauauuaaaaucauuaaaggguuuuccccaaaggaauauuguggccuuauaauccuauuacauagcagaaaauuaaagggugcgugcggguuaucuguaaaggccucugacuuugugaauugaguagcaaguagaagcuaagguuacccacgaaccccacuuugcaguucccccucugccugcuuugcuggaugaggauucuagccuagcuguccaccauuaccuuggguggucaguuuuguugcaggcaccuuuaucacucugcugaauucuacuguuuguauuuaaaucuuaugugcucugaaaaucagcugucuacuuuaaaagacuggagaugaaaaacaaaaucuuugccaaauccacuggagaauacuauauuugcauauccauuaaucauuauccaaagcugcuuaaaucgggcguccucccagucuucucuuuccuauagcaugguuuuaaagccugccuccuugacgugcuguauauauccuguuguauuuguuucacugucccacacuuaauucaggugugcuaaaauaaaagugacauuuuaacaacaacaaaaaaaagu

SEQ ID NO: 1742 - RNA, 31303 nt, Mus musculus
caugaauuccacuacaccaaaguucauagcugcagcuaaggcagcuguuucuguucaggccgauaaggccuaucauacaaaguauguauauccugccuaucauggcaaauagccaaggucuucugggaagaauguucaaggacugcuuguccaggacaggcugggggggcagggaucacauuauuucaaauucccgagcgaggcacacacauaaauacccuucugugcugcuccuucucacuggagcagugcgaacauggugccagggcugcagguccuucuguuccucacccugcaucuccugcagaacacagagagcuccauggugcaucucaacagcaauggauacgaggguguggucauugccauuaaccccagugugccggaggacgaaaggcucaucccaagcauaaagguaagaagggguuuuauugucaggucaauaauucuguugccugcgcauccaaacucacacacacaguuacacauucacacacacaguuacacacucacacacacgguuuuacccuccuaaagggcacuuuaaccaucuucaucaugucugcaguauuaucuacagucaagauggaaauuugccuagcuuuauauuuuuauuauauaauaaaaucuguguuuaaccuguuaauaauuuauuaacuugguaaaguaagagacuucagaagaagaagaguucucacacuuuaucuuaguaauguugguuuacagagucuauacagcaaauguccugcccacuccuccagcugcuccuacgugcucaacuuuggaaaauccuuaccuaucuuaacuuaaaggaaaacugacacaugcuuaaagcugauguguuccuaauugcacuuguuuaauaaaaauguuugcgucguguguacuuuguccauagguccuugcaacauuuccaugcaaugcuuaggagcagaaggcuggguuccucuaaaaauugaaugaauuguuuguaggauuguagcaaguagcaggcagaagcaaaccagucuuauuuguauuuauuauuagacauugagcaaugccagagugacucaguggguuauaaauacagcuguguauacauauguguaaaaugauaauugaagaugaggucgugaguuuguuagggaaaggaggguugugggaggaaugggggaaggguguagacacauucauauauaaaguuuaccaaaaaaauguguguuuuuuuuuaauaaucuggucauuuauuuauaugcucuacuuggguaguaacucaaaauaaaacaaaggcaauuuuaauuaacauagaauacaauaauuaccaaaccuuaagcucccugugaguuugaacaaugcaauuguaagaaaauugauuaacgcaccacuugccugcagacuucugacauucaucccuguuaugccuaacgcacagacugcagucgcaucuccaauccaacugccaccuggaggggugggcaggugaaggucaggguuagcuuugggcauguggaaaugaguuuacggauccaagagauucagucaaauguaucccaguuuuucaguuacucugugcacacacacuugaggaagaggagcccccguuugcuucuucugguuuauguauagaugauuuaugcucaguuuguuuugagauugcuaccacaaugcacuuuucauuuucucaggaaaugguaacucaagccucuaccuaccuguuugaagccagccaaggaagaguuuauuucagaaacauaagcauauuagucccgaugaccuggaagucaaaaccugaguacuuaaugccaaaacgagaaucguaugacaaaguagguuuccuguccagcuccuaaacuguuucuuguggguuuccaaaugaauguuuacaagguuugauaauuguuaaccauuaaguuaguaauaaguauuauaacuuguuguugcuuuugugugucuguguguacauuuguguggacuauuuguacacauccacauguuuguguauguguguagaugcacacaaacaugcucuccccaagugugugugugugugugugugugugugugugugugaucauguaggagucagagguuaauauuaggugguuuccucuauuugcuuuggaccuuuaacuuuuaaagacaaggucugcuacugaaccugagagucaucaauuuggguaggcuagcuagagaacaaucucugguagucugucugucucuaccacuucaccagugggguuacaaacacacgucaccauacccagcuuuugaguggguauugggacugaaacucccguucuugugcauaaacagaaagcacuuuacccacggagcccucuacucaacccuaacuuuuaucacuuaagugagacaguccuuguuuguaaaaucucuugauucuaacaucuuggaaucugacuggguuugcuguucuguguuuaggcagacgucauaguugcggauccucaccugcaacauggagacgaccccuacacccuucaguauggacaguguggggacagaggacaguacauacacuucacuccaaacuuccuacucacugauaacuugcguaucuacggaccccgagguaaaaauaacuauuuuauacuucuuauuuccacuggggaaaagcaaaccacuaccauuaauguggauuucuaaaacuuuaagaaaauuaagccuucacuaacaccuguguuugaaacuaugauaguuauaucccaccuauuugugcauucaaauuaauacauaaaaugggucacuuguuauaacaagcauauucgaauuuuucagcuauuaaaaauuaucaauuucuuagaguuuguaacaauugcaauuugggaaauagacaaagugauugaaaauaaaaggaaacuguauucaaauacauaaacuucaguuuuguagaugacagucuucucucucaggcagagucuuuguccaugagugggcccaucuccgguggggaguauuugaugaguauaacguggaccagccuuucuacaugucuagaaagaacacuauagaagcaacaagguaucacugugaacuuuccauuucuacaauuuguugccugagagucuucugcugucuguacuuggcaguucaacugacagaguguuagacaguucacacaauauucaaacuguagcacuuuguauuaacacauauuugauuaguucuggugccuuggaaugaagauaaucagauauauggaccuaacucagacuuacuagaauuuuacaaauaucauuuauugauagcaaaaauaugaaauagcuaaacccaaagacaucaacaaauugcaacuuaauccuacugacauauucuauauuauuuuacacuuugauuucuucaugcauauuguauacuaacuguguguagaaagaagacaugugacgcuccucccuucuuuacauucucauaugcccugcccuucccuccagucuaugucgcuucuacuucuuuccaaaccuuauaggggauaaccauuucauugaagacaauuaaguugccagacagcuuugugauaaaaaugcuuuucuuuuaaauuggugaaaaauccugugucucaugaggaucugagaguacauugaucuuuuuuuuuuuaagaaauaaaauucucugagaaaucuaaucaaacccuaugcauaaacugguagguauuuaagccuuuaaaucuaaaagugacagacacuuaguacauugagaaaaguauugagaaaaauagaaguugaugugaagaggcagccagucuuugaaaggacaucuaucuuauaaaauaguguucuugaaaacaccuacccagccugccucccuccgugugugaucugcagagcugccuggacccgugcacaaaaggaucagcugagaaugaauuaauuauguucaauucuuccuucaguguaagucaaaagguaaacugaagacuacuauaaagccaaagccgugugagaauuuaagagaauuuuaagcuuaauuuugaucaccacacuccaccaaaaacaauucuuaacuuuuagucaagaauugguuuuuuuauuuauuuuauuagauauuuucuucauuuacauuucaaaugcuacccucuuuccuaguuuccucuccaaaaguccccuauagccucccccccucccccccguucugcuccgcaaccccccuggcauuccuuuauacaggggcauaugaucuucacaagaccaagggccucuccuuccauugauggcugacuaggccauccucugcuacauauacaacuagagacacaagcucugggggggggggggguacugguuaguuccuauuguuauuccuccuguaggguugcagaccccuucagcuccuuggguacuuucgcuagcuccuucacugggggagaauuguuaaguaacucuuaguucauuucauuucuacaacauuauuauaauacaguaaauacuaucuuugguucaaugauaacgaacaugaacuaaaaaugcuguucucaacuguugcauguaguuuuuaaaacacacuaccaacuugcccaggaacugcggcacuacuggucccuccuggcucccguuugcuccacauggcuuagcuccaggcuugauugcaaccagcacuaagccagcuuccuuugaaauccacagaugaaagacacacacucaguuauuucaccuuaauuugccugccaagcacaauugcugggcgcuaacaccuccagcccggaaaugcgugcccuaaccaauuuaacuccaucucuccuccugcccuaaacuuaguggcuuguuccaauuagcuccugccacacaucuuuggcaccccgcccauagcugaggccacaggcccucgcugcccccgaggucuuacaugguggcugugucccuuuuccuccaagcauggcagaaaagcuucuucucuccuucccugugucuccuuuuccucuugggacccgggaaccugucccuuccacccaacaguuggcucacagccuucuugacugacaaaucaagaacaaauuagcaaacuggacguugaguaucagaaccuccccugacacccaacagggaauaugucucagucuauagagcacuugccucacaagcaugagaaccuaggacugaugcccagaacucacgaaaacaacguuggcauggagguacguguuugcgaccccagcacuggggaggaggagaaaggaagauuguggaagggaggucgggcagucagucuaaccuacucugugaguuccaggcugaggagagacccugccucaaaggaagugaacggaaugacuucggauaacagcugaguucgcccuuuguccuccacaugaacacacucauacacauaugcaagaagcacauagaccaaacauuuacauaaacauuaaaaauaauaauaaaucucaaaaccacuguuccuauugaaaccugggggggcacggcccuguaucuacucuugucaaaguggagggcgugguagaggaugaccaauagcaguugccacagagagauuuuagaguacugauuugacuccuaguacugaaauacauagggauuuuaaaaaccaauauggggcugaggaagcagagguguugcagagggcucaccgagcaugcacgggcucuagguccaauagcuagaaucaccaagguaauccaauucuuuugucauagguguuccaccaggaucacuggcaccaaugugguucacaacugugagagaggcaacugugucacaagggcgugccggcgugacucgaagacacggcuguaugaacccaaauguacauuuaucccagacaaaauacagacggcuggggccuccauaauguucaugcaaaaccuuaauucuguaagugcuuuccacuucuuuccucgaugacccuccaagcguguaaaauggacgggaaaguaucuacauacaaaccggcuugucaggagacaaauccucuucaggaugcaugugacaacuaacucugcauugaaaagaaagaaggugaucccuuauaaauuauuacaauaucagguuuuaauugauuuauguuucaggugguugaauuuugcacagaaaaaaaccacaaugcagaagccccaaaccuacaaaacaaaaugugcaaucgcagaagcacgugggauguaaucaagacgucugcugacuuucagaaugccccucccaugagaggaacagaagccccuccuccaccuacauuuucacugcucaaguccagaaggcgaguggugugcuuggugcuggauaaaucuggaagcauggacaaaguaagaaacgauaugcuggauuucuuaaauuaaguauuuaagcgaaauacagaacuauaauuuauucugagguuuaguucuacuaaacauauaaaccuauauauucaugaucaaauguauguguauauguauauguauguauauauauauauauauucaugaucagaaaaauaucuacccaacaauuguauguaaauaaguaccuagaauaaguuuuuuaaaacaaguuauugaugccccaguauagggaaaugccagagccaggaaugggaguggguggguugaggagugggaggaugggggaggggauagaggauuuucagaggggaaacuaggaaaagggauaacauuugaaauauaaauaaagaaaauaucuaauaaaagaaaaaauaaaauaaguuauugagccuggcagagguggugcacgccuuuaauccacagacuugggagguagaagcagguacccucugaguucgagaccauccuggucuacagagugagacaaagcucccaagacaggcaaagcuacacagaaaaacccugacucaaaaaaaaaaaaaaguuuugcuguuguuuuuauuggauuaaaggucauuuuuacuccugaacuuucaguuuuugcuacaaaaaaaguacaacaagaagaaaaaauuuacaauuucaauauuucauguuuuauuuuuauuacauucgccuuuccucucaaaagcuauuauauuuuagauguuuuauaauccaacuuuuauagaaucuaccacauauacuccuuaccaaaaagaaaaagaaaacaauuauuuugugaaaaaaaaauuguguggguguguguauguggguggggaagagcggggugcugggaauugaacccagagccuuguaaauacuaggcaugcauucugacacuaauuuuuuuuuugucuguugguauuuugagaccaagucaugauauggagccauagguggccucaugucugcaagguggucacucagacaggucucaaucuguguccuuccaucugucucaggaccguaugugcuuggauugcaggcauguaggcccaccuccaugacauaccuugugaaauacuuguuacaauuucauacauguaugcaauauauuuuuaacauauaaaaccccacugcccugucuuucacugcuucucgcaccaccucagcaauuaucccuacgacucucaaggguauuguaguaauggcucccuuacuguggaaagcacaggaauuucaucagugucuaccuguagagaaagaugaguccccuuccccagcagcccugaaaugcccugagagccucuugagcccucccccacccacacagggauguucauguugccuggcuugaucuugugcagguauccagagcugaguucauagugcagugaccacgucauggccaguagagggcgccucacagcuccagcucuaagccucuuuccaccuucucccuugcccuguuuccuggacuguggagaaggcaggauacagugucucauuuauucucaguacuuugaccaguuaugagucucugaauuaaccacuucccauugcaaaaagaagcuccugugaaugccccagaaacuaaggcccagaggcagcacuaaucuauagguauaagcauauuuagaaggcaaaauguaaguauuugauaacauguacaaacauggcaaaacugguaguagauuccccaguacaaccuauaaccaugccagccuuggguucaugaccauuuuugcagugugaggcaugaacucucucucguggagagggugucauagccaaccagaaagcaguugauugcacccauggcagugaugugaccauuacaccagcagacacauuuuuuuggcagaugggcauuguacugcccauuugccaccauuaaaauaagacuaucccagugaccuuauauuuccagacgccuauauagcuccuucuggcagcaugaaagcuauccaucagggaaaaugauucuugcuugucuccaucuugauuucucugcauccaccagccugagaguguugucuacugucuaguucuggggaggagccaaaaguaaugauagggauugauauuguuuggugacccuuuggaaggaagugucccacacuucucauuggaguuauuguuuaauaacauaggcuuucuggaagcagcaauagcccaucaagcacagacacaauuuuuaaggauauuauauaaacaguguuccauaaucuucauaaauacuucuguauuaauggacauuuuugagauauucaccguguuacuuuuaaaauauauuccaauaaacacaucuuaugugcuuuaaaaaucauuuccucagcugaaacuuccaaauagauaacuguuggaaaaugagcauagacuuugaagguugucagaacuauaacaacuaaaguuuaaauaucuuaaacuuuuuaauuagauuaaagaguuaaaauuuuaauguccauuaauuauuaccauguucuaugguccauggaugccuuuauuguucauuaauccgucaagguuggaagagacccugcuauuguacaugcaucuuucucuuacaggaagaccgucuuauucgaaugaaucaagcagcagaacuguacuuaacucaaauuguggaaaaggagucuaugguuggauuagucacauuugacagcgcugcccacauccaaaauuaucuaauaaaaauaacgaguaguagugacuaccaaaagaucaccgcaaaccucccccaacaggcuucugguggaacuucaauuugccauggacuccaggcaggauuucaggugaucuuuuaaauugaauguaacuggacauugacuuuccauccuaucuguuuaccuuugaauaggguccugaauucaggguucacucauuuaauagcauucugaccugaaagagaaaaaccuuucugaaaguagcuucaccaacuauuauuuacggccacaccuuuucaguuuucauuugcucuacugauaaaauccugagaggcugugugaccggagguagaggacagggcaaagguuccuugggcaaacaauuaucaaaaccucaaugaggagcuacacauuucucugggaucccauuaauagauagaauuuguaugaauagaagaagaugccacagaacggguagaaagaaguuuguaacaacuguguaguucagauaaaagucauagcacacuaauuuaaauuggaggcagcuccacaagcaacaagcaacaaacacaggugcacacaaaaugaaaucaugauggugaacaagaaaacgcagacuuccuuuugagcacuguacucagagguuacaguaucugucugauucucucccaccccaagucagccuccacuuuaguauuuguggucauguuuugagccagcaaaaugggagacuauuuccguuccucauccugccuguguggaagucaucacuacuacccuaugcagaccuuugauucacacuaucccuuagcuugcuucauggcacccaggucaaaaaucagauggguuuuuaaaaccggaggugcucacucuacuguauauuaucuaaaggaucuugugaaaguaagaauaauuuuuauucauuugguagcuacuguaugccagaaaucguuauuggagauuuguucguccucuacugaguagccaacaugucuaucucuggaggauuaaaaaugcugagaagucuaaugcuugcccauuuccguguaucaucaagucagcuaagaaagagaauauuaaaaauauugaaaaucucuuuccugaacucagaugacaugguuauaaauaggguuuaccacauuuaacuauagcaauuauauaaguaaauguucacaaagauuugcuauuuugaaaguaauugucauacaucuauucaguucuaaagcaugaauaaaauaaccagcuuucacuuaaugaaaucauaucaagaccuaaauguauuacucucacaauaauuauaaaguagcuauauguuggccauacaguauauuacugacugugcuaaguaccguggaugugugaucuuguauucuuuuacuuuuaggaguuaaguaacauuaguaaagccauucugcccaaaaugaagcugaaauauggaauagugagauuuauccauuauaagacaauugccaaaucuaagauugagaaccuuaucucuacagucuauaaacgaucauuacacuaacagucugaaagaggggugugugugugugugugugugugugugugugugugugugugugugugugaguguuugggaaaaucucaggaaagacuaaacauaaauuagaaaacauaauuucuucucaagguaccuaaaacaaagacccuuaacuaauauucuugguggaagccagaaaaauaugcaaaccaauuauaacaaaguauaucaacuucuuccuucaugauaagucaaaguuguuuuguuuuggguaaaucauaaaauucuuuaauaauaacuaaauaaaauacacgaaaagucacauaucaaauaauugaaucuugcuaguccaacuguggucaugacuuugcaaaugcuauugagucggaaggaaucuacaacuaucugaaagucuugaaucuucaucaaguguuuuguggggagauaauaacaacuauuuacauucaacuauuuacauucauacauaauuuuuauucauuugguagcuacuguaugccagaaaucguuauuggagauuuguucguccucuacugaguagccaacaugucuaucucuggaggauuaaaaaugcugagaagucuaaugcuugcccauuuccguguaucaucaagucagcuaagaaagagaauauuaaaaagaugugcauucuuaaguuuaucagcagugacagcauguaauuagcacccugcuuuucacaggcaauuaccuccagugaccagagcacuuccgguucugagaucguauugcugacagauggggaagauaauggaauacguuccugcuuugaggccgucucucgcagcggugccaucauccacaccaucgcucuggggccuucggcugcccgagaacuggagacucugucggacaugacagguacaacuucggaacaguuugaacagauguucaccaagugggaagcuuuucaagacuucccuguuuaaaguuaauuuuucucucuucuuugaccuucaaguucaguucuuuccuuucucugcuucuucgcauguccccaucuuaaauuauucggugccugcugcuuucauucauccuucacccacuuuuucuucauugcacuaaacagacgcucugucuccaugguuacgcaaauacaaguagaaagugucagcucaauaccaaaguaccauucaaucccgcaguaaagauuuagacgucucaugauaggugaggaggugaaaaccuggagacacaaaugauuuucucaauuaaaacccuggucaccggaucaggccuccccgccagcccacucugcucccaccaccucaggagauccgaguaucuucucucccuaacagguuuucccaucacacccugacccagcacucacacccugccuagguuacuuccaggaucuuccaguuggccuuucugaaaugcauuacuuuaguuagcaugcacugguugguacauuucuggcagucauuugucuaacuccuguccuuuguuaucuagucuuucccauaucuucauacccaaaaaucuucuuucacugccaucauuuaaucucugcauuuugcccaugacuauucuguuauacauuggcauccucugaagcaaucuucagucucaccuucuauagaaccacuggguacuggcccaauuucacuaucacacuuaccucugcugauugacauaaaauaaugaaauuucccuuaugcuuacauuuuccacuucucuuuaaccuaccuauucugaauaagauuuuuugauuaauauagguuuauaguaaguucagagauacucugaauguccaugguuuagaaacucaucuucuguggaguuuaaacagaaauguuaacucgaggcuggugauucagcucagugagugaagguucacagccugaguucaacuccugaacuaacauggcggaaagagagaagcaacuucaacaagcuguccacugacuuaccugcaggcacacaaauauaguuauuuaauaauaaaagacacaucaaauggacuuuaaacuaaaucucugauagcacauuugauuuucccauuuaaaacuccccuucaggagggcuucguuucuaugccaacaaagaccuaaacagccuuaucgaugcuuucaguagaauuucaucuacaaguggcagcgucucccagcaggcucugcaggucaguacauggagagaauacuuuaaaauauucccucaccuuugcaguaaauuccuauuauguuucuuauuaccucuucuuucucuaauaaaucauucuuuugccaaaaaauuaauuccauuaugaaaaacaccaucaguguauuuucuuuuagaagucauacaaaaugugguuaccuuuuccucuggcauucguuccuuaguuuuacauggggugucuguguguuuucugugugugugagagagagagagagagagagagagagagagagagagagagagauaugaaaagcuguucaacaauucccuguguuaacauuacuuuuugucucuuccaugaccuucaaguucacuucguuccucuuucucagcuucuucacaugacagcaucuuaaauuguucagucccugccacuuucauucccucuucauccacucucuuuucaucgcacuaaacacaagcuucugucuccaugguuacucagauacaagaccaaaguguuggcucaguugcaaaguaccauucaaucccacaguaaagauuuacacaucucauuuuuaggugaggagugugucaguacaugcacgggaggggagagagagagaaagagggggggagagagagcaagagagagagggagggagggagagagauugguggacugugguuugaagaauguuuuaaaucaucauugcaacuaaaucuuauauaugauuuuuaaauuacuuugaacugccuaaauuagaaaauuccacuacuuaagauaacaaauauguuuuauguguuugcuuuuucuuucuguuacaguuggagagcaaagccuucgaugucagagcaggggcauggauaaacgguacaguaccucuggacaguaccgucggcaacgacacguucuuuguuaucaccuggaugguaaaaaagccagaaaucauucuucaagauccaaaaggaaaaaaauauacaaccucagauuuccaagaugauaaacuaaacauccggucugcuagacuucaaauaccgggcacugcagagguaagucuauucuuuucaccauguuuuauuaauccauacuugugcuguaaaaauaaaauaaugacauguuacauuaucaguauuaagaucaaugaaagaauaguuuucacuaaaaauuaaguugaauaucuaaguguucaaaucuauauuaucuauuaguuuuuaacaaucacccauuaaaaucaguauugagguuagcaauguaggucucuacucuuaguaggacaguuguuuaccaugcguaaggcaugaguuccauauucagcaccccacguuuuucaauuuuauuuuuccaaguagcaagaaauccuuagcaaaguucuuaaagagaauuuuuucagacagguacuuggacuuacagcaucacggguaccaagucucaguugauuacaaugacagugaccacucgagcaagaagucccaccauggaaccacuccuggcuacugcucacaugagucagagcacagcccaguacccuagccggaugauuguguacgcacgggucagccaaggauuuuugccuguucugggagccaaugucacagcccucauagaagcugaacauggacaucaagucaccuuggagcucugggacaauggggcagguauugggagccuguaucaauuccaugaauugaaauucuccuauaggauccuauaacuugguagucaacauuuuuuaaauaguuauaaaccuauuugaguaauacugucuuuaaaacuucuuacuugcuuaucuugacaaagcaagcccagacaaaagcacaaguauuuugguuaaauuuguuuaucaguuucauacuucccauggaacuugagauaguuuuuccuuuucgcuaauauuaggaguuugcauaugguuuugggggucuaaauauauuuucuuuguucugguaagcuucuucuuuaguauucaacauauauauuuauaggcuuuccauaugagaauauuacagauuuaaucacacucacccuuugguaccucccccucucucucuuccucccccucucucuucuucuucuucuucuucuucuucuucuccuauuucuuccucucucucucucucucucucucucucucucucucucucucucucucucucucucugucucuuacucuuucucucugucucuuccucucucucucucucccccacccucucccucugucugucuccucccaccaauauccuucauuuuaccuucaaauauaauuuuauuuaucuauauaaauuucaauagcuacacaugagagaaaacguguggguuuaaugcuagguccuguauccauuccacagguauacagguaugcccuuuggcaacacugcacuacuuuguuacugugguucuagcagcacugagcuacuuuguuacugugguucuagcagcacugagcuacuuuguuacugugguucuagcagcacugagcuacuuuguuacugugguucuagcagcacugagcuacuuuguuacugugguucuagcagcacugagcuacuuuguuacugugguucuagcagcacugagcuacuuuguuacugugguucuagcagcacugagcuacuuuguuacugugguucuagcagcaccgcacuacuuuguuacugugguucuagcagcaccgcacuacauuguuacugugguucuagcagcacugagcuacuuuguuacugugguucuagcagcaccgcacuacauuguuacugugguucuagcagcacugagcuacuuuguuacugugguucuagcagcaccgcacuacuuuguuacugugguucuagcagcaccgcacuacuuuguuacugugguucuagcagcaccgcacuacuuuguuacugugguucuagcagcaccgcacuacuuuguuacugugguucuagcagcaccgcacuacuuuguuacugugguucuagcagcaccgcacuacuuuguuacugugguucuagcagcaccgcacuacuuuguuacugugguucuagcagcaccguacuacaucguuacugugguucuagcagcccugagcuacuuuguuacugugguucuagcagcaccgcacuacaucguuacugagguucuagcagcccugagcuacuuuguuacugugguucuagcagcaccgcacuacuuuguuacugugguucuagcagcaccgcacuacuuuguuacugugguucuagcagcaccgcgcuacuuuguuacugugguucucuaguauaccucacagaccuaguaauaccaccaccagcuuuguucccuuuauucggagaugauuuggcuguucuggggcuuuuguguucccauauggauuguacuuuuaauucuaucccugugaagaaugucacuaaacuuuuugggggauuguugaaucugcagauggcucugggcugugaguccauuuucacagugcuaguccugcugacguaagcacggaaaccuuuuccaugucccuccucuaugguuuacgguuuucacugaagaggucuuucacguccucaauaaagguuacuccuggauaauuuuuaagguguuauaaauaguaugguuuucccgguuucuuucucagcauguucauugacuuuuuaaucaguaauaaucucauaucagaugagcuucauugguuauauaauacugucgucacacaaaaguuggcuaauauuuuuuuacauugguuuuagaucuugcuucuaugcuaaaugucuugucuguucugagugcuuuuggacaccuuucuauuguggaauaaaaauaacugcuaauguuaacuaaauaucuacuacaaguuauauuuucuuuuuuuuagcucuuuuuuuuaauuuauuauguauuuccucaaugacauuuccaaugcuaucccaaaagucccccauacccucccccccacuucccuacccacccauucucauuuuuuuggcccugguguuccccuguacuggggcauauaaaguuugugucugaugggccucucuuuccagugauggccgacuaggccaucuuuugauacauauguagcuagagucaagagcuccggaguacugguuaguucauaauguuguugcaccuacaggguugcagaucucuuuagcucuuuggauacuuucucuagcuccuccacugggggcccuaugauccauccaauagcugacugugagcaucuacuuauguguuugcuaggccccugccuagucucacaagagacagcuauaucuggguccuuucagcaaaaucuuucuaguguaugcaguggugucagcauuuggaagcugauuaugggguggaucccuagguaaggcagucucuagaugguccauccuuuugucgcagcuccaaacuuugucucuguaacuccuuccauggguguuuuguuuccaauucuaagaaagggcacaguguccacacuuuggucuucauucuucuagaguuucaugcauuuggcaaauuguaucuuauaucuuggguauacuaaguuuugggcuauuauccacuuaucagugaguacauauugugugaguuccuuuuugauuggguuaccucgcucaguaugaugcccuccagguccauucauuugccuaggaauuucauaaauucauucuuuuuaauagcugaguaguacuccauuguguaaauguaccacauuuucuguauccauuccucuguugaggggcaucuggguucuuuucagcuucuggcuauuauaaauaaggcugcuaugaacauagugguguauguguccuucauacugguugggacaucuucuagauauaugcccagaagagguauugcuggauccuccgguaguacuauguccaauuuucuaaggaaccgccagacugauuuccagagugguugugcaagcuugcaaucccaccaacaguggaggaguguuucucuuucuccacauccucgccagcaucugcugucaccugaauuuuugaucuuagccauucugacuggugugagguggaaucucaggguuguuuugauuugcauuucccuaaugauuaaggauguugaacauuuuuucaggugcuucucugccauucgguauuccucgggugagaauucuuuguucaauucugagccccauuuuuuaaugggguuauuugauuuucuggaguccacccucuucaguucuuuauauauauuggacauuaguccccuaucugauuuaggacagguaaagauccuuucccaaucuguugguggccuuuuugucuuauugacaguaucuuuugccuugcagaagcuuugcaauuucaugaggucccauuugucgauucuugaucuuacagcacaagcuauugcuguucuauucaggaauuuuuccccuaugcccauaucuucgaggcuuuuccccacuuucuccucuauaaguuucagugucucugguuuuaugugaaguuccuugauccacuuagauuugaccuuaguacaaggagauagaaauggaucaauucgcauucaucuauaggauaacaaccaguugugccagcaccauuuguugaaaaugcugucuuucuuccacuggaugguuuuagcucccuugucgaagaucaaauggccauagguguguggguucauuucugggucuucaauucuauuccauuggucuacuugucugucacuauaccaguaccaugcaguuuuuaucacaauugcucuguaguaaagcuuuagguccggcauggugauuccaccagagguucuuuuauccuugagaagaguuuuugcuauccuagguuuuuuguuauuccagaugaauuugcagauugcucuuucuaauucauugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugagguuuuuaucauacagaucuuucacuuccuuuguuagagucacgacaagauauuuuauauuauuugugacuauugagaaggguguuuuuucccuaauuucuuucucagccuguuuauucuuuguguagagaaaggccauugacuuguuugaauuaauuuuauauccugcuacuucacagaagcuguuuaucaguuuuacgaguucucugguggaaguuuuaggguaacugauauauacuaucauaucaucugcaaaaagugauauuuugacuuccucuuuuccaauuuguauccccuugaucuccuuuuguugucgaauugcucuggcuaggacuucaagaacaauguugaauagguauggagagaguggacagccuugucuagucccugauuuuagugggauugcuuccagcuucucaccauuuacuuugauguuggcuacuguuuugcuguagauugcuuuuaucauguuuagguaugggccuugaauuccugaucuuugcaagacuuaucaugaauggguguuggaucuugucgaaugcuuuuucugcaucuaacgagaugaucaugugguuuuugucuuugaguuuguuuauauacuggauuacguugauggauuucuguauauuaaaccauccuugcaucccuggaauaaaauauacuuggucaggauggaugauugcuuuaauguguucuugaauucgguuagcgagaauuuuauugaguauuuuugcaucgauauucauaagagaaauuggucugaaguucucuaucuuuuugggaucuuucugugguuuagguaucagaguaauuguggcuucauagaaugauuuggguagaguaccuucuauuucuauuuuguggaauaguuugugcagaacuggaauuagaucuucuuugaaggucugauagaacucugcacuaaacccaucugguccugggcuuuuuuuugguugggagacuauuaaugacugcuucuauuucuuuagggaauaugggacuguuuggauuguuaacuugauccugguuuaacuuugguaccugguaucugucuagaaauuugucaauuucguccagguuuuccagcuuuguugauuauagccuuuuguagaaggaucugaugguguuuuggauuucuucaggaucuguuguuaugucucccuuuucauuucugauuuuguuaauuaggaugcugucccugugcccucuagugagucuagcuaaggguuuaucuaucuuguugauuuucucaaagaaccaacucuuguuugguuaauucuuugaauaguucgucuucuuuccacuugguugauuucaccccugaguuugauuauuuccugccgucuacuucuccugggugaauuuucuuccuuuuuuucuagagcuuuuagauguguugucaagcugcuagugugugcucucucuaguuucuuuauggaggcacucagagcuaugaguuuuucucuuagaaaugcuuucauugugucccauagguuuggguauguuguagcuucauuuucauuaaauucuaaaaagucuuuaauuucuuucuuuauuccuucuuugaccaagguaucauugagaagaguguuguucaguuuccacgugaauuuuggcuuuccauuauuuauguuguuauugaagaucagccuuaguccaugguggucugauaggaugcaugggacaauuucaauauuuuuguaucuguugaggccuguuuugugaccaauuauauggucaguuuuggagaaggucccgugaggugcugagaagaagguaaauccuuuuguuuuaggauaaaauguucuguagauaucuguuaauuccauuuguuucauaaguucuguuagguucacugugucccuguuuaguuucuguuuccacgaucuguccauugaugaaagugguguguugaagucucccacuauuauugugugaggugcaauguguguuuugagcuuuacuaaugugucuuuaaugaauguggcugcccuuguauuuggagcauagauauucaggauugagaguuccucuuggaggauuuuaccuuugaugaauaugaagugucccuccuugucuuuuuugaugacuuuggguuggaagucaauuuuauucgauauuagaauggcuacuccagcuuguuucuucagaccauuugcuuggaaaauuguuuuccagccuuucacucugagguauugucugucuuuuucccugagauggguuucuuguaagcagcagaauguuggguccuguuuguguagccagucuguuagucuaugucuuuuuauuggggaauugaguccauugauauuaagagauauuaaggaaaaguaaauguugcuuccuuuuauuuuugucguuagaguuggcauucuguucuuguggcugucuucuuuuugguuuguugagggauuacuuucuugcuuuuucuagggcgugauuuccguccuuguauuguuuuuuugguuuuuucgguuuuuuucuguuauuauccuuugaagggcuggauucguggaaagauaauguguaaauuuuguuuugucguguaauacuuugguuucuccaucagugauaauugagaguuuggcuggguauaguagccugggcuggcauuuguguucucuuagugucuguauaacaucuguccaggcucuucuggcuuucaucgucucuggugaaaagucugguguaauucugauaggcuugccuuuauauguuacuugaccuuucucccuuacagcuuuuaauauucuaucuuuauuuagugcauuuguuguucugauuauuauguguugggaggaauuucuuuucugguccagucuauuuggaguucuguaggcuuccuguauguucaugggcauuucuuucuuuagguuugggaaguuuucuucuauaauuuuguugaauauauuugcuggcccuuuaaguugaaaaucuucguucucaucaacuccuauuauccguagguuuggucuucucauuguguccuguauuuccuggauguuuugaguuaggauccuucugcauuuuguauuuucuuugauuguugugccaauguucucuauggaaucuucugcaccugagauucucucuuccaucucuuguauucuguugcugaugcucacaucuaugguuccagauuucuuuccuaggguuucuaucuccagcguugccucacuuuggguuuucuuuauugugccuacuucccuuuuuaugucuaguaugguuuuguucauuuccaucaccuguuuggauguguuuccuguuuuucuauaaggacuucuaccuguuugguuguguuuuccuguuuuucuuuaaggacuuguaacucuuuagcaguguucuccuguauuucuuuaagugaguuauuaaaguccuucuugauguccucuaccaucaucaugagauaugcuuuuaaauccgggucuagcuuuucgguuguguuggggugcccaggacuagauggggugggaguguugcguucugaugauggugaguggucuugauuucuguuaguaggauucuuacguuugccuuucgccaucugguauucucuggagcugugcaggauacacucagcgggguccuggaaccaagaugucugugcaggguauacucggcagggucccggaacuaagaugucugcuaccaaugcucaggcaaagcgcuccugcgccgggcaggucccuauccucuggccgggaaaauggucaccugccugugcaggauacacucagcgggaucccagaaccaagauaucugcugccgaugcucaggcaaaaugcucccgcgccgggcagaucccuauccucuggccgggaaaauggccagcucucugugcaggauacacucggcgggguccuggaaccgagaugucugcuguccaugcucaggcaaagcgcucccgcgccaggcagaucccaauccucagaauucuuaagaucgcguggcugguguuguggguaucuggcgguagucagccgacucugcgcccgagcuaccccagugcugcucggaccgaagggggcuugugccccuacucagaccggguuuucugcuuuccuaacuaaugcagucuuaggucccgcacgauuggauuggagcagaugcuguguuccacucaccagaagucuuaagaucgcuugguggguguuguggguagcuggcgauagucagacgacugagcacccuagcuauccaggugcugcucggaaguuauauuuucuaaaaacagcauuacuacacagucaagcaaggcuuuguaucagaacagugugaccuaguguuuaacugugcuguauacucucugacacacucuuaucaucaaugcgaacaaacagcaucaauuuucauuuuaacuuacuaugugacuaaucacugugcuucauuauaaaggugcugauacuguuaaaaaugauggcaucuacacaagauacuuuacagauuaucauggaaaugguagauacagccuaaaagugcguguccaggcacaaagaaacaaaaccagacugagcuuaagacagaagaacaagucuuuauauauaccuggcuauguggaaaaugguaaguaguauuaaaacagauauggcuuaccugcagauagauagacagacagauagauacauagauacauagauagagcaaacacugaauagagagucacacccacccaacuauauaauuauggagucagccuugugauuuaaaacaauauucaugucaaugggcccagcauaaaugacauuuccacauaauuuguuacaaucuuccucaguuuguuuuauuuccacugaaaaauacauuuccugaccuuguggaacaaacccugugguaaguuguaaagcugagugaaauacgaguauugucgccacggaucucaugagaaggugauagggaaaacagggucaaaaauuaguuuuaacuuaucacauuucaaaaugauaguuaagccagcuuucucccccuuauuauuuuaacauuuaucuuuaugugcauuggugauuugucuauauguauaucugaaggugucagauccccgagaagugaagggacagacaggugugagcugccauguuggugcuggguacugaacccagguccucuggaaggacagccaccguucuuaaccacugagccuucuauccaauccuuucuuccacuuuucagugucugcugucaauuuaccuaagcccugagcagauguaggucagcacgagauaacaaacagacaagaugagagucacaaaugccuggggguguuuuuuuauagguaaaauuguacugaauccacccagaccagauguccaagaagaagccauagaagcuacaguggaagacuucaacagaguaaccucuggagggucguuuacugugucuggagcgcccccugauggcgaccacgcucguguguucccaccaaguaaagucacagaccuggaggcugaguuuauaggugauuauauucaccuuacauggacggccccuggcaagguucucgacaauggaagaggugagucugauggcgaauuuaaaauguaaugaaagacaccccuuuaucuuucauuuuuccaaagcuucuucaaugucucacuuauaaauaauauuuauggaaugucuucuauaggccauuauucauuuauuuuuauauguaaaagcugaacuucagaaaagcugaaauaggacaaaguuauuccugucauuuuaauuuaaaauucucaaaccaucucuaauauuaauguccugucccugaccucugcucccugucugcacaaccuugaaauuacuuuaaaacaaacacuagcagauuucugcuacauucguuguaauguacaauuuucuaaguauuucuacacuugggaaauucuauucagcgauuguugaguuuucaaauacaaucaaguuuuaagggacaaccucuacucucagaacaguuaaccaaaaggacacacaagcacccagauacuuuaggauagaugaaugagauagauagaugacagacagauagauccaccuacauagauuacaaggauucuguggaggacagcagcaagggggacacagcuuaaucaucaggugaacugaguuguaagcacaagcagaggcuuuagccaggcccugggcagaggugcagagugacucaaaaggcaaagcuucucaccgcacaucuaaaacauuuucacauuuccugaaaacguuaaaaaacaaacccauguggauaggauggaguccagugcucgccuggcaugcacaggcccucaguucaauucugagcaccacauauagguaacaaauaaacaaauuuguaaaaaaaaaaaaaaaaauguccacacccacaccaaaaggacauuagauguuuuccuuucacauguaaagauacaagaagauauuuucuuaucaauaucaaugacugagguagauuacuaacaucaguaucagccugugagucaacacucauauaagccuccuccuuuccuuuccugauaaaauaauacuuuuuuuaaaaaagcauuucagacagcuauuaaccacaacuuacuacuuauuaguacagcuaaacacuuuuaugcauuuaucauuuauaauucucaccaccggaacagugagcauuccaagaguggguuagaaaaacuaaguauguuuuaaaaaauuuaaaaacugaaccuuggggagccucuagaaaaguggccugguaaagaagagugcuugcuccuguaccccagaaaacccgggcaagguggggcauaucucuaaccacagacuggguugaggagcagagacagacaccugagggaggguugccacugcccaggaauaacaccuggaacagcuaguucuaguugcaaauguuuuaauucaagccagaaacuuuuaaaauaggaaaccauaccacauucuuaaaauucaagacaaagauuuuuuuaagaccguguccuucaucuuggagaccaaaggaguaagaucagcaaauucagucuccggcccucauguacacacacugaaacuggagaugagacacauuaaagaauaauagcgaugacucaacaaauggcuccccaggcaagagcugguuguucuuccagaggagccagguucaauuuccagcacccacaaggcaucucacaaucuucuguuacuccaucuucaagggacucucuucugguccuuuacaccaaacaugcacauggugcucaaacaugcaggcaggcaaaacacccacacacguaauaaaaaaaaaaguauuaaaauaaacucuaaaaaagcacaguagcauagaauuaagagcuagugaaggucagacuagcuccucagcaaauguuuacguaguguucauccuacuucugugaccuuugacuccuccuuaucugucguccucccagguccugucucugagugcucccacauugcuccuucccugaacuugauaaaaagucacagaggacacuuauggucuuuacugaacaugaauauuauguguucccuguucuaauauaaaacugaauuccacuguuuuuucuaaauaaaaaacuggcuucuggguggaaggcaggucacguaucaucuuacuuaggguuccauugcugugaagagacacuaugaccacagcaacuauuguaaaggacaauauuuaauuggggcuggcuuacagcuucugagguucaguccaugaucaugaugggaagcauggcagcaucuaggcagacauggcacuggaggagccaagaguucuacaucuugauccaaaggcaaccaugagagacucucuccaucacaaaggcauaggaccacaaagccaacuccuacagugacacacuuccucugacaaggucacaccuauuccaacagggucauaccuccuaauagugccaugucccaugcccaagcauauucaaaugaccacauuccacucacuggccccauuggcuuguucaaacauaugauucugcggggcuguaccuagccauagcauaaugcaaaauguauuuuguccaacuucaaaaguccacaaagucuauagugucucaacaauguuaaaaguccaaaauucaaggaaccucuucugggauucuuacaaucucuuaacuguaaucucuaauaaaaucaaaaucaaaaagaagaucacauacuuccaacaucacaggauauagauuaccauuccaaaaucucauaguggggagacacugaagcaaagcaagaccgaaagccagcugagcaaacuccaaacucugcaucuccaugucugaugucacagcgcucuucagaucuccaacuccuuucaucuuuguggacugcaacacaauucuuucucuugggcugguuccacacccugagagcagcuuuucucagcagguguccuguggacucagcaucccuaguuuuuuggagacucuguacuggcuaguuuugugucaacuugacacagcuggaguuaucacagagaaaggagcuucaguugaggaaaugccuccaugagauccaacuguaaggcauuuucucaauucgugaucaagggggaaaggccccuugugggugggaccaucucugggcugguagucuuggguuuuauaagagagcaggcuaagcaagccaguaaagaacaucccuccauggccucugcaucagcuccugcuuucugaccugcuugaguuccaguccugcauccuuuggugaucaacagcaguauggaaauguaagccaaauaaacccuuuccuccccaacuugcuucuuggucaugaugcuugugcaggaauagaaauccugacuaagacaaauugguaccaggagugggguauuccugugacaagcugaccauguuuuggggaggacuguggaaggacuuuggaacuuugggcuugaagauccauccguuguuaagagcucugucggaugccguguaggagcuuggaagauaauguugagaacaccgcagaagauggaggucugguuugugaaauuucagagggaaaauuaaagacucuuuucagggccauugcuguucuugauugugaagauucuguaguucugguuagcuggggcugaagaaucagcugugauuaacaagauaccagaacuaccaaagcaaaaacuuugcauuauugggacuauugaugcugguuagcuggagcuaagaaauuagcggugauuaagaagagaccagcaucauugaggugacaucuucugggaaguguuuucugaaagcacaguggcuguguuccagauauagccaaaguuguaccuugugcuguggcuggacuugguaauguguaagggucacccaggugguacugguuuugaaggcaugaaggaguugagcagagcagcugaggcuuggcacugugagaggccauggaaggccauucgugaaggugcagccucaguugcaauugaaggcccaggacugaaggggucauacaguguuuuggagaugccagugccaugagaugaccaccaagagcagcagcagcagugggguacaggcaucuggagccuagaggaugaugcgugugcuacaaagggcauggcuggagaagugacccaagcccuuggaggagcccagaagaucgugaguuggaucccagacauuggacaguuggagauugacuuuugcuuuugauugugacugugcccugauauuuucccucuugaaggaagaaacuguuuuaguggagcccacaguuaagagacuuuuaauuguaaaaagacuuuggauuuuaaaaaagauggauauuuuaaagagauugaaauuuuaagaauauguaaaggcugugggacuuuuaaaguuauuuagaucuuggggaugaauaagauuguaaggguugaggcuuacuagugauguuuuugugugucaaguugacaaggggucaauuguacuggcuaguuuugugucaacuugacacagcuggaguuaucacagagaaaggagcuucaguugaggaaaugccuccaugagauccaacuguaaggcauuuucucaauucgugaucaagggggaaaggccccuugugggugggaccaucucugggcugguagucuuggguuuuauaagagagcaggcuaagcaagccaguaaagaacaucccuccauggccucugcaucagcuccugcuuucugaccugcuugagauccaguccugcauccuuuggugaucaacagcaguauggaaauguaagccaaauaaacccuuuccuccccaacuugcuucuuggucaugaugcuugugcaggaauagaaauccugacuaagacagacuccaaggcaacuucaacuuuacaucuucuuauucuagucucuggaauccagugaucuucugggauccuccaaagggcucguguuacugcuucagcucugccuucuguagcacucuaggcucugggugacuccacuucaaugcugcugcuguucuuggugaucuugguggcaucuccaauauccucuggaauuaggcuucacuaauagccuuucauagguucccuuuaauggugccaagcuucaacuucuuugcaugacccuaucaguccuaggcugucaaaugcaacugaggcugcaccuucaccaauggccuuuccuggccucucacagugccaaaccucagcugcuuuucaugacccuuucaugccuucaaaaccaguaccaccugggugacucucacaaguccaacugccaaugagaugucuaucucuggaacauagcuucuuugugcucucagaaaacacuucccacaguucaaguaacccucagcaccucaguccuccaugcaucgacuagaauggcccauuaagccccacuuaaagcaugccacugcuuuccaaaguuccaaaauccacauuccuccaaacaaagguauggucaggccuaucagagcaauaccccacucuugguaccaacuucucucuuaauuaggaucucguuguuguaaagagacaccaugaccaaagcaacccuuaugaagaacauuuaauugggacuggauuacagguucagagguucaguccaugaucaucaagacaggagcaugacagcauccaggcagacauggcacuaaagguccugagaguucuacaucuuguucugaaggcaaacaggagaagacugaaucucucaggaagcuaggaggaggcucacaaagcuuacccccuacagugacacacuuccuucaacaaggccacaccuauuccaacaaggccacaccuccuaauagugccauuucccaaggguuaagccuauucaaaggaccacauacauauaugauacugaauuaagcuuuucugugauuuugaaaacuggacauuuguuugucaauaauugcuccuauacuuguuuguaaaaucagugagaugggauaaccagacacaaaugauaucugggcucucagucuaaagcugucaugcaccacucagagcuuccacacaggugcagggcagaggcagagaccaucuuuggaauauuaaugaacaucucucucucucuuuuagcacauagauacaucaucagaaugagccagcauccucuggaucuccaagaagauuuuaacaaugcuacuuuagugaaugcuuccagucugauaccuaaagaagcuggcucaaaagaaacauuuaaauucaaaccagaaacuuuuaaaauagcaaauggcauccagcucuacauugcaauccaggcagacaaugaagccagucucaccucugaggucuccaacaucgcacaggcugucaagcuuacuucucuagaagauaguaucucugcacugggugaugauauuucugcaaucucuaugacaauuuggggguuaacugugauuuuuaacucuauuuuaaacuagaagauagaauggcacuaaaaugcaauccuguacauauuugcuaaguguugcuuuagaaugacuuuacuacacacucaaaggcugccugucaacaauuguaauauagaaguucauauucaaaguugaaaaucccgaguuacuaacaacauucuuuugcuauauguagaucaagauuaacaguuccucauucaauuucuuaauuguuccauuuacuauggaaauaagauauccauucucuuuucacagugugaugcaaguucacuuuguauaugaaaauaaaaaauuuguacaagucgauuaaagggaauuauucauauuuaauagcaaacaauuuuauaguugaauuauuuguaagacaauuaauaaagaaugcuuccugcuuauacaacugaaaucaagagggacuaugaaaguaauuuguagggcugaagagauggcucagugguuaagagcacugacugcucuuccagagguccugaguucaauucccagcaaccacaugguagcucauaaccaucuguaaugggaucugaugcccucuucuugugugucugaagacagcaacaguguacucauacacauaaaaauuaauaaauaaaucuuuaaaagaauuucaucuauaucuucaaaaguaauuuguagagaaaaauggucaaaagaggucauaaagucaaaugucuuuugucauuggcugaagguguuuuaucaguacacaaagugauuagcaagaaugucuuuaccuaugaauugcaggcaucacacugagucugguucuguccugggaccaucauuugaucuuaagagcaucagcaagacguacaguuagaauugagauuuuuuuuuucacuuuguagcucuuggaucuagagaaaaacuugauauguaguagacauucaauaaauguuugguaaauaauuaauguuuuuuuuacuuuca

SEQ ID NO: 1743 - RNA, 622 nt, Mus musculus
auuuacauucauacauaauuuuuauucauuugguagcuacuguaugccagaaaucguuauuggagauuuguucguccucuacugaguagccaacaugucuaucucuggaggauuaaaaaugcugagaagucuaaugcuugcccauuuccguguaucaucaagucagcuaagaaagagaauauuaaaaagaugugcauucuuaaguuuaucagcagugacagcauguaauuagcacccugcuuuucacaggcaauuaccuccagugaccagagcacuuccgguucugagaucguauugcugacagauggggaagauaauggaauacguuccugcuuugaggccgucucucgcagcggugccaucauccacaccaucgcucuggggccuucggcugcccgagaacuggagacucugucggacaugacagguacaacuucggaacaguuugaacagauguucaccaagugggaagcuuuucaagacuucccuguuuaaaguuaauuuuucucucuucuuugaccuucaaguucaguucuuuccuuucucugcuucuucgcauguccccaucuuaaauuauucggugccugcugcuuucauucauccuucacccacuuuuucuuca

SEQ ID NO: 1744 - RNA, 29043 nt, Mus musculus
cugcuuuacggcuagcucggcuucccgcaggcgugcagagcuugccgcggcugcuuugcugcacguguggcgcugucggcgguucguuugguaaucucucuuauuggcuugguggugccaccgugaagaacggaguggcagcuucggccuaggcucgugagcucauggaaucugcagcugagaaggaagggacuccgggaggagguucccagaggguagcggagggggcgcggccgaggccugcggcugguggggagggagccagggacuuagacgggagcccagaagcuggcgauggagaggagaggaacggacuggcaggaacuaagaccacggaggaugcggaggagauaaagauggacuuagcuguggugaagcaggaaguaguagacuggucggauuuagacagugguguugcggacagccagugggugaagcaggagguggagggcgggcccgaggugaaggaugagaaaggcguguuggaagugaagcaggaggcggauaguagccugguggugaaagaagaggagguggaugagccagaagugaaggaagagaaggugaaggugaaggaggaggugacggacugggaagaagugaaggaggaggacuugaccauaaaacaggaguuguuuguuggucagaacguaaaggaagagcaagugauggaugcagcgccuauaaaagaagaggguucccucaagagcgaagcgauggaagacgcgaaggugaaggaagagccccagaugaacccccgagugggcagcaagaggaaauuggcucugucaagguagggcggggagaaaacccagaugggaaauagacuacuggguggacgaguccuuaacagcagaaagugagguaaguuaaaccaggcgugacgugggucccugaagucugaguggugaaguucagguugggcgugacgcuuucgaggacacagugugaugugacuguguccagaaggguauggccagguuagggagugaaaauucugggcaucagaaggccuuuguggagccagagcuuguuaaauaagaaacgcuuucgcagucuuucuuuuagagagaauaggauuagaggcgccauccaauauaaaccaaaaaccagcaaguggguagacuaauagacacaugucaacuuacucuugaauuuauuccgggcuccuaugaauguucguuucuuggauguagucucuuuaaugugcucaugugacaguacagaagaucagauuguggucagauucagucucaaacuccuugagcugauagaacugacugguaccagguacacuuugguucucaguaucaccagacccuagaagaccgaggacagaugaaucauaccauuauuuggguguucauucugaauucgcuguggaacuggggaaagggcacacauugcugccagucugggauucauccuuccuuguuucuccgguguauauguuuuuaaaauacucauauguagcucauggauuauacuucuagacacacacaaagucuccaugaaucacaauuucaaaaaucgcugggcgugguagcgcaugccuuuaaucccagugcucaggaggcagaggcaggcggauuucugaguuugaggccagccuagccuggucuacaaaaaucagcaauucauauuauucucuuaaguccuguagaaaaaaaugggcgggccagugacuucuuucauacaguuuucuugaauugcacgucauuguaaaugucauuuuuaaacauuuucaugauuuccaauagcagcuaucauauacuuuaucagaguugcuuugacuaccugccuguaaacugugaaaugcccuugaguccaaauucuaagaccggaaggacauacauagaguugauuuugcguguuaagucucaggugcacucuuacaggugugagacuugugggacagaagaagcgaaguacagauguccacgcugcaugcgcuuuuccugcagguagauauguagcuuccuaccucacucccugccugugugcacucugacuucagguacagagcugccuccuguuuguuucuucaguuugcccuguguaaagaaacacaaagcugaccugacgugcaguggaguccgggauaagaccgcuuaugugucgcugcagcaguuuacugagaugaaucuccugagugguaagucacuuugugcaccacccagggaugccuucuggccacuggcaccgugucacucguuaacuuguccauucugaaauuacaagacuauagauuuuuggaagacguggcaagaacggcagacaagguuucaagagauacuuucuugaaaagaccaaagcgcaaaaaauauguaaguauuucuucuaaucuuuucaaguucagaucucuuccacccaguuuauucauuucucaguuguaucaaguggucacugcgcuguggggcuauucugguuauuugagauggauccaaguacuuacccucaggcauuuguacuguagaggggagguaguugagugggggaguugggagguauagagcagcagauagaauuucuuacagauguaagugcaugaggaaguuaagaugguucaagagaguaaagagaacagggugcuugaggggcauggacuacgcagagugugauuaucagcacagugguagagaugagcuuuccugagacgggacagauaggcaguggaccuaaugguaugaaguggacaguuggagacauuuagagggaaacucugaguggaaacauaggcagaagcggcacagacucggcauucaggaggaauguauagcaagacugacucagaagugcaaagacgcaggcugggaacaggacgccugugcuccggggauuagcagggcaggguaaccgaagcacggugaguaaggagggaugagggaaaccuguaagaguuuccaagcauucugaguaaacaugagacuaagggagguggggcguaauggcgccuuuaaucuagcacuugggauggaggcaggugagucucugaguuccgggccaggcaaggcuacauuugaccuguucucagaaaagaaaacacaaaaugccuagagccuggagaggcggcccagcaguugagagcacucggucuuacagggaaccaugggcuacacagagauguacaaccccugagauucugguucuagaugcuccaacgcccucuucuggccuccagcagaaccaggcacacacaggaugcacauucaugugggcagacacauaaaguaaaaauacauuuuaauaaaaggcuggcuuucacuuggugucggggagcaacaguggggguuggaagcaugaaggacagcugcagaggguggaggucauggcagcaaugcuguuagaaaucauuggaaagugguucacaauuuucacaaaguaguuaaacacaagaaagaaauugaugagugaaaaauucauuaauagugugauugaaucaaagaccguuuuaguagagaaguuaggauuuucaguaacuuugacacaacuauguuauugguauagagaugcuguuacacaugcagaaaguuaccagguagcaguucuuaaugaacaucccuaaauucuauuauauuauaaaauacaguguacauuaaaacacucauaaaacggaacuauagcguaaugcuauaacuugcauugggccugggaggggaccacucuggcuucccuggagauccuugcuacccucuggugugcugaccuggugaccuuuccaaaggguugucuuucauccauaccauugcuuauccuaguguuuauaaacuuugaauuuucaguaauuaacaaaaaacaaaaaagcuguuuuugaaacauuauuauugggaaucuuuuugguuuugaauuaugguuugucuaugcacuuguuuuucuaggauuuauaccuaaacaugaaguuguuuuguugugauaugaccaugucauuagugugacuagauguuaguagaacuuauuuaguuaguuuucauucugaccaauuaugucuaaauguggucccgcuaagauugcucucggauugauuguagacauucgauuuccucuuugugagcgagugcuuaagcauuuuguucuuuuuguuggucagcuuuguuaccucuguaacaguaacaguaacagugugggcaggcacaugccauggcacauguauguggagggcagaggacaaccucugccgcuuccuucuuuugcuuguuagagacaggaucucuucuccugucucuagcucccuccccuccacaggcgacugcgagagcagacucugcuaacacggagcuuucugugucugugauauccaacucagcucuuccuuccagcucuucuuacccgcugagggucgucagcccuggcgagccguccuugucuuuaccaguuuauaagaaagagcucuuuguguuuuuuagauauuggucaauacuugauagaauguuauaagacuauuucauaugcuuuaucuuuucauucuuuuggugaacaaacuauuuuaguguacgauuucuuuugcuugucuccguuauaguuaguaguuuguauguuuauaaggagauucuuugcuguaugugauggucagcagcacugccguuuggcugucccuuugaacugaacauuuucuauguugaaguuacagagguaauuguuuucuggaagcuuuaugggauuacaucucacaguuuugccuuuuucuggaauuaauugucaguaucauugaaacugaaacucauuugauuuuccacauagauacuccacuuccuagcaccauuuccuggaaaggucaucuugcugcuuccucucaaggucaccuuuaucauaagccaggcagucauagaacaaacgcuuuggucagguuguagccugucugcgccaucuuauuagucuacuuaucagucuuguaucucugcuacacucugacuuauuguaguguguuucacucaacauguggcauauuugcuugggagagacagagagucauuugagguauuuggccuugucacguauucacccagccauagaucgauguguuugggguaaaaauuaaauccauagugagcagccacaaaccuuuuucuuaccguuauuacucccugcauuaccucuugacugcuguccucagagcgucgggcauaaagauuaugucacugaggcaggcagaauguguggaugucguaugcagaugucacaccauuuaugcauggacuugagcuucugcaaagccugguaugcaucagugcuucuaggggacaagaagaggcucucaaaggcaggguuguugcguguguuauuuauuauuucuggcuuuccuugcuuacaguauuccuaguggguagaagcaaaauuacuuuuuggccccuauggcaugguuaauuucugcuucguuacuuuaaagcuaaauuacuaagugcaucaggaauuaguucuucuuugacuuuaugaggucaccuuuucuucuaagccagugguucuuggccugugggucacuaccccuuuaagaccauuggaaaaagcagauauuuacauuacaguuuguaucaguaggaaaauuacaguuaugaaguagcaacaaaaauaauuuuaugguagaguaucgcccgcuauaacauggggagcuauguuaaaggguuagaguuaggaaggcugagaagcacugcucucagcuucugucugcuuugcccaguaguaauuaaugcugcagggcuuugcacugugcuuguggagguucuaguucuacugcucauguuucgauaaaucucugugucacaguuguguucucucuugagcaagugugguaacuugggagcuuuugccagcucauaaaugguuuuaaggcaauuuuuaaauauucuuauccuuauauauguauuucucccauugcuuggcuauguuuucauggaaaaauucaucuuuauaacuacugccguuacuaaaaccaaagucugaugacuuacaaaauuacauuccauuauuuuuguaauuuucuuacuuagcuggugauugcuaacccuuuuccguggacuuaugacuugacuuuccaacuuggcauuacaacucuuagauuccuauccgcuuaacuagaaaacuugaucccccacccacccacccccccauccucugggugaucuugugucuucuuuaacucaguagaaggcuugguugagcuacuuugagauuguccaguuaccuccuugagcuuaauuacuaacucagagggaguaacauauguuagaaacaggugucaguauaucccauuuuguaccuucuuuguauacuauuaucugaauaugaauuguaaagcauucugaaauuaacuuuuauuugguuuuguuguuagcuguucuuuaugaagaaucgugcccgaaagcaaggcauuuacuugaggcuucuacccaauggauuuagcaagagaaaagagaauucaacaguuuuugaccauagguaggugucucacuuuuacuguauguauagcugucauaauuugauaagggacaaccuauaagguuugguuugcuuuagaacauuguaaacaaacgucagaucuguaaacuguuccuggaugacaacagaaacugauaauugcauguccugugacuggugugaauguccaagaacuuguauguuguccuuggagaagcuucucaaauguuaauguacauaacaaaccaguaaauauccuugugauuucaucucagugaguuggaaugugauaacauguauuucugacagugccucaacaauauuuguggcugggcuggaauuugauagugugcauuucuaauggugcccagaaacguucauggcugagaauccuacuuggaggaauccuacuuuuugagugucgugaaguuuucuuugagaccuagaacaucauggaaguauuuggggagcuuaacuucagaucucggaagggugguaaaagcuaguuuccuuggacuaacucguuccuccuccuccucacucagcacuuuguaccuuggugcaagguuaacaccccuauagacuuacugccucuguuuuguaggcaggucucacuguacuguccagacuggucucagaguucugacucaggcaccucccaccucugaccuccgcaggccucacugcagugucuguggccucuuauggacuuuggucaguuguuuuagagggaccuuguucucccguuguucuccaucucuuuucuucuuucucuccuucuccugacuccucuucugcaguguucccugagcagagggauuugaugcacauaccuugcuuagagagguuccaagcaugcaugcucaggcuuucucucaggcacucaccuacccucccucccuucuucccuuccuucccucccucucuguguuuugucuggcugugaaucucuguaucugaccccaucugcugcagaaagaagccucucugacuauagcugacuaagacaccaguacucaguacucaguacucagccugugugauuagcucuacucucaaccuguauucuuguauggccuaaggaccaguuccccagaagggcccaggcuucaccuuccucugccccacccaguucuagacaaccccuaagcccuguacuuauggucaguaaguacuuauuguucuuguaccuccuacuuagaacugugaguccuaaacuucuuaauccaucuuuuggacuugggguuugguuugguuugguuuuuugcuuucuacagauguauauaucaucuuuauagaacuuauagaucauagagacaugcccguugucaaaaugugaauuaguauuuaaguguuccgguucuguuuuagaaguuagccacuaggugucccucuuguaaagacuuaacaaacauuuuacaaauuuaaaaacauuuuauuccuuagauacaauuauagcuuucuuguuauaucguguaacaugcccaucuacuuguugguuaacauaauugcaaugauuuccuuaaauaguuguggcaaugcauuucuuuaaacacaggauuguuuuuaacaugguaucuauguaaguguagguuuguacauuccuauagcuucgcuuuagaaaggagcaaggauaagugaaacggugagucuugcaguuguggagaacaggugggcuuuacagugagauucagagggcaauauacuacagacucaaaguugugcugaaauguugaauucugcuauuccuuuuccauguggcuuuuagauguuacagaggaauuucagagugacuguggggccuucuaaaaacacugggaagaaguagaagccugauuguuccccugcccggccucuccugacuguguccaugacagcaggcaagggagcucugugacacugcuuccuagggcauacauucccgcagugcugcucaaagacugucucuggaaaaccuaacacuggucauguucagucgucaugcuuuaccaugauggccaccuacucagaauauuacagcuucuugcccacuguggucagggccucgggugguuacuuuggcuguuggcaggauugcugguaguuuaaaucuguaaucucaucaccuagccugugucugaaagucugaaauguuuuguucuuccguggcuagaaguuaacaucugcuuuuuuuuuuuccaauuuuuuauuagguauuuucuucauuuacauuucaaaugcugucccugaaguccccuauacccugccugcccccugcuccccuacccacucacucccacuucuuggcccuggcguuccccuguacuggggcauauaaaguuugcaaguccaaagggccucucuuuccagugauggccgacuaggccaucuuuugauacauaugcagcuaaagucaagagcuccgggguacugguuaguucauaauguuguuccaccuauaggguugcagaucccuuuagcuccuugggugcuuucucuagcuccuccauugggagccuugugauccauucaauagcugacugugagcauccacuucuguguuugcuaggccccggcauagucucacaagagagagcuauaucuggguccuuccagcaaaaucuugcuuguguaugcaaugauguuagcguuugaaggcugauuaugggauggauuccuggguauggcagucucuagaugguucauccuuuugucucagcuccaaacuuugucucuguaacuccuuccauggguguuuuguucccaauucuaagaaggggcaaaguguccacacuuuggucuucguucuucuucaguuucauguguuuugcaaauuguaucuugaguauucuagguuucugggcuaauacccacuuaccagugaguacauaucaugugaguucuuuugugacuggguuaccucacucaggaugauacccuccagauccguccauuugccuaggaauuucauaaauucauucuuuuuaauagcugaccaguacugcauuguguaaaugaaccacauuuucuguauccauuccucuguugagggacaucuggguucuuuccagcuuucaaucacucugcaaccugaauugcuaccuuuuuaagcagagcagagacuaugucagguauuucucaugaauaaugggagaugccuuguguguuugcuaguuaaagaagaucacuacauaggucauagauacucuuugcuuguuucaugcucaccaugguaaggccugauguugagggaggggaguuuucuuggcaggccacuucucuaugccugcugccuggguaucaaggaggaucuauauagugaugggacuguuugccauguuuaggggauucagcucagagcaccuuccagaacuaacugugggcgguucugaagcucagaauuaggcuugaugaacagagcuguuacuucauggaccuuaggguauccuuauuuuuaaaaagcaccagaugaguuugaaaucugccucugguugaaaacuacuggccuauguaccuacuagcuccugcccaacuucucagcagccucugcacaguugaguacuacugauuggaguggugacauacagggcgcaguagaugcacaagucucacugccugggagcacagaagaaaaccaagaagagcagugugcaucaugaccacaucccugacaaggggcaggugagggaucuauggcacagcucaucucaucagguagaucagauagagaaagacaggggccuagaaguggggccagacuguaaugcucaaggcugguaaccccagcaucccguucuuccagcuguacccaccucuuaaggugccauagccuccccaggcuggaccaccggcuagagagcaucuuauuuauuucauauucugaccucaucaagguccaagacucauuuaaaaggaaggggaacagguuuguacucugcugguaugauagcagcuccaaaggccuagggacuuuaagacaguggagguaguuugugugucuagagggcaggguagugaguccuggugggcugcggacaagccugccgugcuacaccagggaugagucauggugggcugcggacaagccugccaugcuacaccggggaguuuauugagguaaaccccuuggacaggcgaucuguagucugccccuccugauuuccugcugauuccuagggugucucccucuuuggcguccccucacuaucugugcacauguacacacagcucaucugcucuccauccugucucucgugccugaguuccuguaguacucauuuucuccacaguuaacaugaaacagaugucggcauuuaauaccacuuuuugguaugcauauaucugcucaucuuccugucugucaugguguccccauaggggcgugugaguauuuugaaagguauauuugguguguguggaaccuuugauacuuuuuagaaaaacuuguauuccugaaccuuccguaguaaggaaguauguaugugcacucuuggaggccaaaggaaagcccuuuggaacuggaguuuuagguaguugugagcugucugaugugggugcugggaacuaaggcuggguccucugggagagcagcaaguaccacugcgccuucuuuccaggcccagagacuacgaagucguaagagaagcaagaaggcuucacuggugaucacauggggagacagaacacgccagccagagaggagcacacguccauaauccacuaacgugugcauggcagaggccggugcucagcugugucucagaagcucagcucagcacuggugcugaggaaacgggagcccagcacaggacugucuggggagccauuuguaucuaacacucaaguuaagguucaggcugacaucaugucagugugguacucaaauacucagaaauacuucucaaaagcacaaacaaagcuagacguggcagcacaagcuuuaaucccagcauuugggaggaagagccagguggaucucugcauuugaggccagccuggucugucuacaaauugauuuccuggacagccagaacuacacagugaaacccugucuugaaaucauggggguggggggagcagaagaacguacaaggaccagugaaauggcucggugaggaaaggcgccaagucuuaggcaucuaguuuaauaccuagggccaacauaguaagaggagggaaccggcuccacagguuguccucuugaccuccagcugugugcaauagacaauacugcuauacucaaaaaauagcaauaaauguaagcaaagaaaugacaauuaagucucuguugccucccacauugagggacuauaagcgugugccuugcuauuuauaacauauuucuaagcaaaauaccuuugaggcuaucaaaauaauuacauacauaauccaggccucauugggccuaucugugugucuauggguguccaggccaggggucagucagugcuccucagucacuugccauguuuguuugggggggggggggguguuuguuuuguuuuuugagaaaguaucucacuuaugugccacccacugagugggcuaggcuaggccaugagccccaggggucugaacccagcagacacaucauuugccaacugaaccaucuaccccagccccccaaguaauaaucuguaaggagacgacaaguucaagugaauuucuuuuuucccauuuauuuauuuauuuauuuauuuauuugauauuuucuuuauauacauuucaaaugcuaucccgaaaguuuccuauacccucccuccgcccugcuccccuacccacccacucccacuucuuggcccuggcauuccccuguacuggggcauauaaaguuugcaauaccaagaggccucucuucccagugauggccaacuaggccaucuucugcuacauaugcagcuagagacacgagcucuggggguacuggcuaguucauauuguuguucuaccuauaggguugcagaccccuucagcuccuugggugcuuucucuagcuccuccauuggggguccuguguuccaucuuauagaugacugugaacauccacuucuguauuugccaggcacuggcauagccucauacgagacagcuauaacaggaucccuucagcaaaaucuuucuggcauaugcaauagugucuggguuugguggcaaucccugggugggguagucucuggauaguccauccuuucgucuuagcuccaaacuuugucucuguaacuccuuucauggguauuuuguucccuauucuaaggaggaaugaaguauccacccucuuccugauuuucauguguuuugcaaaauuguaucuuggguguucuauguuucuggcuaauauccacuuaucagugagugcauaucuaaugacuucuuuugugauuggguuaccucacuaagggugauauccuccagauccauccauuuguccaagaauuucauaaauucguuguuuuuaaaagcugaguaguacuccauuguguaaauguaccacauuuucuguauccauucuucuguugagggacaucuggguucuuuccugcuucuggcuauuauaaauaaggcugcuaugaacauaguggaccauguguucuuauuaccaguuggaacuucuggguauaugcccaggagagguauugcuggaucuuuugguaguauuauguccaauuuucugaggaaccuccagacugacuuccagagugguuguacaagcuugcaaucccaccagcaauggaggaguguuccucuuucuccaccuccucaacagcaucugcuaucacaugaauuuuugauccuagccauucugacuggugugagguggaaucucaggguugcuuugauuugcauuucccugaugauuaaggauguugaacauuuuuucaggugcuucucagccauucgguauuccucaguugagaauucuuuguuuagcucugaaccccauuuuuaaugggguuauuugaauuucuggaguccagcuucuugagcucuuuguauacauuggauauuaguccccuaucagauuuaggauugguaaaaauucaggugaauuucuaauagagaaguauuuuaguuuuuaaaaaaauguaaggauuacuuccaguguuuaucucacuauuauaugguucuucucauuaaaaauaucuuugguuuuagucuuggaaaauaacaaaucaaaugugaaagauuuauuuaaugcagaccuauucuuaaauaggaaugaagguauuucaugucauacucugagacuuggacguacuuuccugccucacugcagagcccugcccgugcccuaggacuaguuagcauucacugucuuaauguuuccugacgauggagguuguuuccacuggcccuacuguagcagcggugcagugaacgguuacccauaucuuacuccuugcccgguccuuccucaguauaaauucauaggacugaaacagaugggcaaaaaccaauacaguuuuaaaugauaaauuuguacuuauagcuuuuugugaaauugugcugccagaggcuuuuaucuauguguauucuggccagcaauggacaguguauuuuucuccauauuccuggugcuacuaauuuucagaguauaucuguaagccugauaaccaccacguuucuuucugugugcauucuuugcauugcauuugaacagcccugcagcaugagcaguuuaccauuuaucaggagcugguggcuuuggauuuguggauuccuuaggauucugagagagcuucagguuaaaaugcaguguuuaagaauaaagucaagaauaauugagugcaugaucauagagcccucugccaguguccucaucuacauauuuuauugaaacuuggaaaggaaaggauuaucccucagaguuccaaguaagugaggguugauaaauauguauagcuccuggguauaaauauugcauaauauuuauauucccuauuucauacauguuuuuccaucaauuuuuauauuuuuucuauccucccccuucuccccggggagccuuucagacacucauugccccuguggaggcucuugcaguaagguuuuguugacuauccaaaaaacauugggacaguacuggcucuauugcaugcauggugugugugucugugugugaguguguguguguaugagagaguguggguguggguggguguggguguuuacuugucaguauuuggggaaagauaaacugccaccacacccuugcugacuguuccucugacaccuuuggcuucauggaacuccaagagcugauugugagugaguugcccagaaagggauggcacuguuaguaauugugcccaccgcuucacugagcuagcuagucagcugugaacaacugucucggguuguuuacguuauguagaauguucacccuugagaaaguggauuugccaagggugcuguggucacacugugcaucugagugaaucuggggaacagugaguugaagcuaagccucugucccgauacucuguuauggccguguuuuccugcuggggaugccggggagcauggucaguuauugucagaccuggaagccugaguucucaagacaucuggugggucaggcuggggcucugauaaauguucuccaguggguguauggagcagugaagcggcagcucuaaaauaucggcccugccacgauugagaagcacugaacuagccugauggugagaggguuucuuggaauguggcuuuaggagauaccagguagcauucuggcuuuaguauauguucauguuuuaagcaauuuguguaucaccauauguaauuaugaacauagaaaacaauucuuuggagucuccagagcagauuugauugucuguguguaucugcuucuuguugguuauuacuuaaguuaugccuacaugaauuucaguuaaaaagucuuuagggaagagccagugagauggcucagcggguacaugcuguucccucaauugcuugcuuaaaacuaauaacugcugcaucugaauucaggucuuugugucugagacacuagacaucagacuucuauauuaguaaugugugcuuauugauguuguucuaucaaaaaaaauaaacuaagccaaacucaguuguuucuuguauaauaauggcacuguaaacacaaacauaaucuccacacucuuuucuucagcuuuuccaaaaccugcuguauucaaauguguggugacuuaccuuaacagacaggcuuuucauuggcauacagccguugccuucagauaaaaagaaaaauccucacuaaaucguauaaauggagauguacugcuaaaguuguguuuuuuaaaaaauguuauagauuugggguugugcuauuuauugcuacugaucauugccuagaagagauauagcaagcggguggccaaaguuuucuucuaagacaagcaaauacauguaggccaggucagaggcaggcugaccugaccucaaguacaaacuggccuacauagcaaggcuucuaagcuagccagggcugcagagucagacccugaaacccuguuucaaaacaacaacaacaaaaacaaacaggagagcuguauaaagccaucacuucaagugaagagauuuaaauuucuguaguggugcuucaaacaguaguuagguuuuuuaaguuucauuuuguuugauuuaggucugaugaguauguggucauuuuuguaaaagcaaaaguuuagugaguuaccguuuaguucccacacagaccaaagucuagauggaaagcagaggcacucuguguguuuugcuuagcaaccagccuguuguguccuguuuugcuacugaaugcacacagucauccucacaagugugcagacaaccagcuggacacaacuggacaggacuuccuucaccugcuuucuagaugagucuggaggacagcagcucacagugcuuaaucaugaggaaaugugcucggaaacucgggacgcaggcucacccaccucacacgccccagcugcgagaaccacccccuaagucaggaagacaaacgucccucagguucagaacuucuguucuuuccgcuuaccaaccuuaccaacaaguccgugacuccaggacgucguucccacggcuuuagaaaguggcaagcggcccugaauaaaagcaguagucaagguuugggagccacucuagaaaauccuacagugggaacggaucugaucugugggcuuugauccuucucucccuaauccgcucauaauuguucuccuaggaagcagcaguuuuguuggcaugucaagcuccaguuuccucagagucaagcagaguacauagaaaaaagguacguaugaggcuaugccggugccuggcaaauacagaaguggaugcucacagucaucuauaggauggaacacagggcccccaguggaggagcuagagaaagcacccaaggagcugaaagggucugcaacacuauagguggaacaacauuaugaacuaaccaguacccacagagcucauaucucuagcugcauauguagcagaacauggccuagucgaccaucauugggaagagaggccccuuggucuugcaaacuuuagaugccccaguacaggggaaugccagggccaagaagugggaguggguggguaggagaguggggcggggggugggggggggcgugguaugggggauuuucgggauagcauuugaaauguaaauaaagaaaauaucuaauaaaaaauuaaaauaaaagggaaaaauaagauaaaagaaaaaagguacaguacuaccacugucugcuacagaugucuuacuuuaaggcucuggaauuacacaggcugaaugaauaaccgaagcugugcgagucacagugcaguccucauuggccgugacuaaggguccugcagcugagcccagcagcauguggaucaaaucagcuaccaugcugacaagguucugucugagaguauagaaaacuccagaaauuuuaaccauuucaggaauaucuacaaagugggucagacuugaagggaaaaguuaaccuugacuguggcagugauuauuugagcagggagugugauuuaaggagagggacgugauccaaaucaggaggucugaaacugagugacuccacgggacaugagagauaaccaagaauucugcuauaggaaaacuccucuauagugauagaauccacagaaaauauuauagguguauguaugaaaccuguguguauacaucauaaucucuccuacauaugcaugcauaaguacaucaucacuuaauguuaucaaggcuuguuaagguuguuuaagaauauauccacguaucgcucagguuuuauuuaccaugcuguguggcucuaaguggauguuaggugguguccucagcaucuguccccacugugcaucgucuuuggaaucgucacggagaguuagcaaagaauuuuguuucaaagcagaaggcaggauuggucuuaauacagaggcgagugacgcagagguucagugaguuaacuugcuaagauacauuacuguuucgagggagucuuaauuuuguuaugcagcuuauauagaaauguaaagcugugugcauauacaggaagguuugcaaaccuaacaugcuucacugcaggaaaauugggaucagcuuuaaagccugacuguggcucuggcugagugaacagaacacuggcuggcuugcggccuccugaguguuccucugguguauuucucugagguucaugcauguuucaguuuuaaguuguuaaaguuugaacacagguguacauuaaaagcagcuucauauuuuuauaagugacuuguaaggagguuuucuagauuuuuaaagacuuuaaucacauguuccuagaaagucugucugugcuuuucuucugcaaaaacuuaccaugaaaaaaaaauucuaugcuauauuuugccaagaguaaaauaaaggguccuugccaguauuuauacaaaauuuagugguuuuaagauaacacuuaguagcaauuauuaauaauaacguaacuacuuuucuucucuguuggaaagaguaccagaugauaaaacuauuaaugaaauucuaaagccuuacaucgauccugaagagucugacccugugauccgucagagguagguuucaaacgucucguagcuuucugacaagauuuaaacuguugacuuaaauguugugugagugugcaugugugcacacgcgugcugcagaacacacacagaguauagaaacuguggagaacgggcucuccuuccaccaugugccucucagaguuggaacuuagaccaccaggcuucacaggcaucuuuaccugcuguucaucuugcuggaugcaaagguuaacguauuuuugaguguguauuuauuauaggaaauuguggcuguauuuaaguauguuguuggacuuugcugagguucagucacuguaaaacuagugccauuuuuuucuaccacagaugcuccucaaguaggcaggaauggugucaauucauuuaacuguugcagcagcucacacccauuuuacagguggagacacugaggcuuaaguagguucaauaaccuccugugaccaauaagcaaggaagcugagauucaggccccuacaggacugaagucuacagucucagccuuagaccagacugccuucacauugaacuaaaaauucuaaaacuuaaagcuuuucuaguaacugugaaagacaggaaauuauuuuucagucaaguccucaaagaacuaaacaagguuacacuuugccucuagaaguacagcauggucaaaaguggguagcacagcuuaauggaaagucucuccuggauaugugaguuaaguagcuaccugccugccucugaaccgugugaucagagccaacugcuucacaccaugcuuuaaguuccccaugaguuauacuagaauaaugcuagauuaaaaagucaggaagcaugaaagagagaaguauaaagucucagggccuggugugcucacggcagcgcgcuggcaggaagcuuggugguggguaguuuccaggcugugcuccccggcaggaaacgagaggugggggccucuuuuugagaugggagugcuuguuugauuccuagaggguuggaguuuauaccugguggauccuguugucucucacuauugaagaaaacagugccaggcagacuccugcaagccaugcaggagcugggccuugucuuugggacaacucugacaguuaaagcuugacuaauugauaaucugguuauuaucguugcucagauaguuggcauugaugaagagcguuugcuacuaaauugaaggcaguauggugguaagcagcugacuguuugcugauacaaguauguuuuuuagcauauguacugacaaaacaagacuugaauuucagauguguaaccagcucugguucgguauugcuuucacaucuugcuuagaaaccaucuuuuucucucucuccucguggauagcugaauuaugaacauuggcugcucauagaugcucagacuaucuggaaauagauuaaaaauaacuuuuucuuccucuacugcauuguuuucuuccagauugaaagcuuacgcacagucacagacugggguccaaauuuuaaugagggucgaaaauaugcagcaaaauaugauaagguaaaauugcuuccgucauuuucucuguguuuaauuaacuggcuugauuaggugacguagcuaacuauuauauuaauuguuuugcugugaacaaaaaaaucucgaaaucuaaacuuaccacuuucaaguuaaaauacuaaaauagucgcacacauauuuauuauguaugaguacacuguagcugucuucagacaccccagaagagggcaucagaucucauuaugggugguugugagccaccauaugguugcugggauuugaacucaggaccuucagaaaagcagucagugcucuuaacugagccauuucuccggucccacacaaguuuuuuuuguuuuuguuuuuguuuuauuuuuauuagguauuuuccucguuuacauuuucaaugcuaucccaaaaguccaccauacccacccccccaauccacuacccacccacucccccguuuuggcccugggguuccccuguacuggggcauauacaguuugcaaguccagugggccucucuuugcagugauggccgacuaggcuaucuuuugauacauaugcagcuagagucaagagcuccaggguacugguuaguucauaauguuguuccaccuauaggguugcaguucccuuuagcuccuugaguaauuucucuagcuccuccauugggggccgugugacccauccaauagcugacugugaucauccacuucuguguuugcuaggccccggcauagucucacaagagagagcuauaucuggguccuuucagcaaaaucuugcuaguguaugcaauggugucagcguuugggagcugauuaugggauggaucccugcauauggcaaucacuagaugguccauccuuucgucacagcuccaaauuuugucucuguaacuccuucaauggguguuuuguucccauuucuaagaaggggcaaaguguccacacuuuggucuucguucuucuugaauuucauguguuuagcaaauuguaucuuauaucuuggguauccuaaguuucugggcuaauauccacuuaucagugaguacauauugugcgaguuccuuugugauuggguuaccucacucaggaugaugcccuccagguccauccauuugccuaggaauuucauaaauucauuuuuuuuaauagcugaguaguacuccauuguguagauguaccacauuuucuguauucguuccucuguugagggacaucuggguucuuuccagcuucuggcuauuauaaacaaggcugcuaugaacauaguggagcauguguccuucuuacugguuggggcaucuucuggauauaugcccaggagagguauugcuggauccuccgguaguacuauguccaauuuucugaggaaccgccagacugauuuccagaauguacauaagaacucacagcaguugugacaguguccacaacaccacuacaagcccaagacagacagaaucccagcaugaggagaggaagcagacacuaagugccaccacucgcugagaguauagagagaguuaaucuguaagggcgcgacccugcuagguugaucacacuccaguuaguggccacacauccuaaaguauauggacuggaugguuucuuagaggaagauaaagaggagaagcgugaucuggaugacaugugggaagggaugaaugugaucaaaauuguacacaauucuuaauaacuaauaaaaggggauacuaauuaaaaacagaaaccuuaaaacaauaaauuuuuaagauauacaaacuaaaaauuuauuccagcaucuuacugaauuccauuauucuagaauaagccaugauuuaaaaaaaaaaauuaagccaccagauagcagugagcugacuuauacccuauuaagucuuggacucuccccucaaccccccaaaaagucagagguucaguucuguacuuuagagucaguuguuuucaccuuuaacccaaagaccuaggaggagacauaucuaccaccguccuaaaacauagguuauauuuguggcaggugugcaucacaacuugaaauuuuacagcugugauugcuuccgucagugaccuuauuuuuaguggaaaauuaccguguacuagagacgauuaaauugucacaucugggaagaguugagcuuugcuauuuuauauuuuagauaguggacggguagagauccagagcaucaccaccuagaugggacguagcguuguuuguggcccuccucuuuuuaagucucuagaaugugaggaauagaagccugcgcccuagcuugcuggggcagacagaaggaaguuggcugaugucuuugaaagauugaggaucaggcuccuaguuaccaucaaccuuugagaugccuguugagccuccugugugagccugcuuggguucucaguacccauguggagagaaaaaacuguaaaaaucuauguaguaaguguuuuucauuaugccugcuugguuugcucaguaagacuggcuucucacgguaaccaggccuaacccuaacaguuccaggcaucugauguguaacgugcuggucagugguauguaucucugaacauuucuuugcugggagcaugguauuuuuuuuaaauagcaguaauauugggguuugaguccauguagcuuuuggcaaucuaaagcaaccaagugaacagugaaugcuauaaaugagauaaaauacugaaaaguauuagcuaaacacagaaaaucauuugccaaaaaaagcuaaaaucaauagaaacaucccuuuacuugugaagucccuuaggggaagccuugugguuaggauuaaauguguagaaggugagcuauuucaaguaugcccccugcggccugagaagacccccugguaguguuugccccuaggaaaaguucaguugcaucauuguauacuauacauuaauuuucuguuccguuaucuaauguaaucgccugucuuucuuaguguaacuacaacuggggguuauuuuaauugaugcuuuuuuauuuauuuuuaauuguaugcaugugaaugcaugcuuugcaugcauguagcgcaccacguguauguaguacugguggaggucagcagagggcaucagaucuccgggaaggguaguaacaaacaguugugaggugucuugugggcuccaggaaugguacccagguccucugcaagaguacugaguacaacugcugugcgguucuccagccccacguuguuuauuuuuaagggaaugauguuugaaagaugugaagcauuugauccuuaaauccuggacccacuuguaaaauauuuucugcacaccugucuucuguugcccagggagaggcuggagugugaccacagaugcugcugcagaaacgaacgcacuuacucugcauuucaugcuucuuuuuaaugcucugugauucugaaguaaaugacuccaguucuugguagagcaauugucagagaagcugcacacagguuccuucacacucagucucucaaguguuuuccucugaggaaguccuguuaccaugguaggcauggcuuugccguuuuaaagcacaucuguuuccccuguugcacaggacagccuuggaacagagaaaucgcuguuaccagaguucauagcuccauauacaaauaacucgauauuaguuaagagccgccgagacucaccagugauuuacccugaauacaccuguagaguguggugcuuccagggacaucucugcucuugagccuucaugcuccaguaugcuuucuucuuuaaagauugauuuuucauuauuuuuauuauuuucaucacgugugcuguuuaggcaugugcaugugagugcaggugccuggggaggcuagaggcuugggacuacuggggcuggagucaggguuaggagccacccauauggaugcugggagccaaacccagguccucugcaagaacagcaaauaguuggaagagcuguggguuugccuuugagugucauaugucauuguuagggaaggaugaagcuggaaacccucuucuugguguuuucuuguucaccugaaacggcauucagaugccagcauguuccugcacacacuguuaccgcgcaagcugacacaccaccccagagaggaacucgauguguauguagccuaggcugcccucaaagccaugagccucuuuccuuggcugcucauguguuugguuguaggcacugguacaccugccaauucauuucaauguuagucucuuugccuggauucuuagaagacauaagugagguguuuguauuguuuuguucuuguuaagguaucaugaacuggauccuuacaaaagccuuucagacaacuugaaggacaaagugaucauugaguacccgacuuugcacgugguguugagaggaucuaguaaugacaagcagcuacuucaagguaagcaguguggauguuuugugccgguuccgaggcugaguggaaaugguggguuagagugucuugcuggaaaggauguuuuggcugauuggaauugugaagaugucguuuacugucuacugaaaacucaagagauuccugaaaugagcaauggcugcuuccuauccucccuucucuaguuaccucuuuaaacucacugguguuauuuccugccucuucugauucuuuguccaugugaggauauuaaaacuguuaaagcugggaguggugugugaauguuuggugguguauaaaaaccuucccugcguuccagccacugauggaaguaaccuagcugugcugcggaacacagaagucucuggcugggcuaaagcucagcacugacuguuagacuuagauuacucagaacccugagauaacauucagcugagaaaucagcuaggcuacagauacaggccggauacagguggauacaggccggcugcaguaccgcacacuggagacacugugugaaucuguacguuuagauaguuuuauucaacaagugugauuuguguuuuguugcauaacaaaauguuaccuguuuuuaagguguucucuccacauguauauauaugucauuuuuuucuuucuuguauaaaauuagcaaaaaaguuuuugaagauucuuucagugcuauaucuugaaacuagauucugauuaacaaaugugaaguuuuuuaaaaauaaauuaagaaucucuaagccuuauauuuauucuugucucuuuuuaccauuugagaauagccccccuuuuuuuuuaacauuagaaauuucaguuuuaaaguaaucauuuuuacuucuuuaaacuuuuuguaaaacauuuuucuucaacaugauuaacauagcgcugagucuucuaaauguugguuucagggaaaguuguagggugaguuccucgccagggcaaacacgggcuguguaaacaaacggcacacacagcuucucuuucaccuuguuuaggaauaacacuugauucaagcgaggcuuccuggguugcagcgguaagaaaggauaauucauccuguacuggaaccucacuuagaaucuguugcuuuauuuuggacuuaauuacaggcacacacaggugacucccucuuccucuguaaaggccugucuagggcugcagcugcaaagagaaucugacagaggucaaggguccugcccuggcugucauguccuaagugcaucccuuagcaggaaagacaggccuguggacaugcauuuauuugucuuggcccaucaagcuacaagguccccugugcaguccuguaccgggucugcggaucuucugcagcguggcucauggugagggaggcucugucagaacugaacauuuucuagggaaagcauugaaaauuuuguucucuccaauugaauuuuuauccugagaauagaguucucuuuugggggaagauguggcuuuuauaacaugacugcuucuacauuuuaucuguaugcuuccccacuguguuuauagauguaaaagaacugacuguguacagcagcugagacugaauugugucauuuccgcccugugagaaagugccaguuacgaugcugaguggaaggguggguuagagugucuugcuggaaaaugcaguugaugguuguuacaguguuugguuggagauugccauaguuaggucugccuguauucaucgccaagggguuuugguauuugcuugcuuguccuuccuucucuuuuuaaggaaugaaaaggguuaacucuaccacuuaagggcuaggcaggagaggaaagugccaguuaacucuggcugguagggguacacacacacacacacacacacacacaccuuugaauccuguggagagcacugagaagaguguaagauccugcccaggaccuccucugcugccacuccaguagcagaugggagggacuugaaaaagcagccugugcgguccuaugaggaaaaggacagaaccccaggaaaagucagcugagcagcuuuauaggcaaagaaaaggcacgcgugcugccuugcugcggagcuucacgaaugagucagcaaugugaccagucucucagugggaaaauaaauccuucacugacuccccucccccauccuuccucagcccucuuugccuuuuguaccuuuuacugugucggugacgggaggcucagauaugaaaggacagcuaagcuguguguacaguaggcgccaugauaaaccccugcagagaaagccagaggacaaaaugauucacucacaagaucuuggaggaaucuaaaaggaagguucuagaauuuauaaaacucccaagauggauguugccugagguggcuacauuuugcugccuuaccaucggaaagacuugccagcuguuguuuccaguacaacuguagaucuaaaugaaccccagggaagcagucaguuggaauaugagacagagcucugggcaagcuugucuuucuagccuguguauaucuucuguccgcuuccuucugcuucucugccucauggagauaaacgguaguaacuuuaagccaaauaaucucuauaauuccuuaaaggcuuaguuuuauuuaaauguguacaugugugugucugugucuaugugugugcgugcacucgcacuuacauacaaugcucuaaaaggccaaaagaagauaauggaucuccuagggcugaguuagaggcagcugugaaugucucugcaccugccccgugugaaagagcagugaguccccuuaacccugagccauugcuccagauccuaaucauauuuuaauguaaggacagaguaacauacaaguacagggcucaguauccugcacauuaugagacagauccagggaggagagauuagauuuugucaugaaggacuggcuucagugcccagcugggugccgcucacccugggcguaaaagcuucagagaugcuccauuuguggucagucuucugccagccuucuuuccuucaccuauacuugccauuaaguuaaauuuaaaauauacacauauguaaaaauguuuccagcgacauguaggcaggccacaugauaauaguggucuauuuggcgucaucugugggacaacugaacugagaggucgguccccaagucuucagucaggaaggauauaaccucacaggauagaauugccacuuucacccaucaguucuguuuccuauguucagaauucuggauccuggcugcuugggacaugacacggucugucccugugugcagcgcuguugcuaugccucagaagggaggagcggugaagagaaaacaaaacaggcugagcaguauaaacgucugacucuguguuuacgugguuuuuuuccagugaaaagugagucugcccagaagcuuggcaauggaaauuaagcacugagaaagaagguggccguucccagagggcugagaagauuguguguuacuggacugcugggugacuggguccgucaguggguaguguguuguuuauccaaaaaguaauuaaacagcauaagguuucucacggggagaaagugcauguuacugccuuuugagcuaagugacuuauaaacccucuucuuccauaggaugagcuccugguucacccgacugcuguaguccuugcuaggcauucagugugcucauuucuauaagcugaaaaccuguuuuauuuguuaaguugucacgagaccaagcccaagggucaccugugucaaccacaacgcuggcgcucucuguggucucagcucucugaagagaaugccucacaucaaagcaucuagcuagggagaagccgcuguccaggaguuggcuguccucugguugggcuuaugugcuauacaaaggguucauguggagccguguuguugccagggccacagggaagacgggaggcuccaucucacgggaugcagauggagccaaagguggagucugugucccugacacgggcaggaaggaauugaacugaacugucuggggguuugggggaagagggagaaaguacacagaaggacaugugauccaaguguggggagugagggcucuccucacugaaaucagcacuuuccucugaaguugaagaaaaguguugagcuuuauaaaacuaaacaaagaaaaaauuuauucugugcuuuccucugcuucccggaguucaccuaaauauaacugccagcucauuuggcuaauaugcauauuuauucccaauuuauaaugaacauguguuauguguugucuuaguuaagacuuuauguugugaacagacaccaugaccuaggcaacucuucaaaagagcauuucauuggagcuggcuuacagguucagagguucagucaaugaucacgaagguaggaucauagcaguguccauaugugguacaggagaugcugagaguuguacgucuucaucugaaggcugcuagcagaaugcugacuucugggcauuggggaugagggucucaauugcguuggcauugaacaucagaagcccacauccacagugccacgccuacuccaacagagccacaccgucuaauagugccuccccugggcugagcaugugcaaaccaucacaugugucauaaugaauaaucguguuauacuuacagggggugagguuggaauaguuugcugagagcccuggaaggcagagguauuaaagcu

SEQ ID NO: 1745 - RNA, 3016 nt, Mus musculus
cagauauuagguaaauauuucuuuauuaaaugauuaauuuuauaaauaaauucucuucacugauauaaaauuaaaaucauuuacaaauuauuccaguauuacauuuccccucccuccccaaaagcuacacuuugauaaauaaaaaaacauucaaucuuaaaacaccugguuucuguuugcaguuuuagagugcagguagcugccccaaggacacucacagaguguccccccuccgcucgggaaggaaugagaggcgcuuucauuuacuucugucaaaggacaagcagggcuuucacuuggcccaacuaaucuuauuuugucucuauuacaauuguagaaccaagaaaggggggggggggucuggagcaaaaaaauacacuuagcaaauaauuuacaaacagaaaacagaacgucauccguaaacaugcuccaauauggagcaauaaugcccgcuccaguacuaugaagcgaagucuucuccaacugcggcugcgcugcuguccguccacaucagccccuuggcauucuccaacugcggcugcgcugcuguccguccacaucagccccuuggcaguuuugaaauacccuaaugcuacucaagaaugagcaaggcaccauucauccuccgcccacccacgucuccaugaugcuugcgcuucuccucuguccagcccacacuaggaacccuggaggcacuuagucccugaacuuguggaugucauugaauaggcuguacagucggaacgaugccucguugggaugcgggcaguuguaguuacauuugcaggacuggaucaucaugacauucuuggaaaacaucucuccaucuucgcaucggaaccgcaucuucacaguucuggucugcagaggugugcagcaccggccaucuacgcaggagccgcaguauuugggccgguauuucuugacacuggagcauccugcauaaguaaaucugacugguucuggggauuucuuggucuugcugcauuucuugcccuucuggaagaaagaacaaaagaaagccaagaaugaggauuguuguuuuuuuguuuuuguuuguuuguuuguuuggagguaugcuuuuaaccacuguacauaguguugggcuucauaaagacaauuucuuuucagauauaucauggacuuuucuuuuuuucuuuuuugaacagaggcucauaucccacccaccuguggggucaucacggucaagcccugaaagaaacuuacuuuuaggcugcuguacacugguuguccacaaggacgcacuucacagauccgggucucuuucaccaggcggcacucuggguugucauugguaacucguguggagaugccaguuccgcagcucuuggagcacugggaccaagacguggucugaacgaugcauuucuggccaugggcgugcagaggguugaaaagaacucgcgguucggugccaaagacuagaaagauaaaggaaauggaaggcuucuuagaugcuugcauacacacacugguuucuacaaaguugcagaccaagaaagcauuucugcacagugucuuaaggacucuauauccacuuaccaggaagccucuucagugagcugccuuuuccaauugcgauuaacucauuguuucucguuaacuccaccuccgaggcaucgaguccgaggaggucauccuggucguccagggaguccuuaaugcugucuucaucacaaacccacucuucacagcacugcccgcugacuuucaccagccggggguugggacagcccagauuggggagagacaguucuuggggacacagaggaaugcagcccacggcgccaucaauacaugugcacugguguuuacaguugggcuggaagcuuuccccguuuugguagauucuggaguuauauucacagggucugccuucugacugagcugcaaagacgaccaaaagagagagaggagaagguuaagauucgccgccacaggcugaaacucauacauauuuuccgcuguucaauucaauguaugguaaaguucccuacaguucccccgagacuccagagcugaacaauaaguuagucaggaaucacuuuuccguaugcgcuuuucguugggcccagacacucugaauugcauuccagacugcugaaaucaugugccuuucugccaagcuaccaucaacaaagcguccaccauacauggucucaaaauuacuaaacuucuggacuauggggacuauuauuuuuuuuaaaggggccaaaccacaagccucuuaccucugcagaucccuuucagagcgguggagcuggcgccgaaauugcauuccaaccccuugguguggucgcagggcugaguuuugcugcaguccucguugaguuguuuagcgcagaccuuacagcagccgcagccgucccggaccaacccgacucccggggcgcacuugggugccuccagagggcaguggcaggcggcggggcagguggagagcgccugcaagagggagaagcgcgugagauugcuuugcauugcucggggaggcacguaaacugcccugagccuaggucuggcuguggggcuccguccaccagaagugucucgaucgcgucccggcagccugaccaccccagcggcugcgucccaggaagaggcccccugggcauaaagcaacagcuaccuccgaacuuuucagucuaacuuucccugcggugaaagaucauggcccggggaaaggaaucgaugagggcagaccgggaagcagugguuaaaaaaaaaaauccaacucaccagucuggucaaguggagaagggugacggcgacagcgagcguccugaaggugcuggagcucauuguggcgcgcaggaggaaccggggcgagcgcggcgacacagaaccaacaagccggcgagcagcgggaucaaaugcgcccggagugcggugaggcgagggccgaggcggcggguguccuucucucgaggugcuggcggaggaggcgcagagauugcaggcgcuucucuggggcgcucucgcucacggucugccc

SEQ ID NO: 1746 - RNA, 3016 nt, Mus musculus
gggcagaccgugagcgagagcgccccagagaagcgccugcaaucucugcgccuccuccgccagcaccucgagagaaggacacccgccgccucggcccucgccucaccgcacuccgggcgcauuugaucccgcugcucgccggcuuguugguucugugucgccgcgcucgccccgguuccuccugcgcgccacaaugagcuccagcaccuucaggacgcucgcugucgccgucacccuucuccacuugaccagacuggugaguuggauuuuuuuuuuuaaccacugcuucccggucugcccucaucgauuccuuuccccgggccaugaucuuucaccgcagggaaaguuagacugaaaaguucggagguagcuguugcuuuaugcccagggggccucuuccugggacgcagccgcugggguggucaggcugccgggacgcgaucgagacacuucugguggacggagccccacagccagaccuaggcucagggcaguuuacgugccuccccgagcaaugcaaagcaaucucacgcgcuucucccucuugcaggcgcucuccaccugccccgccgccugccacugcccucuggaggcacccaagugcgccccgggagucggguugguccgggacggcugcggcugcuguaaggucugcgcuaaacaacucaacgaggacugcagcaaaacucagcccugcgaccacaccaagggguuggaaugcaauuucggcgccagcuccaccgcucugaaagggaucugcagagguaagaggcuugugguuuggccccuuuaaaaaaaauaauaguccccauaguccagaaguuuaguaauuuugagaccauguaugguggacgcuuuguugaugguagcuuggcagaaaggcacaugauuucagcagucuggaaugcaauucagagugucugggcccaacgaaaagcgcauacggaaaagugauuccugacuaacuuauuguucagcucuggagucucgggggaacuguagggaacuuuaccauacauugaauugaacagcggaaaauauguaugaguuucagccuguggcggcgaaucuuaaccuucuccucucucucuuuuggucgucuuugcagcucagucagaaggcagacccugugaauauaacuccagaaucuaccaaaacggggaaagcuuccagcccaacuguaaacaccagugcacauguauugauggcgccgugggcugcauuccucuguguccccaagaacugucucuccccaaucugggcugucccaacccccggcuggugaaagucagcgggcagugcugugaagaguggguuugugaugaagacagcauuaaggacucccuggacgaccaggaugaccuccucggacucgaugccucggagguggaguuaacgagaaacaaugaguuaaucgcaauuggaaaaggcagcucacugaagaggcuuccugguaaguggauauagaguccuuaagacacugugcagaaaugcuuucuuggucugcaacuuuguagaaaccaguguguguaugcaagcaucuaagaagccuuccauuuccuuuaucuuucuagucuuuggcaccgaaccgcgaguucuuuucaacccucugcacgcccauggccagaaaugcaucguucagaccacgucuuggucccagugcuccaagagcugcggaacuggcaucuccacacgaguuaccaaugacaacccagagugccgccuggugaaagagacccggaucugugaagugcguccuuguggacaaccaguguacagcagccuaaaaguaaguuucuuucagggcuugaccgugaugaccccacaggugggugggauaugagccucuguucaaaaaagaaaaaaagaaaaguccaugauauaucugaaaagaaauugucuuuaugaagcccaacacuauguacagugguuaaaagcauaccuccaaacaaacaaacaaacaaaaacaaaaaaacaacaauccucauucuuggcuuucuuuuguucuuucuuccagaagggcaagaaaugcagcaagaccaagaaauccccagaaccagucagauuuacuuaugcaggaugcuccagugucaagaaauaccggcccaaauacugcggcuccugcguagauggccggugcugcacaccucugcagaccagaacugugaagaugcgguuccgaugcgaagauggagagauguuuuccaagaaugucaugaugauccaguccugcaaauguaacuacaacugcccgcaucccaacgaggcaucguuccgacuguacagccuauucaaugacauccacaaguucagggacuaagugccuccaggguuccuagugugggcuggacagaggagaagcgcaagcaucauggagacgugggugggcggaggaugaauggugccuugcucauucuugaguagcauuaggguauuucaaaacugccaaggggcugauguggacggacagcagcgcagccgcaguuggagaaugccaaggggcugauguggacggacagcagcgcagccgcaguuggagaagacuucgcuucauaguacuggagcgggcauuauugcuccauauuggagcauguuuacggaugacguucuguuuucuguuuguaaauuauuugcuaaguguauuuuuuugcuccagaccccccccccccuuucuugguucuacaauuguaauagagacaaaauaagauuaguugggccaagugaaagcccugcuuguccuuugacagaaguaaaugaaagcgccucucauuccuucccgagcggaggggggacacucugugaguguccuuggggcagcuaccugcacucuaaaacugcaaacagaaaccagguguuuuaagauugaauguuuuuuuauuuaucaaaguguagcuuuuggggagggaggggaaauguaauacuggaauaauuuguaaaugauuuuaauuuuauaucagugaagagaauuuauuuauaaaauuaaucauuuaauaaagaaauauuuaccuaauaucug

SEQ ID NO: 1747 - RNA, 6821 nt, Mus musculus
cggcuuccggcuuccggccgagagagggugggaacccgcggccgucauggcagccgaagagaaggacccguugagcuacuucgcggcuuacgggagcagcagcuccgacucgucggaugagaacagcgagccggaagacgcgggucgcaaggaggcggccucggcuccgacgacgggcggccgcgggaagcaggcggagaagcggcugcccggcccggacgagcuguuccgcagcgugacccgcccggccuuccucuacaacccgcucaacaagcagaucgacugggagcggcauguggugaaagcgccggaggaggugagauccccggccccgcggccgccccggggcccgacgcccgcuugccccuccgcccgcucgcccacccccggcucgcacucagcccgcgccgcgccgcgcguccccacggccccgggagcccggggggugucagcccgggcccgccccuccgcgcucgggggucccagccgggcgacgacuaacgguggugacuccccgccccccgcugcagcuucuccccgagaccccuucccuuugacgccgaagugccugcgcugcugccuccaagacagcgucucugcugcagccuccugaaggggucagccuggccguaguaucugggacugcauccuccuuugguaacuaaaaguuauuagcuuuauuuauccagggaacccuuugacuuuuucaccuaacaguguugugauguugauggaaaaaaaaaagugucuuuuaagccuaaaggauuuuaaaaaagaaagaaagaggaaagucagccagaaugaugagcagggaggugcaugcgcucguauccaucgcgggaaccucgguucgucacaggguuucuuaaugugcuuacucgacagccuccaaaggaguucaagaucuggaaguccaacugcgugccgcccccagagaccuacacuacugagaagaagccgccgccgccagagcuggacauggcgaucaaauggucgaauaucuaugaagacaauggagacgaugccccacagaacgccaagaaagccaggcuucugccugaaggggaggagacaguggaaucagguaagagagaggaguguuguuguuuaagauuucagcacucagaaagaagaaaauccuuccggacaagguuuacagccuagugaguuggaaggcuugcccagaaauugucuuuggaugcuaacggucuuucgaucguucggguuuuuuguuuuguuuuggggggagacaaggucuauguaaccugaauguucucggaacucauuauguagaccagucucuugagugaggccagcccagccugucugugccucaguaucucagugcuaggacugaaggugugugccagcaacccacguuuccgcuccguuuguaaggauucugccugaaaguagucucagaggucucuggguaugaugccuuauuagagcggcgggugugaacucgcucgcggguccuuguccugcauuugugacccacugaaggcuucgcuucuguugagacagcagugcuucagcuaaucaggguugcagcgugaagcagcuguguaggagcaggccuggagugguuugauuuccuugccuuguugguaaucucguuucugucgugccuagacugcugcaguaaucucuuccugcaaaucucugucuccaacuguagcuaguagugagcuucuacaguugauaucugauuguguaacuggcuugcccccgaaccucuacaaacugaagagagcuggagaguugugugacccguucggucccccucaccaccgucauuuuggggcuccaucccagcauuuuuaucuugaaacucagaccuggguggaccacacugggauggguucuugcuuugguggguauugccaauagucuggaccgaaugcuuuaaacucuuggcugguaaagccauucaucuuacagaaaccaaaguggaaauuuuucuaguauuuccucuccuuuaccugggaugugcuagugcugcuaacuuaguuguguguggcugcuuuucacaaggccuucugcaauacaguuugucaggcagcaagcucugaucugguccuguguguggccuagguuacucuaguacauugugagcacucagaggcuggcuguuagacugagcucagcguuuuagacugucguucugaaagccguuugcuuuuuuguuaaacaaauuucugaucuuccaauacaagggccaaccauagagagagauguuuaagagaagggcugcuacuggcaggagucuacacgcacucuuuugaucuguuuggcaaggcagcaucugacauagcugaagaugaccuugaaccccuguuccccugccuuuaccucccuggcacugggauuauagguauauacuauguccagguuugggcugguuuuuuuuuuuaagaucuuuaauaaagugugaauuuuaauacauuauuauaugguacuuugauuaaaagauauuuuugaauaaaguaauccuuauagaguccuacaaaacuagaacagguaaauauaaaaaugaaagcuuaagacuuacccaaggucacaguaaauacuuuuaauauucuuagcaaacugacacaauaguuacucauaguugcuuaucagucuugcagauuagaauacagucugacaugaaggaauuugccuacgugcacaccauuaggaacugacaaauuaagacuuaaguucaaccuugaaauaggauuugugucuuguuaagcugagguugcuuccucccuguuucacugguuaagaacuaaccauucuucuccgggaccagaguugacauccggguugucgcagucuagugcucuuacaucucugucccuugaggauaaagaccaaggaagcaagaauccucuguuuuuaauuuuuggguucaauuaucagaaauucaaauaaauggcaaaagcacccauauuaccauagcgaguucuauccuuuugguugaaaagugaauguuagcaguggaaaaggacaaaaagaacucguuuuuuucugguuuaaagccacauggcaugacucaaaagucaccugagugaggcugaggauguagcacagucuuacagggcuguccucacacgccugaggaccuggguuugaucccaggaucuaccuacaaaugcugauguagugaugccugcuuaucauccugaucccagggaggcagaggcaggagaaccuuuggggccugaaggccagccugucuaacaauugguaaaugccagacagaagagaaaccuugucucaggaaguaagugggguuucagggguggcacgcacauuaaaaauagauaaauauuaaauuguuaauuuggacuuguguguugguuacugaauauaacucuuguaauaaauagccccccuccuuuuuugaaauugggucugacacuauguagccagauggccgugaacuuccgauccucuugccccugccucucaaacugagaucacacgucuguaccacccucuauucugugcuccuagauguugaaccuaggguuuucugugugcuaggcgaacacucgaccuacucagccacauccucagccagugcacacucccgugccauaggaaguugcugaaaauauuaauuugccugacauuuccucuuuguacacaugugaacguggagaccagaggaccacccugggugucagccuuaucuucuaccuuguuugacuuuuucucugccauucauguauguaugccaugucaggcuggcuuuagagcugggaauucugucucugccucccaccuugccaugugagcuuugagaugacagacaugaguuaacugaucaggcuuuuugcaaaggcugugagaauucaaauucugaucuagagccaucucuccaaccccugacauuuuuuaaccuauaguuuguaaguaauuauuaagcuaccuggcuuuuauuuuaccuucccauagucuucuuccucuggucauuuuugcuacuuauguucagaauauagaggagguuaaaucaagccuugucccucgcugccuaacagugcuucuucuuuagcaacugugaaguguugauaaguaaaacucggguggccauagcuuuauuaaccaauagcugucuguccugcccugguguuuaaggcaguuccuaacugugccacuagagggugugagcccucgugcuucagucaugggaacucacuuucucaauuguaguaugugguuucaguuuuaucuguagacuuaccuguagugucagaauaaaagcagaaaugccccuuacuaauguguguuaauguguuucauggaagucuucaaaaaugcuuucaacuuuucauacuacuguuucugaaaauaauuucaagguuaacuugauaauuaagcucuagcuaauuguuuuaauggguauaguggcuuuacaccaauaucccuaaacuuaggaaguggaagcaggggugucagacauucauauccagccuaaguuacagauuuucuucacagaauuugugcuuuaaccuuagcaguuagguuaaccuuagcaauuuuaaauaugaaggcaucuuaaaaucaaaaucguuuauaugucaccauauuauaccuguugggcuuuggguaucauguucaucaaaaaguaaacuuaagccaacauggaggcucaugucugucaacuuaguaccuagaaggcucgaggcagggagauuauaaaaucaggcaagucugcgugacauaggaaggaaggggaugggggauaaagucaaagacagcuaaggguguuuaguauagagcgguugucugaaaggcauaggcuaggguggauuuagucccugcucuguggaaguagggaagucagaaguuauguuuauguauauagaguucuucugaggugggaugcaguugcuauaaagcccaggcuggccccaagcugauagcaguucuccugucucauccuccuggauuugagacauaccaccacccagcuuuggcugggauucuuuacagcacacauucauuaagggagaugggaauuagcagcuaauccgcugcagcugccuguguuuacugaaccacuuaaauaaagugcuuggguuuuuguuuuuaauaggaugaaaaggucugcuuugucagaauugacauuuuuauuaauggaaauuuucuguguccgcagacaaugacuguguggggcagugggugcuguuuacuguauaguucaguagucuuccuucauccaacuuucccuuaacuugaagguggagccugcuuauucuguugccauuaggauguucugaccuccuaggaggacugguccagaauuagagcagacaccugcgagguugucugaaccuccacuugugugguggguuaauaaucauaagacuggaggugaaaucugagaggacaagucacgcuggugguuacucggcacggcuagaagaugcaugcuuuguagaaggagcagugcucuaugcugugaaguauggacuguaucuaaauggauguacuguuugugcuggagaguuugcggagugaguguuucagaaaaagcugauuuucaccaaaauaucuuaugcgacgacauuauuaacuugccucuaaaaggucaguuugcaaauauuauauugcuacaauuaaaccauuuuauauguaauuuaauauccguguucuaaaaauuaguauuuaguuuuuauuaguaugccuuuaaacguccagugaguaacuguuucggcauaaagcugaauguguguuuuguguugauuuuuagagaacuaagaaagcucucuucuuucccucuucaagaugaugacaaagaugagcgggcaucuaagauucgcagaguggagccaggagaagcagccaagaagaagaaguagagaauugugacuccugagaugugucguugaguggaguguuugcuuuugugcguuacuaugacagacaucuccaugaacguauuuauguuaacgaacuaaugagugucgccucaagacuuuccacuguagaauucacuuuuuuuauuuaaaaccuguacguauuuacaacucuaauggugaccugugauugugaacugacaguacuuggaagcauucugguuaucacaaaauuggugacaggcuuugagaguuugucacauggacaugccaauguucuaugaaccuuuuauaaaggaauauauuuuuaaaguaaauauauuguauuguacugugaacuugugggugcuuuucauuaguaucuguacaguguaaauagaugaucauggaaauaaaauuacuuaauccaaccuuguuauuacugaaugccacuaacauaaguauuugugacaggcagccugcuugcccugugacguuuugauucacaguggggauuagcauguagggagagccucccaugcucgggugccuugugcauacuucucuccuacaguccugggaggaaagcagacgugagcguccucagguuuguggugagagcuugaggaacugggcagagggguacacagcagugagugaagaggagcggucacgcaggacugacuccagucagaugaagccaccugucacucgucagacuucagucguuugccaagaacauuaucaucucugccaugugcacuuguauuagggaggucuccuacucugauucugcagcugcacugauaaaugccuuauagugugaguauaaguauucauuucuucauuagguagacugaagaugaggcuccucugugaaagaugagcaaauucagaaaagaacauaagguaaccaguuaaauuugagucugucugaguauaugugauauaagagacacauuaaaaaccaucugaaauucuaauuua

SEQ ID NO: 1748 - RNA, 1320 nt, Mus musculus
uccuagaaggugaauugcuccagaaaaacaaacaaaccccaaagcagccagaagcauucuguugcugcucugaaugggacuggcgucuccucacccccucuccucccagccacugccugggaaggaauccuucaacaccugguggacaaaccugagccuucccuguacagagcuccgagcuugcuucacagcagggcagaugcccccucauccacuagggauucaaagggguugguuuuagaccagcaagauagcccggggaguaaagacaucugccaugcaagucuaacauucuggguuugacccuguggccagcuccaguaggcugucuccugaccuguacacagacuccacggcauacgcagguacauaguauuuguucucacuuaaggcuauacuuucuuucuuugaaaauaaaaggagcauucaggaugcaagcuuugguggucaggcagcauccuccauggucuggaagccgacggaugagaaggcgccacacuucaggcagaguagcaucccugauggagauaaggauggguguuccucccuuagacaaggagccuuugugggaacauuuggugggacccagaugcaaaccccaggcaucugcucggagaagaagcaacagggugcccugugauaaagccagcagggaucuugcuguacagucggggagggcuaaugggcugugugcggcuaccagccagggaguguguagcacgcuccuuacaauacagaacauccaucuguggagggaguuugacagccaggcucugugcccgcccgugugccugugccacuucagagaccuugagcccgccauuguucauuugugagcucccugugugugauucugggagggcaggucucagugcuccgcugugcuccccuccccuccucccucccacugcaccagcacccuccucccuuccugcuuccaccgcucagcuguggcaagcauuuggucauaucuuucucagaaagcaucgucuaagcaaccgacuuggucaccuggauaaaagucacgugagagagucggguaggagccggcuaaacauggaggaaggaggcccggauuccgcuuccugcugccaucuuaagcugcucugaguuuuuaccguuagcagcaguuuauuuuguuggacuuuuuuuuuucucauggggcaguauuaacaacugcauggcucuugcucugugugcucccugaccccugccuauggaagacauggcuaaucagucacugugcuguagaaccuuagacuuggccuuaccgccuuaguauagagcucuggaagauggaugcucagugauuugaaagca

SEQ ID NO: 1749 - RNA, 1320 nt, Mus musculus
ugcuuucaaaucacugagcauccaucuuccagagcucuauacuaaggcgguaaggccaagucuaagguucuacagcacagugacugauuagccaugucuuccauaggcaggggucagggagcacacagagcaagagccaugcaguuguuaauacugccccaugagaaaaaaaaaaguccaacaaaauaaacugcugcuaacgguaaaaacucagagcagcuuaagauggcagcaggaagcggaauccgggccuccuuccuccauguuuagccggcuccuacccgacucucucacgugacuuuuauccaggugaccaagucgguugcuuagacgaugcuuucugagaaagauaugaccaaaugcuugccacagcugagcgguggaagcaggaagggaggagggugcuggugcagugggagggaggaggggaggggagcacagcggagcacugagaccugcccucccagaaucacacacagggagcucacaaaugaacaauggcgggcucaaggucucugaaguggcacaggcacacgggcgggcacagagccuggcugucaaacucccuccacagauggauguucuguauuguaaggagcgugcuacacacucccuggcugguagccgcacacagcccauuagcccuccccgacuguacagcaagaucccugcuggcuuuaucacagggcacccuguugcuucuucuccgagcagaugccugggguuugcaucugggucccaccaaauguucccacaaaggcuccuugucuaagggaggaacacccauccuuaucuccaucagggaugcuacucugccugaaguguggcgccuucucauccgucggcuuccagaccauggaggaugcugccugaccaccaaagcuugcauccugaaugcuccuuuuauuuucaaagaaagaaaguauagccuuaagugagaacaaauacuauguaccugcguaugccguggagucuguguacaggucaggagacagccuacuggagcuggccacagggucaaacccagaauguuagacuugcauggcagaugucuuuacuccccgggcuaucuugcuggucuaaaaccaaccccuuugaaucccuaguggaugagggggcaucugcccugcugugaagcaagcucggagcucuguacagggaaggcucagguuuguccaccagguguugaaggauuccuucccaggcaguggcugggaggagagggggugaggagacgccagucccauucagagcagcaacagaaugcuucuggcugcuuugggguuuguuuguuuuucuggagcaauucaccuucuagga

SEQ ID NO: 1750 - RNA, 6251 nt, Mus musculus
agggggcgucggcgcgcaugcgcggcgcgcacagccccggaaacuucgacgaaguucggagccccgcccccgccgucccgcgaccugccgcccccugcccggacugacgagucggcccggcugucccgagcgccaugucggguucuucuagcgucgccgccaugaagaaggugguccagcagcuccggcuggaggccgggcucaaccgcgugaaggugagcgggcgugggcgggcggugggccccgggguuggggggaagcgcgagccgacacgcggcuccucuggccgggcugugggccgagggcgaggagggggcccgcccuuccgccgcccgccgacucucggcggccccggcgggucucgccagcgacuuccgucucgcacgucucacccaggcucacucccagcccucguccuuugaacacacacgaguccgccuggguagcuccggauggcggccugaugagcaacuuuuguuugcggaucgucccgggagucuccggacuccaccuuuguggggguccagccucgaacaaagagguguuugcagcagacgccgcggcgugcucggcugaccuugcuggggugucuguuuacccgagaaaccgcuggccgcuggccugggagcuugcggucugguuggggggucgggucuugggcuguugacuuuuagggaaaggcuguccuuguugguagacagcuaggcauucagacgcuuuggcucuaaggaccguuugguuuauuuuuuucaacuccuaaacggauuuggccucuuucugacguaauaggucggguuacaugugaaacacuucccggugauuauaaaaagaaacaagaauauaagucgccuugcuagacccugccaguuuccaaggugauuugauuuuauauucagcaggcuaguccuuauuucuaacgugcuuuuggagaaggcuucuauuuagcuuucuucucaaguagaaaugucagagacugcucaacuuccuugugguaaccauaggaggaggguagggagacgcccaaucagucuugguuuggacucuaaucauauucucacuuuucauccaagugacuuagucuuggccagauuagagcucugaaauuugaagugaucuauugaucaucaucauucauauauaauaacugucauaaaguaggccaggaaggaaaaaaauaguggguugggggaggaaauaaagacagguacguguaguaauuacaguggcgguacuuaacccugguggcccaaagcagugagcuagcucccagaggaggacuuccuuuucuuugaaaacccuaccugcucuguggcuaccuccuagcuucucuugccuugcguccuaauucuucugaaggcuucucacugggaugacucgagccaccacagacaaacagguuuuugaaguuuccauggcaaggcucaucucacuugggaauguuacaugucuaaucuagguuccuaaauuagguuaggugccauuugauaucauccauguaccacaccuaugcuaggugcuuuuugugugugacauuuuaaagcuagcauaaacuuacuauuguauucguuuaggugguaauuacaagugcuuuuuuuuaccaaacucucagguaggucaggacauuuggaagccugacuaauaguuuugcagugucaaccuccuggaugguagauaguggcugcucuguggcuuggguacuagcagccauuccaucuuaagucucaagguugcuguuuagaaugcuggguuuuguuuucuugagacaggguuucuccauauaacccuggcucuccuggaacucucuguagagcagacuggccucaagcugaggucugccugccucugccugcugggauuaaaggagugcaccccagcggccuggagcacuguuagucaaacagccuuagguuucucaccguuccuucccuaggauucugugccuagagauacaguccauacaucgugguacuuggagaaaugugugggaaaggaauuaacaggcacuucaugcuaacugcugaucuugaacaaaaccaaaugcuguaacacugaaaacucauacuuuaccuuccauacaguagccacuuuuaagaggcaaagcaggguguggguuauuuguacaagcguuuaagaacugcaggaaccucuaauauucaguccaugagucacaugagacguauuauacugaauuguuguauaagccaaacacagguagauugaagcugaguuuaacuuauccagggugacugaucccuaggucacaauauagcuaucaucuagggccuggguuuuaggcauuuguuguaaucuuagagauaacugagauuaagaguaaacacaggaauuaaauggcuugagugcauuuuuaguuuuucagugucugcuuacccauccacuuuguugugucgguauuuguguucaaucagcuaguuugagauaggguuuugccaaguagcuggaccagcuuugaacucaacuguuuaaguuacagagccaggcacuucugcucugguuaauuuaaaagguguguguaugugagcaugcaugccaugguacacacggggaguuaagagagcugcaaccuuguagaguuugaucacuccuuccacucaaauguggguucuggagaucaaacucaggcccagucuaacaaccuuucugagcagccuaucuucaagaaacacuguauuugccacaaaugugauuuggcaguguugauacguguauauaguacaacccaaauaggacuucaguauuguuuauuauauccuguauuuccuaaccagaauauauauaaaaugguagguguaugucacucuuaauugcaagguaguauauggauggguauaaauuuaaagaacauugaauucuuaguucugugcugguuaccuuagguucaugggcauuuuuccaguuugcuuucaagaccauuucccuauaauguuaagaucuuuuuguugaacuauuaauacuacauauuaauaacaagauaaugggggaugugacucaguuguuaagaguuuuugccuaugaaaguccugauuuggaucccagcacucagauuaccaucuaagaggcaggaggcuuagauguucaguguuuaaggcaguugcugcauagcaaguuugaggccagccugggcuacacaagacuaaacaaauucuauuuuccccaaaccaagcugucagggcuuguugaacagcccaucauauaaaaacaagacaugcugugcuuuguagguaaaugggauuauacuauugagucgcuugaugcuugugaugaguaggaaaaaaacauugcaauucaguuucauuuacuuaguguccugaguaugagccaguauagaacgguuagcaguacgcuauuuugaagugauguuuauuucagguguuuccagacuuauaaaaaucaucagaaccuuaaccaauagauguuucuccuuucacugucauagguuucccaggcagcugcagacuugaaacaguucugucugcagaaugcucaacaugacccucugcugacuggagugucuucaaguacgaaucccuucagaccccagaaagucugcuccuuuuuguagucaucuaucuugagguaaguucacaccgcccccuuugauucaaaggaagacacuuaggucuucuuaucuguagcacugacagugucugucccugugguccugacuggcauuccaaauuccuuguuuuugaaggcuacugaaaacuagguuagaagucacaaagacuaauguuuuuauuuauaucagagugcuaaauagauguaauaacuguaacuagaagcacgggagacucaagaguccacugccaccagcagccauguguuuguggagugcuggcacaagcagcaugacuguuuggagauccuaaaaugcuuuuuuuacuucucaaauugaaauguuaacagauuuacaguguuuauagcaauggcucuacagguauccugguggauuuguggauaaacuguugucacugguguaagagacccaaggugugaguagcacagcagagagcuagggaaagcaauguugggguaccugaguaggcacacacagcgcaggaaccccaccuccguuuuucauugagagagauuuccauuuguguuggcagggaacuggagcugaggaucugcacucucuaauagggcuaucagaguguauauucauguccuagacuaaaugucaugugugaaagaccuguucuccacagauguuuuggcuaauuuaagauguaauuauaggauacuaucauuuguaaucuuuggaacauuaguaguauugaauuaggaagcaaacuuaagaguguuuuuaaaaauacaguguguguggugcacacccuuauacuaacauucugacuugugaaguccaggaagcugcuuccuaaaauaccuuguuacauaggcuuuguagaucuauccgggagugcacaggaaguuacacagcucuugcuaaacagacuugacuucauuugcuauuuauuaaucgaaguuaauugcuuuccccccagagguuuuguugaaaccucuucaguguuaguuaugaaguaauuaaaaauuucaaauaaguauaaaggugaacugguuaucuaccauuucaaggucacuucacccuuuguacaccuucuuuuauaaaacaggucacacucauuuccauaacuugucguggaguaguuaugccuuuguuuuuuucuuucuccuguauacacacuuaacuguauuuuauaguuucaagauagucauuucuaaauguauaacuauugcuucaauuuugagauguuuuguccuguauaguuuagacauuuaagcuguuagacaguauucuguuguauguguagaccuuccuuuauccauuccucuaaugggcugcagucaggugguuucauuuuuaugcugcugacaguauacucaguauccuugguguguuuucuguggguaggugaauagaagagacucuaucuuagaaaucacuuuuucaaaggaucguuagauuuucuguuaaguauuuuuauuuuaccuuuuuauuaugauaaaaaguauauuucaguaguaauauuagugagguaaucuaugagacuccauaagauaggauuuuucugccaguugugaaaauuaaaggaaaguuggauuuuagugccuuuuauacuguagauuguauucuuucuuacucuaguacuuggugaugguaaacagauaaacaggcuuaggcuuaacccuuuauaagccaacauucaugugagccaccuagagagggguugauucauggugggguggauaccaacaaacucaucaugacugaaaguauagcauaccccuaaacugaucacaccuuguguguuguagcacaccaacucagauucaaaguauaauaauguauuauuaaccaacaaaaugggcagaauguaagccauuuucaaaaauuaaaaaggaaauuguccuugcucagguauuagugauaaaaaguguuuuaaaaaguuaccugugugauacuuuaucuucuuuuuuccucccacuagguuucucaaaccacuuuucaugaaccagugaauauucaagagaacuaaauuugaagucuguacaaaagcuucucuuuaacacgugccauaauacacuaucuucugcucgucaguccuuaacaucuaccucucugaauuucauggauuucugucucacaagguuuaacuauuuuauauacacuggcuguagcauacaauaaagcaucauacaaaccuuuggccuccuuacugaugugaaauaugcuggguacuaaucuuuucaacaccaagacucagggccuuauauuggccaggcuucuaggaacuuacagaacaacugcgaaucuuuguucauagacuaggagacuugaagucucuguccuuguguuauuuaugggaauuguuuuaaauaguccacauacagguggagagauggcuuggugguaagaguacuugcuaggcaauagugaugugaguucagaacccugccaccuggguaagaaagcugggcaugacugcaugccuagaagcccagugccugggggagaugguuugcuggcugccaguguggguuaaaaugauaagcuccaugaaaaucccuucuuaauaaauugacauugcccuuugggcucacacaggcaacaacaagauuccaaacaagcagcuuuguaauggcauucacgguuauaccaagaggguagcugcuuccaucuggaaauaagagagaguuccauuaaaagaauc

SEQ ID NO: 1751 - RNA, 15476 nt, Mus musculus
agagcacuuccguuuccguacagccguaaacaacauggcgaaggccggcgagaaaaguguugguggcggcaagcgaggcuugaagaggaaagcugccgcugaagagccucaagaggcugcggccgcgagcgaugggacggcggagagcggggugcagcccgcgaaagcggccgccuuccccccgggcuucaguaucucggagauuaagaacaagcagcggcgacacuugauguucacgcgguggaaacagcagcagcggaagguacgcgcgcgggguuggcggggcacgagcgcaggggcggggccgggagcgcgcggggcuggggggggggcgacgugcgcgcgcgggguugaaggggcggggccgggggcgcgcgggguugaaggggcggggccggaggcgcgcccccagccccucgcuuggcuacgggguccccagcgucagccuuuugccggaugagcuuggcguaggggaauccggcccuugccugcuccguggguugcacucucugggaagccgagggauuuggaaccgacgauccagccucuggccggagauggcagaggguccgcccccugccuuugcgcaucccgccugccuagcguuggugguaaacuccagguccuaaacguggccccagacucuuucaaggaaccauuggugaaguuucagcacugugaagugucugucauagcuguguuugcucucuuccgccuugugcucgcacugaaaacuagacagacuuguaaguaagccuugcccaggaucaugaggcucauuugugucuaaauuacaauuuuaaaaauucccuauuacagcauacacagcaacuaacacaugauuuuauauuuguguucucuuacuggaggaccuuggcuggaucuuuucguaagugcuaggucgcuacuggaguucuuuuuauuuauuuauuuauuuuuuaaagauuuauuuauaugagugcacuguagcugucuucagacacaccagaagagggcaucagaucccauuacagauguuugugagccaccaugugguugcugggaaugaacugaggacuuguggaagaacagucaguuguggagguuuuuugguuuuuguuuuuuuguuuuuuucaagacaggguuucucuguguagcccuggcuguccuggaacucacuuuguagaccagaccucgaacucagaaaucugccugccuuugccucccaagugcugggauuaaaggcgugcgucaccaccgccgggcuugauuugcaauuuugagggaggaauguccuaaaagccuuuuuuuuuuggacugaagaucaguaggcacuacagaaugugucagacauuuugucuagauucaggagauuauaguguauacuaaguaacaacugaacauguuugcaacuuccuauugaccuuaauagguaguuuugguuauaaccuauaagaauaacuaguggugaccuuauuggaaauguccugagaacucaucucccauuucugucuauuuucagugcuuuucaagagaaguaaccauuauacccauaaucuuuagaacgcauccacuaggggaaaauguacuuguucauucauacguuuaauuaauuggaaguauuauaguaaaaaauuaaaguuacugaaaguuuaaauguucagacuuaauguugauuugauggaagcaaaacaaagagcaagcucuuugucaaaugaaucuucuugauuagccugcccauuuguaguucaauauuuuagcuauuaaagaaaaaucgauaagucuaguugugagugggaguaugcaccuguaaucuaaaacacuaaggagucugaggcaggaggauggucagucagaagcaagccugggcuaucuaagcagaccuuuaaaaaguuucaugugcuuauuuuaaaagguuauaguaauuucucagagcugacuuguaguuucaguaugaguuuaugaaauaacuacugguuucucaauauuguuugcuuuuaucucaaaggaaaaguuggcagcuaagaaaaaacuuaaaaaggagagagaggcucuuggcgauaagguaaguaagguuuauagccuuguauuuugucuuaugaaguauuuccugauacuguguugguuucuucuaagacauuucagauguauaaaaauaauguacuaaaucccuuuguacucuguacccaacuuagcaaauaguggugacaacucguccccuauucucaguagcucgcucagauggaguugcuggacuucccugagcugugccuuccuaggugcuuugugugcaggugguaagcgcggugugcucaggaggcagggaaagcucucccugcuguuggaacugggaacucccacuuuaggcuugggguuuaacucuugugacuugaagcuaaaagaacuacuaaauauuccugcauuguuacaagacgaaaguuuucguuuuuuaaaauuuuuacaaauaugcuuaauucauaauuuagcguguaagauuuuuaaagccuaugguucuccuccccuuuaccaccuauaaauaccaagugagaauaggauuucugagaaagauaaacauauucaggcuguguacagacuaagcauacuacuuuucaugcacuguccaaauaggaucaguuuaaaacaucuaaagucaucaauauuagauuauuuugaccuucagcauucuaauacaucauauaaucuuaucaucggauugcagcaaauucaugugcaggccggccuuuaacacaucgcuggcccuggguugggguguauguaggcuuucagcugguauauaccacacccugccuaacugaacacaaaaagucagauuuuggacugaaagaugacuuccuggaauuaucuuuaaagauuacauaagagucagcaagagaacucgguaagguaaaggcacuugcugccaagcuuggccagcugaguguaauucuagagcccacuggguggaaggagagaaccaacuuccacaacugcacaccuuacacacauccacaucgcccauccugaguagcaccucaguucaccguuccuucaggucacuguguggcaucuguguguucuccuaguucugcuguacuccuugcaaguauguugauaccauaaacucggcggcaugauaauucugcauuaucuggucaugugguaugcaggguguuaucuugauguuuguuuccauuacaaauggccaccacauagacaauuuauuucuuuccauaaauuaaccccaaacagaauuacugggucgcuggauagacuugccacguuucugaggagaucgcgggaaguacagaaacagucaccuggauuugcaacuaacuaaacuuuuuuuauuuccauucugcugacucccuuuacuguuagauauuauuuuagacagggauaauuuuugugauuccugucuuaguuuuaagucacuucauucuguauuuaccacguaugucuucucagauuguuaagggguagugucauugcccccacucuauuccuaggauuuaguaacagugguuguggauggaaauaaggacagguuguucugagguuauuugaagaaugucuuguuuccccacaggaaugugaaguuguuaauauaaacugcuucuaacacucgguguuuccccucuuacuuaggcuccaccaaagccuguucccaagaccauugacaaccagcgcguuuacgacgagaccacaguagaccccaaugaugaagagguaaugucagaaaccaaaugugaaugaucacccuugguguguugcuguuugacgucgugguggucgcaagauguagauaucucuucuccccuuccucauugucucuuucccugucucugucguuaggauuugucuagaacaucugauaaugcacgcagugcaccagaugaugcagucuggggaccugcauacauuacuucacuuaggucuucuuaaauauuaaaaauaugguuuaguaaauuuuguaucuucuccauagugguuuuacguaagucuucuuggagcugcuccugcugcccugcuucaguuucccucuggcacaugcgucucugaagauggcuuuguuugcuaguuuguaaacauaacgcuuuguuugcuaguuuguaaacauaacguugauucgaggguagugguccucuaaccauagcuugccuaaccuggcuucuuguaguuuaucuaaauauuagcuucauuuuacauuuuagauaauuauuucuccaaagacagauuuauuucuugcuuuauuuuuucuuuuguucugacuggaacuucugcuguaauguugagugacuagaagaggcagugcagggguccuugaguguuccugauaagaauccugcugguaccaucuccuugauguggaugucgucagcaguuuuucuuaugcuuuacagaaaucacacuuaggcuuggauccaucaugaaugaccauagaacccuuuuucugaaaaugcugagaugcguauguguuuguuccacauauuaccuuaaugcaucuauggguucucuaaaauuaguugaaaauaaguaucuugcauucuugggauaaacuuauucugguuaugauauucauuauuuuuauacguuguuuuggguuguugauuugaacucaugacuaaaauuauaguaaugucuccuuaugauuccuaacauuuuuucuccuuuaaaaauaaaaccucgucguuuuaucgugcgaauagagaucauccuguagcaaggagagugggaggaggaggagcuaggccggccucuguuugaagaaagcccguguuuauucuaacauuugcuuuucgucagucuaaguuuguguucucucagaguaguuuuucuuuuaucuuuucuacugaauuuuguuucauuucuaucucccucuuguuuccuucuacuuucauugagcuuccucuauuuuucauuuaucuauuugcucauuuuuuauuuucuuuacuaugagccauaaaauucccuuugaguaucauucucagcaaaucccacaagcuugaaaaugagcugcuuucacuguuauauuuaaaucaguuauuuuuauaauggaauauuuguuaaucauuuauuugucuuuucaauuaaaaauuuuaauuggcauguucauaaguccauaauuuaauauguuuacauaccauuccugaugauuacacuguaguaauuaacauuuacaucucaaauauccuugugugugugagaaccuucagucuucucuacuuacuuuuaacauaggauaacuaacuaguuuaacauaggauaacuaacuagguuccagugaucuuacccugcucuguuauguaauagaaaauuagcuuuuccugucguuagcacucacccagccccuggcagaccccaucacccaccacaucuuauaucauuaguuuucuccaaugcccaguuccugugcuuaucucuggcuuuuucuggcucucaccaggucugaacuuucuaaggaaucauagacuucacuucugugcuaacgcgugugcaaagcucugguuucccaucugcugccuuacauggcccgugcauuugacagcuuguuggguuuuuuugguuguuuuguuuuuuguuuguuuguuuucuauuuuuuacuuuagucaagaauuuuggauguuuuuuguuuugagucuuguugcugcuguuugguguguguguguguguguguguguguguguguguguguguguguauguguguguguguguguguguguguguguaugggggugguguauggaggaggagcuggaacuggaacccagaccccugcaagugcuaggcagagucacuccagcccaaggguucucuaacuucccuuucuaauugaccucagcucauugauuuuuauguaugcuaacuugaaaauauuauagauuuauuuguguuaauuuuauugugccuguuugcuuacuuugaguuuaguccuuuucaguuaaagagagauuuuugggcugggcgugguggcauacaccuuuaaucccagcacuugggaggcagaggcaggcggauuucugaguucgaggccagccuggucuacagagugaguuccaggacagccagggcuacacagagaaacccugucucgaaaaccaaaaaaaaggagagauuuuuaaguccuggcauguagucugcucugaggaaugggcaguguugccuuugaaaaccugugcuuccuauuuuggaagggcuuguugugaucucauaggcugcucccaucuuacauauucuuucugcauguguguuucauuguucccgaagaaagaacaugcaugcuauaccucuccgcugucugccucuuccagugcguugaguuuuuaccuccuaguguuuauucuuuuguuagcugcaugcauucacaguuauauuguucugugugauuacuuguguguaaugauaauuacauuuucuugauguacucauccuugagcagcgccucuugugugugucuguguuauaugcagggaccacuucagcucucuagggacucucagcaguaggcuucuccaugcuuugcugugagguuauucacagacuugaauuuaauauguaucacuuauccagagcauacgguuagaucuugcuucuuuggucagccuaaaaauuaguauugagugucagucacagcuagacuuacacauccgucugccuuuuacccacucuguauuuuucucugcucuuccuuggcuauuuucuuucauguuaauuuuuuacuaugcuguuuuaauuccucuugauuuuuagacuaugguauucucauaguaguugccccuagaauuauaucaugcacugggcugggcgcugaauccucagccuggagggaaacaagcaaaaggccacgugucuuuaaucacuagagacucuguggcagagucgcagaauucuguuaagcgugcagaggcggugcugguggagguugguuuccucagucucuguaugugcugucggucguagaccacauguugucugagcauggccuaguguugaagcuucucaaaggcacuagaguguuuauccaucuuuugugugcguccaggcuuuccauugcagcaccugcuucccaggccucuaagucugcugcaccaucuaauguuguuuuccuucaguuugcaggauucccuuuuuguuucauagcagauuuaauagcugcgaaguaucucacgguuuacugaaaauauauauauuuugcucuuaacuguucagaauauaaggcuuuuucuuccuguacuuugaacauauucugcagcauauuaaucaucauuauuccuaucugucucaucgcaagguguucuaugauuuuaacagcuugacacuacugcguuuauuuuuguuguuuuaaaucccacgugggguuugcugagcuccuuagauuagugucaguguuuucaucaguuuugucuuuuuagccgugauuucuucacaucccuuucugcccuucuccccguccaucagcauccccauccacacugucagucgacagguuugacauugugcugcagguuccccgucuuugcauuucuaggaugcuuucuugguucuccacacugggccauguugcuaucuaguuggaauuguuuuucaguucaugugucagccacacugccaacuauuuccccugacuguguaucauacuccuuuucuaucaaguuuuggccgaacguuaagacauuuuagucaauaccguguuguaguucuagauuguaaauuauuuaauuaguuuauuuuggauuuguuuaauugacaggaucucccucuguaaugcaggcugcccuagacaguguagcccagccuggcuucaagcucaaggcaguccuccugccucagccucccuggggcugagcucgugugcucggcucuaguucacuguuuaaggacuguucgugucugcagcuuaccugcacuucagagugggaggucacucuguuuuggacaguguccccucagucuccuuuugucuuucaucugcauugcugcugacugucuguuuuuaucacaugcuuuuuaucagucauugacuaggcagguacuguugaacaccuggagucccucagacaugcauccuucucaucugagcugugcauguguugaggaaugccuucagaaauguaaauguacauucagaaauguaaauggcuacucccugccuacccuaagggaggucugcaacccuggucugacuaagcuguguucuuaacuucuucuuaccucuuauucuuguccucuuccacucuagacugcgaucccgucccuaaaagcuggggcuguuguugucccccaccgagaggaugaggcgggggagcagcauuggucgggauugguauuuuugcucaugucuguagccauuuugcaagaaugcacacaucuuagugugugcgcuaagauuaguuugacacuggccguucacacuugugcagaagggggaucagcuucugcguguaugucacuguuaaugucacccaacagucaggcaggcagugcuugaaaacccgugcucaugaacugugugacggaaaaugaccucuccucucuucucagguggcuuacgaugaagcgacggaugaauuugcuucuuacuucaacagacagacgucuccuaagauucuuaucacaacgucagauagaccucaugggguaagcacguugauucguguagucccugaauucuuauauuuaaacgcucccuucagaaaagugaaauaguuaacggcuuugaugaugacagugaaugagccaaacaaaaauaacugauggggauuaacagacuuacugagcauaauucuucaggacaguucugcaaccuuaacacuguuaccaucacugcuggccacaccuuguaauggagugcuguccugcccagugugaugauuagcaacaugcccagccucugucccuuaggaccagcagcggucucacaccccuacaccaguuccacccacaaaaugucuccagauauugccaugucucugugaacuggcaccacccuguggagaccugggcuucuuggaugauuggccuuagauucaggagacacugccccacguccacucuuccccagucuugcucacucucguaacagucuuagaaugucauuacuccuguccuuacauccuuuuucuucuaacuuuuggugauuuuucuuauuuucuuacagagaacaguucgacucugugagcagcucucaacaguuauaccagauucacauguuuauuacagacgaggacuggcucugaaaaaaauuaucccacagugcauugcaagagauuucacagaccugaucguuauuaaugaagaucguaaaacaccgaguauccuuuggauuucauuuuaaggaaacuuuccuguccuuuuccucgccuauuuuuaaacauauaaaagaauaggaaaaggcuucccaucacuuccagaauggauguuuucuguaacauuguaucucuaucccagaugcuauguuuuguuuguuuuuuaauuuaucaaaacauuuaucaggcaggugcuauggcuaaaacacugcuguaaucuuuaguaaagggugcagauauaauagucaagcagccauaguucagacaaauaguucugccaauuaacagaacauuguucgagggacauggacuuuauacagaagcuugagcauggucugcaugggaagggguaaugaaugaggcagaggaguagucauuuggaauggaggagcaugacagcgcuggcccaggugacaccaugacuuugguaucgcuucaucuuccgcucucaggaagcauaucgcuucauuguucugagguaggaaugaagccuugcuauguggcuccugguguuuugguugcuaggaacaaugaaacuuuuccuguaagucucacaucugagacagaugucaucugacuccaagguauuucuguugagaugaaagaauauaaaauacaucuagauucuuauaguugcuauuauuuuuugaacagggccuauuaucucaguaucuaggagaugaccaagugggugagucagaauagaaaagaauuuguaaaaauagcaauagaauguucuguucugcacaggacaacacauucuuuucauaucaauaaacauucaguguuuuaauacacucuauuuuuacaagcuuucauuguuuuuaauauaauguaagcauauuauuuuguuugccuguauuaguuuuccagaaacuaaaauagcaaaaccuuuuuaauguggcauuuguugacuagauuauaauuaaguuugacuagguuaguauauuuuauaugacuaauuacuccagaaaagaaugauuuuuaaagugauugcugccuguaucacagcuuccccaaauagaacgacaaggucaguuuugguuuuagcaauuagguugucgucauuuuaaaauugucaauuccacuguaagaagcaagcauucaucaauuuaauacaguuuucucuuugcuuuagugucuuauauaggugcacaagugauagcacacguagcuuucagaaagccugcacugccugacagacauccuuuucucugaaacauuccccauccuguuucaccacacacucgcacuguagggccagccuucagccucuucuccguuacugaaacagacauggugacuguuugccaugaauuuuguuaguuuaacaauacaacuuauguaucccccucaaaaaaaaaaaacaaaacaaaaacaacaaaaaaagccacccaaacaauuugagagccuauaaauucagaaccuguacuucacuuuugacauaagccacacuguaauaggaauguucuaaauagaauucaagccuuuacaaagguuagaggaaaucauuguagaucuacugguuuucuuaauuuucauggguuuguaauguccaugcaguaagagaaguacuuggcgaaguugacccuguagugaauuguuaaauagagacauucaguguuugcuauuggccuguuguuuaguagacacuaauaccuguuuaaacaaacaacaaaaacccaacuaaacugggguuaacagaaguuggggggaaaggcauuuucauggcucauaccugcuauguuagugacgagcacuagcuaggcaaguuaauucuaacugcaugaaaugggauuggaagcaguccuugauggaauggaagcaagcuaccccaaguguuuggaaaaacuggagcaagaguagcuauauuauguguagucuauaagauugaugauuguaugaggaccuucaagucagaagacauuugagaaagucggauauaagaaauguaguuuguaccuaccuuacucuguuaaacuaacgucuuuauucugaacugagucaacauugacagaaugguaggaaauaagcugcugcuauugaaacugauaguuuuuuacuugucguuaggaaguauaggguagauaaaaugacccgucuaaguccuauguggcuuauuacuuaacagaaccaaggaccaaauccugccuugauuagcaccuguauuagaaaaugugcucggaaguagagaggaccaagaguaaucuuauuuuaaugguggaaaaugucauuuaagaaagucaggagacaaguaguuguagaagugaaaauguuaaaugacagcaguaacacgggguggauuggugacaaauugaagagaacuaauguuggcaguacuguuuuguaaaucucauauuguguauacagugauauguaauggcuuugauuggggcauagucuuaguuuucuaguaccaugacaagacacugugacgaaaagaacuuuggucaaaguuugacagcuuaguuucaaagagugagaccaugcccaucauggcaggaaacaugacagcaggccaauagguaugacacuagagcaugagcuaagagcuguaccucaucuacaagugggggagaacacagagacugggcccggggagggcuuuugaaaccccaacgacaaaccaucuuccaggcuccaccuccaaauccucccuaacugcagcagcugcacaccgaccauuauuggugccagucucaugcaaaccacugcguugcaagggugucuugaaggcagcagaaaaguaacuaaggccacguauuugagguugaugguuuuaauuggauauaaauuagcuuuucccaccugccuucagucuagcaguucucaaccugaggguugaaaccccuguagggagcugaacgacccuuuuacaagggucgccuaagaucaucagcaaacacggauacuuaaacuaugacucauaacaguagcaaauuuacagcuuaucaaauagcaacaaaaguaauguuacgguugggggucaccacaguaugaggaaccguauuaaagggagguuaagaaguacugcuuucguaaagacaacagccaacgcguucaguaaaguguacccccccaucccuuuaaguacuucuuaacuuuaaaauugggucaaguugcccagacaggcuggacugcugggcuaggccaucaaaauccccaccuuuuuccccccuuaaacaaaaagcuguuauuaauugaaaucccuuggucagccacugauuucaguucuggcugcuugugauauaauuugguacuagccaaaaguuaugcauugaaaaguaaaguuguuacaauaccuuuaaccuuaaauaauaguguguuuauugcagcuagcacggaggcuucugacugcuguccuugcugguggguaggucucauacauuaauuuauaguaucuaacauaauucugucaugcuagacgacaaguggauuguaaagguugacuuugauuuuucauucauccgaagagcaagcaguagcaguggcuuugcuuucaguggagcacacuugucguccuguugugaccucuguccuguccuaaucguacaaaggaacacacaaguggggguggacuuacgcacuggcuguauugaaucccaucuuuuugaguaguugccacugaauccauguuuuuguuuuguccuuucacuuugaaagaccagaaggucuuauugagaauauuuaauuguaaaaacaaaaaaaagugaggcuauaagacuauuuuagguuaauauauauuuuccugaaagaguguaugugguuugaguuuaguuugguagaaaaggucaguuaacccagaagaucaaauccauccguccacuauagauuccaggugcccuugaccauaaagaaagccaccuguuacucaguuuagacuuaggcuacauuuugcuguguuucuugacuuuuaugaacagauggacuuauuuugagucauuugccaaacgguccaaccgcucauuuuaaaaugagcaguguucgucuucguaaagaaauuaaggugagucuuccguauuccuugaucaauauugaucucagauuaucaguacauucuugaagaucucauugauuuuacuuauuugaucugaugacagcagguuuucuauugagauuuugugagaccauaaaccauuuugacaacaguaguccucauuacccuaaaacuuuuauacuaagauuugaguauuuaauaagccaccuguuacauuuuugucauuuuaaaguuuuuuuuaaagccaagauuggugguuccugccuauaaucccagcacgugggaagcugaggcaguaggagcacugaguuuuaggauagccugaacuaaaaaguucuaagccguucugagccagugagaccugugcuaaaaaacaaauguugucuaaauucuaaacccaacaauugugucguauaguuuuucuaauuaucuuuacugggccuuuuuccccccagcgaagaggcaaagaccccacagaacauguaccugagauaauucugaauaauuuuaccacacggcuaggccauucuauuggacgcauguuugcuucucucuuuccucauaauccucaauuuauuggaagacaaguugccacguuccacaaucagcgagauuacaucuucuucagguuucacaggugagaggcaugcauuaacuugaacguuugucagucauguaaguacauuaagaaccuauauucugcugggcggugguggcacacgccuuuaaucccagcacuugggaggcagaggcgggcagaucucugaguuugaggccagccuggucuacaaagugaguuccaggacagccagggcuaugcagagaaacccugucucaaaaaaaaaaccaacaacaaaaacaaaaaaagaaccuauauucugauguaacaaauccuuuaagcauugccacaggaaguugaaugaacucaaugguuuaacuuuugucucugaagauacauauucaagagugagaagaaagugggaauucaggaacucggaccacguuuuaccuuaaaauuacgaucucuucagaagggcacuuuugauucuaaauauggagaguacgaauggguccacaagguaugugcuuacuguuccaaagcccauuuuaacugugugcuuacauauuagcaugugcuucuucccccaugaacuagaaaguaccaacaugauguagugucuugaccugccgauuaaccaggauuugcuugaagcaguccgaagaaccuuaaaugggugugguaaugugggaauggaaggaucgcaaacccugacccaccgggcugccgcagcuucagucucuuaagcccgucagugguucugcugcauuaccugagagcugcugcuggacucaccaaaggccuagcuaggagcagcacagccuuuccauuuuguacuuuaaccuccucaccucaaacucccagcacauagaaacuagaccucucgaccgacuguucagggucucagacacagccagagugucucagcacuguuauucaugaagaucuaugaaagccaguuucuuguaucuuacagaaguuguucauugucuuugcuuucccccuuuaauuuucagccacgggaaauggauacaagucgaaggaaauuccacuuauaaaggacuaggggagcaguacugaauuuugcuggauuggccugucuugaaaaacuugguaauucaaugaaacacccuuuucaaaauggaauuugauuuuauaaaucauguauuugaacaaaugaccaaguacugugaauuucuacuccauauaguaaauauaaauaaauauaauuuuauuuaggucugaaaauuuuuuagguauuaaaguccuaaaacuugcugucauuucagauaagcugaaaauaauuuuauaggaaugaagauucaaacuuucuaauuugcauucccaaaggacuguuaggcuagaaaaaggcuuguauaacccugacuuaauacgccagucuuggagggccggucacugggacuuggagcaguuacacaggucacugaaguuagccuguuuucuugcuccuuccuuccuaguuacccucuacuuuccuacuucauucaggcaucguguugaguucucaaguucuugauucuuuuaauggaacucucucuuauuuccagauggaagcagcuacccucuugguauaaccgugaaugccauuacaaagcugcuuguuuggaaucuuguug

SEQ ID NO: 1752 - RNA, 83453 nt, Mus musculus
aaagaggcggaggucgcaguccgggugugcggcuccuggggacgcgccgugucggggacgcgcguggagggcgggcucgggaagggggaguguccgcgcgccgccgcugccgccgccgccaccgccgccaccgccgccaccgccacggucccggucucugccggagagcucucagcaucucucccggacacccagccccuccgugcagccggacgccgcgcucuagggucugcgggagccuagccaaagccuagccaaaguugcugccgacugcggggcgggcggcgggacggccccgguccccuccccuccgucaucccugcuugcggacucccgggucauggggaacacugcgaucgccaagaaaggcagcgaaguggagagcggugagucgagucgaaggcccuggcuggguucccgccggaugggccgccgcgcggugcagcgcccugggccggugucccccccaaggccgcgcgcgagccacgggccgggccuugcaguggccgcgggggccggccgccuccuccucuguccccucccccacgaaggcucgggggugagggccaagccccggggcucacuggagagagggaaggcgggcagcgaggucccugugauccccuuucuuacuagagcgaggagggcugccacggucuggaacgcguccccaaauaugguccuuuugugaucgcacccuuagcucuucuuucucccagagcccccaacacccagacccuccuuuaagggagccacagguaguacguuuggguugacuuggcuuuuucuccuucuccuggauguauaucaguuuucucacaaggugaguguccgugagggucuccaaaggugacguuaacccuuagugucuaaggcucuuucuuucacccaagagauuagagauggcagacauaaauacaagcagcaacuuuauccauucgaggaaaaauaagugagacagcguugcguuuacucuagacauccaggaauguuccaggaugccuguaaaacuuagaggcauuucagaguugaagugcuuucuuccgagagcugaaaguucagacguucaguacuguguacaaaauuucaagacaaaagggucgugggaauugaguuucuguguagcaacuugguuuuauauguaagcauacacauauaugcguguuguguaacaggcugugagaaaauugugugccauuauucggcucauauuauaauuuauaauucacaauaauuagagaacggucccugacuuuuguuacauugccauagguuaaugacaucucaguccuugaaguaagucugacaauuuguucguguuacuguaaguaacgucuuccauugugucuguguuuauaacagaagaaugaagccaaucuuguaauuagcuugaagcaaacagcuuuugauucucaugaacaaagcagaguugaguugacagaagagagucuagcuauugcuuuuguggaauguaaacaacagucagauuuaacggguuauguuucaucaauaagguucguuccagggcauggaacagcagggcaaacuguuggugagcaugugacaacuugaaaagccgauguagaauuaggacuuccuuguuaucuuaguaauugugcaaauguaguaacuaauuguacagacucacaaaaaaugaaguaugacaaaauacuauauccauguaacauugcuuuuccccuauuucucuuguacaauguaugcuaauuguguuaugaaaauaugcuugauaguuggaucagcccaguaauuuucuuagcaagugcuaucuugcacaguucuuauauuuuuaaugauaguccacucuccagcagucuauacacuuccccuagacgauaugcauuuaaacuagcagcuaugacaaagucuugugugaacuuauuuauagaaacugaagaacauuagaaucauuugaaaaauauugugaagugucgaaagaagacagcagaugucccaugggauauaggagacggucauggcucagcucucagggcucacagggggaagugucagccaggugugcuggugcucuucuguagcaaagaagugguacaaugucauaaaacguaaugacagaacauggcuuaccacucuguccccaacucuucuguguacuuuucagaugaauuauuccugaaaauuuguggcucauauuuuaaauguaaucauuuaaauuucucuugauacacagaauacacuuuaagagauacacuuaagaguuuagucuacgaaaucauccuaacucaagacccaaccaagugccagaccugaagaaacaagaauugagaucauguuaucaacgagagaguaaagaacagcucugaggcucugacuaccucugcaucacuaauuaaucuguccucucucagaguagcuaccaccugcuuggguuuccucguagaccuguggacaagauccuaaagugucacuuacuguguagcaucaggugaaaggcagagugucagugcuggagcugagaguaaauuagaccacaagacguuaccagcagcacaguguuugguuugaagagcuaauuaaagauaggaagguaagauuugcaguuugaugaggaagugccucccacagacagggaauucuagagcuuaauucuaaaaauacucccaaggaaugaaguuggguauaaagguaaaugaacaggcuuugggggguuguuuuuguuuuguuugggggagguuguuuuguuuggguguuuuuuuuuuuuuguuuuguuguguuuuugucaguguuguuuuaguuugcuuugguuugcuuugguuuuguuucuuguuagcuuugagcacccagggccuugcuccuacacccacaaaauuaaaggauuccauucugaucaucacaguuucuagacauaaauuacuuugaauuccucagagaacuggguguuucaaagaacaacuuucgccauuauauaagucucccauguguuuuuaaaauuacucuugaaauaaaugucuuccaaaauuugaguauacuuauuuuucaucauuuaauacacagaaccuuaaacuuuuagaaacaggaggcuacaagucucagagauguguucaauccuuguaagucaagaauguuuuauuuuugaguuaaguauguuauucacauagccuuauuaauacaaaaagaaaaacaagcaaacaaaaaaacuccaugcuuuuuguucuuuuaaaaaauauauuacaucuccaagcugucuguggagcuauguauuacagauguaacuauguccaggucaaugggugaaaacugcugggcguuaauucucccaugaguagaguaggaaagccacccucuaccccagugguuauauaaugguuuuuggaaaugaccuugaagcuuagacugggugagguggcacacaccuuaaaucccaacacuggagaggcagaaggcugaucucuuugaguucaaggcuagccugcucuauacaaaguugaggccagcaauaguggcauugugagauauugccucaaaagaaagagaaaaggaaaaagagaccuugagaguaggaagaaacugaucaaagaaagucauuaguagaucaaguucagcaaaugcaaacuucuuaacguuuuggagaacuaaucuggcacuuggcacacauugccauacauacauuucaaacccuguggaauggcucugauguuaccccauuuucaaacuggauaaagaagugcuguguaacuuguuaaagguugcauaguaguuaaucagggagugacauuugaacuugggcaggcuagucucagagccucugaccgaaggguccugcugagcagucuuuuuugaguacccagcugaaagucagguucaggacacacagaauagccaauucaucguuuaaguuuaucagugauaacacacuguguugcuuccaaugaugacucuauuuggauaggcuaacuaucuuaaauacgaaagauuaucauuccuguaccauuuucuggauucauaucaucaucuaaaacugggaggaagggcuaaauuacuuucuuuaauuauuucauuuucaauuugguaaaaugacaaauuaaccauauauaauuaacuuucugcucuuaaaaccuucauugcuauauaguuuauuccucauuucuaacguguaccuuccuguuagguagcaagucaagaggccacuugagcuuacauugcuauuauuaaugaauuuggaauuuugcaucguaccaugauuuuucaaucgacgauagauauggucuccacuucgcugcuccgugaaaugguuucuaacuagauagagcuguugggaauuuggaauacagcugcaccacugaagaaaugauauuuuaccuugcauuugucuagaugguguuugguagauugacagccuguuuuugacaagagcugucuuuacauauaauaaaaacgccaaccaacccuuauucuauaauuuugguaauuugguaauaaucaugaguguauuuagaugaacaaaauucuagauauauguuuucucaaaaucaucagcauuucuuauaaauaacaauuuauaaacauagugaacaaauuaagauguaguaauuugauauacucacaaaguucccuuugguggaacuuaguuaugaauauaaguauauauauuugauugaaaauuuuuuaggaucauuuguugacaaaugaauuuaguuuucucuugcuucuuaugucuuugaacuuuuuauuuaucagauugacaaguuucuuaaaggguaauuagaaguagagaguugucaguuaacuggcagagguacuugaaaauagucuucuuuggguuaaaagagaaaaaucagaauuaugaacucggcuuugacugauaagcacauaugaucucauuauuucugauuuuuauuuuuguguggauuacuguuuagaaucaucucccauuugggagucauuuguccuguuccacucaggcuccuccgcaggacacaggcagauugcugcuucucacugcuggcaucaagaaagcggcuuggguagaucagucauggcuaagagguagaaacagccgggaacgagaggcuggguaagccagaauagcucaagauucucauggacaguuagaaguuaaccacaaccaauugugauagaccaucgaauuaacgaaguaaagcaaucauuaucauuucuaaguuuaagacuacagagucaguucagugaauaaacugcagacagcaggaccugaguucacaucagaacucauggaaagccagacacaguagugcacaguuguaauuucugugccuuuauggugagagggaggccaggcuaggaggaucccuggaaguuagcuuguguguacucugcccaaacaacagaggcccugugucagacaaaguggaaguugcgggcugagauuuuucuuugaucucuguuacacucacaugcauaucgugcacacucacucacucacucacucacucacucaugcucuuccaagacuaucuuguagugguggcacacaccuguaauaccaggaauagaugggcugaagcaggaggaucaugaguuaucagcucccucagucauaucacaggaaaccugggcgcagacauaaaauacuuuauaaagcuuuuuuuccuuguucuuccauccauuuacucauucauuuauucaguacacagaaguaagccuacguguuagaguauaugugaugauguaaaaauaaagauggguuauauccaauucuaaaacagcaacaacaaaaguauuucaugaaagguuagcagggcagccaagagaaggaauggucuuuuccauuaagacaggguccaauaaagacuuucaaagagguggacccuuagugggauacugaaaugagaaauguuuaccaaagaggcuauaggagaaaaucaaaggauagaaacagcacacuaugucacgauuagaaagacaauugccuguuagaacuaaaugguagacucuggaguuggugaucaagauuguauaaugaaagaacucagaagacacgggccccagggaagacuaagaauuugauccuaaagacaacuacuacagacuuugaagucagggaaagagauuugauaaaauuucuguuuuaaaaauaauuuguugaccuugcuguggauauuuagcucuaguggccuuugguguguuuuagugaaugggaugcaggcaaugaguugcuuuccuguagcucauauaaugaaaggcuugaauguucuauuauaaauuagauuuacuguucugugucuaagcaaaugguuucggguuaaauuuaggauucuuuuaaagacagaaaaguaguaauugaaauacugcacuaguuaguugaacuuaguucugccuucgaaauccaguagagaugugaugucuuuuaucaggcuugcuguagugagggaugggcgucaugcccuauggcuacacuggagauucacauguugacucuuuggugacuucacaaagcuuuuucuucuucuaaggcaguuguugaauuucagugugaaaguuuauggcagaccuaaacuuuuccaaguagauaucguccugaaaaauugagccuuugagauuugacuaauggucucacuuuguaaaauuuguuugucguucuuuuuuaguaggugaccacauaggcauuccuuggcuucuuuuauaagggcuggcucuccugggaacuuagcagucacggauguucauggggagagugugucuccucuccagcuguagcugugagauaaaucauccugcagcucagacucacacagaaaaugucugcauauuugucauucuguccucugacgcuucucacucaggacuccugagugucugcuucagacuaggcacugcgcuucguauagaugcaaagaaaagugagacuugguucuuguccucaagcugcaagacugcuacucagaacugucuguggcaagucauaggacacaugggccuggccucggugcugggcagaagugaauuguggggcuuuauauagggaagaguguagaguucccgcguggucuauaguugucuguugaguucccugggucacuccccgcguggucuauagcugccugcugaguccccugggucacacccugugugcagcacucugguuacuguguugcuccguuuguuucucuacugggcagcaugguguguagggcagaaacaguguccaguguguguauuuuauuugcaauaaaaacaugaacacagcuuucccuuacacacugcuugacuggauugcugaguaaaaagaaagaugaagcaaaacuucguuuuguuuuuauuuguauuugagggaagguacgaaaaaccaaaaacuacuuugguuuuucaaaaacugaucucuccugaggucuguuauccaaguguaaguaguauaaccuaaucuaccauuacuggcuuguuacgggucauaucaugcuaccugcacuuucugagaccacacauauacauaccuaccaguguaccugggaagguugcuauagcgugguuacauaugaguccauggugggcagggagauggaagaagaguaauuuggaacagguuuuacauacaguuuaaugaaaacacuagcauuaccuuaaaaacagguugcggcagaaaaauugccaugcuguuuucaucucagcugugugagcacacagcugcuugauccaccugcguguagagaagcccugccaaaaaguauuaaagcacauuagcagcaucugcauuaucuacaguaaauuuugaguauuaaacaaugggcaaaacuuguaaaacugccgacaucuauggcuaccauggaaguaaaugggaggggacagcgugggaaugagaauaagcaaucauucaugugcaggguguaugcuucaagucuuuggauuaaagacuaguaccucaagaagcugcuguuguggaauugcugggaaaccuucuuuacaucucacuagggaccccaaaagcccuaaccaagggucuaaagccacucugagaugcugugaagcagcuuccccagcuguccuaaugcugccaaccuucagcgcaguuccucagcuguguguccccaagcauaaaaguugucgugcuacuacuuuauaacugcaguguuucugcucuuaugcauuguaauguaaaugccugcuagucaggauaucugauaagcggccaccaaaggggucucccaaacagaagccaucggagggaaaaggaggaaugcacaaggcagucugugguguagccucuuuagcaguugagggucaguagaagccacuaacauaccagaagggcuuugagcgccgcugagcggcuucuuuguacaaaacaguaacaggacuucacgccuagggaacuuugucaacaauaaaaugacuuagauugauuugacauugaauauagcagaauuguuuuuaaaaacuaacaaguacauguggugacaacagaaaauuaugaggcagagaacacacacagucaagacuuuaguauaguuucaacaauguuaucccacaguguuggaagaugccuuuuuuaaugguucuuuucaguugacugugugauggaguuccacuaggccaaguuaaaaguggaccccacaugguuacauuguacaagcugugaagguuuuaaaccugugacaagugacagaagggaauaucuacucguugcaagaaaauccucacuuaugauccagagugcuacaagcacuuaaaacccauguaccucuccuggacuuucucagcccgcccacucucugucagcagcugccauauguucuuaggcuggucacucuguagcugaaauauauuuauggaggggcucaguugcaguaccaugacaggcaaauuucuuguuaaacaccuucauucguuauuuuguuuuuguuuuguuugugaucaucagcaauuccuuggucaggaauaagaaucuuccugcuguuccucuguugaagucuuacauggaucuaauccucugugccagcuggaaacaggucaucacccuuccugcaucagcaaagaggccaaaagaggaucuucuggauagugugcguaccauaagauuccuuuuccucgcuucaagggcgaggcagcugaguccuaagugaccagggccuaucacucacuugcuuauuguuuauaagucacuuauucauugaaugacuguaacaaguuaaggcuuuuucucuuuaccugcuggagaugccuacauaguuagcuuucuguacuauaugauuuaaaaaaaaaaacuccucggcaguguggacuucauuaaaaucaguuauugaauccuauuccccuguaugauuaaaauugccaucuucauaauguacuagaaucuagcuaccuggguuguagguagugugguuaugguggcgaacuugcacucugaugucuagucaccauugcagaagcuuuuagacugaaaccuguggcuuucaguccgugucacaauagucuuccgccugucuucauuuuggcaugaacagugcaggagucauugguguaaaucuuucccauggacuuguagagcacagucacaaauccugggucaucaaaucuccauccccauccucuggcuagggggaaggucacuugauuguuucuguaagugaucaaacuuaaaggagacuuguucauagaugccaaacucugaaagugugcagaucaccacgcucugucaucgaagccugcucuccccgcaucuucaucauuauuaaccgacccauguuauacgggguguaugugcccuuuuuagaggagauugucauuauuaaguaguagccagucauugacuacaucacauuuuauuaaacuccucugggaauguauaggugauaaucugacaucugugccuaagguugcagagggaugaagucugucauguaggaaagaccuggugugcugcagauccagaauaugacauuuucauccauacaggaaucagagagcuugcucagugucuugacucuagagugugccaggguugauggcucauguauaguggaaacuaaagucacggaugguuuaaugggugauaaaacuagcaaacucaggagcuggagagauggcucagugguuaagagcauuugcgcccauucagaggacuuagguucaauucccaauacccacaugguaacaugucuguaacuccuuuuccagaugagcuaccacccucgucuagcuuccaugggcaccaggcaugcacauggcacacauacauucaugaagacaaaacauccauaaauugaauucuauuuugugaguguuacaggagaauacuuuacuuuaucuguacugcguugaccauuuggggucagagcuacuugaccugaugagguugcucuucuuuaguauaguacaguuuacuguauuaaaguaauaucacuucuuuuguaaagggugcacgugugugucuauguguguguguguauacacaugagugcaggugacuaagaaggccagaggugucagauccuguugaagcuggaguuguagacagucuuaagccaccugaaauggauguuaggaacuuaagucauacaaguucucaaccucugagccguuucuuuagccccaaauuuacaauaucuaaaaugggagaagaaaauugguuuuuguggggggaggcggggcaugguuguaaaauguuuuccuugaccuuugaaaacuccuucuuuugaaguguuugucacucaucuguacuacugcuaccaguuacugcuuuuauuuaaucuguggcuugcuucgcauuuaccaagagcacggaccucacaaucucuuuugguuuuuaagccuggcauucauuuuaggcagguuccaauucuguguggauaacuauucaucaucacggggccucagaaaccuuuguuaucuguaaccuccuucccuguacuucacucaucucauuaagaaccuugucugucauaugaacgaacugcucucugauugccaggguagcuagcaauucucugaucgcagcgucuucuuucugauugccuuuaacaguuguucucugcgcagccacucauucgcacuucauuuucuucuuaccagucaggaugacauggagcccagaaccuuugcaagucuucauaucauaucugccugauaaacccaacucugagagacuccgcucuccuccuccucagugcuuucagccgagaauugaacacuaggagaaagcuaugcacaagaaugcucuaaauucacugucaucuucaagugggcugucagcaagacaguugucagcaagacagucagacuacguuucucugaacaacucuccuuuaugauuccuguuucauucuucugucuggcuucugcacuaucuuccucuucuaauaauaaucuaaccucauauaucacaaugaaaacaccagauaggaagccagguauaucucuuaucagguuucauccucagcuuauaguuuagagauacuucauauugaccuaucuaggaaucuugguaauuuuauuaauucuaaguucuauguguguguguguguauauguguuauuagauuauuuuuguuguuacuccuacugugacaauaucugagaauuuacaaggaggaaagauuuguuuuggcuuaugaugucagcgauucucagaucauggucagcaggcuuugcuucuuugaccuaugacaaggcagagcauuggguuaguguguaugugcuacagcagaacuuuacaucauggcagccaggaagcagaaggauauaggaaggcucuggaucucaauguucuuucaacagugugccucuaacauuaccuuuaucugauuuaggaaggauauucuuugucucgcauacacaaauuauguguguauguaugguguauguaguauauauacuacauauauguaugaauauguaguauauauacuacauauauacacauauauacauauacauacauauauguaguauauacaccauacauacauauauauacacacauaugaaaauagugugagcauaugcuacuuacauguguauuucucauauguauuagagucuauacauauaaaauagaaaauggguguccuuguuaacuucagcugucagcuucacauagcucagagucaucugaaggaaucuuaauugcggaauugcccagauccaauuggccugugacuuuauguguaaaagaguauccugauagacgacugauugcuaugugaggguucagcccacugaagguagcagcaucccuaagcagggugaucugugcuugaagagcuggcugagcgcgaaccagagagcaagccaacaguaaacagcaguauuccaccauuacuuuugccuccagcaucgugcuuugaguuccucuucuucauuccaucaaugaagcuugugaccugaaagugaaagccuaucaucuuuuguuucccaaguuccuuuugguuaugccauuuaucacagcagcaaaaaacaaauuagaacaaugggcagucuguuaaaaguucuuuuuauaguuaugacuuuugaauaguaauccaauauuggcuaucuaggaaauguucagcuugauugugaaauauuaucauuuuggauccuuuauguagaagugaguuuuguuguuauauuuugauauuuaugacuuuuuugacuaauguuuucuaauguuuuguuuucaaauguuugaggguuuuaaaauuuuuauuuauuuauuuauuuuaguuucauugggauuagaauauauuuugaaagauauucagucuuaaaaacuuuuggacuuagagggaucugggagggagaaagaagggggaaggaaaagggggguugguucagauaaaggaggagaugggggagaaguacagagggucaggaauuugaaaggaggagaguagcagugggggagggggacuggagguggucacuagaaagucccagacgccaggaccccaagagguucccaggauucaacagggaggacauuagcugaauuacccaacaaaggagagauuaaaccuguagagaccauauccaguggauaggcauggcccccaguugaaaaauggggccaccaacccaccucaaaaauauuaauccagaauuccuccugucaaaaggaagugcagggacaaagaguggagcagagauuaaaggaaaggccauccagaggcugcuccaccuagggauccauccuauauguagacaccaaacucuugcugaugcuaauaagcacuugcugacaggagccugguauagcuguccccugagaggcucugccagugccugaccaauacagauguggaugcuggcagccaaacauuggacugagcguggggaccccaguagagaauguaggguaaggacugaaggaucugaagggguuugcaaccccauaggaagaacaguuaucaacuaaccagaccucccaaagcucccagcgacuaaaucaccaaccaaagaauaaacaugggggaccccaugguuccagcuggauauguagcagagaauugccuuaucuggcaucacugguaggggaaccccugguuacuauggaggcucgaugacccagggucaucgaaugcuagggugcuaaggcaggagugggugggugggugggagaacaccgcauagaggcagggaaagggaggaggggauaggaggguuguggaggggaaacugggaagggggauaacauuugaaaugucaauaaauaaaauaaccaauaagaaaugaaaauaaaauuggacuugauauauauaugggauacccgaguaucacacacaccacuauguaggggaauaauugcuccugauaaauacccuguugauuuuugaagaguguauaugcucuacuuguugcuuacaguguuuucccauuucucaagcaucacaguuuuagaaaaguugucaugcugugcaucaguguuacuuauuuuuauugauaaucuuuuauuguuaauuauagcuaauauuuaaagucuuacuggaucugugugcuucuuuucaaucugccaacguucauuuuaaguucuucuggacuuuaagacagauaauuuguagaucuuugucuuuuacaguuacuggugucuuuccuucuucaguuugucagguauuagcuuagcucaucuguuaauucuggcuaguauguguauggcauacuuuucucaguaggcuuuuaacuucucaguacuucuagaauaauugagauuuugcuaaucagcucuuaacacccucuguuuuggagaguuucuguauagacugagguaguugguaauagcuuagguuuugcgcuugucacuuguuuuuguguuugucauacagcugaucuuugugcuguuucagauucuccuguuucucucugugcacucacuuguugauuuuaaauuuggucaucucuaauaucagauuauuacuauauaaguuacaaugaauacuaagccauggccugcuauucaucacccacuaguuuagucuuagcuguauuuuuaauuuggaauauaauuagaauuccauggcucuuuauuaugguuauuccuugccauuaauuggaugcugaggauaaaaucaggugacauacagugauuccuaagguuuccugaaaaccagcugucugucaaggccacugagugucacaagacaaugacauugacuacagcaggaagauccaggacucuucuacucuucuggacacagaucuuagagaucauuguguuuuauuggcagggguauaauguuggcaauauuuugggggggggggguuugagacacgguucucuguguagcccuggcugucccggaacucacuuuguagaccaggguggccucgaacucagaaauccgccugccucugccuccugagugcugagauuaaaggaguugcaccacuacacccugcucaauguuggugaucuugagugugguacuugaacugguuucuaaguauuuuuggcacccuugucauucucucucucuuuuuuuuuucauaugaucugugauuaacuuugcucuaaaguugcucaaaccauccauaguacucauuucugugacugaaaaaagcaagauagacuugguauacucacaacugagcagcccguaaaaguaagcuugaccaguaguuaaugcauaggaaagugagauaauagaaaucagucuugaguuuggaguauuuuggaauuagggcuuuuguuuguuucuuucuuuguuuuucauuucuagaugcagaaacuuaacucaaagaacuaaaacagaaagggagggagccuaugcugggaaccaccugugacccugucagugcagagaguagaggcgaauggaccacagggccaaggccaguuagguuacauaauaagaucugggcucaaaaaaaaaagcaaaaccagaaagaaaauauuuuucaaguaauuugagagcaaaaguaguaagauugacuuuaggcauaauaauaucugaaauacuguaauuauccuugugucuuucuuugucucugccucugucaacucugucuuagauacuaauguaaccgucucuguuccucugaagguggagcugaaguaacgugaacacugcugccugccacagaugugcugcaggcagcacagaagcggucaguaggggcuugguuugugugucagagcucaccaguggaguccaggaagggugcuuuggagcgucccucuucuaucacagaaagcaagaaugggggcugaguccccugugccuucaagcgugcucuauucuuuaccuguuuauacuggucuacugcugguccccagcaaggacauucacuguaugcuccaucucagauaaugaagccaucauucauacacaugaaaacacaacuuugaaccaaacagagacccccagaccccacagucugucugucagucucugggaacuugcuccagcccuuucuguauaguacucaccuugauuuucuuacaguuuuggugcugaauauuguuaacuuccauacuuacaccuuauguaaaaauguugagggaagcaggaaaaaaccuugauauuuauauaaacacacaaauguaggcauagaguuuuuucaaaaccuacuuuacuuaggguucuuaaaugcuucaacuuuccuucuaacccaccaaucagaaguaggggguuaaagaagguuaaaugggaaagugguauuguggacccguuuaaaaguaguuaaagugguguugugggcccguuuaaaaguaguuccuuagggcgauucuucucuuuuaugucaggauaccagcagugcaguucuauagcaagcaccaagccugagucaguaaugguagcaggauucagcaggaacagcaaggcucccucaaaucacaaguggccagaauaccacaagaaguucuuugguguguuucuauaaagugaacaccaacagagaccaguucagaccggcuaagaccagcgaagcauuacauagcauagcaaugcacuagcauccucucacugucuguggggcuccuuuuaucuucuuucuaaacaccaugcgcccucccaagggucuguucucagcacaucaucacauguccucucacaagacagcuucuagaaaaauguugcgugacacaacugaguuguuaaagaaaccuuaaccuuccacuucacacaaauauacaugcacacacaaaauucaggaggagguaucuaguauagucagucauccuguugagaauugcuauuauauuuauaacuuuaucauugaucccuuguuccuaccaacaguguauaagauaaacugggugucuuggcaugguaguaguucagacaguuacucuuacaccacugagaguuccauaguacuuccuaauaaaugcuucuuaagcuggaaauauuuuaauuaagaauguguugagcaccaugaccacucugcuaacaguauagcauauaagagcauaaugaggucgguuaggagcugcaucuuacugccacugccuggcaucucagggaaguaucuuaaugcauauugccagucugagaaaagaugaaaaugcaaaacuuaaaauguuaguuucaacugaguguguuacuuuugcacccuuaaaauggaaaccuuuguaaaucagggaucacuggauugcugaagucauuucucuguuuuuguugucaguauugacauuuccagaugauacacaagauugcauggcucugcagcacacuccgcauccccuucuuaccgcaggaaacgaugccucgcugaugccucaccaaagaaagaaaggucucucuugccuuauuucaguggaaugagggcuccagagcgcccaguggcauucucaacugugugucaaggaguuuauuaugaugauagaagcccucucucccaaggucuuagcuuuauaaaacacaaaggcagacuuuuuccagugaauaaacuauggagcuauagcccacugacucuuaacaugguuacguuuuuaacacuggauaguugauacuagacauuuucuaaaugcuaugguuucauaguuauggucaacuagacagcuguggcacacuugucauugugguauaaacaaaugcuggaucaguagccacagcuuggaagaaaauguaggaaaugauaaagcccugcaagaacuaacucagcauuaaauuaucuauauuauuuuuauaucauaaaagagaauaaauauugaugcaaaaacucagcaaugacugaggcacagauugauucagaaguuaguaucugaguguaaauggguuugagggauucuuucauauuuuuuaauguuuuuuuuaauuuuauauguguucaaaccaauauaaaguuaaaaucuaaagaguucucuucauaaauaacuauaaaauuauaauuaauaaagcauaucauagcuagcugucuagacuuuucccuugcaguacaugagggaugauaaaucuuuuuuuuuuuuuuucuguuuuuuuugagacaggguuucucuguguagcccuggcucuccuggaacucacuuuguagaccaggcuggccuugaacucagagaucugcccaccucugccuccugagugcuaggauuaaaggcgugugccaccaccgccccgccugggaugauaacccuuacgauuuacuaucaugacugguggaauagaguagugaggucugcuguuagcaucucugcccugcaguucacaaacguguuuuugcaguggaagaaauggcauuuuuucugguccuugguaagcuuucuuuccugugaaagcuuuaagguuucagaccauggauggcaggagccagcaguugcugagcagcuugcugacucuuuaguuuugaagcaggcuucauucuauagcucaagagcuggucgcuagagaaagcacccaaggaacuaaagggaacugcaacccuauagguggaacaacaauaugaacuaaccaguaccccggagcucuugucucuagcugcauauguaucaaaagauggccuaauaggccaucacuugaaagagaggcccauuggacuugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaaauggaaaaaaaaaagagcuggucuauucuccugccuccauuccucauauuauuuuucuuauaauuaugugacuaagugagcuguuuggaauuuuuuccuacuuaaugcuuugaaaugaucugcaaauuucuuauaauuuguuuuucuguguaagaauauuggugguuuauuaaucugugacucaucuuuaauaaucugacauuucaguguguuuuuauuuuaacuuuuauuugaauguuuugacaugaaaauuguauucauaugcauucaaauuaggccuggguaauguaauacuuucaucagcaggcccuaagcaucuucuuagguauagcuaaaaugaccccucaucuccauuccccuccagaaugcacgcagggugaaggagaggaagcugaguuaucagugacagcagcuguagccuguaucuuacgguaucgugagcgucugaaaacccuuuaaacgcuagcuccuuucacacagugcgggcucucccgaggcaucagaagaguccugaaauuucaucuggaccagucuguucugcaccauauuucuguguucuucccagaggcagccuuuccucuggcgacccuccuuucccuuuguacuccucaugacacacaaauguaucacccugugagugucauggggagccuccucccagaucuuuuggcaagaggugcuuuguccuccuuguagugccucggucugauagagccugugaauccccuaaacacaaguccuggcucauguggcuccagaagccaccacugcucuguggagcccuuggugaggcuugacacacuugccuccacuaaguagcccugcagaccucgcagccuuaccccagcucuucccuccugacccuucguucugguugccuuaugcgaauggcugcuauuggcaaaucuaguuuuaaaaucaaccaguuugucuguaugcgguuccuucccuacccgagagcuguuagcaccuguuuguuuuguuuuuucuuuuguuucgauuuguuuuauuuuguuuucaggugagaaaguaacaugaacuacaugcuagugucuuagguaucugucuaaugguuuucagucucaguuuucaccuugauguuuuacucaguugauguuucaucagcagguccuaaguguuuauguguucuaggcucuguagucggaaucaggaaagcaaagaugaacaagucuguugugaacagucaagugauaguugaagaacaauauaguaaaccuuauuacaccuucucauuauagaaacaacuuuucuguuuuguuuuguuuguuuuguuuuguuuuguuuuguuuuuccagacaggguuucucuguguagcccuggcuguccuggaacucacuuuguagaccaggcuggccuugaacucagaaauccgccugccucugccuccugagugcugggaucaaaggcgugcgccaccaugccagaaacaacuuuucuuaauaguauuaugaaggauuucaucuugcuguuacugauaacugcuaccaaccuuaccaaacaaaauagauuaaaucguguaacauuuguaguaauucuccaaggaauuguuaguagauucagguauaauacugaaaugaaacaaaggauggguagagccauauuuucuuaguguuguauaaauaggcuucugggagcaggaaaauggagaauagucuucugauaggauggucuuugugggaguuuuauaaccuaauuuguguauaugaaauaauguucuuguguauucucagcucaucuucguauaagggucuaaauuuguguuuuucaucuguuguccaagucuacagaaaugacaaaagaauuuguaguuuugaauuucaauucuacauagccccauucugccaccuucugguagacuucauuucuuauacugcuaugcgcugaaugucaucuaauuauucauaucaugguaggagauuguauuuggggaugggcuacugcagauaucagucacuuaagcugugcucucauucucacugugagccucaaagccucagacugacaucuguguuuuuaguuguaagaugugcuuaauguuaugggaagagaauguuacgguggcugcuuaccacaggguaacauguagggcuguuuaucacacagcaugcuuacaacuaggucaccacaauucugaaguuccuucagauguuaccugauauuaaaacugucaaauuuauuaucuauucaucacagucccaauaaaaauaacuuggaaauuaguauagacaugaaaguugauaaagcagugcaaaauucuaauacagaaacuaaugugugugguaguuucuaguuggaacuuuaaaaugaaaucagaaaauauuagugcucuuuaucccugguuuugugacaccuugauauguuuucacauuuacaaaguauuuccaaguuacuaaaaacauuuauggaaagaaaaguugggggcuuagcuuugugauuggaguauauaccuacaaguaggaggccuagauagauagaugaagggagagagggaguuuugaaaauacuguuugcuuauuuaaaauagauaaauugaaaauaguggaaugcaguauccuaaaguaguuguaaauauacuugcucuacugaggaccaauaaauguccuauaagggcugagcagauaguucacucuaucaaguuugaggcuaugacuucaaucuccaaaaagaauaccuccaaagauuauuuucuucccccuucuaagugggauugaaacauccauacuuuggccuuccuucuuguuaagcuucauauagucugugaguuauaugguguguauucugagcuuuugggcuaauauucacuuaucagugaguauauaccaugugugcccucuugggucuggguuaccucacucaggaugaaauuuucuaguucagucuauuugccugcaaaauucuugaguucaucauuucuaauaguauuccauuguguaaauguaccacauuuucuauauucauucuucugugagggacaucuggguuguuuccagcuucuggcuauuauaaauaaggcugcucugagcagaguggagcacauguucuuauuauauguuggagcuucuuuuggguauaugcccaggagugguauagcugggucuucaaguagaacuauuuccaauuuuugagaaaccaccagauugauuuccagagugguuguaaucucaucagcaauggaggaguguucuucuuucuccacaucuucuccagcaucuacuguccccugaguuuuuguucuuaaucauucugauugguguaagaucagaguuguuuugauuugcauuucucugaugacuaagaauguugaacuuucuuuagguacuuccuggccauuugagauuccucaguugagaauucucuguuuagcauuuguuaauuggguucuuugauuuuuuuuuuuuuuuuugagguuagcuucuagaguucuuuauauauuuuggauauuaaccuuuuauuggaugugggguugguaaagauuuuuuucccaaucuguagguugccaauuuguccuauuaacugugucuuuugccuuacagaagcuuuucaguuucaugagcucuuauuugucaauuuuugaucuuagagcgugagccauuggaguucuguccaggaaauggggccaggccaaugaguuugagguuuuuuguuuguuuguuuguuuguuuguuuucccacuuucucuucuauuagauccacucugucugguuuuauguuuagguccuugauccauuuggauuugagcuuuguucaaggugacaaauacggaucuauuuucauuuuucuacauacagacuacuaguuagaucagcaccauuuauagaagcugcuuucuuuucucuauuacacguuuuuggcuucuuugucaacgaucaaguguacauaaguguguggguuuauuucugggucuucaguucuauuucauugaucagccuaucugucuauguaccaguuccaugcgguuugcuucccugaucuugauuucaaauguuguuguucaauagaagggaagcaugggccuuggagaaagugcugaaucuaaggcuugggcagggaauaugcgaaauauggagguacugauuacuaaagaacgugaggauguguuuagacaugugugugcuugaacacaucacagggacacagaggcaaucagaagaacuuccacuggccagaguguggauaaauaauaugguguugaauuagagcccaaaguauaaauauaugaguugaugacuuaguaccucaaugggggcaaagacccacacuaccuguaccgacaaauuaaauugcacuuggcccucagggaggucaagcauagcuccuuaagugugcuguucauagucacuuccuggcagagaguguaguauggaaagcugggguggcagaguauucuaacgcucaguacuagcuacaggaaauagucaagcugucugcagugaugagcuacauugaauacacagccaguucuagcugacggauaguuuacagugugaguaaccagugcuuccuggauuucuaagggugcggggagaaggaggaaaaucuagagauuaucccagccagagaaguguaagagacauggguacugauggaguguggcauccuggguggaauccuggagcagaaaggacacuagauaaaaccagugagcugguuaacccuagugugucaauaucgauugacuaauuauaaaaagcaaccacauaaaagcaaagcaagaugucauaggauugauguagcauuguauaucucaaucuauuguacaauaaaaucuuaguuuaaugaaagaaauuuugauauguaaaagucuauagaaugcaaauuaucugcauuguuaaaagcucugcuugccuggggauuuugagugguaggagggagacauaguaaggaagugugagaaaagucacaaaggcaaugagugcucucucaucaucuucauugggcaugggaucuuauuguuguauuuguacaacaaugaagacaaauuaaacuagugcauucaccucaaagaugggucauuuccagcaugucaagucuguucauuauaacauaaggagaacagcagaaaagaaauuguagaccuaaauccaauuuugccaacaaucacauuaaauauaacuacucuuuguaagauccagcaaugugcuuuuuucuuguccauugaauauuuuggagaagauuguuuaaaauugggagaaaggggguggggagaauauaccauauaaauacuguuacacuuaaucccaucucgacaaaucaagaauuaccuagguaacaaaccucuugugauguuugugagguagguccuaauugauucuaugcagugcccaucaaaguuccagaaaacuagucuucaaaaaacuagaaaaaauaauuuugaaauguauaugaaacaagguagagacuagauaaagugguccuuaggagaauaaauauacauuggaauuuacuuugacuccaaaaaaaugaaauauguagacaaauauaugcagcuguaaacuuacaucaagugauguguuuuggugguucuuucucauaaggauuuuaguuuauaaugucugugcuuguuuguaagugggggugaauaugggcauaaacugcccaacuagagagagcaggaguugggaagauguggagagagagugaggaagaacaaguguggcaugaaagcacagaggagaugagggaccaaaggaacaagaugggcuuuugggguauggaagaugaugggagggucagcaaaaaucaagguuuguuugaaaaugccuugaugaaaccuaaugguggagaugcugguuaacuugaaaauaaaaacagagagcaaauaauuaagcaaaauccaggcuauagaaguuaauaaacaacacuauuacauuagaguucuccagagaaacagaaccaaaauaaaguauguauauauacuuuaaaggguauauguuuggcugacuuacaguucagaguuuaaaguuucuucugagauucauccaaucacuuaacuguaauccccaaggcaagacaggaaauccacuaggcaaacuccaaacucuacaucuccaagucugauggcaaaauggucugcagaucuccaacuccuuuuucaucuuuguugacugcaacaaacuucuuucuugugagcugguuccacucccuguuagcagcuuuccucagcagauagcccauggcucuggcaucuugaacaucuuggggucucuaagucaacuugaacuucacagcuucuuguuccagugucuaggauccacacaugauccuccaaaaggcuuggggucacaucuccagcucugcucucuguaguacucuaggcucugguugacuucacugcuucuguuguucuugguggucaucccaugguacuggcaucuccaaucugcuggggucuuccgcugcaacuaagcuucaccaauagccucucauagacucucucuucaugguggcaaaccucauguucuuugcaugaccacuucaggccuuggcuauuaacugcaacuaaggcugcaccuucaccagugaccucucacaucuggaucagaaacuguguccucucuuguugaacacuaugcugaaagucauagacauagaguauaauaaggaagguaaauggauggcauaaaucuguucaaaaugauuaaauguauauauaaaaucccaagaaauguaagaaacaagggaggacuaguaaguucacauguuagucugcagugaugauauguauauucuuugcccagggaguggcacuuaggagguguggccuuguuggugugucacugugggugugggcuuuaagacucucauccaagcugccuggaagccaguuuucuagcagccuucagaggaagauguagaacucucagcgccuccugcccagugccugccuggaugcugccauguuccaccuugaugauaauggacugaaccucugaaccuguaagccagccucaauuaaguguuggccuuauaagaguugccuuggucauggugucuguucacagcaguaaaacccuaacuaagacagaaguugguaccaggcucugggguacugcugugauaggccugaccaugcuuuuguuuggaagaaaguggauuuggggacuuuggauuuggaaagcaauggacuguuuuaaauggagcuuaaugggccauccuagaaggaauaugaaagacuuuguugcuaacagugauuugaacuguggaagccuggcucuagagguuuuugaggagaagaauuuuaguauguggccuagagacuguccgugugauauuggugaagaauguggcugcuuuuugcccuugucugaagagucuaccugaugcuaagguaaagagauuuauauuaauugcaaugacaaaggaagucucaaaaaagcccaacagagacuuuguucucugguuaagucucaugaaguguuuugaacaagcagagcaagcuuagaaaggaaaaauauaaaauguaugguucagguaauaauaaaagggcaccaggaagugaaaugcagcuaaaucccgaauuugaggagaugaagagauuaagggagugcugaucucaggguaagacuguuuggaguugaacaggaaauaguuuggacuuuuaaucuggaacgaacuacaauccagaaauggagagcacacuugugauccggcucuuggagcuagaagacacagacuuuugaucuggaucuugaggaacaguggcccaggcaugguggugcacacuuuuaaucccagaagucaaaguaaaucagaucucugaguucaaggccuuccugagacagagaaagucuuaggugaagaaaagcuuaaauucaggccuuuaaucccagcauuccagagacacagccauguagauuucugaguuaagguuaaucuacagaucaaguuccaagacagccaacuuuaggcauugagggaguuagaaaaucgaaagcugauaauagaauaagggaggggugggcauguuccagauucagcggcuuuggcuauggggcuugggcuuuagagucaagaauugaagggacuacugggacaauugcugcugguuagcuggagcuaagaaauuagcagugauuaagaagagaccaaaucacugaggugaaauauucugguaaauuuuuuucugauagcacaaagaagcuguguuccagagauacccaagguuguaccuugugcugcagcaggacuuaguaauguacccaggugguacuggguuugaauguaugaagggguuauggauagcaacugaggcuuggcacugagaggccauggaaggccauuaugaaggugcagccuuaguugcaguuaauagccaaggccugaaguggucaugcaaagaacaugagguuugccaccaugaagagagagucuaugagaggcuauuggugaagcuuaguugcagcggaagaccccagcagauuggagaugccaguaccaugggaugaccaccaagaacaacagaagcagugaagucaaccagagccuagaguacuacagagagcagagcuggagaugugaccccaagccuuuuggaggaucauguguggauccuagacacuggaacaagaagcugugaaguucaaguugacuuagagaccccaagauguucaagaugccagagccaugggcuaucugcugaggaaagcugcuaacagggaguggaaccagcucacaagaaagaaguuuguugcagucaacaaagaugaaaaaggaguuggagaucugcagaccauuuugccaucagacuuggagauguagaguuuggaguuugccuaguggauuuccugucuugccuuggggauuacaguuaagugauuggaugaaucucagaagaaacuuuggacuuuuaacauuuuucagacuccuguaguuuaugggaacuuuggaaguuggacuaaauguauuuuuuuauuauacuuuggcuagguauaaccccccagacucauguguuugaagaagccaauggggacuaaggaguggaaucagacuuuaugaguaugcuugguccaggggguggcacuauuagaaggugugaccuucuuggaguagguguguaacugugggugugggcuuuaagacccucauccuaucucccuggaagacagucuuuuccuguuccuuuagaauaagauauagaauuguuagcuccuccuacacugugccugccuggauacugccauguuucccuccuugaugauaauggacugaaccucugaaccuguaagccagcccuuauaagaauuuccuuggucauagugucuguucacagcaguaaaaccacacacacacacacacacacacacacacacacacacacacacacacacacagagugcagaaagguaauggaaugggaguuagaagauuuacacuguaagauuuuaaguugacuggcaauucugaagcuuccaagucaguaugguaugugaagggacuuggcacaaguugauaaaauaaaagacuaagacccaggaguagauacauauauucagccaccugaauuuuaauaggugcaaaugaaguuuaauuguaaauggauauguauauuguuauaaaucuacccaauggaauccuuacuaaaaauaugagcuauucagacuguguagguaaaugccagucacugugcuaugcuacaugaauuucacuugcuguguaaaucuauauuuacauaacaaggucauggcugugucauuuuuccuccacgugaaagcauuacauacuaaauaugaucccaugucuuccuuaaucuucagacuucuguacauaauuuugcuaggccccgguguguuugcaaacauagauacagauaugaaacugaaaggcuucaagaucuguaucaagauacagauacagauauaaaacugaaagucuuaaaggucuguaucaagguccgaccaucugaaggaaagcauacacuggcagagucucagacacuuggcaauagguccaacagcccaucuugcccaccaccacuuucaccucccuccccagccaaaacugaaacugacuugaaagguccuucuggagagucagcucaugcagccuaagggcuuuuuccucuucuugaaguaggcguggucagaugagcauggugccauaguccugcugucccagugcucaaggacucugagacaagggaucucaaacuccaggccagccuuagcaacauaacaaaguccugucucaaaauacaguguuugaaauaucugaaaauaaaucuugucgguguaguuuguguuucgaauguuugagaccccugguugaguucccaaauagcauugagguggguggugggaaucacauaauaucaguguuguuauucacuuguaaagacuauaggagccuuaacaucacaaaugcagaucucacaugugguaaaguauuuagcaaauauauugcugauauuugcuauuucugugugcaagccuguauaccgugugugugugugugugugugugugugugugugugugcgugugcgugugcgugugcguguguguguguuccaucucuuggcauucacagcacguuuaccuucagaaacugcuauuguuucuuguaauuccaguuuagcuggagcugcaguuguuucugucaggcaguagaugccagcagaguucuuuuaaacuaaaaagcaagucucuggcaccaccauagcaacagcuuccugucacacuacuacagacagauauuuuaaaaauuaaauauucuauguuuugcaaggucuuuugaacaaaaggaaccaguuuuauaaccaacaacaaaaaacuaucaaacauagcauuuucaagauacucaguuuaaguuuaccuuuuugauauaauaauuuuaaaucuuauguauuuuaguuaaaugaaucccuguguuguuguuugaaugugggacuuuauuuaagcaauaucaaacaaaggucuggcuagaugucuguuaaaaggcauaauagcugacauacuauguuuaguuagguuuggcaaggaaccaccaugggagucuuaucuggggaggcccaugcagcagagaugaaugcaggagcguuuucagaaaucuaccuuugcacuuaaugaacagaaaagaaugaaaucaaacuuugacuguagaaaaccuugaaagguccaauaauaucacuucuauuuuuuuuuuuuuuuaagaauuauuuauuuauuauauguaaguacauuguagcugucuucagacacuccagaagagggaaucagaucucguuacagaugguugugagccaccaugugguugcugggauuugaacucuggaccuucggaagagcagucgggugcucuuacccacugagccaucucaccagcccaucacuucuauuauuaacuauaaauuacuuaaugcuuacuaguguauuuacaauuagaguccuguuauuaacaauaauguuuucuaguauauggugauuuuaguuagacuuuuggagugcuaaaaguuaugcuuauauucuuuauuaaucuuauaguauauaauaauaugcauauauguaaucaugugcucaugaauucaaauaauacaacaggagcacaagcugauagacagccaguauuagugugacgugacaagggucguggaagcaggacagcuucuuuccucguuauguagcaguuauguagcagugcucugcugacagcgccaccacucugugcucagcaugacagggagcagaacucucucaggagagccagucaagggaacugaaugcuuucaucuguuuuuugccuacuggucacugugugccagacacauuuagacacugcaggcuccuagucuuucugucuuguaagauaucuccacguguuaauagaucacugauuacacacaguugacgauuuuaaaagcagcacauuuuaagguugaaugguugguccuguagguccugcuguaugcuugucuacccuggugguauuacuccagagagucacugcaggguuucaauggcagagcuuucugcucagggucucccuggcaggccugccugugaccugccugguacugcuuauuuuauuuaacauuauuguuuuuauuuauugcauuaaaauacuuaacaggaaauaggaauucagauauguuucagaaggacaaagacuuuuuaaacgucuuucccuuucuuuucccucuuuuccuuuauuugaacuuccaaagagaaaaccaucaauuucugacacgcaugauguagacaggcaaauacucaaaauccuuaaaugcuaccuuuaucaugcaaacuggacaugacuuuuuuuuuuauuguaugugauguuucuaagagauccuuaaauuagacuaaagaagcagcggccuucuguguuagggcuuugacagucauuagccaagcaacagggauucuuuucucaguuaaaauuucuugguauggcuaauagccuauaaaauuauaauagaugguuacuauaugauuucauaauuccaaucugauuucuuuuccucaagcuuuccaaauguuagaauguuuucagauguuauuuauagacaggcacauaucuauaaauaaauuaauuaggcaguauugguaugcuguuucuauaauuuucauauguauuagccuugagucagugaguuagcaacuuugauucuuuugaaauuaugaaauuagcucagauuuuuucuuaguuaugacaugcuauccauugauaccuuuucauacuaauguuaaugaaaaguuaacuacuuauaaagauucauacagucugucagcugacauccuguaaacuaauucuagcguguuacuauuuggccucugguuauuugcaugggguuguaauacauguuuaacuaguuuuccacauugucaaaaauacuuuuucuccuucucuguauaugaaccuuuauaguuacuguguucauucuccugcauauuaguaucagaacacucaaaccuagaaccuuuagcagauauugcaaguuuuaaaguaugcaugucuagcagagaugaggcucgcuaaugugcuguuuuauauuaacaggaaacagccacaguagugguuugcaaacccugcugacaggaaguuuagcacaugcauagcucuuagcgucuugguaggaaguugagcuccuucugaaaacacuugcaguuacuuuaaaguguaaaugcacgcgaauggcagcucacaaagaacuguccaguggccagcacaguggcacgcccaccgcccuccagaagcuggagggguucgcuagccgccuguuucacaggcacuccagaggcaccgcacaagagcacagggcagcucuggaagaugacggccuucgggccucugagcacacugccucaugggacaaaucaaguaagugguuugguuuuguuuuuaaacugauacaguguaauuagcagcuaaaguacuuggaguuucaggaucaaaugcaaagaauccaguuuugucuuuuuuugauuugcauaaggauuuuuuucaggauggugagaaaguucauaaaaaauuaaguugagcuguuuuguucuuuuuuuaaauuuuauaaguaccuaggacaaauaucaauaacaaaauaucaguguuauucuuauuuaauucuauucuaugucacaugguuuuuguucuacagcauaaacaaugaucugcuuacuuuuacauuucuuuuauuuauaacuaaucuuauguuucagaagugaaaagaaacauuuauguauauuguaucaggcuugucaucuuauuuaaugcauauguaaaagucacucggagucuuacagaaaaggccuucuaauaaaagcacauuauucuauguaaaauuuuauauauuugucacaugaugaacaucaaaaucuuacauccuuguauuuuauaucauguauaaaauagauuaaacaaauuguguaauauauuacauaucuuuaggaccuguuaaaauguucagacuuagacuguuguguuaaaaugguuuggcaucucugauggcaagaagauuaaaggcugaguucacacauaacagcuguaugccuccauucccauauuagcuuggacccuucccagggagcaugcaggggacuacuaagaagcagccguuguccuuggcauuagagcuuuuucuacugcguuuacauggucauuaaauagaacuaggauuugccuccuuggauucauggauuguaaagcaguuaaguaagagaacucaucuuuaaaaugaaaauguacauguagauggcucuggggaagcucgggcaacuguucuacaaugucagacuugcuuuuucacuccuugaagcuacuuuagggagauaugaaaaaggguguauuuuuguacaaaaccauuuucaucaacauauucucucucucucauucuguguguguguguguguguuuguauguaugugugcauguauaucuguguguguguaugcauauauauaugcauguaucuguguguccauauauguauauauauauguauaugugcaugugucuguguguacauauauguacuuacgugugcauguguuucucugugugucugugucuuucugcuucugucugugucucugagcaucucuaucugcauauguguguaugugugcguguguguuuaucucugucuguguguuuucacacaagaucucacaaugcagcugcagauucaaggaauuuguagcuccuccugccuagcuuccugggugcuaugauucugacccuguaccaucaugcccaacuucccagaaagauugcauuacuucaaguuaucuuuacuguauaggaaguuaauacaugaagagucucauaucugucucagugaacuguuaaaaaguggaauaacagcucaguauucaacuucuuguaugacaaagucuccauggccuggucccgcucuguaaauugcagucuucuaaacccuuuuggagauauuuuuguguucuuuaaagguguuuauaauuuuaaaugaggacagaguugauuuucugcuuuguagugaauauaauggaauuuaaucauuggagguucuguuugaacuagacugaacaggcuguaaguguacaagaccaauauacuuucuggaacauuguuaaauucagugacagaguacaguuuuguaauacauaauuucuuuuaaacaaauagacucuuaauaaauacuguuuuuaucuuuucuuuugaaaagacagaaacagggcacuaggaucauggcauacaaacacaauuaggaccaaacguuagagcucugugaauaaugagcuggaguaagaaauggcuaaggagcaaggaaagcucagucagugcuccucacccucuucuccuuucagccccucagcuguucuaagagacacugugaacgcaugugcgaggaggagcacaguaagcguguaagcaugcgcucugcugugucgaugcacaggaggaaggcagagaagagaaacugugauccugucaauucucuuuucugcacuuacuuguuuugcgugaugaaaacaguucuguggucacauguguaugugcuaagggauggauuuuuaaaaaauacuuguuuggagucguggguguagaaaccagaggacagauugcaggaguugauuaucuucuuccaccauuguagguccuggagaucaaacucacguuaccagguucagggacaaaugccuuuacucucugagccaucucacuagaccauagaagagcucuggccaguaaggaguuuucaggcauuguuggauuguuggaagcuacuaaguggaguuuacgugcauggcuuguuuuacagggugcuguauuccaaagugcuauuuuaagaaacaacuaagaguggaagucacaauuuaacaauuagguacauggacucuugaguaaagauuaaaggguaauuuaggcaauuggaguuuugguuuuugaaaagguguuugguuuuauuuuguuuuguaauguggcucagguuaccuuuggacucgauauguagcagcuuaugcuggccuuaacugucugucauccucuugcuucagccugagaauaauaggcaugccccuuucaucagauggaagauaggaaauggaauaaacuuuaaucaaaguuuuuucuucuccagggauguuucuguagggauaaauauggagcaucggcuacagaguuguuucuagggguuucagcuuuuacuuucaaauuaauuaauuaauuguuccugauugauaaaauaugucauagcuaucucugugcacaccuuaguacauucggcuguaguaacagcacagaggaauuccuuuuguccugacucauugacauucauugacucgucuuccuagaaaauguauugugcuucccuuuucaauauuucuuaccucaauagcaguuauauaaaacugaaaguaaucaaagguuugcauguugugagccauugauuuucacgcuuaacagugucuaagcugcagcauuuuaaagagcaaauguguuaagaccuuacaacacuuugccugaacuucccaagaaaugcuugucaguuucuuugugagcacaaguuaauuuuugugaagugcacgcgacagcaaaugcugugaugccuuaggaugcgaauguccucggaacuugauagcucaugugacugucauagcugucagcuuuacccuucugaagcucuucaaacccaaucuguuaguccguugaauuuguguaauuguaacuucuaaauuauuuuuuaaucucuuuucuuaauucugcaacuauuuuaugagcucauugauuauaaucaauuucuacucauuagaaagcuauuuuaauauuuauuaugucauaguuucuaaacugauuauagaggucagagaaauuguccagaguuaagagcacuuacuugcagaggaccuggcuucaguacgcagacccacaggacaguccacaaccuccuggaauuccuguuccaggagauccaaagaccccuucuggccuuaggcaucggcuacaaaugugcuacacaugcauuuuuguaggaaaacauucauacacaugauauaaaaauaaaucauuuuuaaaacuaugauuguaaaaauucuaaagauuaugauuauaaagauucugggggaaauuagaaaucagaagcaauauaacccuuaauauucagaguguuagguuguaauagcaggaagccuauagcaugucugucccuuuccuguccccuccccuuuucccaugucugugugugugaugcugggaguauaauugaacaugguggguaggcgagugauauuuccagccauauuaacaucauuuguuaaaaugggaaaucauaacauaaugacacguuagauaaaagagccaaaagaaucuguaauaugccauuggggauaauuuaaucugcuuagucuucuacaaagaagucgguauagcuagcauacuuucuguuuguuuguguugggucuuuaauucggacuaacacuauuaaaacuacagcaaauaugacaauuuaugauaaccaaauagugaauucccugcuuggccauauuuguucacaguacucugauaggaauuucuuuuugcaguuucuuccugugugaagauuuacucauagauaaugucuuucagauauuagcucuuaacaagacuaucaaaguaccccauuccuccaucguucguucuuaucagaacccacaauuccuuucuucaugcucugaccaucuucugcuuauuuuuaguaagacuuaaguucguggugugagagcuguguuucuuuuaguccuuguguuguguuugucugugguuugauuuugaacucuguggaaacauaacgacuauggguucauucugacacacuguucugagaaaaugcuuuguuaucuuaaucguuuauagccuuuacacuuaugcuaauggacucuucuaacuuguucuauugugguguuugccauuucuuuaaaagguuuacagauauuuaguaaaaauagcaaaaugcucacccaccucaaguaaauacuguguuucaauggccaggaauuuaaguaccaacaauacuuucccauuauaccaugucucugaaucacucuaaauacucagcuaccuccucuuucuguuaauuucuuuuucuagauguuuuacaucacugcaauucuauaguauguagccuauuguuucuggcaucuucuaucuauguugcggaauaugcaaguaguugcuuccugcuuauugcuaaauuauccuguguugugugacaagaacacauuugcuuuaucuguucugacuaacaaaaaaauuguuuuuuagacuguuuggcuauauggauaauguuaugauaaacauuugaaaacaagucugagugaacaggguucuuaguagauauauaggagaagacugggaauaaaaugaucguaugauauauuuuuauauuuugaagaaacagccacugcuggagagaugccucagugguucauagcacuggcugcuuuuccagagguccugaguucaauucccagcaaccacauggugacucacaaccaucuguaaugggaucugaugcccucuucaggaguguauaaagacagcauacucauauauauaaaauagauaaaucuuuuuuaaaaagaagaagaagaagaaagaaccaguauacuuucucacagucucugcgcuguuuuacccgucccuugcacuuggaaggaguggaguuccuucauguguucagcaggacuugguggcaucaggcuuuggggcguagccagauugagguuuaaacuuagguuucacaguagguuuuaguuucucuguccauaauaacuaguaguauugguuaauuuuacaaucucagaagccauuugucuaucuaguuuggacauguguccacuuuuaaaauuaaagugucuucuuuuuauuaaaucuuacgaaucuauuauauauucugaguccaaauucuuuuaaagacuuguaacuugcaaacauuugcucucagcuucuagcaugucucaucauuucuuaaaauaauaucuuugaagaaagaaaggucaacacuuuaaugaagucaguguuaucuuucucuuccccuguguacugugccuuuugggccaggccuuaggaaaucuuugucuuacugaaacccauucauauuuuuaauuugugcuuucugcuacagacccauuuuucagcuuuauauuuacugugaaguaugggcugaaguaguuuuuuauauguguaucggguuuuuauuacuucauuuuuuaugaaaacguuccuccauugaacuaucuuaaucccuuuuucggaacucaagauagauguauauuuaucgaugacuuggcagcucugugucagcgaaugagggauauuuauucuuacgccagccacacugguuugcucacugaguuuugaaaucaagcaguguuucauuaauuuuguccuuuuaccaaaguuauuuuagcuauuaugagggcuuugucuuuucauacaaauuugugaaucagcuuaucauuuucuaaagaaaagccuauugaauuucucuagauauggugugggauucauugaucaguuuguaagaaauugucaucuugacgacagacaugucccucuccaugucuuuagauguuuguaacuaucugugauaccuccaaguucaucucuaaauacuuuauuucuaauucuuuugugaauaagaccauuucugaauuucacuuuuaaauucuuuccugcuuauuuuucaaaugauuauugguaaguuucuuuauaacuuuaaaauucucuucagauugaaucauguggccuucacauaaagcuuguuauguauggaaaugucuuuaauauuucuccuaguugcccuggcuauacaaaguuaaugcagaggagugcuuuguacccaucuuacaggaaagcagcuccucucucacugucaagugugauguaaaucacgggaauuuucucugcacagcagacugagaaacccuucuacuguuaguucuugagaggacucgcugcugcugaugcugcacuugcugguggucaugugguuuguccuucguguuacugauguauuugauucauuacucuucaacauggaacugucuugccuuucuaagacaagccugcaugcucaugucuucagcagacuugcaggcacuuucguauuauuggugagauuugcaauuuucaaucucauauuuucaauuuuauuaguaauugcuuccauuuucauuaguuucaacaaaauggaagaaaugaccacuuugggaccugcuaaucacccacaguuuucuauuucuacaguugguucucagaugauagcacaauacuuacugguugugagaccucuuggacaugggcacacucggccagcauggagcccugggagccucccagagaaguguguagguuguuuccuuccuuuucagaagguuuccuuauuuucuuugggauuucuuugugguacagugucugaggauuuccacauucucuccuguuguugauuccuuaauuaugcuuuuuaaaaauuuuuugaacauauguggagugugugugugugugugugugugugugugugugguaugugcaugccauggcauagauguggaagucagaggagcggccacuuacaggagcugguucucgccagccacguugugggccugggaauggagcucaggccaucagacuuggugccagaugucuuccacucaaccaucucgcaagcccuuaauuauaccugagaagagaauguauuuuaaaagauugaacaagccuuuugauuaauucauuuauuauuuugucuugcauaugaacacagagcauuuucauguacauugcaaaagauuaacauucugcucacuuuuagcaccucauuuuauguguaugaguuuucagugucguuguacaaguuugauccauccguguucacuuccugucuacuuuuccuaugaauuauuaagagaagagccugaagucaccaacucgagcccggcuuugcaucauugaguuucagugaacagugagcgucguccucuguggcugcagcuccacuccaucaucuuggaguacagaccuucguauugcauagugaugccauagcugugcuaaucccauaggucaaugcauuguucaugucuuuauagaaauacuaucaucaacaaaguuacugcuccgagagcuguagaaaggugcaccucauauaauuacagcccauagauaauguguagugaugagaguaaacagauugguugcuggcuuguguguuuugguacuauaguauuuaacauucuguuagaacacagccuucuguuuauauguuagaaagucuacucugaagcaguaugucaggcuaagugagcagcaaccucaaguucacacuuaaacugcauuugugcacugcaucguuuucucuugugugugacuuaauccccuaguguuguguucaucacgcaccuucaugugggcuguguuaccacucuugcaauaagcacguugacugacugggcaugaaaggaggaacucaggugcauaaguggaagucagugagagcuguuguugcuuguuuuuugggcaggguccauucuguuauagcuguguuaaaauauuuuucuuaguaggugccuuugguuuuuaaugacuuuaucugauaacaaucuauuuuaggauaugauugacauaauucucuaguuaaauagaacuucuuugaaccaauaaaugucuuaucuaaauuugauuauuauuauuuucaucuauauugcaucuguacauuuugaacucuuaccuagcaguuuaagguuugauaccaccacauacacagccacauauauaagacuguguauaaccauuauauguguauauaugcauguaggugcacauacauguuuccucuuuaguuugcuuuuuugguauucuuugucccuuccugucagcuuacccuuuaauggcauuucguugucgucugaaaacuccacugugcauuuguacuuaaaacacauguucucuauuauaauuucuccuggaauuuuacguuugugggcgaucguuuuccuggauguacaguuauuacugggcaguuuuguuucuuguuucuucuagcauuucaaaauaucauuucacugucuucuggccacucuuaguucuacuugcgaaguuagcacucaauugaauuguuuuuccuuuguacauuaguacugguuuuucucuugcuacaaauuaagauuucuuccuuugucuuuauuguucaguaacuugaauuugaagugucuagguguaggugucuuuguguuugccccagcuagcauuagcuuaacugcuagcuucaccugccuuguagacugggggcucuucuuucaguaggacauugucagucacuguucuuuuaaacguuuccucuuuccucuuguuuccucuuagauguauguugagcccucagauuggaugccugugugagacuuguacuuuccuuggaguuuguucuucauaguuacucaucuaucuucagcucacauuuacaggguuagggccauuuuccuucugaaaugggguguuaguauuagagugaguuuaaguuuuucuauuaauuugucagaucucuacuuuuuguuuuuucauauuuuucuuuucuguacugacauuuccaucuguaucauucucaucaaguccuuaaacaguucccuuuuauuucaucuaacauuucacuagccaguugcaaauacuuuuuagcuguacauaaaugccauuccugcuuguuauucucaucgugaaugauguauguuuggacaaaaaucaggggcuuaaaauaagguauuuguaguaacucuguauucuauuuaaucuuuuuccuccaaggacuuauguuuucauuucauguucagcaucuuuaguccaguuuguagauugaauguccuucaugguaugugcugcacaucucucaauucugauuugauguuacccugagucccagaacucaguguuguaugcuaucugaaaucaugcuggugggccacgugaucaggaaguacacauuugguccauaacaguuuuaaauuuuggaucucaaauggggcucauaaugcccugugcagccauuuccuugcuaaagcucugucuagaccaucagugcugccugccucugcuuggacauucggcuacuggagcugggcaguauuccugauuccuuccacuucacuuuuuuuuuuuuuuuuuuuuuuuuuuuuuuacaguguagaguuugggucucugauggugucacugcuaagccuuccagaccaagcuggagggaucugagcagacaagaacaccucagacuugaguauuuuuacccagaguccaguacugccuccuaaaaugcuucccagcuugucuguaaugggccuguaccagagcagugcagguccuuuccugcaccccuguccagcucuguuguuucuuggggagguuugcugacugacuguucaucacaagugccgccuuuucuggcagcuuuaaaggugcagauucaccugcugaaguucugccucagccccaguucucuagucccuuccucuuaccagugcugcaaaucagaggucucugagauuagaacacccugcucaucaugccacccagccuacccaccuugccguacagucuguccucagaguacuguaucaugagaggaaugucacucuuggauaaugguuacuaguaaauuuguuguguguggucuuuuaaaaauaauaucuugguaauaucagauacucaaugcugaauuuaauggaaauuuacaagugcuauucccugauuuuccuuuauaaaagaagauuuagauaacauuaccccaugguacagaauguuuaaauaguuaacauuugugccgcaguauagcuuuuggcucgugaaaaaugaaagcugucagcgaucugggcaauaagauucaucgccaauagucacuagcaacagcacacagcacuugagucuccgugagguccgcagcaguaggagcugcuguaaugaaaggcauuuaggcgcaaucacucugcugucguuccucgcuggauccaacaugggcuugugugaguaugugaagcaaacagcauuuaaagauaggcuugagcggugugggaagaggguagcucagugcuuacauggagagaaugucguaauguggacaucacgcuacccuaaaauaaaaagguaguuuauuugcuuuaguugguuaaagcuucaggaaagcuaccucuugguuagaaggaaacugauaaugcuggucuaauguugccgugguaacagcucaugcugauaggauugagaauaucguauacauccugguuugcauuuucucucugccauuuugaguuauucuggagguauaugaaggaagcuaggauagcuagcuggggaaaaaaaagcuaaaccucguuacauaaaacaucuuuggcauuauucucuuaucuaguaguaccuccuacugggcauuugggcguugcuuugggggcuuuucuuuuaaaacaaaagagagcucuugguuuucggcugccugcuccagcguauguguuuacaccaucgcugccuccagagauuagcauaacucccuuugcagucgggcuguuguucugagcaauaugcucuggagacauugccugucaucaugaauggugaguuggucucggagacuuuucaacuauauauuuuuaaaaaauauuuaguuguacaaggaaaaauauuuuguagacaagguuauuaaagccagagcugugguaaugaccuuuguguugaugcuuuuaaaguaggcauuauuguaaagagcccgggagagccauuaggagcuguaaacagccagugcugacagcuccagcaugccagcucugauugucucuaugguugaucucuguucacuagaacugcucuuguuuucuguauuguaaagauaaggagaauaccuauauacugcaaaggagguuuuuauuuuaguauuugguguucaagauauccauauuuaacauaacuuuaauuacuuuugucauccaaauacuauuuuuuguuagguucuuuugggcacuauuuuuuaaauacuaauucugaaaauaagaugcugccaaaauuguauugauuuuuuuuugaggguugcuuuuaauuguaaguaguuuaaaauagugaauuaaggaugaaauaaauauguauguuuuggcuuuggaggcuuuguuaaaauuaguuugggaaaaugauuuaugaaacuaaaucgcuugugaaaaauuuaucuuuugcuaugacuguuuauuuuucuuaggauguucaaaagugcuuuuauuuuuauuuuuuuuuccgagaaaaucugccauaguguguacugcagcuuaccauagggcaggagcuguucacuucaagcaaaccugcagcuaaaaauagacacacuguugucagagagaguguuugcucagagcaucacucauuagcaucucugcugagccggaaagggcugguccaggugucccuuauagggggagcauuauguggcccugugaugacaggguucuugccuaagacauguaggauuggcuucuggaucagaaaguuuuuuuaaugguauagugaaggcauucaaagccaaagaaccuugucgucauaaguagagauggcuucauuaaagggaggaaaugcucuuuauccugcugcaaucuaaaauuaccuucauguuacagaguggcguuugauacacaaggaguugucuuacaugaaaaugugaagaauugccuggacgauuacguucuuguuuccagaguagauuuucugauuuaguccuugaaauuugggcugauagugugaaaucaauguguugacauuucuuagaauucugcagauaugaaagcugguuaucaugcuauucauuuauuuggauaaagcuauguuuccuuuaaaaguuugcacauagccuuagaaucuuuaccagccacaguggugcuguuggaucuggccagcugguguuugagugggggacaucgcugcuguuccuuucucguccugagcuauggcggaaagguuugugugcuuggucauaguugccucccgacagcccuuucuaccacacacgugugcugguaacaaguagacauuggcuucuccaaggagguucaguccuaaauaaauucauuccugcugugacuugagugcucuagccauuuaaaguaugggaaauuauaaguguggcuucauuaauaaaaauaaucaaauauugggccguuuuaucugagucuaaaauuaugaugaguuucucuauguggugcauacagcuauguuuauguggaaauugcuggaaagcuuucuuuuuuccuuccugguaauucuauguucuucuucugugagaaucuaucugcucuuggcccucucagcgcugcauugucugagugaucucauuccugcccacgccucagucacuaccugagacauccauuacaagagucagcuucgucuuucucccuuaacaucugucccuuuaucucugguccucgcuucucuuagugacuccauaacccgcaugagaagaaaagcaagaaucuaggguuguuuguaacuugucacccugguuguguauaugcucauuuaguuccauugacuguacaucaggaguuuucucuaggcccaauaacacuaggaaggccuuuagaacugggcaucagucucuuuucagcggccuuacacugacuggcuucauguuucugccucuucagaugacuuuucauacugaguuuuaaauugaaauaaguccauuucuuaauacagugugaaacuugcaauucuggaauugcaaaucuggaaucuaaagauuaagcuccuuagcaaguuaggggagauccaccugugcgucauguaugaguaaugaccucccauaguuauauuccuuguagaaaucacacaaacaauaauagcuuucaguaucuccauuacaaacucugaaggugauguugcuauacuuucaaagcacaaaagcggauuauauauuugccugugagucucuggaucuuaagugaaagcuaucccuugaggacuuuaauuguucucaucugcucuuuccucucuggcaucgaaagauugcuuguaaauggaagaagagccuuggcugcccccuuguaaguugcuuucauuuggugaggauuuucucuuguuaagcaaguuuugugaaaacauuguaaaggaguucuccccaaauucaucuggguuccauacggcccuccgacuagacgacauggcacagcaugcacagcgauaggugcuguugccuuccgaggcaaaggaagagcuaagcuuugacaaggaccagcacuggcacuggugaaggagccuggaauuaaaacaccuuucuccacuuuucuuucugagaccacgugauuucauuauuuucucugugccugguguucuaucaucacagcauguagcagguugcagugcuguuuguguaagauggagcugagucaucugacacauugaguuacugugcacuccugguucacauaccaauuccuauucggaaaaccggagccagcaagcuguggagaagaaacaccagucaacagguccuuuguuacagcugauaaggggagcaagagcgggucuucuguacacgguggggugacuagagaggaugauuuugcauucuguuguuucaguggaagaagauuucuuaugaucucacugcaaaaauaggcaggaggagacagauccgcucacucugauuugcacaucacacaggacauccacuuauggaaacaucaugugacacacugcagauauguacaaauucuaggcugcucggggagccugcuuccuggugcagcucacugagcgucagugugaagaaaaagcacuaaguaaugguucucggaaguguguggaccuaagcaggagugagcagcugguucacgcccucuccucugucugaccgagaacacaugagccgaacacugaaagcgcugcuuuugcccccagugaggacggaccucuguccgaugaggacuguucuagagcggauugugcucuggauuacuugccuuccaguaagagaagcaaccauuucauccucacugauuuccugggaugaagcuugugaggaaaugagugcaggacaacacugccuguugcuucugugcuccuccuagcccuguugggacagccaggaauucauuaggucauggcaaauugaaaggauggccuuuguuuucuggauacaacagggcucucccuugcugugcuggcaccaauaccagcaaguuccuugugauccuagacacuugcacauuucuuuguuguuguuaaugagucugaguguuuugccugcuugcauguaugugacuacagcgaccagacaucagaucucccucaggaaauggagcuucagaugcuugugaaccuccaugugggugcugagaacugagccuggguccucugcaggagcagccaggacucuugacugcugaacaucuccccaaccucuacaaccacauuucugaaaguugcuggauuauuuaauuaauacacauacauaugcguauacagagaaaaauauccagaacuuaauuuuaauagcaccuauauagaaaaugagagauccaaagaaaaauacacuauguuguuuuagaucguguguaaagauuuuaaaaccuucccauuguuuguggauaaauaagcaaaaaaagaaaagaaaggaaaguggagccuauaaaaaggguuacacaugauuaaaggauaaaaucacagccuucaauaggaaaagaaugaacuuauauucagaaauauguguuuaaaaaacuacagauagcaucuaaauuaauucuucaauguuuugagugaacauaaaaucuaugaaauaagacagaggaaauaauccugaagggacuggagacauggcucagcaguuauaagccuuuucugcucagucguaaggaccugaauucaagugccagcauacaaucgucuguaauuccaacucccaaagauccauggcaccagcacacuuaugugcauguauaugcacacauacacauaggcauuugcauacacauucauaaauaaagugaaucuuuuaauaagaacaaggcugggaugaaaaaaggggcugaaaauaaaauagaaaagaagcauaauauuaugauaaggaaauaugaugagaaaauucauguggugcuugcaagauaacaggcaagcugaauuagaucaggggaguguauacugcucauuguaggaaaguaaaugaaugagguaaagagccagccucaugaagguaauggguaagaucagacuuaauguguauagccugggagguggcuccaugagaaagagugugugcaagcaugagggccugagcuaagauccaagacccacauaaaagcucagcauggcuucaugagccuguaaccacagcacugagggcagaaacugguggccagcuaugauagacaaaacaacuuucugugguucagagagugauucagucucaaagccauaagaugguggcauagguugggggugugggaguagaaugauaucucaucucuauaugcagcugcacacaugcacgcacgcaccacacgugcaugcaaccacagauaaauguaaauaagagaaauuggcaguacagccugcagucuaggcucaggagaguuugaggccagccuaagcucuucagccagauccugccucaaaauacacagaacuggugcagcaaagcccugucucagcaaacaaacagugaagccuacaaaaugaacacuauguuauauaaaagcaggcagucuacagauucacugagcaggguucacacgaggcaguaggaucagaagagaaaguaguuguuguuuguuuguuuguuuguuuuguuuuauaauuaacuaacaaaaaaaguuuuuguuuuggugccagggacccccaacagcaccaccacacaccuagcacgugggaaaacuuaaagcaaaacuuaaaagccugaaucugccaaucagaagccaucgugcuuugacaaaaucaacaagcuaucagcacuaugcgcuuucugguggcaguuuugaauuuuaagguaacaauucaauugucaaacaucuaggucucuuuacaucuuaaaaucucaugugaagcuuuccagugacgggagagaaaaaucuagaauggagaccacauaacuuaaggacucuccuguaaauguccucacaaaaacagaagauaagcccuuaagucuguccaucaugagauuuccuccagcccugugggcagucaggauccugagaagauggucaucucaguggauguguugcuuagaaaacucaaccucugcuggcacgauacacaggaaguuaacaggucuuggcuugagugccuggggucaggggugggauguguguuuguucauguaggaugccucuuccaagaaaugacaaucagcagauuccucucaaaaacauuucagguuuaauguauauuaauuuuguggucuauggacugacaauaaaacauacuguuggaaaagauccaggcugguaacacacugauaccagcagaagcaaauacaaaaccucugcuaggacaaucccuucaaguuuccuacagguaaagcaauguucaaguuuuaguucacgcuuguaagggucuggaccuugauaagagcacccaauuauuuuauuuuauaguaagaucucagagauucaagucauuuauggguccccauuuaacaucaaugacaagaagaaaugaaaaccaugugugccuccgagucucaaaaugcacaaaacacaacuggcuuauuuaggagaaauuauaaaauauaaaauuuauacauuuuauauauauauagagagagaguucucaaaaauauauaaaacaagacuggccuauaugggaaaaauuauaaaauauaaaauuuauagauuuuauauauagagagauuucuuauagucauaaagagaauaaggagaaauauaaagacugcuuauuacauagucaacaaauuccaaagaguggagauauauuuacuuacuuauaauauuugacauagaguaauugaguuuagucaauaaaggcucauuaauaaacaaaaauauguuugcuuauuuucuuaggguuuuacuggugugaacagaccccaugaccaagggaagucuuacaaaggacaacauuuaauuggggcuggcuuacagguucagaaguucaauccaguaucaucaggaacauggcaauauccggacaguucaguaggagcugagaguucuacaucuucaucugaaggcugcuagcagaauacuagcuuccaggcagcuaggaugagggcccacacccacagugccaauucuacuccaacaaggccacaccuacuccaacagggucacgccuucuaauagugcuacucccugggccaagcauauacaaacuaucacacuuuauggacuuagaaaauaccaguaaaucaugagccaauaauuaacuuugaugaauuaaaauucaacuacauauugaaauuuauaguguagcuaaaauggauuuugagcucauuuuuuaggauagcuugugaaguguuuaggaaaagaacuguguaagcagaucaguuggugaagauccagcacagauaagucagaacuuggggugugggaggggugaauaacaaacaugagugaaagguuguagaauagaaaguauagacaagagcuaaaucuuuucauggaaaccauuuuuaaagaagagauuaaagcuauacccaccccagcuguggguucuaagaucccagugguagagagucuugaauugucugaguagcagucacuuaugaauaaugacaguucuggcucuugccuuuuucuuaucuuacucuuagucuuuuuuuuuuuuuaauuauuuguuuacauuucaaauguccccuucccaguuuacccuccacaaacaccccgcccuauuccccuccccuuugccuuaauagagugcuaacccguccacucccaccucacccucuagcauccuccuucucuaggguauggagcccccacaggaccaagccccuccccuccaugguccugacugacagugcagaggugaggagcagugggcaugggcaucuuucccuugauguagcugcagacaagauguuccagguucaugcuucuugcuuuccugucugucuaagacaauguacuucuguuguacaagaucaccucggccugcaguguccucucuuacaaccuugccagucagagcaacucuuuagacuucaaaauucggcacgaaugugucuucugugauguuucagcuuacuguccaagugauacacauucacauaucuuaugucccuacuacaacuuucucagcuucaugguguuagauuuauuaucuguaagauauuacauaaaacaacauaaaauuaaaucauuugcuuuaucacaaaaauguuuuauuuuuaaguauuaaaccaaaauacuuaaaaauauaaaaauaaaaacaugcaaauaacugaauaggaagaauaauaguaaaugcuuguuuuauuaaaaaggaguugccuaccagcugugucugaagaggaaggagaaccauguguaugaaaacugagugauucuuaaacuacacuuauagagcgcuauguuaggauagagccauuuauauguauuuguuccaaaauauugguagaaauaagauguuaauguaaaaacucauuuauuuggcuacauauauuuaaauaguacacuuuaaaggauaaauaaaacuaacaacuguuugauaccaaaauuuguuucauuuuaauuuuccuuaaaauuacgagugcuaucagaguuugcaagaggcucuugguugaagaguggcuuuugaaaagauacaguuugagugaaacaauauuuaguugugcuuuugcuguaggcaguuuauagucugaggguuuguuuucucuguccccucucuuguuuucuaauacacguugacugacucuuguccuucuauuguaugaggugugauggggaggaugagaugcaucuugugagagacucuagaggucagcaucuagagcacagugucucaucuuccguauaaauguacacguucugcacaugagacggccaugaugauaucuggcagguagaccuugcacagugugacucacggcguggcaugacagauuagcagcuguucaguuuauccaguacagagccauguggguuuguucacggucacuacugaaacauucuuguucauugucaaacuaugugaacugcguagguaaaauuauaccauacuugaagugcuaguuaaauuuccuauuuaaaaugaacucuaggcugggcaugguggcgcacgccuuugaucccagcacuugagaggcagaggcagggggaucucugaguucaaguccagccuggucuacagagugaguuccaggacagccagggcuacacagagagacccugucuuguaaaaccaaaaaaaaaaaaaaaagagagagagagagagagagagagagaucugacucuaaguugugacuugcuuccaacuaauguacaaagacaucggugcuggcaacagaaggugcugagaaaugaguuucuuuuuuucuguaacuggaagcccaugagacuugucucuuuuugcaucuuuccucauaucuuggguaggugacuaagaaacccuggguaagcauauagauucauuugguaugcucuuuuagaguacaacauuguagauucuagaaaugacaaaaauugaagagaaaauuauuuuauuuggguaaguaaaauuguccaugaaugaauugauugaguuuuugguguguccucuuuugcuccauuauuaaacaauacagagcaaaacacaauugcagaaaaaacguucccugaaguguugguucuaaggauagucgucaguuaguuagaagcuuugcugaagguuccugaucacacagcuaugacguauuccaaagacuguauuagccugucucacugcuucaaaugguuaaauguauauacagaucauguaauagaagagaacugaacaucgagaaccucgcagugcuugcuuuauggcccguugaauggaaugggguccagugugugagccugaguaccaucccucccucugcuucacuaccugcuaacaucucaguggguagcaagguuggcagugccuaucgaaaagcaguuagacguuaaauccacccaugucugaagauaauagacgaccauggcaaaucccugugaauugucuguuguuuaaagaucaauuaaagagaaucaaucgcaacuauuuuauugagagcugauuauauuugucuuuguaucuaaauaguguacauacaugcuagaaauuccauguuuguacauacugcauaugacaaaagcguguuucaggaacagccuucuucaugguauuauuuacauuauaacugauauauccucaauucuaaaagaaaaugccuuuauauguuaaaaugguacuagaacuuacuauuuuaccaguguguaguaugcaucuuaguaaaacuuuucuggcucuuugcuugcccagugugacuugucaguaaacuuagacugcucaugagugcggagaauauuucaaagcacaagugaauccuggguagcaucaaagccugucuccuggagcucaucacgggcacaggagaagagacuguuguguguccccgcacaggucuuugucaucugugcucacugcucacucgccuccguucccuucaacccuccucaggguaacacaagagcaggcucucucucucucuccccacuucucccuucucuggucgaugugaacucagcagguaucuggagaguuugcaccauaacuucacaguucuguuauacaugggaacugaaauauuuuucagaagaaauuuagagauguauuauuuucauuuucagaaucaccaaauagggcuuuuuuuuuuccagaaaccacaguuauauauccugauguguuuuguuucuaauuuaacuuacacccauuauuuccaagucaugggcaugugcagacaucucuauuccaugaacacaaaacaaauaaacaaaaaacuuaguuauaagauacaaagccagccuuuuugagccugggauggagcuuagugguaagaaacaugccagucaguucaugugagagccccugguuggaguccuggagcagacacaaaacaagcgagcgcucuccaugccgcuagcauaccaacuucccaaagaucagaguucagacuacaacccaaagccucuugacuuuuccaguccuaaaaugaauuagaucauguguugauaauuauauguaucaguuaauuuacuguuuugguacaugagaauuuuaacucugaaaguuaauuuucucuaauuuuuaaaauaaguauuuugcaaauucuguaugauacaauacuuagaaagucguaaagugcuauuuccagaaaugcauaagcggcguucucucaaaacuaccguuuauuauugauguuccucauuguccgcauauuaaaauggcagaacagaauggcaagcgccaucuugguuugugcugggccauagguguuguccuguagagaaaacaagacaguguaaugcacaccguaaguaucaggucccugcugugcacgccgggucucugcuuugcccuauuuggggauuugauaggaacauuuguuguuguuugugugagacagaguccuugcccuauagccuagccuugccuagaaaucacaguguagcccaggcuggucuugaacauacacuguagugcacccaucucagccuucgacaaacugggauugcagaccccaucaugccuagcgugauucuggcuguauuccagccacucuuuguuucuaaaguaguggcugaugcaacagcucaucucccccagcaucuuacuguucuguggccugucacccugcucucuccuccauugagccacgcagggaaaugccaggauucugcugaacaaaagauauaguaaagggaucuuguguaauccaauuguauucucauuuuuuacauaaaaauaagaauauaucauuuuuaaauguuuacaguuauuuguuucuaaaccaucaaaaauuuguuuaaaaacagaagcccuuguuagugaauuugugggaggaguguguaaacaggacauacucuuaagugacucaucuuugguuaacaaauuuaacaauauaaaccacagcucuacaaauacagcuauuauuaacuaccauauaaacaucugcuucuguuugacuuuauuuuaauguaaaauuuaaaucagacauucaguuuaauuuuuguuauaaguucacagcuaguuuuuaaaguaguuuguauuguaauuaguguuuuguuccuuuuggguuuuauggguuuguagauccugucuguaccuguuagucugugguuucuccgcugcucucugcugguggagagaccacagaucuaaugcacacagccuguaccuggaacugccuuuucccacaaccaguucucagguugacuauccucagcucgagcuccagcuuccauuaaccccacucacggcuuagucagucacuagguugucaucaguugauagcuuguacacaaccucaguauguuuucugagcauuguggugacuggguaugauggugucagagugggcccuauguagagcaaucguugaggccuuuagaaauggagacaccaguagcccccugggcugucacacugagggaugcacguguccuuacaacaguugcucacacaaggauaucuguguuucauauagccacaugggaugugucuucuuuaugcaauauacgcauucuuaccagacacugucuauuuucuuuucuuuuuuccagugaaagaguuucuagccaaagccaaagaagacuuucugaggaaaugggagaacccucccccgguaaggaagcuguaugcuuuucugcaauuggaagugaauucaugauucuuguuuaacuuguugcuacuucgcaaauuuuaguuuuuaaguguuaauaguaaacauaugauaugguggaaauuccaccauaaugcugugcuauaauucauuaauuuauaauuuuauggauaccuacaucggagaagcagccaucuucucauagaaucccucaaggggggaguuugguuguuucauuucuuggcacagccugggaauugaacacagggccucguauaccagacaaaauuuccaccaccaagcuauaugcuaagacuguuguguugauacuaauuccaaauugcuauaauauaagguaaauacuuccugaaauauuuuuaguucuacuauuugucacaugaaacauuaaaaaggcggcaaggagggcauucuuuuccgcuaugaagaaaagcagugaucagacaugaagagauggcuucuuguacacuguuuguucgagcuacuugacugugacugcauuagccagugcaauccuccugugucaggaaaaccaacaacuaaccacacguuaauucaaucagaauuauaaggauuuuuauuuuugauaauaauuucccuaaaugugaaaugaacauacagugcaaacacauuuauaaguaaaauauaauauuguuuuccuucuguaaugauucaguaagaugucucuucaaagcagcauuuguguuacuguggagauuaaaugacugcaguggacacugcacauagaagagccgugucacaucagacuuagcucaggcuaaggcugcagauugagccucggaaacacucucugagauuuuccuggguguuuucauaacgaagccuagugaacagaugggucagcaauuacuacuuguugcuagcacauaauuuguuccuagcaauuuaguuuuguuguagcagcaacaaauugaauagauugaugccucuaauuuuuugcuucuguguacuagucaaagccaaacaaagauguuugcuuaacaaagcaucuauucaacuaggagaagaaucugauuauuguucugagacucuggcuucgggucuuugugcaaugaagacauuucuucccuuccuguuuuagguaaugcuggauucucacaaucaaggagaaagucugggaccauacacuggucugagaccauuaccuaguucuaugacucuuaccaagcccuaaggcuguuagcuaguuuuacagcugcuaccuaguucuaugacuagugcuuacuucugcagcugaugucugguuguuugacuuucaucuaguacuauggguauugucuaguuaugcagacacaauaccacuuuucguggaggcaugaaacuuaucucucaguuuucauuuguacaguuauuuacagauauucuuugaccacacauguuauuugacuauagguuuauaauuuuuuuuuauuuuguuuugguuuuuuuugguuuuuucgagacaggguuucucuguauagcccuggcuguccuggagcuuacuuuguagaccaggcaggccucgaacucagaaauccgccugccucugccucccgagugcugggauuaaaggagugcgccaccaugcccggcggguuuauaauucuuaaaauguacuaguaauucauuagcuguguuaggggcucacauuggaagugaaauaugaccauuaauauuuuauccaaggcucuuauuuccuucauuuuuauacuccacuuuacagaguuuucuuuauuauuggacuuuuauuaaucaaaggagaauauagaauuaauggccugaaauuuaaagaguauauaugcauuguuucuacauggauaguuacaaauuaaauuguuuacccugauuauagaacacugaagugauaauaauuguagucuuaugggaauuucuaauuuaaaaccuuauuauauuuuuuaauacuuguauagaguaaugcugggcuugaggauuuugagaggaagaaaacccucgggacggguuccuuuggaagagucauguuggugaagcauaaagccacugagcaguacuacgccaugaagaucuuagacaagcagaagguuggugaccccguggccuacccccuucacuuuaaaauccagucagugagaaugccugccacugacaccuucaaaugauacuugagguugcuguuugcgauuguauuauuuauuaugacuuuguuaugaaguaguuaugugggauuuagugucugagaacaugucauuucuauaauucucaauagauaacacaugauucauaugugcacgaacaguaugggauccauaugugcagaacaaguaccccucacgcugcacuugcagaccagcuauuaacggaagcuccugacuuuaguucaugcuccuccauugcaguuuaaagcugccuuacugacgugccuggguuugaucaauuuaaaaugucagucaaauuguggaaaagcuguaaaaccuauauuguacguaaaagaacuucucguuguuucugagccaguauaauaaucagguugucugaggcaccuaggacuuacgaaccuuaacuaguaagcguugucuugucaucacguaacaacuuaggcaaaagcagaggaauacuggugcguguucuuagugcuugccuuagacagacuggcuucugggccgacagggauccuacuagaaaacuguuagcagaagaguggggauagccaagggacagacauguaacugaccugugggaaugugugccagggaacagauguggaguaacuuuguccucuaguaauagaaagaagcucugcuucugacucuacauuaccuaagaaccauaccauauuuuaagaaauaagaaauagauuuuaaaggcugguuuguuuaauggcccaguguuuaaugcuuaacaaauauagaauuauugugguucauacuaagauuucaaaaucuguuguguauuuuacauuuugauuagccauauuuuauguuaaauaacuacacauguugggcaccauagcaucagacugucccaaccuucauuuuaauugaaacuagauuaaucucucacaugaaaaacaaauacuggcuuacaucucuguggaauuaaugguaaugauacacacaucauugucagcugcccucagucacacauauucgaacuguucuucuuaaacagugguuucacuaacucacuuccugacuauucuaaccccacacuucagauguuccuaaucugucuucucacugucuuccugcaugucucugccaagggucaccaagcuaguaaccaaaucaccaacuccagagcccucugcuuaucuuacuuggcuuuucuuggaguaggugaccauuguggccucuccuccugacauggucccaugccagccccucgaagugggccucucuccugauccugucccuacuucuggggacuuccuaacauuucuuuuccucucuucauuuuauuucucccauguucuuugagaauuucauuucucuaggcucuagacuggugcucucucucucucuuuuucucucucucucucucuguccaccugccccccacccugucugugugucugugucugucugucugucugucugucucucccuuugcucauguuaccuuuucuccuuauauauucuuauccaacaaccucaacccuuucucgggggcuuuguuccuaagcuguacagucugagugcgcaugcgcuuccccggcuguuuacuuccugucucuauucugaugaugagguuguggaucucaaaggguuaccagcucaccugcucacacugggaacaaaaaacaagaggcuucagcuucagcuuuuauuuauaaacuugucauuauaguguguauuaaauacugucagaauagcuucuaauauguuaucuuucuuaaagaauucauaaaaugcuuuauuucaaagaaaagguaaugauauuuaccaugcucauuuuuaaaauauuuggaaagacauauuuagcuucuccuuuucguccuuuagaaccugugaaguaauuacuaagguggcugccucaccucguggauaagucaugggcaugggcaugggaguuugcagaaaaguaacugcaaguugaugucauuucuguuacugcaauacacugugucuuggcauaaaucacugugaaaacuuuuauauuuggauuuuuguuuauuuaauuugcuugagauaaguaauaaaauaacaagcuauaauaacccuuuuugucaguaagaucauaaaaaucauucaguuagcuaugcuuagcuucucuggccuuagaguccaugggauuaaaaucaguacagaaauugaggcagucacauuacuucuuucuacagugcgucagauacugcuagcauacacacacacacacacacacacaggagcacaggcaagcauauguacacaugugcaaauauucacacaugucugcauauauacacacauguaacaagcaugugccaguuguaucaguaagucuucacaguugcaugugguauuguugucccuuuucuaagcuaaccacugcgcgacauuauuucccagugucugacagcuaguaagguagacuaggaugcuggccgagguuuauccgauuucaugccguacuccucuucauugucucuuuaaaauguacuuuaucuccaagagucuuccuuguuugaugcccagucaaugucagcuaguuuuuuuauagcaacaccaugauuugcaagcucuagacuucuuucuuguauuuccuuccucucugacacagauuuuuuacucuaccauagcauuucuuugacucaucugaaagccugugacauuuauuaaguuuauuaaguccgaguugagcucuagcuuccccuacuuccuagccugucauaauugucucccaaacuacacaggagucucucaccucaugccgucauacgugcucucuguggcuacuucucugauugaaaggauacacgauuuucugaggggaaggggaugcuguguggcccauauaugaauuuugaagcuaauauaggaacuuuaucuaaaguuuucucugacacguucuuuaccacguuuucagaagcaccgucuauccuuaagcauccaucgcuaaaagaaaucaucauucuugcuugucuccgcguguuuucccuccugggacugguucuagggguaaccugaacccagcuuuucuuccagcucuccugauaacuagcuuuuaaagucaucucagcucuuauuguuuuuuuuaaauaaguuguaguaacagcugacuuuuuuuuugagcuuuacugugugucaggcaguaaauuaaccacgugacuugugucauauaccaugacauuuuaaagcaucauaauuuuagaaaugaagauucuguccucagccucaaguaagcaguuucucugcugacagcuuaugaaaucauggcugucauuugccggccgcucauggauugcuauuuacagguaaauccucugcagcaugaaggcagacacuucuuaaccugucccuucagugucauuguugaugguguauauauaguagauaagcacaauugaaagucaauucaguuuaaguagcuaauuauuuaaacuuuuacauuaaaaaguggcuaagcauauaugccuuaccaguuuauauauuuugaauuaaugucuaucuuaaucauauuauaucucaugugaauauaguugacuucuuugaucuuuaauuuucugcuacuuacugagauaaugauuugaucauguuguuagcagcaaauauuuuucaaauaguaccuuuuaaaguaaugggucugcuuuuuguuccuauuuaacccuuguuuuuaacuugauuuacaguugacuguguuuuguuuuguuuuguuuugggacgguaucucacuacauagccuaaacuagccuugaauuuaugguacucuuccugagucuuccucccguguguugggauaguagacacacuucagcacagcuggagcauaccugcccagaagauagaggcugggacucugcuaggcugcaaacuugacucuuaccacccugguuguuacuauuuucuuuauugaggucuaguaauccuguucauccguugugauuauuacaugcaagauauuuuucuuugaaaugauaacaacauuuaaauuuguugaaauacacugacgucugugucuuccccuugcagguuguuaagcugaagcaaauagagcacacucugaaugagaagagaauccugcaggccguggaguucccguuccuugugcggcuggaguacucuuuuaaggucaguugccccauuaggaaauaccuaaugaagguauuuccacccagauaugcuuuuggcacgugaaacaguaggagaagccuggugaaaugauaaaacuagagaguggacgugagcaaacacucuaagcccuggauugugugugaucagcccguugugcuugugagcuggggcaacguugagggaguccugcuucuuucuggaucagugaugcacggguggacaucuuccuagucagucuuaugcucauucaaaugaagaugcuacgcauguucugcagagcguaaacccuuccugugacggccuggagauuuuccuucguguacugauuuguacucugggcuuuuguggcuuuauuguugcuguugcuuugcuaaccaggagaacgaccucugugccacuguugcuaagucagcuaaaguggagguggauccuucaaauccgcgcugcccugguucuguggagugacgcuucucaggacugcugagcacaggcggcaccuugcuccugccuaguccuuaacauagacagccauccagcuuucaaacagaaaaugucaauagucuuauuagcuuuuccaaauuguuuucaauguuauuauuucuuugcauaugcugugcuaguaugucauuguuguaauauuucauuauucugaauuaaauguccccuucaagaagaggaacagcaaaagucucagguuucuuuguggcuggaauacuaagggggucgagaugaguguggaaaacuagagcacuuuuuauuucgugucucucccacucauuucuauugaucuguuaaauggauuuugacuuugcccuuucuaauugaacaugcugucaucuuaaaauguuuuauaauugguacuuguuauuuguucauaggauaauucuaauuuauacaugguuauggaauacgucccugggggagagauguucucacaucugagaagaauuggaagguucagguaacgcacgcgcgcgcgcacguccuccuccugagucuucccaugcuugcauuuacuuuaagccaaaacacaucugagucaauuaacucauuuuauccauaggaaguacuaggugagcacagcaauaggaagcuaugacagauaugagcuuuacauuucaaaugagagcaccaugaaacuaauuuaaauauucuuccacugguaaguagugugaccugauuugaagaauuucuaaaaauaaaaaauuuaaauuuaaaaaaccaacauguuuugaaaaaaaauaauaguauuugagauauauaacaacacaugcuaugugacuccuaauaauacuuagugggcauuuauaacaaauuugauugagcgaauaugaggaagaagacauaaaaguaauagugaucauggugauggaugagguuguguuauaaagucuuuuuagacuuauauuaaagcuuuucucauguggaguuccuuaaauguauauacaaauugcauacacaauuauauuuacauauauaauuaguaaugugccaaguuuuuacuaacaugcuucaauuuuuaucuauguacaagguucauagcgacaacuguuaauuaguaaucauuuauaaaauguaucuuaagauuaagaccagaauaaguuucacucaguauucagaauucaguuaaacggaagugugaguuuccguggacugaugacugacucauagaucguagaguugugucaucacaagagaauaacacagaagcagccauuuguuaugugagcugccugagccuaagccaagaugcauucauugaccuuuagugcaagggaaaccuagugcauggagacuguagugaaauguggcuucucuuugacauugaugaucuucuuuuacguccugucuucaccucuuuccaaucacccugucugugguucugcuccguucuuuguucugugacucuaaggaagcccuauauacuuaaaguauugcaaccaugcccuugucccuguuguccuucugugcuuacacugaaaugccacgcccaaaccuguccuuuucuguaagcccuugucucuuuccugugaggcugccccaccugcagccguaagaaaagcaagcugacuagaaugaucccugagcucucauuugcuguaugugaacccuaagcacugcauuuucuuacaaggggacuuaaguaauggcucagugugacuuuuaucagucuagucagucauuugagucuugacuuagacugguucuucacuuaaagcugcuuuaaugcauugcauuuagaauauguucuugcauuucaacauuuugauuacuggauugguacauucucuguauuucuucacacaagcauuagguugaauaaacaaauaaaggcgacaccaagcagaccucauaguuacagaugaggagagaagauauaauggggucuuccagaucaaauucucagggcuucaugccccaaaccagggaggagucccccaauaucuacuccagagccccccucauucuuuauuuucuuguugggaccuggcugaaacuggagaggcaauguaaaauaccucugcuuguuccaaaaauuagccaguuuuucuugggcaccugaagugaguguggcaaggaaggaccugugggcuaugcugaugggcacaaagagcagcagguguccacguccucuuagguaucucugauucugcugccaucccuugaaauucuaucaguaauugagguuguuuauuaaagacacaagucugaaaaucauaaaaaauuaucagacagauuagcaaacacucaaugaauguuuuugaaaauuaacuacaaauuccaauuagaaauuugguauaccauuuucaaauaauucuaagguuauagcaugaaaauugcacuaaugucagaguuucuagauauaugacuuagguacagauugugucuaugugacuauaaacgugcccgguuggagauuaggaaacuugagugacaagauugccuguauaguucuagaugggauuguguguguucuuaccaggauuuuauaugaugccgagugugugccagucagugaauaggggacaguguugaucuucagaugaaugcagcuaagcaguucuguauaaugaaacuccuuaaaccccugagcugugguaggaaagugaguggagccugggaccugggaacugcggugggggcucuucuagaccauccucucaagggcagcuguauuuacaauggcaucaccagcucccaguuugggcaaugauaacuugcaauaagauguguuauuugaaggcaauagauguuuggaaaaugacaaauuuuucaccaauauuugaauaaggaaacccucuccccaaaugcauccacuccguuugcauuuaguguauaauccacgagcgagcauucuucacccguuucuacaggaaacugcuuucucuuuuccagugagccccacgcccguuucuaugcagcccagauugugcuaacauuugaguaccuucauucccucgaccucaucuacagagaucucaagccggaaaaccucuuaauugaccaccaggguuacauccagguaggauuggaucccauggcauggaugcauuuggcagacacugaaauagcuucacacaucuugccucaacugucaguguuugauggguggguugguugguuggcugguuggucguuugguuugguuugaaggagaaaguugguucuaucuaaaaggcuugaagugagcugacagcucugccuuuacagguguguacaucacucaugaaggaggggaggggccuguuuguauccccuagaaucaguggcugugagcuaagcuuaggcuccugccaaaagaaacaguguggcuaacugugugaguagucgugggugccggaaauccugucuguguagcucuagucucucagucugaaaaccccaaucaaaacugguccagucggaaauccguuuguauauugacgucucacccuaaguggagaauugcucaggugacuucaugggacagugugaucagagucaggcgcccugaugagaguguuugcaguuccuccaggcugugaccgugcaucgucuacagaacaugaauucuguggcugccuccucaccaggaucucgaugcucauuuggaauuauuaaaaaaaaaaaaacuggaaaaauccaaacuuugaagcacucuugguaccuaauacuuuggauaagcaauagucaaucuguguugccucuuuuaauacuaauauuaaccaugugaauuauaaauacuccuaaucucaaaguuaaugugucucagucauggccagguacauagucaggaauggaagaauuagaauuuuaacccagaaagucuagcaauguuuaccacucaaauucgugacuggcugggaccuaacugcagacacagcaguuaauggguaucuuuucucuaguuccuuuaauagcuugaggccacggcuuucuagggcuuaccugucagaaguguguccgcagaggaugacccaugucacgggcagagccaggcaggacuuuggggugucucaccagcacuuacuguguacugggccucuaccuuugcuccuccuguucacuugugaggugcauaggucuguguccugccacacgagaguuguuuuuguuuugagaagagaugggguuucaugaauuacuguuaaucguguggacuuuuuuuucauguauauuauuuuaauccugaauucuuaacuuuggauuugaguacaggaccucuguacucugugagugaguuuucacauuccuguuucccuucauaggucacagauuucggguucgccaaaagagucaagggcaggacauggacauuguguggcaccccagaguaccuggccccggagaucauccucagcaagguacuggguaugacuggcacacacaggcagaagcuugaaguccuuuaaguuauaagggggaguggguggguaggggauuggggggguggguaugggggaccuuugggauagcauugaaaauguaaacgaggaaaauaccuaauuaaaaaaaaaaguuauaaauccaaaccugcuggggcagucugccuagcgcuggucacacaucucuaaguuguguuaguuuugacucugaguccugaugaagcagaguaaugacucaacccucagugcagcccaggcaguccugguucuuccagccaggaagggucccagugcagagggcuuguuccaggcccuucccagaugcugagcuagagacaaggugggucagcugacagcucuuccuuucuuucaaacucaccaccuaagcgaagggaugucugaaacaucuuaacaacaaggugagcuuugucauuccguuguaaucugcaguuggcacagaccaaugcugcaugaauggauucuguauugagaauguguugacuuuuacacauugcucagcgugugcuuuuuagugagcuugauagagcacguggcaaacggagcaggucagcgccucugacuggucuuccucacaguguacucuguaagcaugccuuucccuggguacacugcucacgcagccuaugcaggaggugaaacauggagacaagcaaguagcaaacuucacauguacuuggacacuacugcugauuagaggccacaguaaauuuuaaguuuucagaaaauauggaaauagaugugacuaugucaaguguuucugccuuccagaccccagaauguaggcuguucggaaguugguuccaucuuuugcuauuccaauaauccuauuuuguuuuagaauuucugacuucccuagcuagacuguugcacaccuaaugcauagggcuguggccuagguugggccucgagcggcacuuugcucuaauucccuuucugcugucaguguuauucucagugauuuuuaggacucagauuuaacaguucuucccaauaacacauuccaauaucuggaaauucuuugcuucauuuaauuaaacuugcccugauagguuuuauucauuuaucauauucuguucuacacaguugcuaaaaacugcuacagucauguucauacauuuccagaucauuuugaaaucacuggugucuuaguguucgcugauguugcucuaucccaggguuacaauaaggcgguggacuggugggcacugggcgugcugaucuaugagauggcugcuggcuacccuccauucuuugcugaccagccaauucagaucuaugagaagauugucucuggaaagguaagucucauuacuucuucccccggagcucugcgugaaguuaaagcugcagauucgagccauaucgugaugucaggucacugccccaagcagccgggagguagagacucuguaucgaugcuccucuagacuaaagagcuccugugcaaccaggucagcagggucagaagaaggagccagcuaccugugagugcagucgcucucaguauuccuguaaaccagaccuaaccucacgugaaguuauacuuagaguuuuaggagcugucuuuauauaacugcucuaaaaauagaugucuuauuugaauuacaucaaaauuaaaagucaaaauaacuuggaugggccuuuucaaagaagaauucacagaauugaguucaacagaauugaguauguuuaaugggauuauaauuggugcugauuuuuagcaaguaggaaauaaugacccuugaucauuuguggacugagcauguaacacucuccaaaauuacuccauaaacuuuucuuuugcacuuuuagucucuaauuuuucuuccaaaaguauuugcuuaaagucauuacuucucaccuuagcucaugcuugagacuuuucuggaauuacuccuuccguuuucaguagagaaggaacgcaagcauuggaagcuuugggaguugagagauagcucugcaggaaagggcccugaguucacagacagaagaaggcacucaugugcccuccccccacagaaagaaggccauguaauuaacuucuggauucacaggaggaggcacccugcuuagcacuuaccccacaccccucacucacccuuuuguuuuuauugaagaauggaccuguggcucuaacuaauaucgcccuggggugcauacauuuaccguuuuuugguuauuguuguauuuuaugacccucguaggcagagauaaagcugaucagcauggaaguaaagucuccauuucuuucuaaccaaccggauccacacucggcauuuuggaaagcugagccuagcaucaaugaguuuaaauuuuacaauguuaaauauucacaagguaccaugaauauccaauaacguaguaauuuauccuuuaugcuaggauccaaauuuaaauuaauugcagccacaaugagacugcuaggaaagacucaguagacugucuauccagcaauuggggguuacugcucuacauagcauugucauuuccaaaucucacaguguguaugcucucuaugagaguuaggagaauuuuuuccugguauuuuauuacauuuucuugagaugccuucaugccagaauagaauuuacaaauuagugggcuuaccaucgacauuaaccuuaacuuugucacagguaaaaagcaaauaccucuugcaaguaaauaagcugagacuaguguucaaagaggaacaguguugacaugaugcaggcaguggauugcagccuuucuucugagggacaggagcucugcuggucuaguuacacuugauccucuguaccgcagggcucucagccaucacgguuguuaucucaguaugaaagucaccguaagaucauuuaguauacacgaagggaagcauggugggaaagcugguagagaaggaagugacgcuguuugaagaaggcugggcaagagagacuacucaccucacuggacuugcagagcuccagggcgugguucccagcauccacauggcagcucagggccucuggucacucaaguucugggggaaucugaugcuaacccugaccuccacaggcuucugcacacaagauacaaauaaagucacgcaggugcacacgcgugugcaugaaaagaacacgucagugagucuuuaaaaagaaagaaugggaaaaguaaauucuauucagaagagaauaagagcccaaggucaugaagacgguugagaaagcugaaauauauaaaacuauaagaggaggauauuuuauuaauauagaguagaaauauagccagaacagaaauuuggaaauuauaggaauguuuuaaauaauuuaauggagguaauuauaaaauuccugaaccuuuacuauacaacuuuuauuucuucuucauaaaagaaaucaaauuauaacaaagaugcuguguaaacuaaauuuauguuuacuuagaacaguugcuccaguuaaaacaaaugcaugugucuugguaugauuggccucaguuugacggucguucucccuuggguaauaugauuuuggcuguuugugaauuuuuuuauuuuaugucuaauuuuaauauuuuguauucaauaagugaauauguucuaaauagauaaccauguaaaauguaaucacacuuuuaaaauagcauaauauaugacaucauuguaggaugguuuucaucauuuauuuggaaguacagcagauguucgaugcugucguauucagcugaagguuugauccucuccccuuguuaguuucuaccauuucccugucgaaggucacaugccauguuaccaccucaucauuuuagaaucuguaacgauguaacauacaagucauaguccccaguucucccauaaugcuguuucaacuucagauccaagcagaaggcugucuguccauacugcaagacugucacugccucuauuaguacacaaaauccaaauuggauguuaacuagcuuuuaauuuucauagcucaucucauuaaaauccaauuuuagucuuauauuuggguauucuauauuuguaguuuuaauuucaauuugguuguuaugccaggaaagguggugugugccugugcucuuaacacugggagaacagggaagauguuaaggagccuaagagcaaacugggcuccgugcaguaacagcagaaaggaacaaaaggaauagcagcaaguuacucaauacgauaauauuacauccuagccugaaaccguguuguaaaauaggugcaauguuaaaauuaaaaaaaaauuauuaagugauuaauucacuuauauacauacauuugaauauugaauuguuaagcaauuucucuauuacaguauuuuaacccaaacuaguauuuuuaagugcacagaaugauagauggucagucagcuuuuauacucucgccugcccauauuuugccuuugaaaaacagaggagguggcauuuaaaugucagauuauucaugacuauuaagauucagggaaaugcaguuaagagaaaggauuugcaauccugcagugacugugcccauccuagcaaugcaugaacuguguuucuguauauagucuuuauauuugaugccuguaugccaguaguguauaaucagagucaaguaugguuuccauggcaacccuaucuggcuguguugcuaaugggaauauaaaaaucaauauuguguucaaaaaugguaugugagaacagaauaaucaaguagcagcuguuacagaaaaccuaauucuagagucuuugacuuacguacuggaaaaauaucuuagguuuacuauauauaauguaaauauuugucuguucuucaugagcagcaagauaccgcaggaaauguagaaguauauacgucaauguauacugaucagggaguucauuaauauuugcugaagggacauuagcauucacaugauagauaacugauuaguagcccaaaggucauucccucugcuaauggauccuaaaaucucucuccagguucaguaacucugugaggacucagaaggcccagcacauauugguaguuggguuuagauuugugacagucaugagguagauaggagaccaggcacagacagguaggccaccuguggaccgcaggggugcauuuuacugccucaacaucaauucaccgaagcucacacaugugaaguguuacauaucagugccagccaugggagacucaguguucuuacuggcagcuugucacccauguacccucuccuuaucacacaaugccguccuggacucugagagugacagcucacauucagacaaaccaugugucuguagauaugugcaccaaaagccaacuguacuucagggcaguuuccuacaguaccacugguaccacucgcucaagguccugacaaacacagaacuuggaagcaagguuaaaccuagggcuucaugcauucuagaaaagcgcucuacuagcugagccacgucccuggccccuaaauguuguguuugugaaauaaaaagcaaucgugcugucuucaugaaauccaggccauuuuuugccauuucguucuggugacuuacuggucgucaggacuugcuuccagauagucucuuacuggucugcuagcagacaguuauaacacugacugcuuugggggaggggaaggaaggaggagugaccaguagcccugugcacccaucugcagacuuacuguacucccuuagagacaccacagccaugguacuguauuuacagcugugcuuuccugccccagcccucguuccacugaugggaugcaggcugauucccuuucccaugaggaccacagguaaugugaauauugacacauguauagaaagccuaggguaugaaaaugcuuuaucuuugagaauuuaauuaauguauaacuuuuuuccugcuaaauaaauccuuuauugagauugcaauagcugauuuagagaaauaguuucuuaaaacguaaucuagugugcugugaccggaaguuaauagagugccacuuggugcucuucuaugaggcgcuuuaaccccagcaagucuauucggagcacagaaauuuaccaguuauauaaucuuuccccugugacaauaacuguagaauacuaacaagaugcucccaccauuagccagaaaucaauuuuauaacuucugauauucugugaagacaaauuugauucagaauuauuuuauugcuagaugggaggagggucaguaagacuaauuagugaauauaaguuauagauaccaugacaacaugcaaugacuugcuuuuuaaauguuacuucaccuuugagaaauaaauuuacacaucuaaguuuguagaaaauaaugguuauuuuaaaauugaaaagcacgagacuguaauugguuccaagagcacaagaaucugucaggccuguucaccccgagcugagugcuccauggaugugcuccaugggauguguuacaagucacacacagcgcugauccuagaaaacauggcuagggucagccauuuucuccuauucuaucaaaguuucggcaugacuguauuucaguauuuuggaaacauuaaauuaugcuuuccuaucaucuaggcuucuucuuugauuaaagugguaucuaauggaaacgcuuaaagaugugggaagugcauuacuauugggcauaacgaaaguugcuuuuauaaauguuaggcuuuuucauacugucaaguaaaaucuguuuccuccuauuauaauuggacagauugaaggguuuucuauaggccauagacuauguauauaauccaaguugagacugaaagucaggauauuucuucugacccgagugcuguagaugucugucacccuugcugcucaggagauugaggcaggaugcucgcuggaccccaggagcgaggccauucugggcagcaucgcaggagccuaccuuugcagucaggaguugagaacauacaagaaauagcuugagagcuuuuguagcuugugagucugugucccccacacaggggagacgguucggcugugcuuuugaauacacguuuaccuguccacugccaccacuguuaccuuacauaagccacuagagcggcugguuccuugaaaacaagucccauccugucacuucuacaaaacccugugauggaaggcugcagcuacagucuaagguuacauuccaucucagcaugcuuccggcccuggguucaggccccagagccaaaaccaaagugauaaaggaaaaacccuuuuccuugauuuccauagucuucagaguaaaagucugcgaggagugauauaaaacucuaggauccacggagagaaaacauauuuucaaguggggcuuacgggucccguuuuccuugggcauugcaccuguugacugacuccuaggugacugccggugcuucagcagauaggaguaugcaaggaccucuggggcuaucuugacuugguuccuuugccagauccccacuccccgugggugauacagcugagcucugggguagcuguaguuugcugcagagccuccuugcugcuuccuaguggcugagucguuuccaucccgcaguguaagguccucugcuugucaugcucacccgcacugcugcguguccucaccaaucucucuguguuucaucuuucgagaucuucguguucauuucauaagcugucuugcuguuuuuacaauagagaguagauaauccucaucuuguaguaauugcuucuaguagaaaagaugaacguuacagaacauuuuuaagucuaaacuuccagccuucucaacagcucuggauaccauuuuagucuguuagucaugauggugaggcagggcaaugagaaggguuugugcugauguuggaacaucuguuugcaaaugcagcucuaccucuugggucugcagucuuaagcaauuuggucaucauacauaucaguugcuuuaccuguuccuguaaagugggcacuauagccuaccugcccccuauucccccccccccccccgcaaaaccugcauuuuuaauauugugucuccuggguauguauuccuagcauugcuauguuauuucccaauagcaaaauucugcuuaaaaguuuuuguuucaugucuaacuguaaugucccuaugcugggaaaggcaguguggguguuuacagcccuuuucagagucuuccuuggaggaccucuucucaacauaugcuccauguuccacguggauuacaaaguuacauuguacaucucagaaaguguuugcauugaggcccaagggcaucucuuuugagaaugggggagccucugauaguguugggugacugcaugugugcuuuaggcuucuggaggccaccuuguguuccuuaccuaaaucaugcucuuccuuuaagaugacuacagacacugguaugucaugaaaaguguuugguggucaccacuaccgucuguuuucauaacgaucggucacugaauaaagccuguaagaaaucagaacagaaauguccggcagccgugauugugcuucaccuccugccguguucuugcagguccgguucccaucacacuucagcuccgaucucaaggaccuucugcggaaccugcugcagguggaucugacaaagcgauucgggaaccugaagaacggcgugagugacauaaagacccacaagugguuugccacaacugacuggauugcuauuuaucagagaaaggugugguucuguuccucguuuaaugccuuugagaaggugugauuuaucauguagcagagaugcuuucaacuuuagcauauuuguaauuauuuuaagcuaaucucugcaguggcuucccuuguagauuuuuacuguucauacuaaaucuugacaauacuguggaaauaggauuuuagacaguauucuacaggcuugcuuuucagaacugauaaaagccacauuuaaaagauaguauauaaaugaauauaauccaaauucagcacauagccacacagaaaucaacuuaaguucugggacuguuuucucucauuuuagccuugcuguggacauuuacuaaaacugcaacuuuucuaugggguuucccuagaaagauucaagcuuuucacagauccugcaugucugccucuccacucccagaggcguuccccauuuugcugacccuccauaguccacugagugcuuaagaacucaauuauuaauucacugauauuuucucugaagcuaguccuuccuugcuauucuguauacucucucucauuuucaaauauuucaugagaauagaaacuuuaccuuccuuguuuuauacccucucccaggcaacagccacuggugcuugugccugcauguugcucaguuccucaucguucugcacaugcaacuguccuccacugucuuacacacgugcaacuguccuccacugucuuacacaugugcagcuguccucuacugucuuugcacacgugcaacugucccccacugccuuacacaagugcaacuguccuccacugucuuacacacgugcaacugucccccacugucuuacacaagugcagcuguccuccacuaucuuuacacacgugcaacugucauccacugucuuacacacgugcaacuguccuccacugccuuacacacaugcaacuguccuccacugucuuuacacaagugcaacugucccacugucuuuucacacaugcaacuguccuccacugucuuacacacaugcaacuguccuccacugucuuacacacaugcaacuguccuccacugucuuuacacaagugcaacugucccacugucuuuacacaugugcaacuguccuccacugucuuuacacacgugcaacuguccuccacugccuuacacacaugcaacuguccuccacugucuuuacacaagugcaacuguuccacugucuuuacacaugugcaucuguccuccacugucuuacacacgugcaacuguccuccacugucuuuacacaagugcaacugucccacugucuuuacacaugugcaacuguccuccacugucuuuacacacgugcaacuguccuccacugccuuacacacaugcaacuguccuccacugucuuuacacaagugcaacuguuccacugucuuuacacaugugcaucuguccuccacugucuuacacacgugcagcuguccuccacugucuuacacacaugcagcuguccuccacugucuuacacacgugcagcuguccuccacugucuuaccacgugugcagcuguccuccacugucuuaccacgugugcagcuguccuccacugucuuaccacaugugcagcuguacuccacugucuuacacacguccaucuguucuccacuguuuuacacaagugcaacugucccacucugucuuuacacacgugcagcuguccuccacugucuuccacacaugcaguuguccuccucuuucuuuacacauugcaacugucuuccacugucuuuacaaacaugcaacuguccugcucugucuuuacauacaugcagcuguccuccagucucuuacacaaguacaacuguccccuacugucuuacacacaugcaacuguccuucacuguuuuuacacauauguaacuguccuucauguguguccuccaguuuuuauugauuugcuuaacauucuuccaaauaguagcuuggacccugugcuguuucuagguacucuucaaagugcuaagugauuagugaagucugccuuacuccuccagcuuagaccucagaguucaagaacuggaaggcaaaucagccuguugugcuaaucaguuugggaggagucuagugagugcuuuguacccgagugucuagauguucuuaucugcuugcuugcuugcuugcuucccagcagacucuuaaauguuagaaggucaagcaauguggaccauagguguaaaugcaccuuagugccuccccgcacuacuguagcccgugauuaaauagagaagggcuguagcugaccagcagugcuuugaggagacuagcuguguuucccagggucucagcgcuagcagccgcaguaacgccagccacuguguuacuuagcaguaauuccucuaccauggcaauaaacuggggaauuugagcaaagauuuugcuccauuaacuuucucuccccuuccccucucgaaugcuaaauuaaagauaacucggaugcaguguauauauuuggcuuccucccuccccacccccacaaaacccacagagucugauguuucagagucuugccacauuucauaaugaacaacuacagagcacauuuccugaggaaaaauaauuuaaaaugccauuuuauauugaaaacaguuuuucuaauucauuaaaaguuuacaagauuauaaaaacaaaguuauaaaauuuuaaaauucaucuaauagcauagcaaggccagaacaaaacaguaaguacagucacugugccccacagagucccaaggcucagccaagaucaagauugcgcugagugccauuagcucagcacuguucaguagccacagauaaggacccugugacuaaaacagucuguccagcuuagaaaacaugcugcgcgccucuucuagauuugcucgaaugaagacaguuccucauuguuaauagaaggguuuugaucagucuuugagguuuuccuguuaaaaggagaaugcauguuuuguuuuauuauguuuucauuuuacugauuaaaaacaugaccccaaauaggauaacugcuuuaaauaucagugcuaccacauagcuucucaguuugaucccagcuucaccagguuuaaauuucagcacauugcuauuugaaaaucuucccccucuuuuuuucuggguuuugugggggucauuugcuugagacagauucucacucuguaacucaaguugguuuggaacuacauagguauauucuuaacaccccugcugggugucguggggaauccucugaccuuggcuucccaggugcugggauuauaggaagguacagaacauuaaauaccauauuucauaaaacauucagauuuuacagggcaccuguuuaacuuguagcuuugagcauuugggaaagaggaaggcaauuucuacaggaaggagaaaggagagagagggagggagggagggagggagggagggggaggggagaggagagaaagagaagaggaguggagggggagagacacgaggagagagaccuggggagcugugagccugagucagaucaagugugcauugcaguauggccuugagcgcacugugaacuauguaagcauaagcuuuauuacguuaaagugccagggaagguggagaauucaacagggaucacggaaaguugaggaagacuagaucaguagguccugguuccuauccggauaacuuggugagggaaccuggguugacacuaggugucuuccagcuccuuccuuccuucucauccuugcaguccaccuggcugugaccucaguggcaagcuucagucuucccucacauuugcugcuuggcauacauccccuucagugccuuacuauacacggcagaacacugggaaagagucugcuugacaccucuuccuuccuggacugagagaucuaauguuuuuauuguuacauuauuguuagcauuauugaguaaccucgauuuagcuccuuacaaguacuaaacugucauacauuugacucuauuuuuaaacauaccauuccucugucuuuauuccaauguccccuggcauugggcaguuuuaagguccccguguggcugcagcuguccuuacaggauuauguguauuugucccuuguaaauuuuaggggaaaaaaaguacuuacuuuucuccagccaguuuuagaaacugacauuuuucuguaaaauuauuguuuuuaucaucuuuauuauuauguuuauuguuagucagugcuguacuaaaaguauauauuucugugacguguguugugauuucuuaguuuggcaggguuggggguuggggagguguuuguuucucugcauagcccuggcuguccucaccuuguagaccaggcuggccucgaacucagaaauccccugccucugccucccuagagcugggauuaaaggcgugcgccaccaugcccagcucaugugucuguguuaucuauaaccuaggacauauugauaaagucaugaaaaaauaaauaaauauccauguaaugauauacuagaaaauacuuaaugagaucacugcuguacacagaagaaaaaacccuugagaguuugaucccugguucagucauuuauuagugauauaaauucagucagcucuguuuuguaaucuuuaaaacaggaaugaaaauggcugcuuuggcuuccuugcaguguggggaaguggacauggggacagcugugugugacugucaauccaguggcugugguguaaagcugcagccguggcagcucucagagguuuucuuuacauauauuagggauacagaagauuauaugggaagaaagacuugauuuuucagagucaaaaaaaagaaaauguuuagaauuugaguucugugauucugugagaugucucuaacuuagacuuuucauagucacagguuuuaaguaagcuuagcaauuagaaaagacaaugaaaguauaaaguguauuaaccacagaagaaaggaaguuggagaaaauacugaaagucuuggaaauaaauugauaaaaauaaaauaaaauggagaguaguucucucgagccuggagcccacacucugaugcuguucucuguuggucugcacucguguuugugguucucagugaaaacaugaggcuuuagcuaacuucuguggaucguacuucaagcacuucuguguuuaaagaugcccgugugagcuaggcugggaaagcauuguucuugguguuuggaagugucugaggaguucauucucucacuugccuccugaugucgauuacagguugaggcuccauucauaccaaaguucagaggcucuggcgauaccagcaacuucgaugacuaugaagaagaagaaauccgugugucuauaacagaaaaauguggaaaggaauuuugugaauuuuagggaggagaaagauagccuggagcucacacucagcccuugcacgcuguggagguggaagguggagccgagaccugcuuguuggagcggguuccaaucccuucauuccagcaacugcgugaggucuuuccugcgucaucagugugcgcucgcucugcaaccaccuguguccccaggcacggcuccgcagcaucgucugccauaacacggugugcaccacguccuccugguuugguuuuucuccacccuccuauauccuucucauucacuucucugaccagugcucccuuuauuuuccugguguuucagaugggcaguguuauggcugugugauauuuaaaaggaaagcuacauguugcuuuuuguaguuuugagcaauauuuuugcugaccaguggcuugaagauaaacucucuaaugauuauuuuuauuuugaguagcuugaauucaguuuugccaaaacucuuaguaauuuugaagauggaaugucuugucagcaugggaauuugcauaaguaaagauaacuuuucaggggucacugaugcagcagugagucagagcgccuagagagcagugaggacuccuggacgagaggcuacguuccccugggccuucuagugcucuucacuccgugagauaguaagugaccagacagauaagugaggggcauggcuccucgccgcagcugucucccuugguaccgaccucucugugggcuggagagaggccuaagguuucugagccuuggcucuuccaugggggcuucagccaguauuugaggaaagugugacugagaaaugacacuuugggagguuucuccguccucaucggugggcucuuaagggaaaagagcaaacgugcauuuggauaaaugcuaagucagcagaagccuugauaccugcuugcagcuuagagguucucuccuuuaagggaacuugucuguuugcuuugguucguaccagguaagaaaacaagcaaagcaguagcuuauugcguccucuucugagggaagaagacggcaggcgggcacugccgcagcucugccgugucccugccuggcuagugacaggagaacgcaaagcuugagacacugccacauuuguauuucaugcugagcugugauaucuuuaaguacgucagaauugcuaaccucuuccuucucuuucauagacagaguauaugaucaugcggauacaguuuucauauuugcuuuuccuuaauuuuucuauacauuuugccaauugacuuaacaauguugccaucgugaggacauuucaagcacucuugcacauuuaguucaguguuccuuugugaauaaauggcuucacuuuuuuuuuacuauacuuucauuacuuuuaauuuucucaccucauuuuaucucuguaucagugaccuaccuuaaauaguccacuuacccaaauaguuuaaaauauuucauuucaugaugaaucuccaaggauauaagauuguuuuaagucagacaaacccuguuguauauagagccucucuaucugccuccuuacuggugcagguaggucauugacagcaguccuagucauaugcacacacacccucaccaaacccuugaagacauugaaaauccuaucugagaccuucucuccaccuaucugcauguguuuugguugucaaguguuucugcauggcaaugucccacaguaacaaauaaugauuucaguugguccaccuguauuuaaaaugugcaagaaaaacugaaauacucugcuguagcaaguucuguguaacaaagauauaucaucguguuaauaaacugaaagcaucauuuguauaaaauacuuuauuuacuuuuauguauuucauuuaaauccaagaacaugcuaaucauguguucuauguaugcuacaaauucucugguagcguuguuguauauuaauguaaaauuacuucaauaaauuguggggaugacaauuugauuauuauaauuuaguuuucaaaaauugaugaacagauuucuaugaauccuaaaaauauuuuuuucuauaaaauuauuagugcccagcuagaaucuacccagguagaugacaccuagguuucuggggcuucucagccauuccauuuuauugucucuguuggaaguacacgagcaaaccaucagcugggucaaggggucucuuucugacuaaccaaguacacuaaauuggaguauuuuuaacaugccuaaaauucccauuuuuagccacagcugaaaagacuuucuuuaaaaacuugaaauaguaagucaguggcaaaaaccaguauuuuauucaaaguauauuacguaagacagaagaaaugguguuuugcccauuaaaucaagagauggcauuguauaggacagagcccuggacugagggagacuuguuggaguggcguugugcagacagagggcagaagcaggcacguugugggacccccgacucccugagguaggucaggauucccuccucagcuaauauucucaaggguaucccgcugugaaguaagcuuugauagcaacacguuucuguuuguccucccucuuaccuccacagugugcugaaaacccuuugacuaucagaaaggccuugucuguuccauuccuuccuuccucccucacugaugcuaaauagacacuugauaucaaacugucagccuaccaaaaagaagccguggcuuauggguauugcugucuuguucuugguguguaccuguacugauugccccuuggucugaaaaaaaaaaaaaacaaugcucauuguaagccuaaaaauacaugauuaucuuuucccacugacuguuguucuuuccuucugcuuguuguaagaaucaaaugaaauaauguauguaaaggcaccuuguaaacuguacgcuuucaauguaagacguaagguguguuauuucauuaauuaguucuuuguuuagagugcaauuuccuaugcgcuacuauagcuaggaaaugcugaaaauguguuuuuuaauucaucaauaaccgcaaaauuaaaguaucuucaaaggauaaaagcu

SEQ ID NO: 1753 - RNA, 642 nt, Mus musculus
cucaggaaaucugccuagcacuucuuuaauuucuuuuuuuuuuuuuucugagaaaauuuuauuagcuuuuuggaucaaguuuauuuuccaggaaggaugauuccaucguacuucugcuggaaccagcgcauggccuccuccuugcugauucuguguuuggccccaaugcagccuguucugcgcuucuugucugcgaugcugaacccuggccuacccagcaccacauagaaguccaggccguagaucccaaugcuugggucguauuugaugcccaggucaauguguucuugaauuccaaaaccaaaguuuccaguauccgagaaguuauuuuuccgcaacucauacucccgcaccuucaggccuuucuccagaauuuccucugccuuggcuccgcggacugugcagugaacagcaaucuucucauuucuccggaugccaaaggaccugacaguguaucuagcuuuggagaacaccggggucuggccugugagcugcuccaacaccuuggcugcccgggucagucugucuccguucuccccgacgcagauauugaggcagagcuugcggaugcgcaguucccgcaugggguucuccuuuuccccuugaucuugcgccaugguggagaacaggaagagcacuucu

SEQ ID NO: 1754 - RNA, 1061 nt, Mus musculus
agcuaucauuucuuuuuuuuuuuuuuuuucagcuuuuagcaacuuuauuuuccuuccaucuuuuuucccuuugcucaggcaccugcacagcagcucaggaccacucagugguggcuccaacccauucaguggccugcgcugugggagcugcugaccaauccucaguggcuggcugugcacuccagucuuccguggggaacugcuggaugggcacagagggaaccugcacacccucagaccagucggccaccucaggcugagcagcagugaacucaggagcuggugcaguccauucacccuggaauuccuccuuggucacagccuucucagcagcagccugcuccuccuucucaaucuccucugggucucuguagaaguaaagaucaggcaugaccucccaggggugcucacgggagauaguaccucgcaugcggaguacuucccuggccagcauccaccacaucagacccacugagugagcucccuuguuguugcaugggauggcaauguccacauagcgcaggggagaaucuguguuacacagagcaauggugggcagguugacauaagaggccucugugaguggcugauggucagcccugggaucggucaccacuagaagccguggcucccugaacgcugcuuggaucugguuagugaaggucccaggugugaagcggccagcgaucggaguggcuccuguggcagcagcaaacuucagcacagcucgcuggccaguguuccuggaggagaugacgcugacaucagcaggguucucgauggcaacaauagcucgagcugcgagcaacagcuucucccagguccucuucagguuuaugauguagauaccgucacuuuuccuuuuguagauguacugcuccaucugaaagucaagguuggugccaccuaaguggguucccgcagcaaggaauuugaggacauccuccuccuucaucuucaggacgucaagggcuccggacauuguguaaguuucccuuuaaguuacgaugggaaucaagaacaacgccguauggacccguccccggguagcgcggaaagcu

SEQ ID NO: 1755 - RNA, 1117 nt, Mus musculus
ggaaggugcuggcgcacauccuauccugcgagacuagaccugagcaagucuacagcagacuccuuaacaaaagaaaacucagucgccuugaccccagugacccacaagccggaucugagcggauaguuucauccggucccaggacugggcuuuccaccaccaagcucucuuccccugaggcgcuggggaccgaccccacccugcuggcuaccugaagcucgggaacugcugcgcagccagcuugguuggaggacaggcugugccccugugcuuaccucggauggcgcgaucucgaacacgccggcaaucuuggcguagagcucgcugaugcuggagaaguccuccacucggcccguggcgcugccgugcgccagcugugcguggaacaccagcuugcgugccggagcuggggguccggggacacccuggcugccacuggaucucucgcccuccaccagccucgcggccuccuuggacuuggccgccuucuucuucccgcgcaguccaagcggcaucuugcaggucccagggcguggaccaccugcgcugcggcgcaagcucccuggccucggacagcggacuuugcgcuugggggcccggcuccgcgcaggugacagcggcugcugggccaaugguagcagcgcuuccgccuagcggcgcgggcuucagguccccucccugugaaggacagggcaccugagccgggcagcuaccuacucaggcagaaggaaagcugugcacgagucaacccccuucuagacucagaccuccucucagugaaaaggaauugguuuguaugaagggccggggaugcuauaacaaagggccuuugcucgcggaccggccuuaccuugccuugccuuucagaaucugggcgcucaacugggcguggugguucaaugauuucagcacuguuaaggcugggacaggauaauugcaaugguuggaggcuagccuggccuacagagugaguccgucucaaacacacacccacgaccaaagccccucaaauuauaauauuuacaggaaaacgaaaggauggagagaggacauuauuauguuaaauagaguaggccagauucaaagagaaaaauguugccuguuuuucuucuccugu

SEQ ID NO: 1756 - RNA, 31801 nt, Mus musculus
uuuuuucucaaaguuuauuuccaucacuuugggggauggguaauacacacacacuuaauacaaauuaauuuucuaauaaguguuuaauauuucauuuuuguucuauuguuuuuauuguuugcuuacuuguugaacucaggguaugaacuauguagcccaggcugcccucaaacuaaauccuccugucucagccugugcugagauagcuggcauauaccauuaugcccagcuccacauuuuuaaauuuuucugagaaccauuaucagacauuuucuugacuguugccuuagagacagaugcauuuagcccuucuauuuagaucucagaaguacacuguacugaaauagcauugauaaagaggacacuugccuaauggucucugaauuccaacucguaaauacuaaacaaaacacuaagauuuggaugaaugcuuuccacugauugugcgccagcaagacaguacucaguggauaacaguacuuauggcgaagccugaugaccugagcuucauccccaggacccacaugcuggaaggagagaagacuucugcacaucaccaagguacaugcauguccacacaugcacagauaaauucauguaacagucauaaaggaagccaugaagguagcaacuucaggagacacagcuuuuccccacauugcaucggugcucacuuuaugaugaccauaaaauuaagaacauuugccuaacucuguuuuccaaacacugaaauuaaaggcacggugcugcagguugcaucguuauauuuuuauguuaggugacaaaacuuucucugggggcaugcaacacauaucuacucaccccauagauuccacaacauaccaaaguccaacuuggugagccagggacuuuuauuggaguuccuugcaggugggugggugagagguuacuugcaggagcagcaauaacucacaugcagcugcaucaacaaagcccagcccagcaugggugacagcucacaaaucugggaaccuggagcaggcugcacagccugcaggcagcucagcagguuggagagggcccuucccaggugccucaguugcucuaaaccucuuccaggcagcuuggcugcuuucuguuucuuccaggcagcuggucugguucucgucuuugcagcuuggcucugcucagugugagaaaaacucaggguuuuuaugacuuucucaggcaggagagaccuagagaaacuggccuaucucaggcauuugcuggagcuacuuugaguuguuuaccuccuguuucaggaggauuuucccaaauaucacucaacugaaaauaauuuucaugggcuaaaaacaucagauaaugugugccuuggauguagcucauucauggaccacuugcucaggaugggugagacccugaauuuaauacccaacccaggaaaaaaaauguaucagauaauuucauauugccauuugcauagacaagaaauuguguaucugcaacucaacauuuaaacuaauaccaaagugucacgaaggcagcuagaugacagcaugaaaugguauucuuacuaaaaaaaaaaaagaacuaccaacacccucagcaugccauaguacacacaugugugugugugcaugugugucucugugugugccugugugugugcaugcacauaugcaugugugcaugugugguuucuguggugguuugaaauagaaugaccccuauacacucauauauuuggauauuugguccccgguugauagaaccguuugggaaggauuaggagguguggccuugucggaagaggcaugccaaugaggucaggcucugagguuucaaaagacuagccauucccaguuagcucucugccucaagcuuguggaucaagaugugacuuucagcuacugcuccagugccauaccugccugccugcccacuaucagguuucaucaugacgaucgugggcucuaauacucucagaguguuagccccaaauaugcucuuucuucuauguuaccuucgucgugguaucuugucacagcaauagaaaaguaacuaagacagcuugacacauucugggaccucucccaguaggcaauuuuguggcgcuaacaucaguguguaguugucuaaaucuagauggauaacuuaguaggcagcuaggcugugcagucuaacauacugcuuaggcuaccccccugcauagcacguuacugcacugaagacuauagacaaucauaacacaacagcaaauguguuucuaaaucuaggcuggguaugguggcauacucauucucccagcauauuggaggcugggggaucaaaguccuuagcuagcccaggcuacaggguaaggcccugucucagaaaaguaaauuaaaaaaaaaaaaaaucaauguccagcacuguaaacuuaguggaaacacaaggcuggggaagacaugggccuuaggagagaacuugcugcuuguuuagcugaauugacauaucgucaaacugccuugugaacuuauggcccguauggucacaaccuagagucaaacgccuuucugggagaagccccucuuugccaugaacgcagguguguggcugcccaggauaagugacagcuggaagcucaguccuagauaggacaauuguagcaucccuuuuaaggcucagugaacuucacaguaggugaaagaaugaaagaccauaagaggcacaacagggagaagggcaaucacacgccgucuuccaggaacaacacagccauugcagucacgaacucagagcagcuacggcgauucacguugagccugcccaagacuggccccguucacagucaaucaugggcagaggugggacucccagcugcugaaccauuggcuacugacagauucugggagacuggaagucacugucuuaaguugugugcacacugucaaauacacugaagucuaaaagauagccccaaauccauggucacacaaacagcccugguuaaaucuaacgguucacaaacaaaacaagacaugugggaaagaagucuguaggcaaaggaaccuugacagugauaggagagagauaggagagggugggaguaaggcuaaucagacagcauuuuguucauuuaugguauugucaaaagacaaauuuaauuuuuagaaaaaacuagaagaaaagaguuucaaaaaagguuaaagggcguuagaaacccaggcaaaguaacuuucuagucuuguucccugaaucaauuuuacaaaacuucaguauuaaauauaaauaauuuaaauauaaauauuguaagccaagaaucuaaauuuuguguauuugucauuguuauaaacagcauaaauuacucuuuccuaucuuaauauuaguucguguuaagacauuugcuuaaacacacguguucaccuacacacacacauacagagagagagauugugaagauagucagccauacuacauuaucuauuauugaaugaaagccauguuggccuugacuccccaagacugagcagguaauuccugaaaugugagaggaguguuucaucaaggccauugacugaguccaaucacuugcacuaauuucauuucauccaaucacaaacauuccaaugacaguuuccuaagaauaaacaagaggcuuguucaaccccuugccuccaagaccgacuaauagccagagagacaagcuaauguggaugucagagcccaaugcuuucaaggccauggguuacgaagcaccacguggcagggagggcagaugugauggaacagugcgucucgcuuagaaccguccuaagaaaacuguuccucagcuacagagcuaccaaauacaacaccugcccuggaaagccauaagacccguggauauguguucuuuuaacaaacaucuuuaauaagaagcuuuacuggacucauuaugcugcaaaaucauuugagcuaugcaaggacuaguaaauuaaacacuuuaaaagaauuuuaaaaaaaaaggaugcuguguuugucugcauguauguaggugcaccacaugcaugccuggugcccauggagaccaaagagguguccuuggaacuggaguuucagacggcugggagccuccaaguguguccugggaacugaacccagguccacucacgagaggcaagugccucugagcccucuuuccagccccuaaaaggaacaucuuagaagucaaaaguacucucauaguuuaaaucugaaaauuuuuaacauuuuacugucaguauuaauucaauauuuaacaaaacaaugggcacuuacuacacucggaagcauguuuccucuaaauuuauauauuuuguacauuuauucuacuacugucaccgaacccuacccucagcccuaagaguaguacagauugauugauugauugauugauuguuagaauaauuauuacuaaaggaacuaacugaaagauuauuuguguuuauaaacccuuuauuuuggcucagagaaaauguuuacucaauaagacugcaauaauaauuguugguucaaagccuguguggugugaauggcacaugccauucauuccagccacuaugaggcagggagaaaaauucccauaaauuuaucgugaacuugagucacauggagcaacauaccagccagagcuacauaguaagacccuaccuccaaacaagcagacacaaacacacacacacccugccccccucaaacaacucaaaaguugaauacuguggguaugugguuucgaauaugaacuacaaccaucacuccaagacuuuagcucuuuauaucugugugaauuuccaugauguucaaggagauggugcgauuaccucaacucucuggcauuuuuaacauuuucuauuugcaacuaauggauguagcuuuuccuaaccauuccacucucaacuauguaccucagagaaugcagucagucuauccacacagaaauuuguuuacaaaugcucauagcaucauuauucauacugaguagauagaacccagaugcccaaaacaccaaagaagagguaagcugaccaaaugggauucuacccaaguacaugaucugccacacaaaggaugaaguuacugauaaugaggccagacuggaccuugagaacagugcugugcugggugaacgacagcaaauaaaggagccgcaugccgaccgauucuauucuacaauagaauccaucuugaaaagcagaucagugcuccaggggcugaggggagagggggcacagaagcuguucauggugacugcacaggucuguggauacacgaaauucaaaacuacaccacaaagaaagagagagagagggggaggcugggcacagcuccacggugggaggcacuuagugugcacgcagcucugacgucagucaacaguaccaaaaaaaugagggagguuagugugaauuuuaucuuaugagaauucuauuucaauaaagccacaagguauacgcuuacuauaauuuuauacagaauuucuaaauaacuucacauucuauuaaaaagacuauaggacucaguauaccauauauauuuauguauagauauauaucauucugaaaacuguuuuacaaaaaauuuuucauaacaucacuuuugauagauauaaaacagaagacaguaauuuuuuagaauguaaauauauuuuaaaaauuaaaacaccuaagaaaugcaaucuauauacaugaaaagguagaauauuuauaugaugacagcacauuacccacaagcagugaugguguuuguuauauccagauugcgguuuaacaccacagugauagaugacuguucuuuagggaaauuauguaaggugcauagcaugaggaacuuaacagaacacuguaaauggacaauuaaugccaaguaacaguauuuucucuaaaaacauguuaguaaacaaauaccuuaaacuaaugaaccacaaaaugagcuuauuaaguuuaagauauauagucaacugcauaaaauuacauguggccacuuaaaaaccaucuguuucuaaaauaucaggagcucuggcuauugggacuuccacaggagagaaaaugucauucauuuucuucuuaugaugaggucugcuuuacgaacauuacaaccaugcucuuaagaaacgcugcagaauauugagaagucacaacgguaaagcacacacaucaaugcauucugguaccagcccaacacagcaucucugaaugucaccuagacugcauuucuguaugacuuuggcuuuuauucuccacauauuacauauacacuuaagaauuuuaauuuuuauuaaaggagccuaucacacugaucauuuaaagauacacacacagacacgagcacacacagacacacacgcgcgcguacacacacacacacacacacacacgcacaugcacacaguacuuggauaaucuaguauuuacuagaaguauauccauagaccacaaaaccaacuuuuacuuguaaaugaaauacuaaaaauuucugauuugggagaaaugaaauacagugaaugacuuuucaucccuacuguaaaaacccacguugccuauuugaacugugucuauucaugcaguuuaaugagcccucagaagaguuuacacaucuuuacacagaauucacagcagucaacugccgguacuuuuauauuuucagugucuuaucaaacuauggauagcaagguucuucucauccuaggaggcagggagaugcuuccucaggaucucuuuggaugcugcagauaugacgucugggaaggacacaucaaauucuaucaguaggucgccacgcuggucaggguuuuuuggaaauggcagcccauauccaauaacucuucuccucaucccagguuucacaauaucagugacugacauagguagguuucuuccguccauuguuggcacauuaagugagcagccacacaaugccuaaaguggaccaaauaaaaugaaguuauuaauaaacuuccaaacuaaagaauauaagauugugcuaggaaguaaaggguaacaccaugaagguaaaauuuuaacuuccaaaaggauuacaauaguuaauaaaccuuuuuccuauucuaaaaacucugcucaagagaggcauaaucagagauguuaccagagagagacaugaaaggacaaagaaagaaaaaguuaacucaaggaugucuuccacgcugacuuaggacguucaaagcuaucauagucagggugcagaaaacuaacuggagaaacaggaggacuuuagaacaggacggaacuaaacaggaacaaaaccuauuuuccagaagaccuuggggucuacugggcacaguacaguuccuguugaaccacauggggaaccauacaguggagcucugacacagagaaacuaagcaaaguaauaacagcaaauucagggaagagaaaauguacuuggagauagaagccagauuucuaucuuuuaaacuguuuggaauauuaguugguagggauacacugagccauuuaaacagggacauggccccauccaagaaguagugcaaauaaggacucaagaacuauauuaaggggugguauugugcacuauguauaauuauauacuuguuauguucuaaugcuuguucuauaaauuguacuccaaucacuucagaacaaauguauuaauggacuacagugguggguuaccaaugcggaucucacagaccacaaccuaaaacuagaguuaaccuaacacuggccauaaaguagcuaaccaaacuuguacuugaaaaccgacauuuaaauaguuaacaucaguaaauaaauuuagaaacuaugaugucauccagaagagagcuauaauagcaccacuuccuagagaguuaccaugaggaauaagucugcagagcacuggauaaaagccagcgcugcccagacagcccccuagucaaucagcagcagucaucucuccgucuuagagucucagggcugacuuacugacuuaccucccguaaacuaauuuuagcaguauaaacuauauuugauccgucucuuuuaaacuugggauguucuuugucuuuaauaacaaaaacaaugucugcugggauacuauuugguguuucaucgccuucccucggaaaagugauuuuggugccuucuuuccacccuuuuuugaucucaauggugagaauuuuguccucagaucuguaacuccuuccgucaggauuuaaucuuuuucgagaaaucuucauccguuuggugcagccacuauauauuucuucaagcgauacuuuaaguucaugaauaaugggagggucuuguuugagacgggagggucccacagaauuccugucucuuggauauccauucaugcugaauccaaaggcacuaaagggaucuccaucuauuuccauuucuucagaaucucgaccuccacccauccgucucccaaagaagauuucaaaaggguuggaaccuccgaaaaaggcugcaaauguggcaugaggaucuccguggaaaguguaccugaagguaccuccuuguccaucaguaccuccagcgccucccuucaagccuggugaagacauaagcaagauuaggaaaagggccggcagucuagacagcugaccacuuacagauugcccugcuaauaaacucugacuuaucacuuacggccugaaacaucauuagaauuaaacagaauaguuucugaagauccauccuauguuaacguuuuagcuuuuaaaucauuccuccaaauucuuugcuuuaauaauuucuucuugaaucuuuuguuucacaauaaauaugaaaaauaaaaggaaauugagacucccuuaccucaaaaacuccuguucuaacauacuuaaguauuacaaauuuaauaguuuuaaagaugccgguugaaaaccaagucuaaauccuaaggaccauuauaaaaacaaguacaguagcaacaguuaacauaguucgugcucguagcuuuacugcaggccuuugcuguuguuuucaugauguuuaucaucuugauuauguguaggcaugugugugugugugugugugugugugugugugugugugugugcauaugaguaugugcacaugugcagguaccugugaaggucaggagcaucaaaacccccuggaguuagaguuacagaugguggggagcuccugacaaugagauccagcacuuagagaaagcagccaggacccagcccucucuccagcuccuaugucucuacuguuuaauaacugaaauagaacacuuuuuagaggagcaagggagaaauauaauaaaagggacagugugaaaacuguuuuuguuuuuuaaagauuggcuuauuuauuuauuuauuuauugaauguauuucaguaugcuguugcugacacaccagaagagggcauuggaucccauuacaaaugguuguaugugguugcugggaauugaacucaggaccucuggaagagcagccaguacucuuaaccacugaaccaucucucuccaacccaaaaauuuuuuguagacacuagauuaucaucaccuuagacagcaagccuuuuuauguccacuuuaucacauccugacucacagcauuuaaaaacaggaccaaaaaaaaaaaaaucaggguuuuuuaacauguaaaauggacuaguuauuucugccugacaacccacuuuagacaguaguacuaugaccuuuugcccagagguucagcaaaguaacaugugggugacaaagauuauauauauuuaaaauagcauuuuucuaccacauaccaaagaaagauucaacuaaagcccauacagcaacauagugauguuuuaggaggccgaccguggcaaagguuucuaucagucuagugaagcuccuggcagagccuaggaucccucuccaaaacaggacggaggaaaauuaagauuacagaacuaugaaaaacucuacuuuaaacugagauucuuauaucccuauauuccuauugcucauguauaugacauugaaaaugaggaacuccagucuauugaaugaagaaaaucagcuaauuauuaaaguuguccugaacugaaacuaaaauaaguguuuagagaaucagccuaaaaaagacaaagaaaaagcaaaauaacacacacaggugagaucuaaucacugcaaugucagggaggcuuaaucugcaucuccugcuguauaguugguuucuauuauuaaaggauauauauguauguauguauguauauauauauauauauauauauauagagagagagagagagagagagcacgcugugacauccaacagucucaacuaacaucuaaauucuuaccuuuacccaugaagagaaaucuaaaggaccaagaaagaccuaaucagaguccucauuagaggagugugcaugcauacaggcaugcacgcaggcauguacacucacgcacacacguggcaugguuaguugggguauucacuguagaaauggaaugacaagucugagaaggacaaacaagguuacuaaacugcucauucugacuuccuucucuagccuuguuaauaugacuguaacuccaagugugaaaagcuagugagagauuuucuuacaugauagaugaaguauagaccucacagucaucacaugguaacugaaugaguacuuaaaucauuccaggaacuguaucccucuucccacagguuucauaaaguauaagaguuuaccaguuaaucaacaugguaagugagcaugccuauccuuagcucucuaaaaggcaaaaaucuaaaugcuuuggacacauaacagaaaagaaagaauaacauuuucaguauuacaucauagguuuggcuuuucccuaaaaccucuucccuugcucccaaaaaugguaauucagucaguauuauagucugugagaaaauuuacacgcagccugaagugacuuacucaucagagcugacaaaaauguggccuugaguuuccuagacaucaaacagucaacuguggaguccagauaaagaagggagcuacacuguaauaaugagaaaauccuaccaaaugccgcuguaguaugacaugaacugcuugcugucuccugcacugcuuaacacuugaauucuaucaagcaugccgucagccagauaguuaaccuuaauccuguacacuacaacucccagcagaaccugucaacauccagcuggauucucucugcucucuacauuuucuagacacugucuagucagggaauggacucuagauucggcaucugccuagucuuuuaaucaacuaaccaauuuaacacacaaaaacaaauagaucuuugggauacugcccauagcaacgaugucuuuuaguuaaucugacaaaaacuaugaaaagaaggaacccuagagaauuggaacugcagagaagagucaugggaccuauuaggaggccuaggcauaacaguguucgauuuguagcaagacuucagaguuauagaacagaguuauagaacagaguuauagaccuuuaaacagguuaacucacaaguaacuucuguaucuuuaggacccagaaaacaaagaggugcagcggacuaacugcauggaagagaauacugaacuagaagaaggcuauuacacugaauaguuaaguugaaacacaucaacaacuguccacauccagaguaaauuagugaguaagaaauaaucaacaaaguaaagaaggaagaaaugaaggcuagaaaaccagaacccucuaaagguguccuuugaggaaaaguuguaacuuuuauauuuuaaaacugcauuucauuauggucaguuggucuguugauggcacgugugugucaugguaugcauguagaggucagaggacaaucuucagaauuaaggucccucuuuccaccuugagggucccagggauugaacucagguccacaagcaccuuugcccacugagccaucucucuggcucaauagagaaaaauaauuuaauuguuuaauacaaaccucuguucauauccacuuaaccaagccuaaaaguuuagggcagagaauaauucaaaacccaauuauagauuucuguaguuucaugauuauuuucaaauauuuauacuaugaaguaaacugacuuauuuaguauguagacuacaugacaaaauuaauuuguauacuguucagcuguaauaaauuuacuacaauccauuuguggaauauucccaccacucucaagaggucucuacuuguauuuccugcuuauuccuauauuccuaccuccaguccuaggcaagcuagcucagcuaucagauauuucacaaauugaauuacauaauauacaguaucacuucuaucuagagucuuucauccagcauguuuuuccagguucauccaguugagacauacuucauuaaacgggucccuuuuuaauugcuaaaaaguacccacuggaguauauacuccuuguugauccauuugcuaaaccaugugacuucuggauuguuuggaugcagggaccuuaaugguccuacuaugaacaaucaggaacaugucuuuguaugagcaaauguuuugucuuguuuauuuuucuuuuugauucccaggaauaaaacuacuagauaauauaauaacuuuaaaccauaguuauuuuauucacuuuuuuaaaacgaaaccauuuuaaauuucagauguuaaaagaauuucacaacuugaauaaacaguauuaacgguucucuuaauuguaaauguggacagucuagauuucuguuacuauuggagaggccuacagacucaggaacacaagcacggacaaugcgaaggagagaaaggagaaaagcuuccucacacagaaccuccaggccaugaggguggggugcugcggauugagagcggggcucugcaugcuuagcuagugcuguggcccugagcuacaacuccuccuaagccgacagagcuuugcagucacugugugcuagguuaccaaauaguaagaaacagaagagcucaacagucuucacucuccuauauuuucagguagcuaauaacuacagaguauuucugaauaauaaauuucaacacuuuaagcaaccaguccugcuucaugcuucguuccuugcuuagagcacugaucugggcuaagaacaccaagaacaaaaaaagacucaggguauacagaaauugugauuuagucacugguaaugaucaguaaaaaaaaauaagaggaagaaaaagaaaaagaaaaagaaaaagaaaaagaaaaagaaaaagaaaaagaaaaagaaaaagaaaaagaaaaagaaaaagaaaagaaagauaauuuggggagugaguuacucuaaaaagcacugccaagagaaaacguaaagaauuaagaguaccagcugguauacuugaaaacucugaagucaaacacgauuaaugagccugaauccuacggcuuaacacagaggugcacuugagcacuccauaagauggagccaaauaaccugcguuuacacaaguggcuuugugggaacucacacaccacuccaccuacucaagaguggccagaguacuggcacugucucaagagccugcucgcuccugagaggucacaccacggcauucucaacugugugaccauggggaacagacagccucaacuauccacaucuugcuucuuguaauuacucacucacuuuguaagaacuugacacuguggauuugcacgaauuacaaccacaggcagcagcaugcuugggacugacccaaaauuaaagcaggaggaaaagggcccaccacugcucugaguugucgguuuaguuugcuuaaugcauggcccuguuugaaggacuucuaauuagggaaaucugguguuuaaaugcuauaaacaaggggaaaacaguauguuuccauagccaccgugacuuaaaagacauuaggggaagaauaaugcaaaagaacuuuagucuguuuuaacacuugaaaaccccagaacucacgugaacuaaugcaugguugccgcugcugcugacugacaauuucaaacuccuacuuuauggccacauuuacgacauuuauggacauuuauggagaugcuggacaaaauucggaaugguaaaaggagauucucaaaggcuacugagcucacugaguccugaucucagaaggcaagaaaaaaaguauggcugagggaaagggcagcugucaugcuuccucuucagccacauaguaaaauuuccaaaagaaauaguuaacuaaaacaaacucagucauuguuccaacuagguggccauuuuggguuagagaaggagagggagggcgggagggcggggggggggggggaggaagagagggagggagaaagagagagagagagagagagagaucuuguucuccuggcacaauauuaacuguuuauaauuaagcuaaaaacuuguucugguauuuuaugacaucagggaaauucuuuccucucuaggcagauugccaaaaacaacuagaagcuaaaugccugugccuucugcuucuacgacacaccacuccgucuuguucaguuucaacuagcgucgcucuaaaaggacaaaaaacuucuuguuuuucuaaauaaaacauaaauggcccagaauuugaauugccgaucuuaaaauuuuaagugacugaagauucuauuaauucuggcaauaaaaucauuaaaaacaaaacagguugcauaagacuuuuaaacaauucauucacaggcaugagaauuuaagguuucuuuuaaaauauaaaaugcuaaaacaauaagucuaacaggagaauaugaauaauacaauauucuaagaaaaaaacccacaaagacaaacaugacauuucauucauagcucauucaaauaaucaaggauuaaaccuuaguuuuaaccuguuauuuuucuuuuuauuuuaguaugucugauguucucauguaacgauaaccagaaggcugagagagagagaaaaaaaaaagcuacgauucagacacugccaaagguacagaaauaugcagcuuaccuucuucgccaaacugaucauauauuucucucuuuuuaggaucacucaguacuucauacgcuucugcgaccucuuuaaauuuuuccucugcuugaggagauuuguucuuguccgggugaaauuugagggcuugcuuucgguaagccuuuuuaacaucuucaucuguagcuccuuugucaauucccaaaaugugauaauagucuuuccccauuucgaaugccuugaaaugaacuuagauuucccuuuguaaaagaaaacagcguccccaggcuuagcaacacaaugauccugagaaaauaaagcaagcuggguaucuuacaaguuaaagcaaaucagcaacucggcucagcuguccagaggcagcaggcagcgucucuauuuaauuccuccccggcagcucacuuacagauaaauagacaccgcacggagacggccucagcuagacccucccacuucaacuacgugucucuguacuuucuagaacagcgaacgaacgaacgcuacaggacgucacuuucccagcggccucuaggcaaaguacugagcugugccucuccuccuccacgauuaacuauucccuuuccuucguccuagcuguacccuuuuauuuccuguggauuuagcaaaccagcacagaaugccgcaacuacauauacauuuacuccauuagagguaaaaaggcaacagaaauaauuauagccauuaggcaucccauguuaaacugauuauacagucagaaaagcccucaacuuacaguagguauucuaacuucaauuucaaguuaccuagcuauaaaaugugcagaacuaaaauaugagguguuuacauuuaaaaucuucaaauaauuugggucauuuucaaaauuucuggggucuaucgaucugaaaagugagggagccacuauauaaaaugucacaugguaaaaggacuguuauaacauugaaaagcaguauuuuaacauaaauaggugacuuaagaaugguuuuaacuagggguucuuuuuuuuggaggggggauaauacuuaauaaaccauuccuuaucacaaugaaacggaaaagcccauucugagggggucuuuauacugcagggaauguaggggagagaggaucagauuccagcacgcucaggucaguguaacugucacccgggaccaguuuacggccuggauggauuaguuaggagaggcaguuagguaacaaguuccuucaaaacacauuuccccuaauuuuaaguauuuacuuguugacaaagauuuuuuugaaacaaguggggggggguuuucucccuaucuuuuuaguauucccuuguaauauuaguauauuucauaccuuuaaaaaacauuuguugcgauuuguuguaauuuuuuaaaucaacaguuuuaaucauuuuacauuuauauguuaucugaugcuuuccuucuuuaaaaauguaucuugaauagaugagaaauauuuugaauguaaauaacucaucuuuuaucucuuuuguggguuuucaaucuguaccagcuggcuuugugugucaacuugacacaagcuggaguuaucacagagaaaggaucaggaucaaacauuucuuuuucacauuccaugucccaaagaccauggggaaguuaacaucagcagucaucaugagagugcgacucugaaagugcauaugccaucacacucaccuauaaauaucuaccugcuaauacagguguaggggguagacuugagagagacuaugaagagaagagaaacuacaauuaguaaauuaacugcauuuaaaaauugaauucuucuauuaacaugaagcucgaauucuccuuguuuuauuacaaguaucuagccugcuguaucaugcaauaauucaggacucagaaaagcauaaauuuauuuuuauguauaucaaaaagcuuaaaugugauuauuuuaucaauguuaacagcaacaaaguuuuugugcauaauaguauguugaagucaaaugcuacucuauuuuaaugacagguggaugggccagagguaauuaaaacucugaaagucacugauuuugcuccuagcacuuuacucaauguucuuacucgggaugcuaugcuuuaauaaccguacaagaguggucuguacagaagacagcacuuacaccccauaccuacaaguagaacacaucguccaacugacaccaucuuucucuaacuugauuuucauuucuacuuaacaaaaaacucuuagcuguugugaugguucacacuggaaucccagcacucaaggacugagguagaugaaggccaguguaaggcacacagugagcucagggccagcuugagcuauguaauaaaacccugcccuugauauacugugaggagcacaaagacaugcgcugacuucuagaacuacuuagaaaaaaaaaucaauuuuaaaauuaggucacuaaaaaggcuaacgcaggagaauggcuaguuuuaggccagccuaggcuacagagagagaugccgucuccauuaauuauuaagauaaucucaaaaauauuugagaacauacuaauauuuuacugaugugcuuguuaaaaauuuuucuaccaauauuuaauuuuuaaacaggucauguucaauccuggaguuuuucuuuuauguauauguacuggcuaguuuugugucaacuugacacagcuggaguuaucacagagaaaggagcuucaguugaggaaaugccucuaugagauccaacuguaaggcauuuucucaauuagugaucaagggggaaaggccccuuguggaugggaccaucucugggcugguagucuuggguuuuauaagagagcaggcugagcaagccaggggaagcaagccaguaaagaacaucccuccauggccucugcaucagcuccugcuuucugaccugcuugaguuccaguccugacuuccuuggugaugaacagcaguauggaaguguaagccgaauaaaccccuuccuccccaacuugcuucuuggucaugauguuuguacaggaauagaaacccugacuaagacaguauaugagcacaauguagcugucuucagacacaccagaagagggcauuggaucccauuacagaugguuaugagccaccaugggauugcugggaauucaacuucagauaaucucaaauacuugagaacagaucaauauuuuaccaauguacuuagaguuucucauauaaugaacuuauauuagaaaaucaugaccucuaguucccuacacuuccuacccaaagauuaggaauuuuuagccucuuuuauucuauguucuuagugcuucugacaguugcauaucuaaccucaaagcuaagugugcccaauggucacuacaucugucaaggcagcagauauggcagugcacuaacugcaaaucuuggcaggcugaggcagaaagacugcuguugagcuuuaguacagccuggacuauagagugagccgcaagucaucaucaugggcuacauggcaaagaaagaaagaaacagacagacagagggagagagaaagagagagagagggagagggagggagggagggagagagaaagaaagagacagagggagagagaaagagagagagggagggaaggagggagggagggagggagggagggagggagggagggaggaaaagaaaggacagaacagagagagagagaaagagagagagagggagggaaguagggagggagggagggagagagagaaaaaaaggacagaacagagaggggggagagagagggaaggagggagggagagagagagagagagagagaaagaaagacagaauauagagagggggagagacagagagagaauaugaauuuuaagggcuggagaaaagugguaaaaaugcaugucugccuuguaucagacccuggguuuaauccccaggggacagaaaggaggaagaaggaagaaaacccacagugggacuaaggaacaucuaaacaauuauuuaaaguacuuguuaaaagcagucucuggagucaagcuguggugguuuguuuaugcucaacccaagaagagacacuagguguggucuuguuggaguaggugugucacuguaggcguggacuuuaagacuaucauccuagcugccuggaagucaguauucugcuagcagccuucagaugaagauguagaacucucagcaucuccugcaccacgucugccuggaugauaaaggacuggcaccauguuccugccuugaugauaauggacugaaccucugaaccuguaagccagccccaauuaaauguuguccuuaaaagaguugccuuggucauugugucuguucacagcaguaaaacccuaggacacagccuugcuggauuagaauucugguaaugucacucaccaguuguguggccugagaucgaaacucuaugucucaguuucucuaucugucagugggguuaauaucgacuuuguagggcugccauguggauuaaauaagcuaacacacuauauuuaaauaucacugacacugugaagauuaaaggugucagauacuuuuuaugauuuuauuauaugaaauccaacaacuuacuuucagaaaacaaucaugucauguguaacacuguuauuuauaaaauuacacccacacacauaaaugcaaaaaaagcuauguuuggcucuuuccgaauauuccuguuaauauaugcuauuuacaaaccuggauucuguucaucccagcauuugagaggcagaagcaauucaucucugugaguuaagaggccagccugaccaacaaagugaguuccaagaaagucuagguugcuauguagagaaaccccgucucaacaaacaaacaaaaaacaaaagacaaagcaaaacaaaaaaagcuacaaaugucucauaaagacauaaguaugugucuauuuauuuaugcuccugguuucuaaugucagcucugccacuuaaccagguaaaaccugcucuagaguuaaacuuaaaagauuauuauuaauccagguguggcaguguaaaccuuuaauuccaucagaggcaggagacucucuaugacuuggagaccacucugaucuacacagugaauuccaggacauucauggcuauguggauagauccuaucuuaauggccccucacaaaaaaaaaaaaaaagaaagaaaacacugaaauguaugacauauacauacaaauuuugcacuauuuuaagcuauacaaacuauuuugcuaucagugaaagacuacugauaaaaaucuccauuuacucuagauuucaguuugcaaaaaagcauuuaucaaaacaaauaaguaacugucagacugaucucaaaggacucagauacccccauguuuucaugccuugagccaagauuccuucagacuuucaugucugaauuucugacuuuucuuacaccaagaaacucuucuaagccuuccuaauaauagcaauuauauaauggcuguuuggaaaauauuuucguaugcucucugauauguaugcauauauaugugcacguguugguauuuaagcaagacaaauauucauaaagcuuuuccguaauuauggcccaacaguaagcuauggugcucuuugcaaguuucuuguuuuauuuuuauugugcaacaguguagagugaagacucucuaaugcaagugggcucugaacuuauaauccugcugcuuuagccuucugaaugcuagaauuacaggcaggagccaagagacccaacagaagaccuacagagucaacuaacuugggcccauggagacucagagacugaaccaccaaccaacaagcaugcgggggcuggacuuagguccccuacacauuugaaguagaugagcagucugaucuucauauggguccccuaacaauaagagugggggucgucucagccucugcugccuaccacuagaucuccuuccccuagcuggacgcugaucaggccucaguaagagaggaugugcuuaguccuguugugacuugaugucccaggguaggguaguacccacagggaaggggaggggugaugggaggagggguuugugagggugggacugggaggagaagaaggaggggggcugccauagggauguaaagugaauuaauauuucaaguagcuuguguagcauagaagaagcucuaacuucuuaaugcugaaaaagggagaaagcuguuuaauuggucauucaaguauuaaagaacaauuuaaaaaccugugauauuuauuuuuuaguuuucuuagcaaaguaaagugauuuuugaaaaguuuuauuaauguuaauauuuuuaacuaucuaaaaagcauuucuaaaacaacuccaaaaagaucaacaggacauagaagguuaccagacgugauccuccggggacuacuacugucuagcuugucuaagaacuuuaucaccacagguauguaauuccuaucaauuuuugauaaugcuauugcucaguuuuauaacauuuacccuaaaguauuucagaauauauacacuuaaacugauucauuuaauuaucuuuaaaagagauauaagguaaaauuuuaaaaauuuaaagaacaagccuuuuuaaaauaagguaaaaauaaaauugcuuuaaguagcugauuuuaaaacuacuagagaagcuagguaugguggcacacaccuuuaaucacagagcucggagucugaggccaguaucaucuaucuauauauaguaaguucuaggacagccagcacuauguagacacaaaacaaaauuuacuagaguuacugcaaaauacuaaucagaaauauuuuguacuucaaaacuuucuugaaugggaauaaauucauuuuuauuuugggggcguauagaacuaauuuauucauacuauaauauuuaaauguuuccaaguaacaauuaggccuucuuuauuauucucuuuuauaggaagucaccaaaaauuuacuaguaacuccaaaacaaaaagagagcuaguauacuuucuagcaucuugugaucuacuuuauaguguuccuggggcuagggaggaaucuuaguggauguugugaagauucccagcauccacauaaaagccaaguggcaugguggugcaugccuuuaaucccagcacuugggaggcagaggcagagacagugggauuucugaguucgaggccagccuggccuacaaagugaguuccaggacagccagggccauacagagaaacccugucucgaaaaaccaaaaaaaaaaaaaaaaaaaaaaaaagauagauguuauuuauauuauauaaaaccauaauagauguuauuuauauuuagccucucugaaaauccgaagccuuuccuaggguuagaaauuugaaggaagggcuucagagauggcgaaaucugggugacugauggcuggcuagcuagacuggcucaaacaccuagcuccuagcuccagguucagagacacugccuuaaaaacuaaggcugagagugauagaggaagucauucaacauuuaccucuagcauacacacacacauauauaaacauacacacauacauacacacacacacacacacacacacacacacuuauuuucaagaccaacuuauguggccaaaagaaacugggauuucuagacuacuuuaaaugugucuugauucacugauaugugcuuauaacacuaacugggaaaaaaucagcauaugaauuaccaacaagacacuuuccacacuuuaggaggcuaacccuuggaaaucaguguggauccacauucacacagcaccucuuccaccaugcucaugagacggcugcggcagacaguguagggcuauugaguccugauaaccaauuuucagacucauagccuaugaacuuaaaucuaucucucucauacacaucaucucacauacauacuugggaaggucucuuaggagaauauagagaauccauuuucagucauaaaaagcauuucauaucauuuguuuaaaaaaaaaagaugacaggcucaaagguagcaguaaugcuuguguuuacacacgcucaaagguuggggauuagcucagugcaugugcacuuguuugcaagaacaagguccugaguucagucugucuggggcaagguagaguuggggguggggagagacaaaauuauaagcuaaacaagguaaaaucaaacaaacaaacaaacaaacaaacaauguaacuacacaugcucagacaagaaacacacacgugauguucaaaguaaauuaacacuaagaaacaaguaggcacgguuuuaacuuucuucacuucuagagguuuuuccucauaaacaggcagaaaaaaaaauuaacugguuggagaauaccuuaaauccuagcauucuggaggcagaggcaugugaaucuuugugagaucaaggacagccugggauacagagggaaacccuauuuugaaaggccagacaguggcggguguucguguguguguguguguguguguguguguguggugguggugguggugguguacuucuaagagaagugguaugcaguacaaggaaagaagcauuuaucaaauaaggagaggcagguagaggucauggggcugccccaugggagcauguggcucuugcccaacacugugaccaacuaacuauccagcaggauguuuagcuugcuaacuauuugcagcuauaaaaugauuucauuauaucaguaccaaauuuuacuaaaaaucacauuauauccaugcccacauaaucaaacugaugcuacuaaggagacuuaaccacaauucagacguaucgacagcuaccagaaguacuauaauauuuauaaaagugagcaaaccuauccuguaguauucaccaacugcuacaaacuggaugacugagugcuuaauuccaacuauaaugagcucaaacuccuguuuucaccuacagagggcacagauuuaaaaaauuaagauaccaaaaauaauugagauaguaauggcauaaaugauuuuaaaauauagucuuucuugggucaacaagaugacucaaguaaaugugagugcaaccaagccugaugacccgaguucaauccccagcacucacacgaugggaaaaaguacucuccccagacuguccugaccuccaacaucaugcacgacacgcacacgcacuuaauaaaaauuaaacaugcagucuuuuuguuaacuggacuacagucaguuuaucaauacaacacuuaugauaccccacuagauuagaucauugucugcauugugaaggauaaacugaauagaaggcacacagccacuggcccacaagguuuccacuguaaauucauaaggaacuugcuaucauuccucucaccagauagugguagaaaguuaaauccagggcugauggccaauaaugccuaaaauauguacugacuggacauuaauggaaaaugcuugcugacccccauaauauacaagauacuccucauaaaaggacuuuuuaaaagcacuaaacaaaaacccugcuuuuugcaaaauuccuuuuaugcuuuauauuuuaaacccucauaaaguaaaagucaacaucuuuuuucuugacuaaugguaaaaauaaaauuuguagacugacucucaaccuggccaugccuaccaagggggguauauaauauauacaggaauacuugggguguaagcuaaccuuuucucaagagguaguguauguaauauaauaguucagaaagacuguuucauaaucauacuucuuuggucaguuugaucacuuauaucuaacucaucaauccugaccauaaaugacuggccauuucccccaaaucaaauuuacuuucuauaacuguggcagaugcugaguuagcaaauucugaaucauuauuccuaagggaaauaaagguuccugcuagccucuggucauauuuucaucaaccaccccaacacauaacuucuuuuuuauauguauuccuacuuaaaagauucuuauuuuauauuguugacuuacugacauuaacucauagccaaaagugguauaacucaugccugaaugagcuuaccuaacacguguuuucucuauuagguauaucauagcuucuuauacuuagaaauauaagcacuucagcauugugcuugggauccauuuaauggugaaauugauuuaaaaaaaaaucaaugaaagugcaaaaacaacaagaacgccauacuagauaaaccuaaaaggauuuagagaaauucacuaagacaagaauacaaaaaacccgaaggcgcagaaauggaccuacacccaaaccccccacucacacagaagcggccaggcugugcacaugugcaauggcagauucugcaugcugcucauggcaggcugagaggcuucaagcuccagcuucaggaagaggccuuaucucaaaaugcaaaaagaaaaaagaaaagaaagaaugaaaaggaaacgagagaaagaagaggaagaaccccguuuuaaccucuggcauaugugcagacucagaaauuaauaagugaauacauuuuuaaaagaaugaaaaguccuacuaguccaacuugaagccagugcggcucugcaugugugcaucuucaaaugaccccaaaucaucuagaaaauugaucuggggaugaaaauaaauuugugaaguaggcacauucauaaauacagaauuggcaagaaauggggauuaacuguauaaugaugugccacuaaauaacuauggucacaaaaaagaagagaaaagaaaaggagaggagaagagaggggaggaaaggaaagaggcucgagagcaacaccugcaccaaugguaugccuuugauguaucuguuauguauaacgaacugaacuguaucuuucacuccagaaacucuccacauagcuuaagcuccccuuugagccccagccucugagagcugugcugcuguggacccuggcugagguugggcuccuccuacuccacacuuaucacuagauaucaacucucaccauacauaaaugaaugcauuuuccacuagauugcaaucuccuagagggggucucgcucccuuucucucccuuccuuucccccuccugccuucccuaccugaacaagaccuuugcauaacacagauaaacuucugcugaaugaaugaacagaaaugguuagcuacaggacuuaaaguaagauguggaugcuauugagacagaggggaaguuuuaaauagauucugcacaauuuuccaaacagcuagaugugcacauuaggacugguaucagauguugguuucugggcugaacgaagguaugcacaaguguuacuaaucaaagagaauuuaagaauaagacauuugaggguaaagucaaguucauuacaugcaugcuaugguuuuauuaauaaaggccuacugauaacaacagaaacagcgcccuaagaguugauacuguauagagaauaggaccauaaacaaagaacuagcgcuuuagcacguagaguuggagccagcacugccaggugcacucaguacuaucugaucuaacaggaagucucuacuugugacuuggucaggacuaagcucuuuacucaugguuaaaaacagagucuaagaaucaagaugacuacaaugagcauucaugaaguuauucuauguacuguaacuuaugcuaggaguuaaaaguuugcuagaugaaugaccuaucugcucauuaggcuuuuccuaucccaaucuuuaaauucauuuucuaaugaacuacagaccuggacuacuuagacuacuggaaauaacuggaugaaagaaaaugcaggaugcacagagugacucaugauuucacugacaucuaugacuaagaguauuuuugcgaggguggcaucuuuauuguuuaauaggccugcccagcucuuuuaugggauugaaaaacucaagaauuacugcauaccuacuauaggucaauccucaaaucaauaucaaguucaaggucaaccugggccacacaagauucugucuugaaaagaagaaauaaaaugaagacaaagacuacauuugauucugaggaaguuuguauauccuuaguugcuacaacuagaaaugacuaugauaaucguagaaaaacaguagcuucaaagucuuuguguaaaaaguuuaauuccaguuuucucucaaguauguaucucuuuaaauauauuuucaaaaugaaauaaaaccaacuaauaaaaaacaaugcaaaagcauaaagagaaucagagggcaaauuccagaaugaucauaguuauaaauaucaugaaaaaauaaaauucuacuaaaaacaaagcuguuaucucaagugagucuuaaaucucauauccaccaagcuuuacuuaaggauuuaucugguaaagaucuucaguuuccaagugauuuuucuccaggaagaaauguuauaaaggaaaaguagagacccugauuacaaaaccaagacgagcugaguucuacacauugaauauauuaaaccacaggcacuuaauauuaaggcaugauccucuggaaaccuaagccuuuuuuaaaauuaguuuuaugaucauuucaaaauccucucaaauuauuuaacuguucauuuuaggacucaaauuaugucauuuuaaaagauaauaucuaauaaaguucagauaaaaaaaagauuuauuuacauucugccuccuuagcaagacaacuagaacucaucuuuagaaacuagauguugacuauguaacacaccaggcaaaugugaucaaaauacacgugugaaaaugggagauagguuuuauuaauauuuugaacauauuuaacauauuagaaaugacuuuauaaucguacuaugacuguauuaaaauauuuuugcaauaaggaaaaaggaaauaugguccuaccuugaauuacaaagcugauaauaguucugguagacuauaaacuuuguuaccuuaucaggauauagcucaaaugauaagacuacuugcuuguauaggaggcccugguuuugauuuauaacauggcugggaauaaagcucuuugacauuuuaagguuuuuguucauuuaagcagauagugaaccaggaaucaaguagcuucaccucacaaaagguuuggugucagagcugauagggcaaggagacagcuuucauaggguggauuccuuugaguucaggcuagccuggucuauauauugaagucuaggaaagccaaggcuacaauagugagaccuuaucucaaacaaggaacaagaaaccccaaauuaccuucucuguguguauguuuggcuaccuccaguuucagacacugguuaaaaugcuguucucuacccuguuccaagguuauauuuguuaacuuauuuaaaauuugcauaugugcacauguguauaaauccacauauguagaggccaaaagaacucagguauugugcuauaccagucucugccuuacucaauguauagcuagacuggguaccuagugaccuuggcucugccacccaccagacauaguguuagggaccugucaaauaacugugcccaacucuuuauguggauucugggaauuugaaacuaaguccucagacuaacgcaucaagaguucuuaccugaugagccaucuguaaggauccugaguuuuaccaagacuaucuggacaugugauuuaaaguguacuacagucuauagacuagccuuccugaucaugagaauaccagacaaauuaacauauuuuagguggaccaagucccauuugcacagcaccauaugauuccuaaagaguucagaaaugccucuucugagaaugacaaggcagguuauuaucacuauguagaugagaaaucugagacacagauagcucaagauaaaaaaaaauaaaauauaguuuagguuuuucaaaaacauuuauuuacucaacaaaugggcugucaacacaguguuaggaacugauacugaugggacagacuugcucuccaguucacacuuuaagggaacuaagaaaauaaacacaggacacagauaaaugcuagagagcgugguaauaaguuagugguuguugaauggcaugagucaccgcaguggucuucauagagcugaacauaugagacauggaugaggcggucaaggcaugcaugccaagggcuacaagagcaucuagguagaggagagagcaggacuacagacuaaagcagggaagccuuggguagcaaaguggaccaaucgcuggaggaaggggaagaggccugauuacaugaauccuuuucuagggcaaaggauuuaaaguguaaguggaaauguauaggugaggccuguuuccaagaaaccaugaagagguggauuguaauucagucagaaagaaggucuauuugagcuauagaacgguagguaaggguaugguccuugcauaauaucucuaauggcuauuccggguugucaacuugacuauacuguaaugaacuacaauccagaauuggagggcucaccuguaaucuagaucuuaaggcuagaagacacaaguuucugacuuggaucuuggcauggcggcuaaggcaagaagaucuguaaguucaaggucagccggggacaaaacaaguccccagauccgggugugguggugcagcuugugcuggagaccuauguaagaauauuggaagagagaagauuugcucuucuucaucugcuugcacuugcacuuacuugccagcacacuggaaucuacuucuacagaagaccagcucaaacaacuagccugagcaacuacuagauucuuggucuuccauuuacagcauuuacagcugcccacuguuggagaguugggcuacagacugucagucaucacaauaaaucuccucaggauagagagacauaccguaaauuuugcgacucuagagaacccuaauacaauaccccuguacguagaguauguuaguuuugaguucuguacaaacguucuuaaauuuuuuuuuuuuuuuccagacaggguuucuguguagcccuggcuguccuugaacucagggauccacuugccucuggcuccugagcauaaggauuaaagggcacaaagcaccaucaccuggccaacuuuuuucaaauuuugaaagauuauuuuacauguucagguguuuuguuuguauguguauguauguaccuugugggugguaggaacuaaacccugguccucuggaaaaguaccagugcucuuaacuggugagccaucuugacaacucuacaaauuccuuaucuuuauuuuuuuuguuguuguuagugaaacauaaacaagaaggagcaaaacuaaagugcucccuuuugaucugggacuacagugauaguaauugggccagggcuggagcagcagggucaaaaagugcuggacuucauacacuggcaagaguuaauacggucaagaaaaggcaggggcagggaucaaggaagagucagaggugugaacucagugccugaagauauuuucaguuaucacaauugguggugcuuaggagagggcaaguaguggccaaagaugcugcggagauauuguaccaugcaaagcauacagccaagaauuacccaguccaaagucucucagcagcauugaggauaagaaaccguagucuaagcugaucccaaaguauuccauacuacaauacucaccuucccgguaugcaguguuguaaaaaaugagaaaugaagguccuuucaauauuuagaaaaaaucuaaacgauaauugguuauagggggaauaaauaaaacucugaauuauuucaaccagacaucuaacuaguauacaaaucuaauuagugaauaaaaacaucaauuacugaugaguaaaugcuauuugcugggcaaacuuccuuaaaacgcgacugaaauacucucauuagcuaguuuuccuacauauugcuaugauuaaaucuguagcccaauaccuuuacuguuuuucuaaauccacggacauuccuagacauccaugaacagguuaaacaggucaaacugagcuaucaaauggcuaagacagagcugguuuuaagaaaaucaugcuguuuguaucugccagcaccugacuuaguaacugauaguggguacuggacacauaguuuccggcuaucggaaagccaagggaacauauuucucucauucuaagauugguguuaagaaaaaugcuucuuagacugagaggggggaaacgucauacauuagacaguccauuuugccuuuuucuuagcuaaacugagagcagggaucauuguggcauacuaaguauaaacagaauaaaggcccaagaacccucauucaccguaguaauugccagcauuaggcuagcauggcuaagacacgcucaggaauggucuggagaaacgugguuauuggcauauaugacaaauauuagaaacugccugcaaagccaacuaguccagaaaugaaaauucagaccaugacauugaucugacuacccgcaggggcgcggggggggggguggggaaaacgcaguaaagccgguuugugucaggagcaugacacguucgugacauaaggggcacaugguaagacuggccaaagacacgcaacgcuaggugucuacauacuggaugugcaacacucacguuuuuaaaggacaaagggcggucauacuuucaccauccgcucgcccacacuauuuuacauaagagacucaguaggcaaucggcucgagaacuaagggcccgguggucugaguuccuccccgcuugugaccggcccggguggagacaugggcagaggcagcucggcgccccggagcauggugggcucccgccgccgggccgcagacgguuccgcagcgucgccgcggacgccccgcacgccccgugcgcgcggcccucgggcugugcggccgcgcgacacuguugcgugacguccccgcccgacgacgucaggccccuuacuacggaaacacggaaggacacuagcuagcucccugauccgcgacggccuuuccaaguccccuacaagcgcgggcggcacacuucccgggcgccacugccucagccgccgaggcgagggaacaauggcccgcacucgcgcugcgaggag

SEQ ID NO: 1757 - RNA, 31801 nt, Mus musculus
cuccucgcagcgcgagugcgggccauuguucccucgccucggcggcugaggcaguggcgcccgggaagugugccgcccgcgcuuguaggggacuuggaaaggccgucgcggaucagggagcuagcuaguguccuuccguguuuccguaguaaggggccugacgucgucgggcggggacgucacgcaacagugucgcgcggccgcacagcccgagggccgcgcgcacggggcgugcggggcguccgcggcgacgcugcggaaccgucugcggcccggcggcgggagcccaccaugcuccggggcgccgagcugccucugcccaugucuccacccgggccggucacaagcggggaggaacucagaccaccgggcccuuaguucucgagccgauugccuacugagucucuuauguaaaauagugugggcgagcggauggugaaaguaugaccgcccuuuguccuuuaaaaacgugaguguugcacauccaguauguagacaccuagcguugcgugucuuuggccagucuuaccaugugccccuuaugucacgaacgugucaugcuccugacacaaaccggcuuuacugcguuuuccccacccccccccccgcgccccugcggguagucagaucaaugucauggucugaauuuucauuucuggacuaguuggcuuugcaggcaguuucuaauauuugucauauaugccaauaaccacguuucuccagaccauuccugagcgugucuuagccaugcuagccuaaugcuggcaauuacuacggugaaugaggguucuugggccuuuauucuguuuauacuuaguaugccacaaugaucccugcucucaguuuagcuaagaaaaaggcaaaauggacugucuaauguaugacguuuccccccucucagucuaagaagcauuuuucuuaacaccaaucuuagaaugagagaaauauguucccuuggcuuuccgauagccggaaacuauguguccaguacccacuaucaguuacuaagucaggugcuggcagauacaaacagcaugauuuucuuaaaaccagcucugucuuagccauuugauagcucaguuugaccuguuuaaccuguucauggaugucuaggaauguccguggauuuagaaaaacaguaaagguauugggcuacagauuuaaucauagcaauauguaggaaaacuagcuaaugagaguauuucagucgcguuuuaaggaaguuugcccagcaaauagcauuuacucaucaguaauugauguuuuuauucacuaauuagauuuguauacuaguuagaugucugguugaaauaauucagaguuuuauuuauucccccuauaaccaauuaucguuuagauuuuuucuaaauauugaaaggaccuucauuucucauuuuuuacaacacugcauaccgggaaggugaguauuguaguauggaauacuuugggaucagcuuagacuacgguuucuuauccucaaugcugcugagagacuuuggacuggguaauucuuggcuguaugcuuugcaugguacaauaucuccgcagcaucuuuggccacuacuugcccucuccuaagcaccaccaauugugauaacugaaaauaucuucaggcacugaguucacaccucugacucuuccuugaucccugccccugccuuuucuugaccguauuaacucuugccaguguaugaaguccagcacuuuuugacccugcugcuccagcccuggcccaauuacuaucacuguagucccagaucaaaagggagcacuuuaguuuugcuccuucuuguuuauguuucacuaacaacaacaaaaaaaauaaagauaaggaauuuguagaguugucaagauggcucaccaguuaagagcacugguacuuuuccagaggaccaggguuuaguuccuaccacccacaagguacauacauacacauacaaacaaaacaccugaacauguaaaauaaucuuucaaaauuugaaaaaaguuggccaggugauggugcuuugugcccuuuaauccuuaugcucaggagccagaggcaaguggaucccugaguucaaggacagccagggcuacacagaaacccugucuggaaaaaaaaaaaaaaauuuaagaacguuuguacagaacucaaaacuaacauacucuacguacagggguauuguauuaggguucucuagagucgcaaaauuuacgguaugucucucuauccugaggagauuuauugugaugacugacagucuguagcccaacucuccaacagugggcagcuguaaaugcuguaaauggaagaccaagaaucuaguaguugcucaggcuaguuguuugagcuggucuucuguagaaguagauuccagugugcuggcaaguaagugcaagugcaagcagaugaagaagagcaaaucuucucucuuccaauauucuuacauaggucuccagcacaagcugcaccaccacacccggaucuggggacuuguuuuguccccggcugaccuugaacuuacagaucuucuugccuuagccgccaugccaagauccaagucagaaacuugugucuucuagccuuaagaucuagauuacaggugagcccuccaauucuggauuguaguucauuacaguauagucaaguugacaacccggaauagccauuagagauauuaugcaaggaccauacccuuaccuaccguucuauagcucaaauagaccuucuuucugacugaauuacaauccaccucuucaugguuucuuggaaacaggccucaccuauacauuuccacuuacacuuuaaauccuuugcccuagaaaaggauucauguaaucaggccucuuccccuuccuccagcgauugguccacuuugcuacccaaggcuucccugcuuuagucuguaguccugcucucuccucuaccuagaugcucuuguagcccuuggcaugcaugccuugaccgccucauccaugucucauauguucagcucuaugaagaccacugcggugacucaugccauucaacaaccacuaacuuauuaccacgcucucuagcauuuaucuguguccuguguuuauuuucuuaguucccuuaaagugugaacuggagagcaagucugucccaucaguaucaguuccuaacacuguguugacagcccauuuguugaguaaauaaauguuuuugaaaaaccuaaacuauauuuuauuuuuuuuuaucuugagcuaucugugucucagauuucucaucuacauagugauaauaaccugccuugucauucucagaagaggcauuucugaacucuuuaggaaucauauggugcugugcaaaugggacuugguccaccuaaaauauguuaauuugucugguauucucaugaucaggaaggcuagucuauagacuguaguacacuuuaaaucacauguccagauagucuugguaaaacucaggauccuuacagauggcucaucagguaagaacucuugaugcguuagucugaggacuuaguuucaaauucccagaauccacauaaagaguugggcacaguuauuugacaggucccuaacacuaugucugguggguggcagagccaaggucacuagguacccagucuagcuauacauugaguaaggcagagacugguauagcacaauaccugaguucuuuuggccucuacauauguggauuuauacacaugugcacauaugcaaauuuuaaauaaguuaacaaauauaaccuuggaacaggguagagaacagcauuuuaaccagugucugaaacuggagguagccaaacauacacacagagaagguaauuugggguuucuuguuccuuguuugagauaaggucucacuauuguagccuuggcuuuccuagacuucaauauauagaccaggcuagccugaacucaaaggaauccacccuaugaaagcugucuccuugcccuaucagcucugacaccaaaccuuuugugaggugaagcuacuugauuccugguucacuaucugcuuaaaugaacaaaaaccuuaaaaugucaaagagcuuuauucccagccauguuauaaaucaaaaccagggccuccuauacaagcaaguagucuuaucauuugagcuauauccugauaagguaacaaaguuuauagucuaccagaacuauuaucagcuuuguaauucaagguaggaccauauuuccuuuuuccuuauugcaaaaauauuuuaauacagucauaguacgauuauaaagucauuucuaauauguuaaauauguucaaaauauuaauaaaaccuaucucccauuuucacacguguauuuugaucacauuugccugguguguuacauagucaacaucuaguuucuaaagaugaguucuaguugucuugcuaaggaggcagaauguaaauaaaucuuuuuuuuaucugaacuuuauuagauauuaucuuuuaaaaugacauaauuugaguccuaaaaugaacaguuaaauaauuugagaggauuuugaaaugaucauaaaacuaauuuuaaaaaaggcuuagguuuccagaggaucaugccuuaauauuaagugccugugguuuaauauauucaauguguagaacucagcucgucuugguuuuguaaucagggucucuacuuuuccuuuauaacauuucuuccuggagaaaaaucacuuggaaacugaagaucuuuaccagauaaauccuuaaguaaagcuugguggauaugagauuuaagacucacuugagauaacagcuuuguuuuuaguagaauuuuauuuuuucaugauauuuauaacuaugaucauucuggaauuugcccucugauucucuuuaugcuuuugcauuguuuuuuauuaguugguuuuauuucauuuugaaaauauauuuaaagagauacauacuugagagaaaacuggaauuaaacuuuuuacacaaagacuuugaagcuacuguuuuucuacgauuaucauagucauuucuaguuguagcaacuaaggauauacaaacuuccucagaaucaaauguagucuuugucuucauuuuauuucuucuuuucaagacagaaucuuguguggcccagguugaccuugaacuugauauugauuugaggauugaccuauaguagguaugcaguaauucuugaguuuuucaaucccauaaaagagcugggcaggccuauuaaacaauaaagaugccacccucgcaaaaauacucuuagucauagaugucagugaaaucaugagucacucugugcauccugcauuuucuuucauccaguuauuuccaguagucuaaguaguccaggucuguaguucauuagaaaaugaauuuaaagauugggauaggaaaagccuaaugagcagauaggucauucaucuagcaaacuuuuaacuccuagcauaaguuacaguacauagaauaacuucaugaaugcucauuguagucaucuugauucuuagacucuguuuuuaaccaugaguaaagagcuuaguccugaccaagucacaaguagagacuuccuguuagaucagauaguacugagugcaccuggcagugcuggcuccaacucuacgugcuaaagcgcuaguucuuuguuuaugguccuauucucuauacaguaucaacucuuagggcgcuguuucuguuguuaucaguaggccuuuauuaauaaaaccauagcaugcauguaaugaacuugacuuuacccucaaaugucuuauucuuaaauucucuuugauuaguaacacuugugcauaccuucguucagcccagaaaccaacaucugauaccaguccuaaugugcacaucuagcuguuuggaaaauugugcagaaucuauuuaaaacuuccccucugucucaauagcauccacaucuuacuuuaaguccuguagcuaaccauuucuguucauucauucagcagaaguuuaucuguguuaugcaaaggucuuguucagguagggaaggcaggagggggaaaggaagggagagaaagggagcgagacccccucuaggagauugcaaucuaguggaaaaugcauucauuuauguauggugagaguugauaucuagugauaaguguggaguaggaggagcccaaccucagccaggguccacagcagcacagcucucagaggcuggggcucaaaggggagcuuaagcuauguggagaguuucuggagugaaagauacaguucaguucguuauacauaacagauacaucaaaggcauaccauuggugcagguguugcucucgagccucuuuccuuuccuccccucucuucuccucuccuuuucuuuucucuucuuuuuugugaccauaguuauuuaguggcacaucauuauacaguuaauccccauuucuugccaauucuguauuuaugaaugugccuacuucacaaauuuauuuucauccccagaucaauuuucuagaugauuuggggucauuugaagaugcacacaugcagagccgcacuggcuucaaguuggacuaguaggacuuuucauucuuuuaaaaauguauucacuuauuaauuucugagucugcacauaugccagagguuaaaacgggguucuuccucuucuuucucucguuuccuuuucauucuuucuuuucuuuuuucuuuuugcauuuugagauaaggccucuuccugaagcuggagcuugaagccucucagccugccaugagcagcaugcagaaucugccauugcacaugugcacagccuggccgcuucugugugagugggggguuuggguguagguccauuucugcgccuucggguuuuuuguauucuugucuuagugaauuucucuaaauccuuuuagguuuaucuaguauggcguucuuguuguuuuugcacuuucauugauuuuuuuuuaaaucaauuucaccauuaaauggaucccaagcacaaugcugaagugcuuauauuucuaaguauaagaagcuaugauauaccuaauagagaaaacacguguuagguaagcucauucaggcaugaguuauaccacuuuuggcuaugaguuaaugucaguaagucaacaauauaaaauaagaaucuuuuaaguaggaauacauauaaaaaagaaguuauguguuggggugguugaugaaaauaugaccagaggcuagcaggaaccuuuauuucccuuaggaauaaugauucagaauuugcuaacucagcaucugccacaguuauagaaaguaaauuugauuugggggaaauggccagucauuuauggucaggauugaugaguuagauauaagugaucaaacugaccaaagaaguaugauuaugaaacagucuuucugaacuauuauauuacauacacuaccucuugagaaaagguuagcuuacaccccaaguauuccuguauauauuauauaccccccuugguaggcauggccagguugagagucagucuacaaauuuuauuuuuaccauuagucaagaaaaaagauguugacuuuuacuuuaugaggguuuaaaauauaaagcauaaaaggaauuuugcaaaaagcaggguuuuuguuuagugcuuuuaaaaaguccuuuuaugaggaguaucuuguauauuaugggggucagcaagcauuuuccauuaauguccagucaguacauauuuuaggcauuauuggccaucagcccuggauuuaacuuucuaccacuaucuggugagaggaaugauagcaaguuccuuaugaauuuacaguggaaaccuugugggccaguggcugugugccuucuauucaguuuauccuucacaaugcagacaaugaucuaaucuagugggguaucauaaguguuguauugauaaacugacuguaguccaguuaacaaaaagacugcauguuuaauuuuuauuaagugcgugugcgugucgugcaugauguuggaggucaggacagucuggggagaguacuuuuucccaucgugugagugcuggggauugaacucgggucaucaggcuugguugcacucacauuuacuugagucaucuuguugacccaagaaagacuauauuuuaaaaucauuuaugccauuacuaucucaauuauuuuugguaucuuaauuuuuuaaaucugugcccucuguaggugaaaacaggaguuugagcucauuauaguuggaauuaagcacucagucauccaguuuguagcaguuggugaauacuacaggauagguuugcucacuuuuauaaauauuauaguacuucugguagcugucgauacgucugaauugugguuaagucuccuuaguagcaucaguuugauuaugugggcauggauauaaugugauuuuuaguaaaauuugguacugauauaaugaaaucauuuuauagcugcaaauaguuagcaagcuaaacauccugcuggauaguuaguuggucacaguguugggcaagagccacaugcucccauggggcagccccaugaccucuaccugccucuccuuauuugauaaaugcuucuuuccuuguacugcauaccacuucucuuagaaguacaccaccaccaccaccaccacacacacacacacacacacacacacacacgaacacccgccacugucuggccuuucaaaauaggguuucccucuguaucccaggcuguccuugaucucacaaagauucacaugccucugccuccagaaugcuaggauuuaagguauucuccaaccaguuaauuuuuuuuucugccuguuuaugaggaaaaaccucuagaagugaagaaaguuaaaaccgugccuacuuguuucuuaguguuaauuuacuuugaacaucacguguguguuucuugucugagcauguguaguuacauuguuuguuuguuuguuuguuuguuugauuuuaccuuguuuagcuuauaauuuugucucuccccacccccaacucuaccuugccccagacagacugaacucaggaccuuguucuugcaaacaagugcacaugcacugagcuaauccccaaccuuugagcguguguaaacacaagcauuacugcuaccuuugagccugucaucuuuuuuuuuuaaacaaaugauaugaaaugcuuuuuaugacugaaaauggauucucuauauucuccuaagagaccuucccaaguauguaugugagaugauguguaugagagagauagauuuaaguucauaggcuaugagucugaaaauugguuaucaggacucaauagcccuacacugucugccgcagccgucucaugagcaugguggaagaggugcugugugaauguggauccacacugauuuccaaggguuagccuccuaaaguguggaaagugucuuguugguaauucauaugcugauuuuuucccaguuaguguuauaagcacauaucagugaaucaagacacauuuaaaguagucuagaaaucccaguuucuuuuggccacauaaguuggucuugaaaauaaguguguguguguguguguguguguguguguauguauguguguauguuuauauauguguguguguaugcuagagguaaauguugaaugacuuccucuaucacucucagccuuaguuuuuaaggcagugucucugaaccuggagcuaggagcuagguguuugagccagucuagcuagccagccaucagucacccagauuucgccaucucugaagcccuuccuucaaauuucuaacccuaggaaaggcuucggauuuucagagaggcuaaauauaaauaacaucuauuaugguuuuauauaauauaaauaacaucuaucuuuuuuuuuuuuuuuuuuuuuuuuugguuuuucgagacaggguuucucuguauggcccuggcuguccuggaacucacuuuguaggccaggcuggccucgaacucagaaaucccacugucucugccucugccucccaagugcugggauuaaaggcaugcaccaccaugccacuuggcuuuuauguggaugcugggaaucuucacaacauccacuaagauuccucccuagccccaggaacacuauaaaguagaucacaagaugcuagaaaguauacuagcucucuuuuuguuuuggaguuacuaguaaauuuuuggugacuuccuauaaaagagaauaauaaagaaggccuaauuguuacuuggaaacauuuaaauauuauaguaugaauaaauuaguucuauacgcccccaaaauaaaaaugaauuuauucccauucaagaaaguuuugaaguacaaaauauuucugauuaguauuuugcaguaacucuaguaaauuuuguuuugugucuacauagugcuggcuguccuagaacuuacuauauauagauagaugauacuggccucagacuccgagcucugugauuaaaggugugugccaccauaccuagcuucucuaguaguuuuaaaaucagcuacuuaaagcaauuuuauuuuuaccuuauuuuaaaaaggcuuguucuuuaaauuuuuaaaauuuuaccuuauaucucuuuuaaagauaauuaaaugaaucaguuuaaguguauauauucugaaauacuuuaggguaaauguuauaaaacugagcaauagcauuaucaaaaauugauaggaauuacauaccuguggugauaaaguucuuagacaagcuagacaguaguaguccccggaggaucacgucugguaaccuucuauguccuguugaucuuuuuggaguuguuuuagaaaugcuuuuuagauaguuaaaaauauuaacauuaauaaaacuuuucaaaaaucacuuuacuuugcuaagaaaacuaaaaaauaaauaucacagguuuuuaaauuguucuuuaauacuugaaugaccaauuaaacagcuuucucccuuuuucagcauuaagaaguuagagcuucuucuaugcuacacaagcuacuugaaauauuaauucacuuuacaucccuauggcagccccccuccuucuucuccucccagucccacccucacaaaccccuccucccaucaccccuccccuucccuguggguacuacccuacccugggacaucaagucacaacaggacuaagcacauccucucuuacugaggccugaucagcguccagcuaggggaaggagaucuagugguaggcagcagaggcugagacgacccccacucuuauuguuaggggacccauaugaagaucagacugcucaucuacuucaaauguguaggggaccuaaguccagcccccgcaugcuuguugguuggugguucagucucugagucuccaugggcccaaguuaguugacucuguaggucuucuguugggucucuuggcuccugccuguaauucuagcauucagaaggcuaaagcagcaggauuauaaguucagagcccacuugcauuagagagucuucacucuacacuguugcacaauaaaaauaaaacaagaaacuugcaaagagcaccauagcuuacuguugggccauaauuacggaaaagcuuuaugaauauuugucuugcuuaaauaccaacacgugcacauauauaugcauacauaucagagagcauacgaaaauauuuuccaaacagccauuauauaauugcuauuauuaggaaggcuuagaagaguuucuugguguaagaaaagucagaaauucagacaugaaagucugaaggaaucuuggcucaaggcaugaaaacauggggguaucugaguccuuugagaucagucugacaguuacuuauuuguuuugauaaaugcuuuuuugcaaacugaaaucuagaguaaauggagauuuuuaucaguagucuuucacugauagcaaaauaguuuguauagcuuaaaauagugcaaaauuuguauguauaugucauacauuucaguguuuucuuucuuuuuuuuuuuuuuugugaggggccauuaagauaggaucuauccacauagccaugaauguccuggaauucacuguguagaucagaguggucuccaagucauagagagucuccugccucugauggaauuaaagguuuacacugccacaccuggauuaauaauaaucuuuuaaguuuaacucuagagcagguuuuaccugguuaaguggcagagcugacauuagaaaccaggagcauaaauaaauagacacauacuuaugucuuuaugagacauuuguagcuuuuuuuguuuugcuuugucuuuuguuuuuuguuuguuuguugagacgggguuucucuacauagcaaccuagacuuucuuggaacucacuuuguuggucaggcuggccucuuaacucacagagaugaauugcuucugccucucaaaugcugggaugaacagaauccagguuuguaaauagcauauauuaacaggaauauucggaaagagccaaacauagcuuuuuuugcauuuauguguguggguguaauuuuauaaauaacaguguuacacaugacaugauuguuuucugaaaguaaguuguuggauuucauauaauaaaaucauaaaaaguaucugacaccuuuaaucuucacagugucagugauauuuaaauauaguguguuagcuuauuuaauccacauggcagcccuacaaagucgauauuaaccccacugacagauagagaaacugagacauagaguuucgaucucaggccacacaacuggugagugacauuaccagaauucuaauccagcaaggcuguguccuaggguuuuacugcugugaacagacacaaugaccaaggcaacucuuuuaaggacaacauuuaauuggggcuggcuuacagguucagagguucaguccauuaucaucaaggcaggaacauggugccaguccuuuaucauccaggcagacguggugcaggagaugcugagaguucuacaucuucaucugaaggcugcuagcagaauacugacuuccaggcagcuaggaugauagucuuaaaguccacgccuacagugacacaccuacuccaacaagaccacaccuagugucucuucuuggguugagcauaaacaaaccaccacagcuugacuccagagacugcuuuuaacaaguacuuuaaauaauuguuuagauguuccuuagucccacuguggguuuucuuccuucuuccuccuuucuguccccuggggauuaaacccagggucugauacaaggcagacaugcauuuuuaccacuuuucuccagcccuuaaaauucauauucucucucugucucucccccucucuauauucugucuuucuuucucucucucucucucucucucccucccuccuucccucucucuccccccucucuguucuguccuuuuuuucucucucucccucccucccucccuacuucccucccucucucucucuuucucucucucucuguucuguccuuucuuuuccucccucccucccucccucccucccucccucccucccuccuucccucccucucucucuuucucucucccucugucucuuucuuucucucucccucccucccucccucucccucucucucucuuucucucucccucugucugucuguuucuuucuuucuuugccauguagcccaugaugaugacuugcggcucacucuauaguccaggcuguacuaaagcucaacagcagucuuucugccucagccugccaagauuugcaguuagugcacugccauaucugcugccuugacagauguagugaccauugggcacacuuagcuuugagguuagauaugcaacugucagaagcacuaagaacauagaauaaaagaggcuaaaaauuccuaaucuuuggguaggaaguguagggaacuagaggucaugauuuucuaauauaaguucauuauaugagaaacucuaaguacauugguaaaauauugaucuguucucaaguauuugagauuaucugaaguugaauucccagcaaucccaugguggcucauaaccaucuguaaugggauccaaugcccucuucuggugugucugaagacagcuacauugugcucauauacugucuuagucaggguuucuauuccuguacaaacaucaugaccaagaagcaaguuggggaggaagggguuuauucggcuuacacuuccauacugcuguucaucaccaaggaagucaggacuggaacucaagcaggucagaaagcaggagcugaugcagaggccauggagggauguucuuuacuggcuugcuuccccuggcuugcucagccugcucucuuauaaaacccaagacuaccagcccagagauggucccauccacaaggggccuuucccccuugaucacuaauugagaaaaugccuuacaguuggaucucauagaggcauuuccucaacugaagcuccuuucucugugauaacuccagcugugucaaguugacacaaaacuagccaguacauauacauaaaagaaaaacuccaggauugaacaugaccuguuuaaaaauuaaauauugguagaaaaauuuuuaacaagcacaucaguaaaauauuaguauguucucaaauauuuuugagauuaucuuaauaauuaauggagacggcaucucucucuguagccuaggcuggccuaaaacuagccauucuccugcguuagccuuuuuagugaccuaauuuuaaaauugauuuuuuuuucuaaguaguucuagaagucagcgcaugucuuugugcuccucacaguauaucaagggcaggguuuuauuacauagcucaagcuggcccugagcucacugugugccuuacacuggccuucaucuaccucaguccuugagugcugggauuccagugugaaccaucacaacagcuaagaguuuuuuguuaaguagaaaugaaaaucaaguuagagaaagauggugucaguuggacgauguguucuacuuguagguaugggguguaagugcugucuucuguacagaccacucuuguacgguuauuaaagcauagcaucccgaguaagaacauugaguaaagugcuaggagcaaaaucagugacuuucagaguuuuaauuaccucuggcccauccaccugucauuaaaauagaguagcauuugacuucaacauacuauuaugcacaaaaacuuuguugcuguuaacauugauaaaauaaucacauuuaagcuuuuugauauacauaaaaauaaauuuaugcuuuucugaguccugaauuauugcaugauacagcaggcuagauacuuguaauaaaacaaggagaauucgagcuucauguuaauagaagaauucaauuuuuaaaugcaguuaauuuacuaauuguaguuucucuucucuucauagucucucucaagucuacccccuacaccuguauuagcagguagauauuuauaggugagugugauggcauaugcacuuucagagucgcacucucaugaugacugcugauguuaacuuccccauggucuuugggacauggaaugugaaaaagaaauguuugauccugauccuuucucugugauaacuccagcuugugucaaguugacacacaaagccagcugguacagauugaaaacccacaaaagagauaaaagaugaguuauuuacauucaaaauauuucucaucuauucaagauacauuuuuaaagaaggaaagcaucagauaacauauaaauguaaaaugauuaaaacuguugauuuaaaaaauuacaacaaaucgcaacaaauguuuuuuaaagguaugaaauauacuaauauuacaagggaauacuaaaaagauagggagaaaacccccccccacuuguuucaaaaaaaucuuugucaacaaguaaauacuuaaaauuaggggaaauguguuuugaaggaacuuguuaccuaacugccucuccuaacuaauccauccaggccguaaacuggucccgggugacaguuacacugaccugagcgugcuggaaucugauccucucuccccuacauucccugcaguauaaagacccccucagaaugggcuuuuccguuucauugugauaaggaaugguuuauuaaguauuauccccccuccaaaaaaaagaaccccuaguuaaaaccauucuuaagucaccuauuuauguuaaaauacugcuuuucaauguuauaacaguccuuuuaccaugugacauuuuauauaguggcucccucacuuuucagaucgauagaccccagaaauuuugaaaaugacccaaauuauuugaagauuuuaaauguaaacaccucauauuuuaguucugcacauuuuauagcuagguaacuugaaauugaaguuagaauaccuacuguaaguugagggcuuuucugacuguauaaucaguuuaacaugggaugccuaauggcuauaauuauuucuguugccuuuuuaccucuaauggaguaaauguauauguaguugcggcauucugugcugguuugcuaaauccacaggaaauaaaaggguacagcuaggacgaaggaaagggaauaguuaaucguggaggaggagaggcacagcucaguacuuugccuagaggccgcugggaaagugacguccuguagcguucguucguucgcuguucuagaaaguacagagacacguaguugaagugggagggucuagcugaggccgucuccgugcggugucuauuuaucuguaagugagcugccggggaggaauuaaauagagacgcugccugcugccucuggacagcugagccgaguugcugauuugcuuuaacuuguaagauacccagcuugcuuuauuuucucaggaucauuguguugcuaagccuggggacgcuguuuucuuuuacaaagggaaaucuaaguucauuucaaggcauucgaaauggggaaagacuauuaucacauuuugggaauugacaaaggagcuacagaugaagauguuaaaaaggcuuaccgaaagcaagcccucaaauuucacccggacaagaacaaaucuccucaagcagaggaaaaauuuaaagaggucgcagaagcguaugaaguacugagugauccuaaaaagagagaaauauaugaucaguuuggcgaagaagguaagcugcauauuucuguaccuuuggcagugucugaaucguagcuuuuuuuuuucucucucucucagccuucugguuaucguuacaugagaacaucagacauacuaaaauaaaaagaaaaauaacagguuaaaacuaagguuuaauccuugauuauuugaaugagcuaugaaugaaaugucauguuugucuuuguggguuuuuuucuuagaauauuguauuauucauauucuccuguuagacuuauuguuuuagcauuuuauauuuuaaaagaaaccuuaaauucucaugccugugaaugaauuguuuaaaagucuuaugcaaccuguuuuguuuuuaaugauuuuauugccagaauuaauagaaucuucagucacuuaaaauuuuaagaucggcaauucaaauucugggccauuuauguuuuauuuagaaaaacaagaaguuuuuuguccuuuuagagcgacgcuaguugaaacugaacaagacggaguggugugucguagaagcagaaggcacaggcauuuagcuucuaguuguuuuuggcaaucugccuagagaggaaagaauuucccugaugucauaaaauaccagaacaaguuuuuagcuuaauuauaaacaguuaauauugugccaggagaacaagaucucucucucucucucucucucuuucucccucccucucuuccuccccccccccccccgcccucccgcccucccucuccuucucuaacccaaaauggccaccuaguuggaacaaugacugaguuuguuuuaguuaacuauuucuuuuggaaauuuuacuauguggcugaagaggaagcaugacagcugcccuuucccucagccauacuuuuuuucuugccuucugagaucaggacucagugagcucaguagccuuugagaaucuccuuuuaccauuccgaauuuuguccagcaucuccauaaauguccauaaaugucguaaauguggccauaaaguaggaguuugaaauugucagucagcagcagcggcaaccaugcauuaguucacgugaguucugggguuuucaaguguuaaaacagacuaaaguucuuuugcauuauucuuccccuaaugucuuuuaagucacgguggcuauggaaacauacuguuuuccccuuguuuauagcauuuaaacaccagauuucccuaauuagaaguccuucaaacagggccaugcauuaagcaaacuaaaccgacaacucagagcaguggugggcccuuuuccuccugcuuuaauuuugggucagucccaagcaugcugcugccugugguuguaauucgugcaaauccacagugucaaguucuuacaaagugagugaguaauuacaagaagcaagauguggauaguugaggcugucuguuccccauggucacacaguugagaaugccguggugugaccucucaggagcgagcaggcucuugagacagugccaguacucuggccacucuugaguagguggaguggugugugaguucccacaaagccacuuguguaaacgcagguuauuuggcuccaucuuauggagugcucaagugcaccucuguguuaagccguaggauucaggcucauuaaucguguuugacuucagaguuuucaaguauaccagcugguacucuuaauucuuuacguuuucucuuggcagugcuuuuuagaguaacucacuccccaaauuaucuuucuuuucuuuuucuuuuucuuuuucuuuuucuuuuucuuuuucuuuuucuuuuucuuuuucuuuuucuuuuucuuuuucuuuuucuuccucuuauuuuuuuuuacugaucauuaccagugacuaaaucacaauuucuguauacccugagucuuuuuuuguucuugguguucuuagcccagaucagugcucuaagcaaggaacgaagcaugaagcaggacugguugcuuaaaguguugaaauuuauuauucagaaauacucuguaguuauuagcuaccugaaaauauaggagagugaagacuguugagcucuucuguuucuuacuauuugguaaccuagcacacagugacugcaaagcucugucggcuuaggaggaguuguagcucagggccacagcacuagcuaagcaugcagagccccgcucucaauccgcagcaccccacccucauggccuggagguucugugugaggaagcuuuucuccuuucucuccuucgcauuguccgugcuuguguuccugagucuguaggccucuccaauaguaacagaaaucuagacuguccacauuuacaauuaagagaaccguuaauacuguuuauucaaguugugaaauucuuuuaacaucugaaauuuaaaaugguuucguuuuaaaaaagugaauaaaauaacuaugguuuaaaguuauuauauuaucuaguaguuuuauuccugggaaucaaaaagaaaaauaaacaagacaaaacauuugcucauacaaagacauguuccugauuguucauaguaggaccauuaaggucccugcauccaaacaauccagaagucacaugguuuagcaaauggaucaacaaggaguauauacuccaguggguacuuuuuagcaauuaaaaagggacccguuuaaugaaguaugucucaacuggaugaaccuggaaaaacaugcuggaugaaagacucuagauagaagugauacuguauauuauguaauucaauuugugaaauaucugauagcugagcuagcuugccuaggacuggagguaggaauauaggaauaagcaggaaauacaaguagagaccucuugagaguggugggaauauuccacaaauggauuguaguaaauuuauuacagcugaacaguauacaaauuaauuuugucauguagucuacauacuaaauaagucaguuuacuucauaguauaaauauuugaaaauaaucaugaaacuacagaaaucuauaauuggguuuugaauuauucucugcccuaaacuuuuaggcuugguuaaguggauaugaacagagguuuguauuaaacaauuaaauuauuuuucucuauugagccagagagauggcucagugggcaaaggugcuuguggaccugaguucaaucccugggacccucaagguggaaagagggaccuuaauucugaagauuguccucugaccucuacaugcauaccaugacacacacgugccaucaacagaccaacugaccauaaugaaaugcaguuuuaaaauauaaaaguuacaacuuuuccucaaaggacaccuuuagaggguucugguuuucuagccuucauuucuuccuucuuuacuuuguugauuauuucuuacucacuaauuuacucuggauguggacaguuguugauguguuucaacuuaacuauucaguguaauagccuucuucuaguucaguauucucuuccaugcaguuaguccgcugcaccucuuuguuuucuggguccuaaagauacagaaguuacuugugaguuaaccuguuuaaaggucuauaacucuguucuauaacucuguucuauaacucugaagucuugcuacaaaucgaacacuguuaugccuaggccuccuaauaggucccaugacucuucucugcaguuccaauucucuaggguuccuucuuuucauaguuuuugucagauuaacuaaaagacaucguugcuaugggcaguaucccaaagaucuauuuguuuuuguguguuaaauugguuaguugauuaaaagacuaggcagaugccgaaucuagaguccauucccugacuagacagugucuagaaaauguagagagcagagagaauccagcuggauguugacagguucugcugggaguuguaguguacaggauuaagguuaacuaucuggcugacggcaugcuugauagaauucaaguguuaagcagugcaggagacagcaagcaguucaugucauacuacagcggcauuugguaggauuuucucauuauuacaguguagcucccuucuuuaucuggacuccacaguugacuguuugaugucuaggaaacucaaggccacauuuuugucagcucugaugaguaagucacuucaggcugcguguaaauuuucucacagacuauaauacugacugaauuaccauuuuugggagcaagggaagagguuuuagggaaaagccaaaccuaugauguaauacugaaaauguuauucuuucuuuucuguuauguguccaaagcauuuagauuuuugccuuuuagagagcuaaggauaggcaugcucacuuaccauguugauuaacugguaaacucuuauacuuuaugaaaccugugggaagagggauacaguuccuggaaugauuuaaguacucauucaguuaccaugugaugacugugaggucuauacuucaucuaucauguaagaaaaucucucacuagcuuuucacacuuggaguuacagucauauuaacaaggcuagagaaggaagucagaaugagcaguuuaguaaccuuguuuguccuucucagacuugucauuccauuucuacagugaauaccccaacuaaccaugccacgugugugcgugaguguacaugccugcgugcaugccuguaugcaugcacacuccucuaaugaggacucugauuaggucuuucuugguccuuuagauuucucuucauggguaaagguaagaauuuagauguuaguugagacuguuggaugucacagcgugcucucucucucucucucucucuauauauauauauauauauauauauacauacauacauacauauauauccuuuaauaauagaaaccaacuauacagcaggagaugcagauuaagccucccugacauugcagugauuagaucucaccuguguguguuauuuugcuuuuucuuugucuuuuuuaggcugauucucuaaacacuuauuuuaguuucaguucaggacaacuuuaauaauuagcugauuuucuucauucaauagacuggaguuccucauuuucaaugucauauacaugagcaauaggaauauagggauauaagaaucucaguuuaaaguagaguuuuucauaguucuguaaucuuaauuuuccuccguccuguuuuggagagggauccuaggcucugccaggagcuucacuagacugauagaaaccuuugccacggucggccuccuaaaacaucacuauguugcuguaugggcuuuaguugaaucuuucuuugguaugugguagaaaaaugcuauuuuaaauauauauaaucuuugucacccacauguuacuuugcugaaccucugggcaaaaggucauaguacuacugucuaaaguggguugucaggcagaaauaacuaguccauuuuacauguuaaaaaacccugauuuuuuuuuuuuugguccuguuuuuaaaugcugugagucaggaugugauaaaguggacauaaaaaggcuugcugucuaaggugaugauaaucuagugucuacaaaaaauuuuuggguuggagagagaugguucagugguuaagaguacuggcugcucuuccagagguccugaguucaauucccagcaaccacauacaaccauuuguaaugggauccaaugcccucuucuggugugucagcaacagcauacugaaauacauucaauaaauaaauaaauaaauaagccaaucuuuaaaaaacaaaaacaguuuucacacugucccuuuuauuauauuucucccuugcuccucuaaaaaguguucuauuucaguuauuaaacaguagagacauaggagcuggagagagggcuggguccuggcugcuuucucuaagugcuggaucucauugucaggagcuccccaccaucuguaacucuaacuccaggggguuuugaugcuccugaccuucacagguaccugcacaugugcacauacucauaugcacacacacacacacacacacacacacacacacacacacacaugccuacacauaaucaagaugauaaacaucaugaaaacaacagcaaaggccugcaguaaagcuacgagcacgaacuauguuaacuguugcuacuguacuuguuuuuauaaugguccuuaggauuuagacuugguuuucaaccggcaucuuuaaaacuauuaaauuuguaauacuuaaguauguuagaacaggaguuuuugagguaagggagucucaauuuccuuuuauuuuucauauuuauugugaaacaaaagauucaagaagaaauuauuaaagcaaagaauuuggaggaaugauuuaaaagcuaaaacguuaacauaggauggaucuucagaaacuauucuguuuaauucuaaugauguuucaggccguaagugauaagucagaguuuauuagcagggcaaucuguaaguggucagcugucuagacugccggcccuuuuccuaaucuugcuuaugucuucaccaggcuugaagggaggcgcuggagguacugauggacaaggagguaccuucagguacacuuuccacggagauccucaugccacauuugcagccuuuuucggagguuccaacccuuuugaaaucuucuuugggagacggauggguggaggucgagauucugaagaaauggaaauagauggagaucccuuuagugccuuuggauucagcaugaauggauauccaagagacaggaauucugugggacccucccgucucaaacaagacccucccauuauucaugaacuuaaaguaucgcuugaagaaauauauaguggcugcaccaaacggaugaagauuucucgaaaaagauuaaauccugacggaaggaguuacagaucugaggacaaaauucucaccauugagaucaaaaaaggguggaaagaaggcaccaaaaucacuuuuccgagggaaggcgaugaaacaccaaauaguaucccagcagacauuguuuuuguuauuaaagacaaagaacaucccaaguuuaaaagagacggaucaaauauaguuuauacugcuaaaauuaguuuacgggagguaagucaguaagucagcccugagacucuaagacggagagaugacugcugcugauugacuagggggcugucugggcagcgcuggcuuuuauccagugcucugcagacuuauuccucaugguaacucucuaggaaguggugcuauuauagcucucuucuggaugacaucauaguuucuaaauuuauuuacugauguuaacuauuuaaaugucgguuuucaaguacaaguuugguuagcuacuuuauggccaguguuagguuaacucuaguuuuagguuguggucugugagauccgcauugguaacccaccacuguaguccauuaauacauuuguucugaagugauuggaguacaauuuauagaacaagcauuagaacauaacaaguauauaauuauacauagugcacaauaccaccccuuaauauaguucuugaguccuuauuugcacuacuucuuggauggggccaugucccuguuuaaauggcucaguguaucccuaccaacuaauauuccaaacaguuuaaaagauagaaaucuggcuucuaucuccaaguacauuuucucuucccugaauuugcuguuauuacuuugcuuaguuucucugugucagagcuccacuguaugguuccccaugugguucaacaggaacuguacugugcccaguagaccccaaggucuucuggaaaauagguuuuguuccuguuuaguuccguccuguucuaaaguccuccuguuucuccaguuaguuuucugcacccugacuaugauagcuuugaacguccuaagucagcguggaagacauccuugaguuaacuuuuucuuucuuuguccuuucaugucucucucugguaacaucucugauuaugccucucuugagcagaguuuuuagaauaggaaaaagguuuauuaacuauuguaauccuuuuggaaguuaaaauuuuaccuucaugguguuacccuuuacuuccuagcacaaucuuauauucuuuaguuuggaaguuuauuaauaacuucauuuuauuugguccacuuuaggcauuguguggcugcucacuuaaugugccaacaauggacggaagaaaccuaccuaugucagucacugauauugugaaaccugggaugaggagaagaguuauuggauaugggcugccauuuccaaaaaacccugaccagcguggcgaccuacugauagaauuugauguguccuucccagacgucauaucugcagcauccaaagagauccugaggaagcaucucccugccuccuaggaugagaagaaccuugcuauccauaguuugauaagacacugaaaauauaaaaguaccggcaguugacugcugugaauucuguguaaagauguguaaacucuucugagggcucauuaaacugcaugaauagacacaguucaaauaggcaacguggguuuuuacaguagggaugaaaagucauucacuguauuucauuucucccaaaucagaaauuuuuaguauuucauuuacaaguaaaaguugguuuuguggucuauggauauacuucuaguaaauacuagauuauccaaguacugugugcaugugcguguguguguguguguguguguguacgcgcgcgugugugucugugugugcucgugucuguguguguaucuuuaaaugaucagugugauaggcuccuuuaauaaaaauuaaaauucuuaaguguauauguaauauguggagaauaaaagccaaagucauacagaaaugcagucuaggugacauucagagaugcuguguugggcugguaccagaaugcauugaugugugugcuuuaccguugugacuucucaauauucugcagcguuucuuaagagcaugguuguaauguucguaaagcagaccucaucauaagaagaaaaugaaugacauuuucucuccuguggaagucccaauagccagagcuccugauauuuuagaaacagaugguuuuuaaguggccacauguaauuuuaugcaguugacuauauaucuuaaacuuaauaagcucauuuugugguucauuaguuuaagguauuuguuuacuaacauguuuuuagagaaaauacuguuacuuggcauuaauuguccauuuacaguguucuguuaaguuccucaugcuaugcaccuuacauaauuucccuaaagaacagucaucuaucacugugguguuaaaccgcaaucuggauauaacaaacaccaucacugcuuguggguaaugugcugucaucauauaaauauucuaccuuuucauguauauagauugcauuucuuagguguuuuaauuuuuaaaauauauuuacauucuaaaaaauuacugucuucuguuuuauaucuaucaaaagugauguuaugaaaaauuuuuuguaaaacaguuuucagaaugauauauaucuauacauaaauauauaugguauacugaguccuauagucuuuuuaauagaaugugaaguuauuuagaaauucuguauaaaauuauaguaagcguauaccuuguggcuuuauugaaauagaauucucauaagauaaaauucacacuaaccucccucauuuuuuugguacuguugacugacgucagagcugcgugcacacuaagugccucccaccguggagcugugcccagccucccccucucucucucuuucuuugugguguaguuuugaauuucguguauccacagaccugugcagucaccaugaacagcuucugugcccccucuccccucagccccuggagcacugaucugcuuuucaagauggauucuauuguagaauagaaucggucggcaugcggcuccuuuauuugcugucguucacccagcacagcacuguucucaagguccagucuggccucauuaucaguaacuucauccuuuguguggcagaucauguacuuggguagaaucccauuuggucagcuuaccucuucuuugguguuuugggcaucuggguucuaucuacucaguaugaauaaugaugcuaugagcauuuguaaacaaauuucuguguggauagacugacugcauucucugagguacauaguugagaguggaaugguuaggaaaagcuacauccauuaguugcaaauagaaaauguuaaaaaugccagagaguugagguaaucgcaccaucuccuugaacaucauggaaauucacacagauauaaagagcuaaagucuuggagugaugguuguaguucauauucgaaaccacauacccacaguauucaacuuuugaguuguuugaggggggcaggguguguguguguuugugucugcuuguuuggagguagggucuuacuauguagcucuggcugguauguugcuccaugugacucaaguucacgauaaauuuaugggaauuuuucucccugccucauaguggcuggaaugaauggcaugugccauucacaccacacaggcuuugaaccaacaauuauuauugcagucuuauugaguaaacauuuucucugagccaaaauaaaggguuuauaaacacaaauaaucuuucaguuaguuccuuuaguaauaauuauucuaacaaucaaucaaucaaucaaucaaucuguacuacucuuagggcugaggguaggguucggugacaguaguagaauaaauguacaaaauauauaaauuuagaggaaacaugcuuccgaguguaguaagugcccauuguuuuguuaaauauugaauuaauacugacaguaaaauguuaaaaauuuucagauuuaaacuaugagaguacuuuugacuucuaagauguuccuuuuaggggcuggaaagagggcucagaggcacuugccucucgugaguggaccuggguucaguucccaggacacacuuggaggcucccagccgucugaaacuccaguuccaaggacaccucuuuggucuccaugggcaccaggcaugcauguggugcaccuacauacaugcagacaaacacagcauccuuuuuuuuuaaaauucuuuuaaaguguuuaauuuacuaguccuugcauagcucaaaugauuuugcagcauaaugaguccaguaaagcuucuuauuaaagauguuuguuaaaagaacacauauccacgggucuuauggcuuuccagggcagguguuguauuugguagcucuguagcugaggaacaguuuucuuaggacgguucuaagcgagacgcacuguuccaucacaucugcccucccugccacguggugcuucguaacccauggccuugaaagcauugggcucugacauccacauuagcuugucucucuggcuauuagucggucuuggaggcaagggguugaacaagccucuuguuuauucuuaggaaacugucauuggaauguuugugauuggaugaaaugaaauuagugcaagugauuggacucagucaauggccuugaugaaacacuccucucacauuucaggaauuaccugcucagucuuggggagucaaggccaacauggcuuucauucaauaauagauaauguaguauggcugacuaucuucacaaucucucucucuguauguguguguguaggugaacacguguguuuaagcaaaugucuuaacacgaacuaauauuaagauaggaaagaguaauuuaugcuguuuauaacaaugacaaauacacaaaauuuagauucuuggcuuacaauauuuauauuuaaauuauuuauauuuaauacugaaguuuuguaaaauugauucagggaacaagacuagaaaguuacuuugccuggguuucuaacgcccuuuaaccuuuuuugaaacucuuuucuucuaguuuuuucuaaaaauuaaauuugucuuuugacaauaccauaaaugaacaaaaugcugucugauuagccuuacucccacccucuccuaucucucuccuaucacugucaagguuccuuugccuacagacuucuuucccacaugucuuguuuuguuugugaaccguuagauuuaaccagggcuguuugugugaccauggauuuggggcuaucuuuuagacuucaguguauuugacagugugcacacaacuuaagacagugacuuccagucucccagaaucugucaguagccaaugguucagcagcugggagucccaccucugcccaugauugacugugaacggggccagucuugggcaggcucaacgugaaucgccguagcugcucugaguucgugacugcaauggcuguguuguuccuggaagacggcgugugauugcccuucucccuguugugccucuuauggucuuucauucuuucaccuacugugaaguucacugagccuuaaaagggaugcuacaauuguccuaucuaggacugagcuuccagcugucacuuauccugggcagccacacaccugcguucauggcaaagaggggcuucucccagaaaggcguuugacucuagguugugaccauacgggccauaaguucacaaggcaguuugacgauaugucaauucagcuaaacaagcagcaaguucucuccuaaggcccaugucuuccccagccuuguguuuccacuaaguuuacagugcuggacauugauuuuuuuuuuuuuuaauuuacuuuucugagacagggccuuacccuguagccugggcuagcuaaggacuuugaucccccagccuccaauaugcugggagaaugaguaugccaccauacccagccuagauuuagaaacacauuugcuguuguguuaugauugucuauagucuucagugcaguaacgugcuaugcagggggguagccuaagcaguauguuagacugcacagccuagcugccuacuaaguuauccaucuagauuuagacaacuacacacugauguuagcgccacaaaauugccuacugggagaggucccagaaugugucaagcugucuuaguuacuuuucuauugcugugacaagauaccacgacgaagguaacauagaagaaagagcauauuuggggcuaacacucugagaguauuagagcccacgaucgucaugaugaaaccugauagugggcaggcaggcagguauggcacuggagcaguagcugaaagucacaucuugauccacaagcuugaggcagagagcuaacugggaauggcuagucuuuugaaaccucagagccugaccucauuggcaugccucuuccgacaaggccacaccuccuaauccuucccaaacgguucuaucaaccggggaccaaauauccaaauauaugaguguauaggggucauucuauuucaaaccaccacagaaaccacacaugcacacaugcauaugugcaugcacacacacaggcacacacagagacacacaugcacacacacacauguguguacuauggcaugcugaggguguugguaguucuuuuuuuuuuuuaguaagaauaccauuucaugcugucaucuagcugccuucgugacacuuugguauuaguuuaaauguugaguugcagauacacaauuucuugucuaugcaaauggcaauaugaaauuaucugauacauuuuuuuuccuggguuggguauuaaauucagggucucacccauccugagcaagugguccaugaaugagcuacauccaaggcacacauuaucugauguuuuuagcccaugaaaauuauuuucaguugagugauauuugggaaaauccuccugaaacaggagguaaacaacucaaaguagcuccagcaaaugccugagauaggccaguuucucuaggucucuccugccugagaaagucauaaaaacccugaguuuuucucacacugagcagagccaagcugcaaagacgagaaccagaccagcugccuggaagaaacagaaagcagccaagcugccuggaagagguuuagagcaacugaggcaccugggaagggcccucuccaaccugcugagcugccugcaggcugugcagccugcuccagguucccagauuugugagcugucacccaugcugggcugggcuuuguugaugcagcugcaugugaguuauugcugcuccugcaaguaaccucucacccacccaccugcaaggaacuccaauaaaagucccuggcucaccaaguuggacuuugguauguuguggaaucuauggggugaguagauauguguugcaugcccccagagaaaguuuugucaccuaacauaaaaauauaacgaugcaaccugcagcaccgugccuuuaauuucaguguuuggaaaacagaguuaggcaaauguucuuaauuuuauggucaucauaaagugagcaccgaugcaauguggggaaaagcugugucuccugaaguugcuaccuucauggcuuccuuuaugacuguuacaugaauuuaucugugcauguguggacaugcauguaccuuggugaugugcagaagucuucucuccuuccagcauguggguccuggggaugaagcucaggucaucaggcuucgccauaaguacuguuauccacugaguacugucuugcuggcgcacaaucaguggaaagcauucauccaaaucuuaguguuuuguuuaguauuuacgaguuggaauucagagaccauuaggcaaguguccucuuuaucaaugcuauuucaguacaguguacuucugagaucuaaauagaagggcuaaaugcaucugucucuaaggcaacagucaagaaaaugucugauaaugguucucagaaaaauuuaaaaauguggagcugggcauaaugguauaugccagcuaucucagcacaggcugagacaggaggauuuaguuugagggcagccugggcuacauaguucauacccugaguucaacaaguaagcaaacaauaaaaacaauagaacaaaaaugaaauauuaaacacuuauuagaaaauuaauuuguauuaaguguguguguauuacccaucccccaaagugauggaaauaaacuuugagaaaaaa

SEQ ID NO: 1758 - RNA, 6006 nt, Mus musculus
guauggcguucuuguuguuuuugcacuuucauugauuuuuuuuuaaaucaauuucaccauuaaauggaucccaagcacaaugcugaagugcuuauauuucuaaguauaagaagcuaugauauaccuaauagagaaaacacguguuagguaagcucauucaggcaugaguuauaccacuuuuggcuaugaguuaaugucaguaagucaacaauauaaaauaagaaucuuuuaaguaggaauacauauaaaaaagaaguuauguguuggggugguugaugaaaauaugaccagaggcuagcaggaaccuuuauuucccuuaggaauaaugauucagaauuugcuaacucagcaucugccacaguuauagaaaguaaauuugauuugggggaaauggccagucauuuauggucaggauugaugaguuagauauaagugaucaaacugaccaaagaaguaugauuaugaaacagucuuucugaacuauuauauuacauacacuaccucuugagaaaagguuagcuuacaccccaaguauuccuguauauauuauauaccccccuugguaggcauggccagguugagagucagucuacaaauuuuauuuuuaccauuagucaagaaaaaagauguugacuuuuacuuuaugaggguuuaaaauauaaagcauaaaaggaauuuugcaaaaagcaggguuuuuguuuagugcuuuuaaaaaguccuuuuaugaggaguaucuuguauauuaugggggucagcaagcauuuuccauuaauguccagucaguacauauuuuaggcauuauuggccaucagcccuggauuuaacuuucuaccacuaucuggugagaggaaugauagcaaguuccuuaugaauuuacaguggaaaccuugugggccaguggcugugugccuucuauucaguuuauccuucacaaugcagacaaugaucuaaucuagugggguaucauaaguguuguauugauaaacugacuguaguccaguuaacaaaaagacugcauguuuaauuuuuauuaagugcgugugcgugucgugcaugauguuggaggucaggacagucuggggagaguacuuuuucccaucgugugagugcuggggauugaacucgggucaucaggcuugguugcacucacauuuacuugagucaucuuguugacccaagaaagacuauauuuuaaaaucauuuaugccauuacuaucucaauuauuuuugguaucuuaauuuuuuaaaucugugcccucuguaggugaaaacaggaguuugagcucauuauaguuggaauuaagcacucagucauccaguuuguagcaguuggugaauacuacaggauagguuugcucacuuuuauaaauauuauaguacuucugguagcugucgauacgucugaauugugguuaagucuccuuaguagcaucaguuugauuaugugggcauggauauaaugugauuuuuaguaaaauuugguacugauauaaugaaaucauuuuauagcugcaaauaguuagcaagcuaaacauccugcuggauaguuaguuggucacaguguugggcaagagccacaugcucccauggggcagccccaugaccucuaccugccucuccuuauuugauaaaugcuucuuuccuuguacugcauaccacuucucuuagaaguacaccaccaccaccaccaccacacacacacacacacacacacacacacacgaacacccgccacugucuggccuuucaaaauaggguuucccucuguaucccaggcuguccuugaucucacaaagauucacaugccucugccuccagaaugcuaggauuuaagguauucuccaaccaguuaauuuuuuuuucugccuguuuaugaggaaaaaccucuagaagugaagaaaguuaaaaccgugccuacuuguuucuuaguguuaauuuacuuugaacaucacguguguguuucuugucugagcauguguaguuacauuguuuguuuguuuguuuguuuguuugauuuuaccuuguuuagcuuauaauuuugucucuccccacccccaacucuaccuugccccagacagacugaacucaggaccuuguucuugcaaacaagugcacaugcacugagcuaauccccaaccuuugagcguguguaaacacaagcauuacugcuaccuuugagccugucaucuuuuuuuuuuaaacaaaugauaugaaaugcuuuuuaugacugaaaauggauucucuauauucuccuaagagaccuucccaaguauguaugugagaugauguguaugagagagauagauuuaaguucauaggcuaugagucugaaaauugguuaucaggacucaauagcccuacacugucugccgcagccgucucaugagcaugguggaagaggugcugugugaauguggauccacacugauuuccaaggguuagccuccuaaaguguggaaagugucuuguugguaauucauaugcugauuuuuucccaguuaguguuauaagcacauaucagugaaucaagacacauuuaaaguagucuagaaaucccaguuucuuuuggccacauaaguuggucuugaaaauaaguguguguguguguguguguguguguguguauguauguguguauguuuauauauguguguguguaugcuagagguaaauguugaaugacuuccucuaucacucucagccuuaguuuuuaaggcagugucucugaaccuggagcuaggagcuagguguuugagccagucuagcuagccagccaucagucacccagauuucgccaucucugaagcccuuccuucaaauuucuaacccuaggaaaggcuucggauuuucagagaggcuaaauauaaauaacaucuauuaugguuuuauauaauauaaauaacaucuaucuuuuuuuuuuuuuuuuuuuuuuuuugguuuuucgagacaggguuucucuguauggcccuggcuguccuggaacucacuuuguaggccaggcuggccucgaacucagaaaucccacugucucugccucugccucccaagugcugggauuaaaggcaugcaccaccaugccacuuggcuuuuauguggaugcugggaaucuucacaacauccacuaagauuccucccuagccccaggaacacuauaaaguagaucacaagaugcuagaaaguauacuagcucucuuuuuguuuuggaguuacuaguaaauuuuuggugacuuccuauaaaagagaauaauaaagaaggccuaauuguuacuuggaaacauuuaaauauuauaguaugaauaaauuaguucuauacgcccccaaaauaaaaaugaauuuauucccauucaagaaaguuuugaaguacaaaauauuucugauuaguauuuugcaguaacucuaguaaauuuuguuuugugucuacauagugcuggcuguccuagaacuuacuauauauagauagaugauacuggccucagacuccgagcucugugauuaaaggugugugccaccauaccuagcuucucuaguaguuuuaaaaucagcuacuuaaagcaauuuuauuuuuaccuuauuuuaaaaaggcuuguucuuuaaauuuuuaaaauuuuaccuuauaucucuuuuaaagauaauuaaaugaaucaguuuaaguguauauauucugaaauacuuuaggguaaauguuauaaaacugagcaauagcauuaucaaaaauugauaggaauuacauaccuguggugauaaaguucuuagacaagcuagacaguaguaguccccggaggaucacgucugguaaccuucuauguccuguugaucuuuuuggaguuguuuuagaaaugcuuuuuagauaguuaaaaauauuaacauuaauaaaacuuuucaaaaaucacuuuacuuugcuaagaaaacuaaaaaauaaauaucacagguuuuuaaauuguucuuuaauacuugaaugaccaauuaaacagcuuucucccuuuuucagcauuaagaaguuagagcuucuucuaugcuacacaagcuacuugaaauauuaauucacuuuacaucccuauggcagccccccuccuucuucuccucccagucccacccucacaaaccccuccucccaucaccccuccccuucccuguggguacuacccuacccugggacaucaagucacaacaggacuaagcacauccucucuuacugaggccugaucagcguccagcuaggggaaggagaucuagugguaggcagcagaggcugagacgacccccacucuuauuguuaggggacccauaugaagaucagacugcucaucuacuucaaauguguaggggaccuaaguccagcccccgcaugcuuguugguuggugguucagucucugagucuccaugggcccaaguuaguugacucuguaggucuucuguugggucucuuggcuccugccuguaauucuagcauucagaaggcuaaagcagcaggauuauaaguucagagcccacuugcauuagagagucuucacucuacacuguugcacaauaaaaauaaaacaagaaacuugcaaagagcaccauagcuuacuguugggccauaauuacggaaaagcuuuaugaauauuugucuugcuuaaauaccaacacgugcacauauauaugcauacauaucagagagcauacgaaaauauuuuccaaacagccauuauauaauugcuauuauuaggaaggcuuagaagaguuucuugguguaagaaaagucagaaauucagacaugaaagucugaaggaaucuuggcucaaggcaugaaaacauggggguaucugaguccuuugagaucagucugacaguuacuuauuuguuuugauaaaugcuuuuuugcaaacugaaaucuagaguaaauggagauuuuuaucaguagucuuucacugauagcaaaauaguuuguauagcuuaaaauagugcaaaauuuguauguauaugucauacauuucaguguuuucuuucuuuuuuuuuuuuuuugugaggggccauuaagauaggaucuauccacauagccaugaauguccuggaauucacuguguagaucagaguggucuccaagucauagagagucuccugccucugauggaauuaaagguuuacacugccacaccuggauuaauaauaaucuuuuaaguuuaacucuagagcagguuuuaccugguuaaguggcagagcugacauuagaaaccaggagcauaaauaaauagacacauacuuaugucuuuaugagacauuuguagcuuuuuuuguuuugcuuugucuuuuguuuuuuguuuguuuguugagacgggguuucucuacauagcaaccuagacuuucuuggaacucacuuuguuggucaggcuggccucuuaacucacagagaugaauugcuucugccucucaaaugcugggaugaacagaauccagguuuguaaauagcauauauuaacaggaauauucggaaagagccaaacauagcuuuuuuugcauuuauguguguggguguaauuuuauaaauaacaguguuacacaugacaugauuguuuucugaaaguaaguuguuggauuucauauaauaaaaucauaaaaaguaucugacaccuuuaaucuucacagugucagugauauuuaaauauaguguguuagcuuauuuaauccacauggcagcccuacaaagucgauauuaaccccacugacagauagagaaacugagacauagaguuucgaucucaggccacacaacuggugagugacauuaccagaauucuaauccagcaaggcuguguccuaggguuuuacugcugugaacagacacaaugaccaaggcaacucuuuuaaggacaacauuuaauuggggcuggcuuacagguucagagguucaguccauuaucaucaaggcaggaacauggugccaguccuuuaucauccaggcagacguggugcaggagaugcugagaguucuacaucuucaucugaaggcugcuagcagaauacug

SEQ ID NO: 1759 - RNA, 26411 nt, Mus musculus
cgcugaaacaucgcgggauuuccgucugccagucuccgccccuuuacggcacgauggucgugcaagaaugugauagagccucgacggccgccaucuucuuccuuucuuagcaguuaaccgagagcggcgccucccuccgcgaggaaacggcagcgugugcuguagcguggguauggccgacuacuccacagugccuccgccgucgucuggcucggcuggcggcggcggcggcggagucguuaacgacgcuuucaaagaugcccugcagagagcgcggcagguaagcguggaccgaccgcgcggcggcuuccccuccccgacccccgagagccgccggcggggcagguccggcccugcucgcacucgcggcugccgcccgaggagauggcgucuucucacgaggggucccagcggcucgaggccgagcccguugucguggucugaagcgccccccccucccacgcgcucuccccgagcguggccuccacuuccgccccgcgcgcgcggccucgccgccccgugcgcccugccugccccggcucccucggcuccgguuccgcccgacccaggcgcguggaagguucugggcgcucaggucacggcgagggcaagccagggagggccggcugccuggcuagcgguccccgccgcuucccgcgccgccgagcucuccacccucgccguaauuagccuaacguuccccgcggcguucaccagcgaggcucuccccggggcgggaucugcgugcgauccaccaauccuuuccccagcuccaaauggccccgggcccuuucuuccccagccuugaguuugaaucugccucucucuucccaagucgaagccuccaaccucuuugugcuacguagggacguacuguugccucgaauggcaaccauuuucccagaugaaaaggguuggauagauaagaguccuugcauuugacaccccccccccaauaaccugaacgucaaugucuucaaguagcccccgcccccgacuucuuuguagcuuaaaaauguauaauguugccuugccgggugggguggugcucgacuuuagucccagcacucgagagacagagccuggcaggucucuugaguuugaggccagucaaaacggccaagagggaccugucucaaaaaaaaaaguauguuauggaauuugccuguaagguaaaauaaacccuuauggcucuguuguaguugcuagacaugagcagguuuuuaaagccagcuuugacuauacuggaaacuuccuucaggaccgaaagauuaccgacucaaucaagguuuaucaagucuaccauaauacagcaagcacacuuaucuagugcauagauacugaaaaaauauauuuauucauacagagggauuccaugagcaaugugguugguguacauagaagucagaggacaacuugugggaguugauucuccuuccauguaggacccuuuggucagguguaaguuguuaggcucagggacaagugugucugccugggcaucugaggaaacuuuuugaugcagggccucuaccgaaagccuaggcaggccugagguuuaaggcuuccugcugaauugucucuaguguagguguacuccaccucucggcuuuggaagcuuuuuaagugugugauuucuagucuugugagauaaaaaucgaacacgagugagcagacagcuuugaugauaaaguaaaccacagcgguuacauaaauagucacacugugaggcaggcgcuguacaggacgcugcuggaaagggaugccucacugaaagaugggugacauucauauagugcagugaggagugggagucuggccagcauagacaagaagcugcugcuugcucuacaaagaucgaggguuucuggaaggacagcucuaagagguagucagcuaauauaggauaacauaggaggaggaaaaaggugggaaugugagaaaaacuauggauagauuccauuguuagcaagcauuggcugugauaauacaaguguuuauuauagaugauaguaucuguuacaccuuuggacauucuggguauguagaaauuccaucaggaccuugccuguguaaguaagggacuaaggucucacuauguaguucuggcuguccuggaacucacugccuaccucugccuuuaggacuaaaggugugugccacccaugcccagaugagauuuuguuuucaaaaugagagucuuucugccucacccuccugaaugcuggagugacaggucugccuacacugauccuggcacacuuacuuuuucuaaaaauuauuuucuuuauuuacauuccugcccacucacccccaguuccucacaccauuccuucuucaucuccccaccucccuucccuggggccucaagucucaaggguuagguggaucuucucccacugagaccagaccaggcaguccucugcuguuacacacacacacacacacacacacacacacacacauauacacacauaagccagggaacuuggaccagcccgagugugcugcuaggcacacuuuuuauaaguuuggugcaacugugucuuugaggaugaaugugcgcauuguuaaauuuuccaaaaggaaaauuugaaaguugcuguggacccugccuaggaagcacuagaaguagauuugcacuuccaccuuuaaaacuacuaaagaaagugugggcuaaaguguaggagauagauguuuucacgucauuaccuucuuagaauuaucuuuaacuccaaaauuggugagggugggucagugaagaaagugguaaaugcugguuugguuugauuuuugucugaaguaaaaaagcacagaaauacaguagagcaaaaaucaaguggaaagcuugaauuauuucuguggguuaaaauaaaaacauuacuuacacuuaauguguguuuaauagaaacauuggguucauaauuguagcaugugagaaguuaggauuagacuagcuggggcuauaaucagaccauguucccauccacccaccacccacccccaaugaggggagaguugaaaguuuugcuuggucuuuugaaugaacuguguaccaauuuuucuuuuggaugcuuguagaccuauuacaugaauggagugugaauaagcaugcuuucuuauggauauuccuuggucuucaaguaaacucagaaguguucauaaaagcuaauuguagaacauagccauagucuaagccguuuuccucucguucaauuguacguaacacuucccuuuuaacaucaguuccugucagucccauacagugcacuuaaauaccuaagauauaguuuacaaaugcuaugauuugaaaucaaaggguggaaaagauuuuguuuccaaauguguggguuguuuuaaauggggauauaacauaaguuuaauagaucauuaacuauuuguuagcucccugaaguauuagugguaguuuuaauuauucuuaauaagugaaucuuucuaguguuuuuaaaaguauaucuuuuauuguaggaaauuuagugcugaguaguacauaaaguauuaauacccugauuaguauuccgauuuuucuuuuaagauugcagcaaaaauugggggugaugcugguacaucauugaauucaaaugacuaugguuaugggggacaaaaaagacccuuagaagauggagguaaguuauagccaacaagaauaauuaucuuccaugguauucauuugauaagauuuucaguauuguuuaucaagaugauuuaucaaaauacuacuaucuauuggucucagaagaauaggauuuugaaaaagacagaccuagaaaagguagguauaauuugaaucuauugggaaguauuauuguaauagaaaacagguuuuguuauuuuuuuuuuuuuuuguccuguuauaggauuaugcuugcuuugaguugcacagacuguuaaugauauaaauaaaguuauguuauuugggaaacacuuuacugaauuuucucauuuauugaaugagucuuugauacucccuuucauucagucagaauccacgucuagguuaagguugguugguugcaggcaucccauuuuuauauuguuuuaguguuuuguguguuucauauuuaucuuuaaacauugauuaaaacuguggauucauaguguuuucucuuuuuaaaaaucaucacuucugcacuuagaaguguguacuuuuuuauuuuaguuuugauguauguauaaauuuugauauugauauauuugcccuuuuguaaaagauucugauagcauauaggacugacuguauuuguggcccuuucugguaauacuugguuuccuuuuguuuaaguauguuuauauuugcaagugagguuuuuaauaugcaagaaaaaaugagcuaaugaugcuucagauguuguguguaauguacucuuuuuauuuuauguguagauggcucuuggacaaauccgagcaguaccacacacugggagggaaugcccucuccuuuuaaaggcaggaauuuuuauuuauuaccuguguuuaguauguaaaugugaaauaagccaguggauucuuaaauggacacaauggucucuugguuuaugugucugaauuuuugcuauacaaaagccuugaaguugggagaauaauaauaguguuuugagcuauaggcugucuauucauauguuguaugcauuuuguuuauuugagaaaggcaaucgugugguugcuuugagguuuugguguucuguagugaaaugcuucauuugagaauaauagaacaguuuagauugaaauugucuuguaacgugagcuuucuuuuuugguauaguuuuaugaucacugucagauucacucaucuuuugauaugucugguuuuuauguagugcucucuaauugucaguucuagaguggaugaagcaucauuaaccauuagcauaagguauucaccagcauugaagcuaaacaguuugugcuguauuauuccaaacuaaagugucugugcauuguuuaaacacaagagaaugaaagaauuuagguuuuguggguuuuuuuuuuuuuuuuagauuuuugagucuagguugaauugugucaguuuugauucaauugguaaaccaauauaucauguauuuuaauaaauaucauuauucuugcuugguggggguggggagcuuuguuuuuaauugacaaaaaguaaaagacacuuaauuuugcagaucagccagaugcuaagaaaguaccuccccaaaaugacuguaaguacuuuaagcugagguuuuguugcuucuuuaaaaauuacguguguguguguguguguguguauguguguguguauguauguauguauguauguaugucaagauggcauaggaauucccugaaaguggacuacaugugggugcugagaacuugguucucuacaagagcauguguccucuuuaucaucuaagucuucucuccagacuguuguuucuacuuuggguggguugugaguuugggguuuggggaauuugcuuuugagccaaagucucaaauauguaauucugacugcccuugacuucacagagaucuaccuguguaaaaguauuuuuuauuuugccugauguaauugucaucucugagccuuacugccucaaaccuucuaguucuuucugaacucuggugcaaacuccucuccaagcugauucaauauagcuucucucuugaccucugccggaauugcucugcuuggccucaaacuauccuucucauuuucuggcuuauucuguuuuuacaugugucuagcuuguucccucucugcaaccuauauaucucuacaacuguuccaauaagacuguccucccacccccugggcuauuuauuuaucucuuaaguccuccucucuauucuccugagagcuagacauaauuaaucccauucuuuuugggguuuuuuuuugggggggggggguuagacaggguuucucuguguagcccuggcuguccuggaacucacucuguagaccaggcuggccucgaacucagaaauccaccugccuuugccucccaagugcugggauuaaaggugugcgccaccaacgcccggcuguuuguuuuucaaaacaggguuucucuguagcucuggcugucuagaacucacccuggaccaggcugaccucugccucccaagugcugggauuaaaaggcgugacccaccacugcccggcuuuuuuuccuuuucuuuuccucaaagauuuguuacuuuauauaugagugcacuguagcugccuucaggcacacuagaaucggauccuaucccauuacagaugguugugagccacccugugguugcugggaauugaucucaggaccucuggaagaacagucagugcucuuaaccacugagccauuuucccagcccuaauuuuauucuuuugacuccuucucugauugaucacuuugucugcuacucuaaauuaaacaucacuuucaaacaugagugcuuccuucuacaaacuaacuucaucuuuacuguuugggauuaaaggucauuaaaggauuaaagagcaaagccacaccacaacuauaagcacauacacccccacccccguaaauaacacaaucuuggggcucacccuauaaucuaagugaucaaauagccuacaacagacuugcuuuuguuuucuccugugcuuggacuaaggaugugugugccuugccauacucaacaggguugguauuacaaaugucuagcuggaauuuccuuacaaauguauauagguuuuuacuauauuuuuaaaaaagaaugauucucuuuuacuugggagccacguauauacaaacacugauggcugagcugugacuauaaguuaacuacucuaguuguuaaucugugugucccuuuccugacuuucuugcuacucucagugaugauucaaauaugaaugguccgaauuuuuuuccuauguauacaucagggaaagaguuuggaguacgugguauguuugucucaaauaaacucgaacuuaagcuuguuuuuguucauuuuuucguagcuuuuggagcacaguuaccuccaaugcaucagcagcaaagguauagucaaaacuuuuaaagcuacuuugcaagucuuaguuggauuguauguacagccaaguuagucuauaaugcaaaugucugcauaccauuuuguaugugugguuuacuucuguaaaccacauugggaaaaugguauagaaacauuguuaauuugggaaaacagguugaaauugacgcauuucagaagagguaaaauaaauguuaaaguggcauucgcuuugacagguguucaguuuccugcccugcucacacaugcugccucauuuaagaaccuggcugggcuacugggagacuuuaagauuggguuuauuagacugcuuuuauguguauauguacauuauuuuucugugaggaaaauguuaguuucuguucuuucuuagcagaucuguaaugacagaagaauacaaagucccagaugggauggucggauuuaguaaguaccauuaauacuaagguuuuaagacaaagcauacuuucaaaaauaguaugaaugauaacuucuccccuuucucuaccuuaacuaguaauuggcagaggaggugaacagaucucacgaauacagcaggaaucuggaugcaagauacagauagcaccugguaacauuccguguguguguguguguguguacgaauuacuuguuguuuuguccaguucuuacaguuuuuugagaguggcuaggaaacucaaguauuuuaaguuucuaaauaucugauauuuuuauuguauuuuuuacuuaaacuuuucuuuuuauuuaauuguagauagugguggccuaccagaaaggucuuguaugcuaacuggaacaccugaaucuguccaguaaguuugaaaauguuaagucuacuuacaguuaagacugaagacuauaagcuucguuuucauaccauuucgcuuuaaaaguuuacauauuaugccuuucuuaaaauaggguucaucaucugaaccuaagacagagaaauuguuaaagccagagacuaagccguaacucaggcauuuaggugcuugccuuccauguaggaagaacugaguuugauccuaaaacuaaaaaaaaaaaaacuggcgugguaauaucauggcucaggaguuggacacaggcagauuuuggggacuugguaaccaaccagcuaacacuauuugauggguucaaagucauugagagaccuugccucaagguacuuaucacaaaaaagguacugaugguuguaauuugaccuauacaccuuccauacgugucuauacagacucagaaauuauuaaaaccugccuugcacaaauauguuaauaacgucaccuaaaacucaugaccaaucuagucaugaaaauuuuauauuccuguuuuucucuuccacucaauucuaaggcucugauaaaacuacccaaucuuuaccucuaauugucuucuccccacugccaucuccccuccagacaggguuucauuguauauccauagcugacugucucugaacucacucgcucuguaguccaggcuggccuaaaacuuaaaagaucugccugccgaaggcauguaccaccauugcccaccacacucacugucuugacugacuuguguugcugugaccaagaaaguguuaucauccuacacugaaaucuuaacaccguuccuugcauacuuuuuuuuuuuugucuaguauugagauacuguuuuacguucauuugccugacuuucuacuucaagaaauuccugacuaaacugauuuuuuacuucauuccuaaaauuuuaggaguaauuucuaagaguuuauagacagauuuggaaauuacauaucauaaaaauaucuuugaaccucauguuguauuuuguuaacacagugcuuuaaaagguuuguaccauugaaguuuccccuuuaaaaguuuaucuagugugugugccucucaguuuccuucaagcucugcuucuaacagcugcaucgacaguucucuuuccaaggcagaggcugagucgugcacuaguuaaccccguugcugugugacaggauggauggaagauguuuaaugacuguguucacuuggagcauacagacuucaguacuuacugcccauuugacuugacacucacuccuuugguuuagguucuugccuccgaccaugaaaugccauaugaccaauuuagaguauguuugaaaccugacuaagauaaaacugcugacuuuuauuauuuugggauaaguuggguuaugcuacguauuuuuaucaagauuaauuuguuaacagaucagcaaaaagauuauuggaccagauuguugaaaagggaagaccagccccuggcuuucaucauggugauggaccuggaaaugcaguucaggaaaucaugauuccagccagcaaagcaggacuaguuauuggaaaggggggcgagacuauuaaacaacuucagguauuauuauauuguaaagaauauuauuaagucuuuugaggccacuuuuuauuguuuuuacuaacauauuuucaugauauuaauaggaacgggcugguguuaaaaugguaaugauucaagaugggccucaaaacacuggugcugauaaaccucuuaggauuacgggugacccauacaaaguucagguaagcuucacuuugucucuuauauauaaaggcugaggggguggacaaaauacguauuaaauuuuuuugacaaauauucugaauuggauaacuuucuauuauagcaagccaaggaaaugguauuagaguuaauucgugaucaaggugguuucagagaagugcggaaugaguauggcucaagaauaggaggcaaugaagggauagauguaaguaagaauucugagucagcagugguuguauccuaauccaugggcacuaguguuuuccugcuuugaauuaaauggacuuggcuuaacaucaugucccuuuucuuguuuucuuccuugggguuuuuuuaucuuguuauuuuuaugaucauuuaguauauuuacuuuuaugauuaaguggggaugaguuuuugagaaaugucuuuuaaaauauacuuuuacuuaaggucccaauuccaagauuugcuguuggcauuguaauaggaagaaauggagaaaugauuaaaaaaauacaaaaugaugcugguguucgaauucaguuuaagccagguaaguuuaagguauauuuaauguucuaagaauugauagcuuuuaaucuugacauuuauaauugguuugucacaacuuacucuguuuuuuuuuguuguuguuguuguuauuguuuuagaugauggaacaacaccugauaggauagcacagauaacaggaccuccagacaggugucagcacgcugcagaaauaaucacagaccuucuacgaaguguucaggugugauaggaaauuaacauuuucaguuugcuuucuuuggaaaaguuuuuaucauaccugaaugaaaaaaaugccccuccagguuauauuagaaucuguuggcaguguuaaaaugacuaacguuaaauugcuuuaagguaaacauuuuaggguagauuugcauaaauguucugccuuauuucccccagugcaugugaacuuuuauuucuauggguauaugugccuuggcaauugugccuauggaagccaaaggaaauuuuucugaaguugguucucuauuauguggguccuagaaauuaaacccaggucauuuugcauguauggguagucucccaauauauuuuaaaaguggaaguuauuacuuaguugacuauuuuuguuugacgucaucucuuaauuucauuguuuagaaauacgagaguuggggauaauaagcuaauaguuuuauuacagaguuuauuuuguucucuccuuucuuaggcuggcaauccugguggaccgggaccugguggucgaggacgagguagaggucaaggaaacuggaauauggggcccccggguggacuccaggaguuuaauuucauugugccaacugggaaaacuggacugaucauuggaaaaggcaauguauuuuaaacucuuuguuuugauauacuggauauuuguaaacaaaagaugcuauuuauauuuuuuuaggaaaggggucuuaacauggcagcuaaaauaagaauacucuuuaauguaugcuaaaaaugggauugugucucaacugcuucuagggaaaggggaccaaaagucugucaguuacaaaacuugauccuaauucaaauggguuuuguugguguuuuuuguuuuguuuugcauuuaacuucuuuguuacuuacaaaaccuguugauugaaauauuuuucuguucugacccauaucaggguguauguuuaguaagguguguauaaaauagacuuuaguguguuuugcauuaguucuagauggaagaacaggcuaaauagaaaauccuaacauuauuguccaguggaaugcuacaaaacuguuuaaugggcaaaguaauagguguuugggguuuuuuuugguuuuuuuuaaauaguauuucugccagacauggugacagacaccuuuaaucccagcacuuaguaggcagaugcagguguuucucuugugaguuugaagccagcauggucuacagggugaguuauaggacaaccagggccacacagagacccuugucuuaggaaagaguauugcuugcauucugugaacuuagugucuugcgguuuuaggaggugaaaccauaaaaagcauaagccaacagucuggugcaagaauagaacugcagagaagcccuccaccuaaugcagaucccaauaugaaguuauuuacaauucggggcacuccacagcaaauagacuaugcucgacaacucauagaagagaagauugggguaaguguacucucauuuauagcauaguuccugguaacuuuaaaauguacugugggaaaauacaucguuucuaauaugaaauugcagguauugugauauaguguauauacauauauugacauaggaaagauauccaaaauacaagaaccaugaacucagaaauccgccugccucugccugucaagugcugggauuaaaggcgugcgccaccacacccggcugagaauaccauguguuaaguuuucccuugaugugcaauuugcagaauauacucucagcaguugucacauuagggaaguaaagggaacuaggcagucuuguuuuuaaaagaaaaucauaaaaagaguaagaaacacagaagacuaagcugaaagaacucugcuggagcugaggauuucagugaauuuuacauggcagaugaugacauuuuauuuuuugcaccaaaauucaaagaggguaaauuuaaauuuguuauuuaagcguagaaauggaagaguaguuggacuuugaauuacucaaccauuacauuguuugagugucuaguuauuguuuauguuuucuuuuccuuuuuuuuuuuauaauagggcccaguaaauccuuuagggccaccuguaccccaugggccccaugggguuccagguccucaugggccuccuggaccuccagggccgggaacuccaaugggaccauacaacccugcaccuuacaauccaggaccaccuggcccagcuccucaguaaguaccacauuugcuugguucugggcuuucccuaaagaccuaggaauugggggcuggagagaugacgauggcucagcagugcagagcacuuguuccuguugcagagggaccugagcucacuucccagcaccacacggggguucgcaaccauucgugacagguuccaggguaucuuuacagcgacacuaggcauacauagcugcauauacauacaugcaauacaugcagaggcaaaaccuacacauaaaauaaauaaagcuggcuuuuauuaaugguauuuguguuuuguuccccaccccuagcgguccuccagccccauaugcuccccagggauggggaaaugcguauccacauuggcagcaacaggcuccuccugacccagguaaaggguaaucuacuauuaauauguuagcuucauuguauacugcuggucacaguccuaaacuaccuacugcaugugcgaucuuuuaaggcacuuccccugcaguauaggaugacacugcugucuaguauguugugacuuuauucauaguaguucauauuuauaaaauaauguguuuaacacuacuauguucucaaauaauaaguauaaauuauuuuguugcugauaaaauuaaggucccuuaauuaccaaaacaggagaguacauuuauuuuucucucuuauaaucuggauuuucuauagcaugguguucucauuauaucuucccauacugguuuuguuucuacuccaucaugaucaggaaucaacuuggaaauaggacuuuuuucuuuguuuuucuuuuguuuuuucacuuugcagccccuguaguuugauucauuugaaaaguuugagagaacguguucugaguuauagauuucuacauaguguauuuuuuacaaaucaaaguugauuuagauguaauugcuuuguuggauuuguuaaauguuuuaauauuuuaauguauguuaaauucauaggaacuuuucucagucaccaaauaaccacaacuucuauucauuuaagaaacaacuugagccgggcggcaguggugaacgccauuagucccagcacacaggagacagaagcaggcagaucucugaguucgaggacagccugaucuacagagcauguucaaggauagccagggacacacaggaaaaauccuaucucaaaaaagagagagagagaaaaaaaaagaaaaagaaauaacuugaauugugauggcaucugaauaugaaagaugagugucgauuagcaaaagagugcauucccagggcagacaagaagcaucaguuaugacuuccuuuguaaggguuuuaaaagugaaucuucuccuucuaacaagcauuuagacguggcaugaucaaauagaguuggaacagguuauauugaagguuuuauauggcuaauucaauuucauaggauugcucaaaugagugauguuugauauuagcacuguaaggucuggucagugaauaugacuuccagcauuaccuggaagacugacucggcaauauguugcuuaaauuugacuuggaaguauacaguauuuuauugucugcauuuucaagaaacugcugcugugagguugagauuuauauagaugucaagaauuuaaucuucaaucuuaaauggauaauaugcgaauucauccuauguaaaagaauagugagcucuuaguaccugcuaguugcaagucacaaaaaaaaaguuuggguuuugguuugguuuuugaguuacaaaggugagcuuagugcagaggaugcugguuguggugacuugggaauagggcagcagcuaaaacuugaguauugggggaugcuaaaagaauuaauagaaaggauaagccacagugcuggggauaagcauuagaaccugaguucuaucccucccaccuguuguaaagaaaaauaaauaaagcgcuuuaauaaaguucguaaaaaggauccguaaaguuuccuggccugcucuuguaaccaaaucuaggagcucuggguucagagagaaauccuaucucaaaaaaaauuaggaaggaaggcuggagagagggcucaguggauaagaaaagcaauaacugcucuuccagaggucugaguucaauucccagcaaccacaugguaguucacaaccaucugcaaugggaucugaugcccucugcugguguuucugaagagagcuucaaguguacucauauacaaaauaauaauaauucuuuuaaaaaaugaggaagggugucagagagguagcuuagugauuauuauaaaggucuuccugcucuuugagaggaugcaaguugagauccaguuacucucacaccuucugguucucuuuaguaacccacauuuguguagauacacacagguucacagauacacauaacuagaagugggacuuuaaagucuagauaaaacaaggugagcaugucuagggagaucacccagaaucaguacacacaaacagacacgccacgacacgauggcuaagcuggggagggcggccagaccacagcauguagcccggaaacaggaaaaguggaggaagaaaagguaacggcuuggaaauccaacggccuguguuaaauggggcauggucuuaaaacuguacaggagcuuucaaaugauaagcuaugcuugaaguauccuaaagguguuagaaaaggauagagcaggacuuucaggauugugacugaaauaaauauaaacugcauguaucuaaccuuuguuucuuucuuguacaaauuaguccauaacugccugcuauacagaacuguugcacuuggcagcuuaacuuguugggggaaaaaaagcaaagacacgggauugagcugagacaaaccauuggauuggaagccaaaagaucauccauuuauauaccaguuccaccgaucacuaguaaauuacuuaauaccuguaaccuaggaaauuacuuaauucccgaggcugaaguuucugaacuaaaagccaagugaugaugauaauacuagaacauuuugaaaguuuccauucgcuauugguaacuuuugagccuauuugucaggaaucaccaaaaagguaaggguugguuucuagaguuuacauauuaaccuugaaaccgcucuuuguuuuuacauuguagccaaggcaggagcagauccaaacucggcagcuugggcugcuuauuaugcucacuauuaccagcagcaggcacaacccccaccugcagcuccugccggugcaccagcuacaacccaaacgaacggacaagguaacuacgguaaugaaagauuuuauuuccuauuuuaaagcuauaguuuguguuuggauucauguaugaagucauaacaaaacucucuuucaguccugagaauuguugggccuugugcaugaugguaucauuagguuagauccucgggccuaagguuuugaagacucaguugugacuuuguguaagcaaacuaagucaaauaauaguuggaagaauaaugccuuaaguagugagacuguuaacuguccuccccccacccccauuuacuucacuacccugauuuaugucuguuauaauaguucugaagagagcuacugaaaacuguacuuagagacauaaaaucauaucaccuuucuacagacccuuauucauuccaaaauaaaugaccaccauggacuuuaaagucaguuacucaucauugauauaccacuguuauacacagcccuugcuuagaucaccaacugaccccguguuuucauuagguucauuaagucucaucaagcuagagcacuuucuuggucuucuuuuaugccucuaauaagaggauaacucaacaguuagauagcugccaagcuauagaguuacuaaccaugguuguuuaaauggucuugcuacuaccagccugguuuuugcacuauacuacaacuauguacuguaaagaauuaccuaggggcuggugagauggcucaguggauaagagcacccgacugcucuuccaaagguccggaguucaaaucccagcaaccacaugguggcucacaaccaucuguaaugggauacgauccgauucuagugugccugaaggcagcuacaguguacuuacauauaauaaauaaauaaaucuuuuaaaaaaaaaaagaauuaccuaguauuuucugcuacuuuuuacuggaguaaugucacuauccuauacauugaacuucugccucagccuuagucuguauuauuaauaaaccuugccuugguacccuacuauuacagcagcuguuaacuguuaguuucugucauuguauauuaguugcuauuuuacuacaaggaauagauugcccuuuuuuaacuacuuucauuauauuguccuagauuuggggugguugggguuaucuucaagguggcucuggugccucugacguucguucuucaggugcuuccuuaguaccugacacaguaagauaacuuugucuucugagcuccaaucggugauucauuuccuuuucucucucucuuucucucucucucucucucucucucucucccucucucucucucucucucucucucucucucucaggauagaauuuagagaucagucuaaguauacuaauugcuaucuaaaugucacuaauuauaauccuguccaaauuagaacuaaaaaguauguuuggggcuggcauucagucaauaguacuuguuccugcagaaaacccagguuugauugcuaguacccacaugguaacucacacugaaacugauuccaggggacccagugcccucuucugaucuguggagcaccagauacccagggugcacagauuauacauguggacaaaaugcucacacauaaaauuaaacaguaucuuuaaaaacaugcaggacaacacgugucuacuaaaaaucacaugauuauauacuacuuuuucauuuaaucuuuaaaauuagugcuucaaagcuauuuguggcuuuucuaaaaaugugugcaggagauaucaagggaugaaccaugcuugaacuguccuuaaaaauggauagaaaccauguucuauauuucuuuugugugcauuuacuuacuauucccaguuucuguguccaccccuucuauacccacuugucauguauucccaacaaacacuugcacaacuccgugguguagacagugcuaauuacaguacugaugguguagaagcaaaagugcauaacaaccuucagaaacuuaaaucuuguuuuguuuguuuguuuuuuaaaaaggagaucagcaggcuccagcuccagcuggacagguugauuauacaaaggcuugggaagaauacuacaagaaaauggguaugcucuacaguuuacgucuuauccuuuaucuuaguaacuaaacggaaguaaauacacauuacaaagcuagagaugaguaacaaaacauuugcuuguuuuuaaaaaagaauacuugagguaacucauccguauguuuuuauaauguuaaaguuuauauuaaacaagcuaggcaguggugauaccugccuuuaaucccaguacuuggaagguagaggaagguagaucuccgaguuugaggccagccuugucuacaaagcaaguuccaggacacuugggacucuuagacagagaaaccccaucuugaaaaacaaaaauaauaauaaacaggaaaggugacauccugaaauugacuggaaguuaagacauauuaagagcaauucaagaaauucuuauaauugugcuuauggcagagaaauacaauugucagcaaguuaauaauuaaaaccuggcauuuccuuacuagguaauaauauauggcuuuauuacuguacuuuuguguaguggucuaaauggaaugagauuaaauuuuaggccagcaaaguaguuguaucacuggcuuuacugcaaaauaagcauaaaauuagcccacagugacauugcuuuacauuucuaaacauuugcaugcauugaaaaggaaaaaagggugaccuuuuaaaaagauuuugacaacuauugaacguaauucuuaacauaaccauagugauuguguuaauguauuucuugucggugauacagcuuucgacaaaguuccuuucagaacaacuguuuggggaaaugugauaacaaacuucugcagugaacagaugggcugauaacuuuucuuaaccucacugaucgcaggcagguucuaacagauggaccuuagcacuagaaacuugaaaccugccgggcgugguggcacacaccuuuaaucccagcacuuggugggcagaggcaggcagauuucugaguucgaggacagccuggucuacagagugaguuccauccaggacagccagggcuacacagagaaacccuguuuggggccuggggggaagaaacuugaaaccuuaaaacaauauuguguguaauuagaaugcuuacauaauuucuucucugaacugugauauuuuugagaguagauggaaauguauuaaucauuccgugguagccgugcugaaauagugcuacuuguuuauaagaagcugagcaugccaaggugaaagugcgcuaacuccauuguuuguuuuuacugugugaguguugauuggguagaaaccugguaacuggacuacguaauuaagacagaguaagguauuugucugugcucgauuaugucauguuauuuguuuacaugacuucaaauaaguuuuauagauauuuugcauucuguauucuuaaaaaguauauugacuaggacuuuugagaguagguauuuuaacucaauuagguuuuaguuuuuaauauucuagcacuuuccagcacacaguucugugaauuccucuucuucuaauuauuauuauuauuauuagagauuuauuuauuuuauguauaugaaugcacuguagcuguacagaugguugugagccuucauaugguuguuggaaauugaauuuuaagaacucugcucaauccgacccaaagauuuauuuacugucauaaauaaguacaccguugcugacuucagacauaccagaagagggcaucauaucucacuaugggugguugugagcuaccaugugguugcuaggauuugaacucaggaccuugagaagaguaguacucuuacucgcugagccgucucccagcccgaauuccuguucuugguuguuaugucuaccgaucaaucaguuggcauacauagagacagacacacacagacagcagcaucgugcaggauaacuauuuggagacucauuuucuucauuugugcuuuuuuguaauuauguugaagaucuuaauccugugagcaaaaaaagacuaacugaacaauucccugucauauagaucuugaaagauacuguuuuagguaauuuaauuaaucauugaauuaguauuuuuaauuauaugauaguuauaaaaaucauuuuucccuguaaaacauuuaacuacaauuuuuuucugaaaguaugguccuugauauauuuuuuaguauaaucaugaauuaagagaccuuaaagcaaaagguucagaauagaagcucaggagauagauggguaagagugcuuaaugaccuggguucaaaucccacuaccuaucuuaaaagccaaucaugacuguugcauguugggaagcaguugcaggagcuugcuagccaacuguggauucaguaaaaggagcaggggaauaagguacagagggauagaagaaggcaaaggcaggcagauuucugaguucgaggccagccuggucugcaaagugaguuccaggacagccagggcuauacagagaaacccugucucgaaaaaaaagaaaaagaaacucauuugcaguuaacuugcuuguuuacaaaauucauuaaguauuucuagaauucgauuuuuaucauuugauaacucagaauggucacuuaaaacaaaauuacuaauaaacgcugaguuuugggcuggugagaucgcucaguggguaagagcacccuacugcucguccgaagguccggaguucaaaucccagcaaccacaugguggcucacaacaaccaucuguaacaagaucugacacccucuucuggagugucugaagacagcuacaguguacuuacauauaauaaauaaauaaaucuuuaaaaaaaaaaagcugaguuuuacaucuuucauugaacuuuauuucagcugccagguuauuuuuaguaaagcugugauauaaacucaguaugucuuuugcuucauugugugugucauaaauaucuuucaguacuucucuguaguuuaagacuaguaauauagugacccaaauggauagaagaguggugagcuagguaugguggcacauauacgcauuuaguccuagugcucaggaggcagaagcagguagaucuccaaggaugaggucagcccuggauagugagacccuuucucaguuagcaaaaaaaaaaaacaaagcguuucuucuuuccuugucaaagauuauaucugaauuuuccccuuuguuuaaagguaugugaguuugggucauuuugucuuuuacuaaucaagcugaacuaagagacugaaacuugugauugaagugaaaagaguaucuuugccguuucuugugugcugcacuuuccccccucauccucccucccuugucuaaggcauauuuaagauaaacagaaacugaaggggcaaugaggcacagauaauccuagcacgugggaaguugccaagaggauaacaaguuuugagccaccugugcuacauaagugaaacccuguguugagauaaaaacaagagcuauugccccucugugccuugcauuauaagcuguacuuaaugguacauacauuuuuguauuaaaguugaggggguguuuuaggucacaagggcagacacgagguuauuaaaaggcuuggaagaaguauuaaaaaggcaagaugcuguguuuacuagagaagaguuacugugagauuuguaauuauagcagcaauaaaguucucuguuuuccugaaggucaagcaguuccugcuccugcuggggccccaccagguggucagccggauuauagugcagccugggcugaguacuauagacagcaagcagcguauuaugcccagacaaguccccaggggaugccgcagcauccuccagcaccucagguagaaaacauuugcuauuuuuuuuguuuuguuuuuguuuuuguuuuccacuccaaccauguuuucugcauguuugucuguuugggaaugaauauguuuuacuugguaaaguauaacuacaugaaauaucguguuguguuuggggacucaguuuuucuaauaauguuuucuggcaucugagugcuauuuuuguaaugccuuugauuuuaaaaauaaauuuucuuccccccagggauuugcaaaucaugcaagaagccaccaucauuuauauuaaccaguuuuucuuucuuaaaggauucacuccugaauuagcuccauuuaaaggauuuucuuuaacuuuuuguguaucucuuauguaucucuucugcacagggccaauaauaagaaguggacaauacaguauuugcuucauugugugggggaaaaaaccuuuguuaaauauauggaugcagacgacuugaugaagaucuuaauuuuguuuuugguuuaaaguaguguuuuuuucccccccuuuuuuuuuauuuugaaaauguacaaaauaacuaucacuacugauaggagguuaauauuucuguguagaaaugaaaauugguuuguuuuuagucuuuaguguagauguacacauuccagcaaauguauuugcaacuauuauguggucgaugcuuugugauauaaauguacuuuuucaauguauacuuucacuuuuaaaaugccuguuuugugcuuuacaauaaaugauaugaaaccuccugugucgguaaguuggauauguggguaaaggauucauaguuucuuagcagugauaaauuaagauacauguacacgaauauauaagcuuuccccaugaauuacugaguuuuuaaacacuggcauguuuuuuccccuguuggaguauagugguagauuggagguucuuuucuguuguauuuggcuauuucagcacaaguaauccugauauuuucauguuuuuccuucuauuugauuaaaaacugcauguguauacaaugaucuuuaguauacuuccauugcauuaacagugacauuuccuuuuauacaugagcacuauuucagaccuguaccgcugcuacaacaguuaaccuuccuguucuucacuuauuuccgagacuguuucagcauaacuaauuuugaacaguuugcagacagugauuugaggaguuuauaagaaacauuguuuuuuucauguaaagcaacucuuuccauguauauauauauauuauaauaguguguuucucucuaaauucaggauagaaaaguaauagaaugugaaaguauagcuacauugcaucugccauugaaacauuugggguaugaaaauguucaagcuuuuuuuuucuuuuugcaguauagauaagcuuugucuuguaauugcacaaguccagucauugaaucaaauuaauuuuuuuauguacugaaucauuuuauuaaucuuuaacauucaugcugaaguucugauauuuuguugaaaaccauuguuuuacucugcauauuuguuggcucuuugcauauuaauauauuagacuacaugcaaauacagucugucuugccauugucuguugaagugcagguuugauccagccaguauagaacuagcucuguaggggugaggaggacugugcuguguaucauccuugauuguguuccuucaaggagcauugcacuguaaguacaucagagugacaaauugaugaacugcaacagugucuuuuugucgauguuccacauaaugcaauugcuauauuuugugugacuauuauguuggaauacagugcugucaugggaaaccauaacugcuucuuaacauagaauaauacauaguucuguauuuuuuuuaagugagcuuaauggguaaguauuuuugauaugcuuuagcuaauagcuaaagaaaauugaucaguaacaaaguugaauaguauuaucagugcuccuaaaaugcuguuuuucaguguaaaauaugccuaucuuuuauagugauaugaaaaacuugaaauguuuaagacagaagugcuuuucaguuugcaaaguuuaaggacuuaacgccuuuucauuaaauguuaguucuaucaucuguggggagcaccauuuguaugaggacaaaaauguugagguuauagggcagaaaauaguacagcucauuguggauguuuugaaauguuuuuugauuguuuuauguaacuuagugacuucccuuccccuuauuuagaucuggaugcauagcucuaguaugaaguuuaauaguaauaguuaaggccuuaccuguuaagaucuuaaguguaggguauugacaugaacaguuucaguauuuugcaugauauuguugcauagaugaccuaggaaaguguuguggugcauuuaguaauuaaacugaaggaaauaguuggauucaguaucauaauucacaaauuggaggcuguugauuuugauucguuuaaaauuuaaaaucuuuauuaauugcaaacagugcaauuauuuauacuucacagugccuucccagaccuuccaccuuagguucugcugcaaaaagcaacagguaagcacaaccuaaggccaucucuauauaaauauaucaguacauacauguugucccugugagguuugugguuguguacucacucaagcaaucugcugcugccgcugccccaaauguacuuuguuauuuaugguaccauucuaguggaaagucuguuaaguuguucaagcaacuguuuacaauuuugggugauguuuuguuuuugguuuuuuuggguuuuuuuuuuccccauuaaaaugaguagauugcugcaauaacugaaaaacauccaaaucuuuuugugcaccccuccucucccagaguuauagaaauguuuaagaacacuucaguaguugagacauaggaaaucauuuggucagaaauuucaacagccuucacagcccguuuguaugaguaacaggaaauucucuuugcccuccaaaucugaucuuuuuauaguuuuauuuuuauuauuuuuccccuguauuaguacugcuuuaaaguacaguaauucagugagaucguuuugguucaguuucauagacaguucuauuuucaugacuuguauuugcugacaaggaagaauaaagaauacuggcaguaaguuuugggaaaggcaugugcaucagugaaauguuacuuguauaacaaauaaccuuucauaaucugcauaaccaguaguuucugauuuauaauauuuuaauaacugacugcauuuauuuuugccaguuuaaaauguuuuguguucuuaggauugauguuuagugcauauuuugaguuaaaugacuaucuuaaagcagcaccauaucaguuguuuuuauucauuuucuaaaaugugcugauccuauuaaaaacuccugcuuaucuuuuacaacaaagaaaaauauucaaaaauacugccuucauuuucacacacagugcugaagaugcugcaagcaccaaaucauagcucauaaaaucagguccugagauaguuacccauaaagaggaauccuuugaguguaugccauuggugagccgaugagcauggaccauagaagggcucaauguagaagguaaaauuggcaaaucauaauugagaaauaugacuguguucccauacauaauaugguauaggguguaauguaccugcucuugaucacuuucauuuuaaagugcuauucacuuaaauguuccaugaauuguuuauugcaccacaguuugugugugugugugugugugagagagagagagagagagagagaaauaggucagaucaguauguugcaagcagaucuuuagagccugucaaguuuugguuaguuguaguuuccauuuggaaauguagaugaaugcuuguagauauuggagauuguuucuaucuuguaagaacuuuucacuggugcuguaagcauuucaaauagcaccagucuuaaccuuuaaaugggaaguagaaaaggugagcccaaaguuuacagaugauuuuaaugcuauacauguuaguguagugauacuuagaaugcuuuguuugauguuuauuucagaaaugcguauacuagaaaaucauuuuaauauuaaaacuggugacuuaauacuaguuguaaaguguuuucuuaaagaaggaucuugguacuuaauugauaaaguggguuuagauaggaguagcaagugcucucgauagagaaaguuuuuguucacuucaauacuuugucauuacaaccaguucuuccugaaaauaguuacaugucuaguaaauugauguagaauuaacucgcuggagauaaucucauuuuaguucugcaaauucugccuggcuuuaaaaugcauuuucauaauacuuagaaauaauuugacugaaaauaacugcuuuuuuauuuaaucagucaaucaacuuuuacuacaaauuuaauugagggauuuuuuaauuuaauuggugcuuuaaagaagcaaauaaaucccuggguuuuguuuucuucaguaaauauccuaaagaaacucuuuaauguauuugcgaguauauauauauuuucuuaugcaugcucgaugcauuuucguccugagaaaaguguucucuacagaaacuacccguguguuaaaagaagauuggcuuaaaauggcuacugugaugggaacagugucuuagggagaugcagcuuggacuugagguaaauugaauacuuuacaaacuggcuuagaguuuugcuuuaaugucauuauauguaaaagggcacaugauuauuguaauuuuguauucuuuaugguuuccuuaauuaaaauaauaaauguacagugauuacuaugau

SEQ ID NO: 1760 - RNA, 26411 nt, Mus musculus
aucauaguaaucacuguacauuuauuauuuuaauuaaggaaaccauaaagaauacaaaauuacaauaaucaugugcccuuuuacauauaaugacauuaaagcaaaacucuaagccaguuuguaaaguauucaauuuaccucaaguccaagcugcaucucccuaagacacuguucccaucacaguagccauuuuaagccaaucuucuuuuaacacacggguaguuucuguagagaacacuuuucucaggacgaaaaugcaucgagcaugcauaagaaaauauauauauacucgcaaauacauuaaagaguuucuuuaggauauuuacugaagaaaacaaaacccagggauuuauuugcuucuuuaaagcaccaauuaaauuaaaaaaucccucaauuaaauuuguaguaaaaguugauugacugauuaaauaaaaaagcaguuauuuucagucaaauuauuucuaaguauuaugaaaaugcauuuuaaagccaggcagaauuugcagaacuaaaaugagauuaucuccagcgaguuaauucuacaucaauuuacuagacauguaacuauuuucaggaagaacugguuguaaugacaaaguauugaagugaacaaaaacuuucucuaucgagagcacuugcuacuccuaucuaaacccacuuuaucaauuaaguaccaagauccuucuuuaagaaaacacuuuacaacuaguauuaagucaccaguuuuaauauuaaaaugauuuucuaguauacgcauuucugaaauaaacaucaaacaaagcauucuaaguaucacuacacuaacauguauagcauuaaaaucaucuguaaacuuugggcucaccuuuucuacuucccauuuaaagguuaagacuggugcuauuugaaaugcuuacagcaccagugaaaaguucuuacaagauagaaacaaucuccaauaucuacaagcauucaucuacauuuccaaauggaaacuacaacuaaccaaaacuugacaggcucuaaagaucugcuugcaacauacugaucugaccuauuucucucucucucucucucucucucacacacacacacacacacaaacuguggugcaauaaacaauucauggaacauuuaagugaauagcacuuuaaaaugaaagugaucaagagcagguacauuacacccuauaccauauuauguaugggaacacagucauauuucucaauuaugauuugccaauuuuaccuucuacauugagcccuucuaugguccaugcucaucggcucaccaauggcauacacucaaaggauuccucuuuauggguaacuaucucaggaccugauuuuaugagcuaugauuuggugcuugcagcaucuucagcacugugugugaaaaugaaggcaguauuuuugaauauuuuucuuuguuguaaaagauaagcaggaguuuuuaauaggaucagcacauuuuagaaaaugaauaaaaacaacugauauggugcugcuuuaagauagucauuuaacucaaaauaugcacuaaacaucaauccuaagaacacaaaacauuuuaaacuggcaaaaauaaaugcagucaguuauuaaaauauuauaaaucagaaacuacugguuaugcagauuaugaaagguuauuuguuauacaaguaacauuucacugaugcacaugccuuucccaaaacuuacugccaguauucuuuauucuuccuugucagcaaauacaagucaugaaaauagaacugucuaugaaacugaaccaaaacgaucucacugaauuacuguacuuuaaagcaguacuaauacaggggaaaaauaauaaaaauaaaacuauaaaaagaucagauuuggagggcaaagagaauuuccuguuacucauacaaacgggcugugaaggcuguugaaauuucugaccaaaugauuuccuaugucucaacuacugaaguguucuuaaacauuucuauaacucugggagaggaggggugcacaaaaagauuuggauguuuuucaguuauugcagcaaucuacucauuuuaauggggaaaaaaaaaacccaaaaaaaccaaaaacaaaacaucacccaaaauuguaaacaguugcuugaacaacuuaacagacuuuccacuagaaugguaccauaaauaacaaaguacauuuggggcagcggcagcagcagauugcuugagugaguacacaaccacaaaccucacagggacaacauguauguacugauauauuuauauagagauggccuuagguugugcuuaccuguugcuuuuugcagcagaaccuaagguggaaggucugggaaggcacugugaaguauaaauaauugcacuguuugcaauuaauaaagauuuuaaauuuuaaacgaaucaaaaucaacagccuccaauuugugaauuaugauacugaauccaacuauuuccuucaguuuaauuacuaaaugcaccacaacacuuuccuaggucaucuaugcaacaauaucaugcaaaauacugaaacuguucaugucaauacccuacacuuaagaucuuaacagguaaggccuuaacuauuacuauuaaacuucauacuagagcuaugcauccagaucuaaauaaggggaagggaagucacuaaguuacauaaaacaaucaaaaaacauuucaaaacauccacaaugagcuguacuauuuucugcccuauaaccucaacauuuuuguccucauacaaauggugcuccccacagaugauagaacuaacauuuaaugaaaaggcguuaaguccuuaaacuuugcaaacugaaaagcacuucugucuuaaacauuucaaguuuuucauaucacuauaaaagauaggcauauuuuacacugaaaaacagcauuuuaggagcacugauaauacuauucaacuuuguuacugaucaauuuucuuuagcuauuagcuaaagcauaucaaaaauacuuacccauuaagcucacuuaaaaaaaauacagaacuauguauuauucuauguuaagaagcaguuaugguuucccaugacagcacuguauuccaacauaauagucacacaaaauauagcaauugcauuauguggaacaucgacaaaaagacacuguugcaguucaucaauuugucacucugauguacuuacagugcaaugcuccuugaaggaacacaaucaaggaugauacacagcacaguccuccucaccccuacagagcuaguucuauacuggcuggaucaaaccugcacuucaacagacaauggcaagacagacuguauuugcauguagucuaauauauuaauaugcaaagagccaacaaauaugcagaguaaaacaaugguuuucaacaaaauaucagaacuucagcaugaauguuaaagauuaauaaaaugauucaguacauaaaaaaauuaauuugauucaaugacuggacuugugcaauuacaagacaaagcuuaucuauacugcaaaaagaaaaaaaaagcuugaacauuuucauaccccaaauguuucaauggcagaugcaauguagcuauacuuucacauucuauuacuuuucuauccugaauuuagagagaaacacacuauuauaauauauauauauacauggaaagaguugcuuuacaugaaaaaaacaauguuucuuauaaacuccucaaaucacugucugcaaacuguucaaaauuaguuaugcugaaacagucucggaaauaagugaagaacaggaagguuaacuguuguagcagcgguacaggucugaaauagugcucauguauaaaaggaaaugucacuguuaaugcaauggaaguauacuaaagaucauuguauacacaugcaguuuuuaaucaaauagaaggaaaaacaugaaaauaucaggauuacuugugcugaaauagccaaauacaacagaaaagaaccuccaaucuaccacuauacuccaacaggggaaaaaacaugccaguguuuaaaaacucaguaauucauggggaaagcuuauauauucguguacauguaucuuaauuuaucacugcuaagaaacuaugaauccuuuacccacauauccaacuuaccgacacaggagguuucauaucauuuauuguaaagcacaaaacaggcauuuuaaaagugaaaguauacauugaaaaaguacauuuauaucacaaagcaucgaccacauaauaguugcaaauacauuugcuggaauguguacaucuacacuaaagacuaaaaacaaaccaauuuucauuucuacacagaaauauuaaccuccuaucaguagugauaguuauuuuguacauuuucaaaauaaaaaaaaagggggggaaaaaaacacuacuuuaaaccaaaaacaaaauuaagaucuucaucaagucgucugcauccauauauuuaacaaagguuuuuucccccacacaaugaagcaaauacuguauuguccacuucuuauuauuggcccugugcagaagagauacauaagagauacacaaaaaguuaaagaaaauccuuuaaauggagcuaauucaggagugaauccuuuaagaaagaaaaacugguuaauauaaaugaugguggcuucuugcaugauuugcaaaucccuggggggaagaaaauuuauuuuuaaaaucaaaggcauuacaaaaauagcacucagaugccagaaaacauuauuagaaaaacugaguccccaaacacaacacgauauuucauguaguuauacuuuaccaaguaaaacauauucauucccaaacagacaaacaugcagaaaacaugguuggaguggaaaacaaaaacaaaaacaaaacaaaaaaaauagcaaauguuuucuaccugaggugcuggaggaugcugcggcauccccuggggacuugucugggcauaauacgcugcuugcugucuauaguacucagcccaggcugcacuauaauccggcugaccaccugguggggccccagcaggagcaggaacugcuugaccuucaggaaaacagagaacuuuauugcugcuauaauuacaaaucucacaguaacucuucucuaguaaacacagcaucuugccuuuuuaauacuucuuccaagccuuuuaauaaccucgugucugcccuugugaccuaaaacacccccucaacuuuaauacaaaaauguauguaccauuaaguacagcuuauaaugcaaggcacagaggggcaauagcucuuguuuuuaucucaacacaggguuucacuuauguagcacagguggcucaaaacuuguuauccucuuggcaacuucccacgugcuaggauuaucugugccucauugccccuucaguuucuguuuaucuuaaauaugccuuagacaagggagggaggaugaggggggaaagugcagcacacaagaaacggcaaagauacucuuuucacuucaaucacaaguuucagucucuuaguucagcuugauuaguaaaagacaaaaugacccaaacucacauaccuuuaaacaaaggggaaaauucagauauaaucuuugacaaggaaagaagaaacgcuuuguuuuuuuuuuuugcuaacugagaaagggucucacuauccagggcugaccucauccuuggagaucuaccugcuucugccuccugagcacuaggacuaaaugcguauaugugccaccauaccuagcucaccacucuucuauccauuugggucacuauauuacuagucuuaaacuacagagaaguacugaaagauauuuaugacacacacaaugaagcaaaagacauacugaguuuauaucacagcuuuacuaaaaauaaccuggcagcugaaauaaaguucaaugaaagauguaaaacucagcuuuuuuuuuuuaaagauuuauuuauuuauuauauguaaguacacuguagcugucuucagacacuccagaagagggugucagaucuuguuacagaugguuguugugagccaccaugugguugcugggauuugaacuccggaccuucggacgagcaguagggugcucuuacccacugagcgaucucaccagcccaaaacucagcguuuauuaguaauuuuguuuuaagugaccauucugaguuaucaaaugauaaaaaucgaauucuagaaauacuuaaugaauuuuguaaacaagcaaguuaacugcaaaugaguuucuuuuucuuuuuuuucgagacaggguuucucuguauagcccuggcuguccuggaacucacuuugcagaccaggcuggccucgaacucagaaaucugccugccuuugccuucuucuaucccucuguaccuuauuccccugcuccuuuuacugaauccacaguuggcuagcaagcuccugcaacugcuucccaacaugcaacagucaugauuggcuuuuaagauagguagugggauuugaacccaggucauuaagcacucuuacccaucuaucuccugagcuucuauucugaaccuuuugcuuuaaggucucuuaauucaugauuauacuaaaaaauauaucaaggaccauacuuucagaaaaaaauuguaguuaaauguuuuacagggaaaaaugauuuuuauaacuaucauauaauuaaaaauacuaauucaaugauuaauuaaauuaccuaaaacaguaucuuucaagaucuauaugacagggaauuguucaguuagucuuuuuuugcucacaggauuaagaucuucaacauaauuacaaaaaagcacaaaugaagaaaaugagucuccaaauaguuauccugcacgaugcugcugucugugugugucugucucuauguaugccaacugauugaucgguagacauaacaaccaagaacaggaauucgggcugggagacggcucagcgaguaagaguacuacucuucucaagguccugaguucaaauccuagcaaccacaugguagcucacaaccacccauagugagauaugaugcccucuucugguaugucugaagucagcaacgguguacuuauuuaugacaguaaauaaaucuuugggucggauugagcagaguucuuaaaauucaauuuccaacaaccauaugaaggcucacaaccaucuguacagcuacagugcauucauauacauaaaauaaauaaaucucuaauaauaauaauaauaauuagaagaagaggaauucacagaacugugugcuggaaagugcuagaauauuaaaaacuaaaaccuaauugaguuaaaauaccuacucucaaaaguccuagucaauauacuuuuuaagaauacagaaugcaaaauaucuauaaaacuuauuugaagucauguaaacaaauaacaugacauaaucgagcacagacaaauaccuuacucugucuuaauuacguaguccaguuaccagguuucuacccaaucaacacucacacaguaaaaacaaacaauggaguuagcgcacuuucaccuuggcaugcucagcuucuuauaaacaaguagcacuauuucagcacggcuaccacggaaugauuaauacauuuccaucuacucucaaaaauaucacaguucagagaagaaauuauguaagcauucuaauuacacacaauauuguuuuaagguuucaaguuucuuccccccaggccccaaacaggguuucucuguguagcccuggcuguccuggauggaacucacucuguagaccaggcuguccucgaacucagaaaucugccugccucugcccaccaagugcugggauuaaaggugugugccaccacgcccggcagguuucaaguuucuagugcuaagguccaucuguuagaaccugccugcgaucagugagguuaagaaaaguuaucagcccaucuguucacugcagaaguuuguuaucacauuuccccaaacaguuguucugaaaggaacuuugucgaaagcuguaucaccgacaagaaauacauuaacacaaucacuaugguuauguuaagaauuacguucaauaguugucaaaaucuuuuuaaaaggucacccuuuuuuccuuuucaaugcaugcaaauguuuagaaauguaaagcaaugucacugugggcuaauuuuaugcuuauuuugcaguaaagccagugauacaacuacuuugcuggccuaaaauuuaaucucauuccauuuagaccacuacacaaaaguacaguaauaaagccauauauuauuaccuaguaaggaaaugccagguuuuaauuauuaacuugcugacaauuguauuucucugccauaagcacaauuauaagaauuucuugaauugcucuuaauaugucuuaacuuccagucaauuucaggaugucaccuuuccuguuuauuauuauuuuuguuuuucaagaugggguuucucugucuaagagucccaaguguccuggaacuugcuuuguagacaaggcuggccucaaacucggagaucuaccuuccucuaccuuccaaguacugggauuaaaggcagguaucaccacugccuagcuuguuuaauauaaacuuuaacauuauaaaaacauacggaugaguuaccucaaguauucuuuuuuaaaaacaagcaaauguuuuguuacucaucucuagcuuuguaauguguauuuacuuccguuuaguuacuaagauaaaggauaagacguaaacuguagagcauacccauuuucuuguaguauucuucccaagccuuuguauaaucaaccuguccagcuggagcuggagccugcugaucuccuuuuuaaaaaacaaacaaacaaaacaagauuuaaguuucugaagguuguuaugcacuuuugcuucuacaccaucaguacuguaauuagcacugucuacaccacggaguugugcaaguguuuguugggaauacaugacaaguggguauagaagggguggacacagaaacugggaauaguaaguaaaugcacacaaaagaaauauagaacaugguuucuauccauuuuuaaggacaguucaagcaugguucaucccuugauaucuccugcacacauuuuuagaaaagccacaaauagcuuugaagcacuaauuuuaaagauuaaaugaaaaaguaguauauaaucaugugauuuuuaguagacacguguuguccugcauguuuuuaaagauacuguuuaauuuuaugugugagcauuuuguccacauguauaaucugugcacccuggguaucuggugcuccacagaucagaagagggcacuggguccccuggaaucaguuucagugugaguuaccauguggguacuagcaaucaaaccuggguuuucugcaggaacaaguacuauugacugaaugccagccccaaacauacuuuuuaguucuaauuuggacaggauuauaauuagugacauuuagauagcaauuaguauacuuagacugaucucuaaauucuauccugagagagagagagagagagagagagagagagagggagagagagagagagagagagagagagaaagagagagagaaaaggaaaugaaucaccgauuggagcucagaagacaaaguuaucuuacugugucagguacuaaggaagcaccugaagaacgaacgucagaggcaccagagccaccuugaagauaaccccaaccaccccaaaucuaggacaauauaaugaaaguaguuaaaaaagggcaaucuauuccuuguaguaaaauagcaacuaauauacaaugacagaaacuaacaguuaacagcugcuguaauaguaggguaccaaggcaagguuuauuaauaauacagacuaaggcugaggcagaaguucaauguauaggauagugacauuacuccaguaaaaaguagcagaaaauacuagguaauucuuuuuuuuuuuaaaagauuuauuuauuuauuauauguaaguacacuguagcugccuucaggcacacuagaaucggaucguaucccauuacagaugguugugagccaccaugugguugcugggauuugaacuccggaccuuuggaagagcagucgggugcucuuauccacugagccaucucaccagccccuagguaauucuuuacaguacauaguuguaguauagugcaaaaaccaggcugguaguagcaagaccauuuaaacaaccaugguuaguaacucuauagcuuggcagcuaucuaacuguugaguuauccucuuauuagaggcauaaaagaagaccaagaaagugcucuagcuugaugagacuuaaugaaccuaaugaaaacacggggucaguuggugaucuaagcaagggcuguguauaacagugguauaucaaugaugaguaacugacuuuaaaguccaugguggucauuuauuuuggaaugaauaagggucuguagaaaggugauaugauuuuaugucucuaaguacaguuuucaguagcucucuucagaacuauuauaacagacauaaaucaggguagugaaguaaauggggguggggggaggacaguuaacagucucacuacuuaaggcauuauucuuccaacuauuauuugacuuaguuugcuuacacaaagucacaacugagucuucaaaaccuuaggcccgaggaucuaaccuaaugauaccaucaugcacaaggcccaacaauucucaggacugaaagagaguuuuguuaugacuucauacaugaauccaaacacaaacuauagcuuuaaaauaggaaauaaaaucuuucauuaccguaguuaccuuguccguucguuuggguuguagcuggugcaccggcaggagcugcagguggggguugugccugcugcugguaauagugagcauaauaagcagcccaagcugccgaguuuggaucugcuccugccuuggcuacaauguaaaaacaaagagcgguuucaagguuaauauguaaacucuagaaaccaacccuuaccuuuuuggugauuccugacaaauaggcucaaaaguuaccaauagcgaauggaaacuuucaaaauguucuaguauuaucaucaucacuuggcuuuuaguucagaaacuucagccucgggaauuaaguaauuuccuagguuacagguauuaaguaauuuacuagugaucgguggaacugguauauaaauggaugaucuuuuggcuuccaauccaaugguuugucucagcucaaucccgugucuuugcuuuuuuucccccaacaaguuaagcugccaagugcaacaguucuguauagcaggcaguuauggacuaauuuguacaagaaagaaacaaagguuagauacaugcaguuuauauuuauuucagucacaauccugaaaguccugcucuauccuuuucuaacaccuuuaggauacuucaagcauagcuuaucauuugaaagcuccuguacaguuuuaagaccaugccccauuuaacacaggccguuggauuuccaagccguuaccuuuucuuccuccacuuuuccuguuuccgggcuacaugcuguggucuggccgcccuccccagcuuagccaucgugucguggcgugucuguuuguguguacugauucugggugaucucccuagacaugcucaccuuguuuuaucuagacuuuaaagucccacuucuaguuauguguaucugugaaccuguguguaucuacacaaauguggguuacuaaagagaaccagaaggugugagaguaacuggaucucaacuugcauccucucaaagagcaggaagaccuuuauaauaaucacuaagcuaccucucugacacccuuccucauuuuuuaaaagaauuauuauuauuuuguauaugaguacacuugaagcucucuucagaaacaccagcagagggcaucagaucccauugcagaugguugugaacuaccaugugguugcugggaauugaacucagaccucuggaagagcaguuauugcuuuucuuauccacugagcccucucuccagccuuccuuccuaauuuuuuuugagauaggauuucucucugaacccagagcuccuagauuugguuacaagagcaggccaggaaacuuuacggauccuuuuuacgaacuuuauuaaagcgcuuuauuuauuuuucuuuacaacaggugggagggauagaacucagguucuaaugcuuauccccagcacuguggcuuauccuuucuauuaauucuuuuagcaucccccaauacucaaguuuuagcugcugcccuauucccaagucaccacaaccagcauccucugcacuaagcucaccuuuguaacucaaaaaccaaaccaaaacccaaacuuuuuuuuugugacuugcaacuagcagguacuaagagcucacuauucuuuuacauaggaugaauucgcauauuauccauuuaagauugaagauuaaauucuugacaucuauauaaaucucaaccucacagcagcaguuucuugaaaaugcagacaauaaaauacuguauacuuccaagucaaauuuaagcaacauauugccgagucagucuuccagguaaugcuggaagucauauucacugaccagaccuuacagugcuaauaucaaacaucacucauuugagcaauccuaugaaauugaauuagccauauaaaaccuucaauauaaccuguuccaacucuauuugaucaugccacgucuaaaugcuuguuagaaggagaagauucacuuuuaaaacccuuacaaaggaagucauaacugaugcuucuugucugcccugggaaugcacucuuuugcuaaucgacacucaucuuucauauucagaugccaucacaauucaaguuauuucuuuuucuuuuuuuuucucucucucucuuuuuugagauaggauuuuuccugugugucccuggcuauccuugaacaugcucuguagaucaggcuguccucgaacucagagaucugccugcuucugucuccugugugcugggacuaauggcguucaccacugccgcccggcucaaguuguuucuuaaaugaauagaaguugugguuauuuggugacugagaaaaguuccuaugaauuuaacauacauuaaaauauuaaaacauuuaacaaauccaacaaagcaauuacaucuaaaucaacuuugauuuguaaaaaauacacuauguagaaaucuauaacucagaacacguucucucaaacuuuucaaaugaaucaaacuacaggggcugcaaagugaaaaaacaaaagaaaaacaaagaaaaaaguccuauuuccaaguugauuccugaucaugauggaguagaaacaaaaccaguaugggaagauauaaugagaacaccaugcuauagaaaauccagauuauaagagagaaaaauaaauguacucuccuguuuugguaauuaagggaccuuaauuuuaucagcaacaaaauaauuuauacuuauuauuugagaacauaguaguguuaaacacauuauuuuauaaauaugaacuacuaugaauaaagucacaacauacuagacagcagugucauccuauacugcaggggaagugccuuaaaagaucgcacaugcaguagguaguuuaggacugugaccagcaguauacaaugaagcuaacauauuaauaguagauuacccuuuaccugggucaggaggagccuguugcugccaauguggauacgcauuuccccaucccuggggagcauauggggcuggaggaccgcuagggguggggaacaaaacacaaauaccauuaauaaaagccagcuuuauuuauuuuauguguagguuuugccucugcauguauugcauguauguauaugcagcuauguaugccuagugucgcuguaaagauacccuggaaccugucacgaaugguugcgaacccccguguggugcugggaagugagcucaggucccucugcaacaggaacaagugcucugcacugcugagccaucgucaucucuccagcccccaauuccuaggucuuuagggaaagcccagaaccaagcaaaugugguacuuacugaggagcugggccaggugguccuggauuguaaggugcaggguuguauggucccauuggaguucccggcccuggagguccaggaggcccaugaggaccuggaaccccauggggcccaugggguacagguggcccuaaaggauuuacugggcccuauuauaaaaaaaaaaaggaaaagaaaacauaaacaauaacuagacacucaaacaauguaaugguugaguaauucaaaguccaacuacucuuccauuucuacgcuuaaauaacaaauuuaaauuuacccucuuugaauuuuggugcaaaaaauaaaaugucaucaucugccauguaaaauucacugaaauccucagcuccagcagaguucuuucagcuuagucuucuguguuucuuacucuuuuuaugauuuucuuuuaaaaacaagacugccuaguucccuuuacuucccuaaugugacaacugcugagaguauauucugcaaauugcacaucaagggaaaacuuaacacaugguauucucagccgggugugguggcgcacgccuuuaaucccagcacuugacaggcagaggcaggcggauuucugaguucaugguucuuguauuuuggauaucuuuccuaugucaauauauguauauacacuauaucacaauaccugcaauuucauauuagaaacgauguauuuucccacaguacauuuuaaaguuaccaggaacuaugcuauaaaugagaguacacuuaccccaaucuucucuucuaugaguugucgagcauagucuauuugcuguggagugccccgaauuguaaauaacuucauauugggaucugcauuagguggagggcuucucugcaguucuauucuugcaccagacuguuggcuuaugcuuuuuaugguuucaccuccuaaaaccgcaagacacuaaguucacagaaugcaagcaauacucuuuccuaagacaagggucucuguguggcccugguuguccuauaacucacccuguagaccaugcuggcuucaaacucacaagagaaacaccugcaucugccuacuaagugcugggauuaaaggugucugucaccaugucuggcagaaauacuauuuaaaaaaaaccaaaaaaaaccccaaacaccuauuacuuugcccauuaaacaguuuuguagcauuccacuggacaauaauguuaggauuuucuauuuagccuguucuuccaucuagaacuaaugcaaaacacacuaaagucuauuuuauacacaccuuacuaaacauacacccugauaugggucagaacagaaaaauauuucaaucaacagguuuuguaaguaacaaagaaguuaaaugcaaaacaaaacaaaaaacaccaacaaaacccauuugaauuaggaucaaguuuuguaacugacagacuuuugguccccuuucccuagaagcaguugagacacaaucccauuuuuagcauacauuaaagaguauucuuauuuuagcugccauguuaagaccccuuuccuaaaaaaauauaaauagcaucuuuuguuuacaaauauccaguauaucaaaacaaagaguuuaaaauacauugccuuuuccaaugaucaguccaguuuucccaguuggcacaaugaaauuaaacuccuggaguccacccgggggccccauauuccaguuuccuugaccucuaccucguccucgaccaccaggucccgguccaccaggauugccagccuaagaaaggagagaacaaaauaaacucuguaauaaaacuauuagcuuauuauccccaacucucguauuucuaaacaaugaaauuaagagaugacgucaaacaaaaauagucaacuaaguaauaacuuccacuuuuaaaauauauugggagacuacccauacaugcaaaaugaccuggguuuaauuucuaggacccacauaauagagaaccaacuucagaaaaauuuccuuuggcuuccauaggcacaauugccaaggcacauauacccauagaaauaaaaguucacaugcacugggggaaauaaggcagaacauuuaugcaaaucuacccuaaaauguuuaccuuaaagcaauuuaacguuagucauuuuaacacugccaacagauucuaauauaaccuggaggggcauuuuuuucauucagguaugauaaaaacuuuuccaaagaaagcaaacugaaaauguuaauuuccuaucacaccugaacacuucguagaaggucugugauuauuucugcagcgugcugacaccugucuggagguccuguuaucugugcuauccuaucagguguuguuccaucaucuaaaacaauaacaacaacaacaacaaaaaaaaacagaguaaguugugacaaaccaauuauaaaugucaagauuaaaagcuaucaauucuuagaacauuaaauauaccuuaaacuuaccuggcuuaaacugaauucgaacaccagcaucauuuuguauuuuuuuaaucauuucuccauuucuuccuauuacaaugccaacagcaaaucuuggaauugggaccuuaaguaaaaguauauuuuaaaagacauuucucaaaaacucauccccacuuaaucauaaaaguaaauauacuaaaugaucauaaaaauaacaagauaaaaaaaccccaaggaagaaaacaagaaaagggacaugauguuaagccaaguccauuuaauucaaagcaggaaaacacuagugcccauggauuaggauacaaccacugcugacucagaauucuuacuuacaucuaucccuucauugccuccuauucuugagccauacucauuccgcacuucucugaaaccaccuugaucacgaauuaacucuaauaccauuuccuuggcuugcuauaauagaaaguuauccaauucagaauauuugucaaaaaaauuuaauacguauuuuguccacccccucagccuuuauauauaagagacaaagugaagcuuaccugaacuuuguaugggucacccguaauccuaagagguuuaucagcaccaguguuuugaggcccaucuugaaucauuaccauuuuaacaccagcccguuccuauuaauaucaugaaaauauguuaguaaaaacaauaaaaaguggccucaaaagacuuaauaauauucuuuacaauauaauaauaccugaaguuguuuaauagucucgccccccuuuccaauaacuaguccugcuuugcuggcuggaaucaugauuuccugaacugcauuuccagguccaucaccaugaugaaagccaggggcuggucuucccuuuucaacaaucugguccaauaaucuuuuugcugaucuguuaacaaauuaaucuugauaaaaauacguagcauaacccaacuuaucccaaaauaauaaaagucagcaguuuuaucuuagucagguuucaaacauacucuaaauuggucauauggcauuucauggucggaggcaagaaccuaaaccaaaggagugagugucaagucaaaugggcaguaaguacugaagucuguaugcuccaagugaacacagucauuaaacaucuuccauccauccugucacacagcaacgggguuaacuagugcacgacucagccucugccuuggaaagagaacugucgaugcagcuguuagaagcagagcuugaaggaaacugagaggcacacacacuagauaaacuuuuaaaggggaaacuucaaugguacaaaccuuuuaaagcacuguguuaacaaaauacaacaugagguucaaagauauuuuuaugauauguaauuuccaaaucugucuauaaacucuuagaaauuacuccuaaaauuuuaggaaugaaguaaaaaaucaguuuagucaggaauuucuugaaguagaaagucaggcaaaugaacguaaaacaguaucucaauacuagacaaaaaaaaaaaaguaugcaaggaacgguguuaagauuucaguguaggaugauaacacuuucuuggucacagcaacacaagucagucaagacagugaguguggugggcaauggugguacaugccuucggcaggcagaucuuuuaaguuuuaggccagccuggacuacagagcgagugaguucagagacagucagcuauggauauacaaugaaacccugucuggaggggagauggcaguggggagaagacaauuagagguaaagauuggguaguuuuaucagagccuuagaauugaguggaagagaaaaacaggaauauaaaauuuucaugacuagauuggucaugaguuuuaggugacguuauuaacauauuugugcaaggcagguuuuaauaauuucugagucuguauagacacguauggaagguguauaggucaaauuacaaccaucaguaccuuuuuugugauaaguaccuugaggcaaggucucucaaugacuuugaacccaucaaauaguguuagcugguugguuaccaaguccccaaaaucugccuguguccaacuccugagccaugauauuaccacgccaguuuuuuuuuuuuuaguuuuaggaucaaacucaguucuuccuacauggaaggcaagcaccuaaaugccugaguuacggcuuagucucuggcuuuaacaauuucucugucuuagguucagaugaugaacccuauuuuaagaaaggcauaauauguaaacuuuuaaagcgaaaugguaugaaaacgaagcuuauagucuucagucuuaacuguaaguagacuuaacauuuucaaacuuacuggacagauucagguguuccaguuagcauacaagaccuuucugguaggccaccacuaucuacaauuaaauaaaaagaaaaguuuaaguaaaaaauacaauaaaaauaucagauauuuagaaacuuaaaauacuugaguuuccuagccacucucaaaaaacuguaagaacuggacaaaacaacaaguaauucguacacacacacacacacacacggaauguuaccaggugcuaucuguaucuugcauccagauuccugcuguauucgugagaucuguucaccuccucugccaauuacuaguuaagguagagaaaggggagaaguuaucauucauacuauuuuugaaaguaugcuuugucuuaaaaccuuaguauuaaugguacuuacuaaauccgaccaucccaucugggacuuuguauucuucugucauuacagaucugcuaagaaagaacagaaacuaacauuuuccucacagaaaaauaauguacauauacacauaaaagcagucuaauaaacccaaucuuaaagucucccaguagcccagccagguucuuaaaugaggcagcaugugugagcagggcaggaaacugaacaccugucaaagcgaaugccacuuuaacauuuauuuuaccucuucugaaaugcgucaauuucaaccuguuuucccaaauuaacaauguuucuauaccauuuucccaaugugguuuacagaaguaaaccacacauacaaaaugguaugcagacauuugcauuauagacuaacuuggcuguacauacaauccaacuaagacuugcaaaguagcuuuaaaaguuuugacuauaccuuugcugcugaugcauuggagguaacugugcuccaaaagcuacgaaaaaaugaacaaaaacaagcuuaaguucgaguuuauuugagacaaacauaccacguacuccaaacucuuucccugauguauacauaggaaaaaaauucggaccauucauauuugaaucaucacugagaguagcaagaaagucaggaaagggacacacagauuaacaacuagaguaguuaacuuauagucacagcucagccaucaguguuuguauauacguggcucccaaguaaaagagaaucauucuuuuuuaaaaauauaguaaaaaccuauauacauuuguaaggaaauuccagcuagacauuuguaauaccaacccuguugaguauggcaaggcacacacauccuuaguccaagcacaggagaaaacaaaagcaagucuguuguaggcuauuugaucacuuagauuauagggugagccccaagauuguguuauuuacggggguggggguguaugugcuuauaguugugguguggcuuugcucuuuaauccuuuaaugaccuuuaaucccaaacaguaaagaugaaguuaguuuguagaaggaagcacucauguuugaaagugauguuuaauuuagaguagcagacaaagugaucaaucagagaaggagucaaaagaauaaaauuagggcugggaaaauggcucagugguuaagagcacugacuguucuuccagagguccugagaucaauucccagcaaccacaggguggcucacaaccaucuguaaugggauaggauccgauucuagugugccugaaggcagcuacagugcacucauauauaaaguaacaaaucuuugaggaaaagaaaaggaaaaaaagccgggcaguggugggucacgccuuuuaaucccagcacuugggaggcagaggucagccugguccagggugaguucuagacagccagagcuacagagaaacccuguuuugaaaaacaaacagccgggcguugguggcgcacaccuuuaaucccagcacuugggaggcaaaggcagguggauuucugaguucgaggccagccuggucuacagagugaguuccaggacagccagggcuacacagagaaacccugucuaaccccccccccccaaaaaaaaaccccaaaaagaaugggauuaauuaugucuagcucucaggagaauagagaggaggacuuaagagauaaauaaauagcccagggggugggaggacagucuuauuggaacaguuguagagauauauagguugcagagagggaacaagcuagacacauguaaaaacagaauaagccagaaaaugagaaggauaguuugaggccaagcagagcaauuccggcagaggucaagagagaagcuauauugaaucagcuuggagaggaguuugcaccagaguucagaaagaacuagaagguuugaggcaguaaggcucagagaugacaauuacaucaggcaaaauaaaaaauacuuuuacacagguagaucucugugaagucaagggcagucagaauuacauauuugagacuuuggcucaaaagcaaauuccccaaaccccaaacucacaacccacccaaaguagaaacaacagucuggagagaagacuuagaugauaaagaggacacaugcucuuguagagaaccaaguucucagcacccacauguaguccacuuucagggaauuccuaugccaucuugacauacauacauacauacauacauacacacacacauacacacacacacacacacacacguaauuuuuaaagaagcaacaaaaccucagcuuaaaguacuuacagucauuuuggggagguacuuucuuagcaucuggcugaucugcaaaauuaagugucuuuuacuuuuugucaauuaaaaacaaagcuccccacccccaccaagcaagaauaaugauauuuauuaaaauacaugauauauugguuuaccaauugaaucaaaacugacacaauucaaccuagacucaaaaaucuaaaaaaaaaaaaaaaacccacaaaaccuaaauucuuucauucucuuguguuuaaacaaugcacagacacuuuaguuuggaauaauacagcacaaacuguuuagcuucaaugcuggugaauaccuuaugcuaaugguuaaugaugcuucauccacucuagaacugacaauuagagagcacuacauaaaaaccagacauaucaaaagaugagugaaucugacagugaucauaaaacuauaccaaaaaagaaagcucacguuacaagacaauuucaaucuaaacuguucuauuauucucaaaugaagcauuucacuacagaacaccaaaaccucaaagcaaccacacgauugccuuucucaaauaaacaaaaugcauacaacauaugaauagacagccuauagcucaaaacacuauuauuauucucccaacuucaaggcuuuuguauagcaaaaauucagacacauaaaccaagagaccauuguguccauuuaagaauccacuggcuuauuucacauuuacauacuaaacacagguaauaaauaaaaauuccugccuuuaaaaggagagggcauucccucccagugugugguacugcucggauuuguccaagagccaucuacacauaaaauaaaaagaguacauuacacacaacaucugaagcaucauuagcucauuuuuucuugcauauuaaaaaccucacuugcaaauauaaacauacuuaaacaaaaggaaaccaaguauuaccagaaagggccacaaauacagucaguccuauaugcuaucagaaucuuuuacaaaagggcaaauauaucaauaucaaaauuuauacauacaucaaaacuaaaauaaaaaaguacacacuucuaagugcagaagugaugauuuuuaaaaagagaaaacacuaugaauccacaguuuuaaucaauguuuaaagauaaauaugaaacacacaaaacacuaaaacaauauaaaaaugggaugccugcaaccaaccaaccuuaaccuagacguggauucugacugaaugaaagggaguaucaaagacucauucaauaaaugagaaaauucaguaaaguguuucccaaauaacauaacuuuauuuauaucauuaacagucugugcaacucaaagcaagcauaauccuauaacaggacaaaaaaaaaaaaaaauaacaaaaccuguuuucuauuacaauaauacuucccaauagauucaaauuauaccuaccuuuucuaggucugucuuuuucaaaauccuauucuucugagaccaauagauaguaguauuuugauaaaucaucuugauaaacaauacugaaaaucuuaucaaaugaauaccauggaagauaauuauucuuguuggcuauaacuuaccuccaucuucuaagggucuuuuuugucccccauaaccauagucauuugaauucaaugauguaccagcaucacccccaauuuuugcugcaaucuuaaaagaaaaaucggaauacuaaucaggguauuaauacuuuauguacuacucagcacuaaauuuccuacaauaaaagauauacuuuuaaaaacacuagaaagauucacuuauuaagaauaauuaaaacuaccacuaauacuucagggagcuaacaaauaguuaaugaucuauuaaacuuauguuauauccccauuuaaaacaacccacacauuuggaaacaaaaucuuuuccacccuuugauuucaaaucauagcauuuguaaacuauaucuuagguauuuaagugcacuguaugggacugacaggaacugauguuaaaagggaaguguuacguacaauugaacgagaggaaaacggcuuagacuauggcuauguucuacaauuagcuuuuaugaacacuucugaguuuacuugaagaccaaggaauauccauaagaaagcaugcuuauucacacuccauucauguaauaggucuacaagcauccaaaagaaaaauugguacacaguucauucaaaagaccaagcaaaacuuucaacucuccccucauugggggugggugguggguggaugggaacauggucugauuauagccccagcuagucuaauccuaacuucucacaugcuacaauuaugaacccaauguuucuauuaaacacacauuaaguguaaguaauguuuuuauuuuaacccacagaaauaauucaagcuuuccacuugauuuuugcucuacuguauuucugugcuuuuuuacuucagacaaaaaucaaaccaaaccagcauuuaccacuuucuucacugacccacccucaccaauuuuggaguuaaagauaauucuaagaagguaaugacgugaaaacaucuaucuccuacacuuuagcccacacuuucuuuaguaguuuuaaagguggaagugcaaaucuacuucuagugcuuccuaggcaggguccacagcaacuuucaaauuuuccuuuuggaaaauuuaacaaugcgcacauucauccucaaagacacaguugcaccaaacuuauaaaaagugugccuagcagcacacucgggcugguccaaguucccuggcuuauguguguauauguguguguguguguguguguguguguguguguguaacagcagaggacugccuggucuggucucagugggagaagauccaccuaacccuugagacuugaggccccagggaagggagguggggagaugaagaaggaauggugugaggaacugggggugagugggcaggaauguaaauaaagaaaauaauuuuuagaaaaaguaagugugccaggaucaguguaggcagaccugucacuccagcauucaggagggugaggcagaaagacucucauuuugaaaacaaaaucucaucugggcauggguggcacacaccuuuaguccuaaaggcagagguaggcagugaguuccaggacagccagaacuacauagugagaccuuagucccuuacuuacacaggcaagguccugauggaauuucuacauacccagaauguccaaagguguaacagauacuaucaucuauaauaaacacuuguauuaucacagccaaugcuugcuaacaauggaaucuauccauaguuuuucucacauucccaccuuuuuccuccuccuauguuauccuauauuagcugacuaccucuuagagcuguccuuccagaaacccucgaucuuuguagagcaagcagcagcuucuugucuaugcuggccagacucccacuccucacugcacuauaugaaugucacccaucuuucagugaggcaucccuuuccagcagcguccuguacagcgccugccucacagugugacuauuuauguaaccgcugugguuuacuuuaucaucaaagcugucugcucacucguguucgauuuuuaucucacaagacuagaaaucacacacuuaaaaagcuuccaaagccgagagguggaguacaccuacacuagagacaauucagcaggaagccuuaaaccucaggccugccuaggcuuucgguagaggcccugcaucaaaaaguuuccucagaugcccaggcagacacacuugucccugagccuaacaacuuacaccugaccaaaggguccuacauggaaggagaaucaacucccacaaguuguccucugacuucuauguacaccaaccacauugcucauggaaucccucuguaugaauaaauauauuuuuucaguaucuaugcacuagauaagugugcuugcuguauuaugguagacuugauaaaccuugauugagucgguaaucuuucgguccugaaggaaguuuccaguauagucaaagcuggcuuuaaaaaccugcucaugucuagcaacuacaacagagccauaaggguuuauuuuaccuuacaggcaaauuccauaacauacuuuuuuuuuugagacaggucccucuuggccguuuugacuggccucaaacucaagagaccugccaggcucugucucucgagugcugggacuaaagucgagcaccaccccacccggcaaggcaacauuauacauuuuuaagcuacaaagaagucgggggcgggggcuacuugaagacauugacguucagguuauuggggggggggugucaaaugcaaggacucuuaucuauccaacccuuuucaucugggaaaaugguugccauucgaggcaacaguacgucccuacguagcacaaagagguuggaggcuucgacuugggaagagagaggcagauucaaacucaaggcuggggaagaaagggcccggggccauuuggagcuggggaaaggauugguggaucgcacgcagaucccgccccggggagagccucgcuggugaacgccgcggggaacguuaggcuaauuacggcgaggguggagagcucggcggcgcgggaagcggcggggaccgcuagccaggcagccggcccucccuggcuugcccucgccgugaccugagcgcccagaaccuuccacgcgccugggucgggcggaaccggagccgagggagccggggcaggcagggcgcacggggcggcgaggccgcgcgcgcggggcggaaguggaggccacgcucggggagagcgcgugggaggggggggcgcuucagaccacgacaacgggcucggccucgagccgcugggaccccucgugagaagacgccaucuccucgggcggcagccgcgagugcgagcagggccggaccugccccgccggcggcucucgggggucggggaggggaagccgccgcgcggucgguccacgcuuaccugccgcgcucucugcagggcaucuuugaaagcgucguuaacgacuccgccgccgccgccgccagccgagccagacgacggcggaggcacuguggaguagucggccauacccacgcuacagcacacgcugccguuuccucgcggagggaggcgccgcucucgguuaacugcuaagaaaggaagaagauggcggccgucgaggcucuaucacauucuugcacgaccaucgugccguaaaggggcggagacuggcagacggaaaucccgcgauguuucagcg

SEQ ID NO: 1761 - RNA, 47142 nt, Mus musculus
agacgcccgcagcggccgcggagacaccggaaggagcggcggcugccgagggaagcgucgggcagcggucggguucugcgggccgcgcugcggaaccguuuugcggcccugcggauccgagcgcucaggcuccgaggaggagugcgcugggcggcgggcugaggugagcgcggcggacgggcgggcgggcgugcggcggcggcgggccggagggagggcgggcgcggccgggcugaggcucgccccggcgcgcggcccgggcggcucgguggucagggauccgggucggggggcgcgaccugugcgcgccgccccguuauucauugcuacgaacgggaaaaccgaggugucaccgucccaguggcgugucuucggccgacgcagcguuugggucgaguccagucguagcgucugucggucgcagcuuuuguucgggucacauuuccacggugugagugcuuucccaagcgcucaagcauuuuucaaauacaaaaugcuccucgucggaaaauucgucauguugaccuguuaggcaaugugauugauuugauugccuuaggggcuuugcacacaacugaagauuaggguuuacauucugucggaaucaguauuaggccugcgaaauggagccaggggcugacauccuggcuggagcagagucuaacuaaacugaagacgcguuuuaccaaaggucucgagacuuagugcuuaauguagaauucuagaauguucucucucucucucucucucuuuuuucuucuuuaaauuuuuucgagacaguccaaugucuggccucccaaguccugauccuccugccuccaucucccaaguugcugggauuccaaauguauugccaccaugucaugccagauauuuuuuuguuugaucugacaauuuuuuucuuuacgaaaaaccuguuaccaaagauaaugagagucaggguagacugcucaagccuagagaugccuuuggcagaagauaacauuuggaagguggaggaagguagagaaggacuuccaggcuagccuaggcuacaggagcccccauuucaaagcaagcaagcaagcaagcaagcaaaccaaagaggcaggggaggggagggagagggagagaaugagaccauuucuccgagugucuucugugguugagggugcaguuguaucuuauggaaaggucagagcaaauccgaugauugcagcaggcuauuugaucuuaugaaugcuggcagugaguuuguacuguuaauauaaguauggaagaaugaaaauuuuauaacuuguuucaguaacuuauacuaugccgauaguuuuguuauuucauuuacuuuggcaagaugagaaaaacuacacaaauauacaugggggcuauauuuaugauugcaugcuauuuuuuuuuuuuuuuuuugguuuuucgagacaggguuucucuguguagcccuggcuguccuggcacucacuuuguagaccaggcuggccuugaacccagaaauccgccugccucugccucccgagugcugggauuaaaggcgugugccaccacgcccggcuugcaugcuauuuuuugaucugcauugccaguuuucaguuacuuuccuuuuuaguucauguaguauaugaauaagcaaaucucuccacauaguugcagcaaguaggugauuugcuguuuucaggauccuuucacuuacaaaaucuuacuugauucuguuccuguccucugacgaaugccaaauagccuuuucccaagucagaguuucaagcuuguguaaggaucagccuuuccuucugaaacaauauugccaaaccagccuguacuagaaauuagaauucagguggauuaaggcugagccaggucguggugauaugcaccccuuuaauccuagcacuugggaggcagaggcggucuuaaccucuguacauuccaggccagccuggucuacagcgagaguugacagccauggcuacacacacaaacccugucucaaucagucaaucaagcaaccaaguggaauaaagauuauaaaauuaugagagacuuaaaugcagcguuuuaaaagcuugaguuuuuuuuuuuuuuuuuuuuuucuuuuucuuuuuuugagacaugcuggccuugaaauugcuugcggcucaggaugaccuugaaucccucuggacuugcaccaucuccugugcugggacuguagugcuuaccaaccugcuggugcaagagucugugcugcaagaaaaugacguaaaaugcucaaugaugucuaagaggggaaauguggauuauuugaaaaaauaaagagaugaggggauaguauugcccagaugggccuggaaccucacuuuuuccuauucuagccuccucgguggcugggcccacaguaccacaucugcuccagaucuguucccucaguauaggugcaguucuaaagcuguuaaaagucuacauugggguuucaggagcauguugguaguagaacaaagaauuugaggugaguacaguugguuuaucuuucuauaagaagauucacggggcuggagagauggcgcaguguuuaagagggcuuaccaagguccugaauuaaauuucuagcucaaguagguagcuugaacaccuuuaucugguuuccauggacacaagcaaacacacauacacauaaaauaauacaaauaaagcacccguagggcacaugaauuuugugcaguguggugucuguauguguaaugagaacucauauuuaagagacagugcauuuguguuacuucagagaguagguaggucaguaaccuguugaaggcaaggcucuccuaauaagaggaguggcccauagggcuguagcgaugugggagagcacuuaguaugcacaaggccccgacucugcuccccagaacuacggggugggaaccgaaugcaacauguuuucuaaaacucuacaguugaguagggucuuugcuguggguuagcccggggccugugcaugcuaggcaagcaccuguaacccccuagcugauucuuugcuuuuuauucugaaacuagccucacugugguaucuuuaccuccagagggcagagggcagagggcagagggcaggggcagagggcaggggcagagggcagagggcagagggcaggggcagagcagcagaucgugaacucacuuuguagccuugaauuuguuacuuuuuuuccuuuccuuuuuuuuuuuuuuuuuuucuuuuugguuauuuugauggagucucauaaaggcaaggcagaaacuugcuguguagcccaggcuagccuggaacuugcuguguagcccaggcuagccuggaacuugugauccuucucucuccacuucugaauagcugggauuauuggcuuggaccaccaguucuggcagauggagucuuuuugcuuguuuguuuuuaauagaaguacauauggugagaaccuuauggguauuauaaaauccuucaggccuaauucucuugagaaccuuauacuuauucuaggauauauacucuuguuuuuuuuuuuuuuuguuuguuuuuuuuuuuuuuuguuuuuugagacaagagucgcacuauguccuggucacuguagaccaggggucugccugccuggccucuggagguaaagguguguggugcugcucccugucuugcuucuuccuucuuuaguuccuguacuuaaaguacauuuaaacccucuccuaaaacacuccagaugugauucauaauaaauaaaugauaggaaggucuuuuggagguuuagcugacggagacaaucccccucccccuccuccuccucccauacagagugaauuccuagggaggugagacccugaggcuggaagauuaacuuggguagcuuuagguucgacugaauuuugacagcuuaaaccccuuuaaaugaacgugaauugauuguacaaacgcauuacuggaguccugugugauuucaguguguacauacugggacagcauccuuucugaggcuucucuguagugucucuugaacucagaccuugugguaacaauaugggugugggugcuauuccauaaacugugaggaagggaguauagccccuaaggagugagcaaccaagggcuuaaagcugcaaacuguagagaaaugucccuuagugcagcugggcaugguguuuucuacuuacccuguccuugcucacugugacugcuucagaaaugcucccuugugaggaacaggcaaguuccugacgugcuagggaacuuaggagagaagcaagguguugagguaccuggaagcuguacuacagcuaucacuaagauccgagguagguucaaaggguauuguggcucgguaucagugguguuagcccaugcucucauucaguaauccuggugugacagaacugagcugagaagugguaaaaagacacagcuuggcaguagaagggaaggagagggucgaagggcaaugaaguuaggaagccucugccacuggcuuccaaguuauuucaggagaaugaaggaacagcagaguaggucgggguggagaggugaugguugguacugucagucugcuuucagggcuuguagcaacccugaaguagugagccagugaggcugugguacucaugggagguaaacaagacuggaugguuacaauugguuaugaaaucccaaagaaggcacuuugaauagguuugguggaagcauuacucaaugacuuaaaaggcuuauuugcccauucauucauuuugagacaaggucucccugcguggucucagaguggccuugaacuaacagucuuuggcauccaccuccagggcagcgauuacagguguguacuaacacuccuggcaguguguauuccuucacgaucgcuaauguuaucuucaaugaacaaauagaaaggcucaaccauuuucuuuauaguggcugucacuggaauauggugguugcauuugcuuuucugucuguaccugucugaacaaguuguuuauuuguggugauauuggggaaggaaccuacagucucauggaugcugggaagacacaggaccacugggcugcacucucuagacuucauggcuguccuuuuuguuucugucuccaugugucacucuguaauccagacugcugucacaaugguggagcuuccuugucucucuaauggaauuacagccgugggcugggcugcuguguugcugcaguggcuguccuuguccuuggucuuguuugauguaagacuuaaggcucagauuacuugaggauuuuauuagaccucuggcaaauuuguuaacccuuucauguuuucucucccauaguuguuaugauuaguucaacuagauaaacuaaaacugaccaugacguuccacuuacugggcagauuuuuaagaaauuucuuuuuaagauuaucauaaauuauaucauuuucccuuucccuuuccucccaccaaaccuuccuauauagccuuccuugaucucuuaaauuuccugccucccccccccccucucucucucucucaagucaggguuucucuguguagcccuggcuguccuggaacucgcucuguagaccaggcuggccucgaacucacagauucaccagcuucugccucugcagagauugaaggcgagcacuaccauaccuggcuucaugagcagguuuuucauuaauuguuuuuacaugcaugcaugcauacauacauauuccuaaauagaaccugccgaaugggaauggauauaguguuaccccuacguauguuuccagagcucaccaucugguauugaacagccaguugaccagcuuuucucuggggaagauuauuucucagguucucagcauuucuuaguugcccggaguucuuuuugcaguuuugaggccuugugggcuuucuccagucuacucuaggauaucuauaguugcuguccuuacucagcucauguuugggcaguugugcuggugagacauuacggggacagcuucugguguuacuaggagaaacaaucucaacuguaaaccuugaucuccuggcucggccacuccucccuccucuucugcagugcucucugaaccuuaggugcugcagguguuuguccacuggggccuggauucacagcucugcauucgauuggcuguaguuuucuguaauggucucuauugcagagagacguuuccuugaugaggggugaggacuacauuuuaucuguggguguaaggaaagcuaucuacaucauaguuaggaauuaggcuguuuuaguaacgugaugguuguagguucagacuucaguagguugagguagaugguggagcauuaccaucuguaauuggguccgaugaccucuucugaugugucugaaaacggcaacaauuuacucacauacauaaaauaaauaaaucuuuaaaaaagaaaaagaaaagauggucaagaauuugccucuggggcuaugcauggugauguauguaugccuuaaacccagcuccuggcaggcagagagaccuuuggauaucugaguacagggccaaucuuaucuacauagugaguuccagaccagcaaagacagcauagugagauccugucucuaaaaccaaaaccuaaacaaaacuaucaguggcaaaaaggauuugucuuugaaaacaguagcauagcagaugguuuuaaguuaagaaugccucauccugagggaagcccucugcuucaccacuggagaugcugcuccgugcaucucacaugaagcacagaaucuauacgcgcacuauuauccaauaggguauacauaggaagcaauagguuagcaacaucauuuggccaaguagaauauguugccccaacauaaugaucguucuauccacgaguucagcucuucgugucccgagaggugcuggauaaagcucaucaagacagcuuuaaaccaucuaaugcccuggagaggucacucaggguuaccugccuuuucugcccuuccagaggacggagguucaggucccaguggugcaguggaguauaacugcagcucuaugagaacugacacccauggaggccuccaucagcaccugcacacacugguauacauuuacacaauacacauuaaaaauagaauaggccuaguuagaauggagggaacgacagcauguaaaugccugaaguuuguccagcaggggcuugaggagugaagagcuaggacugcggaaugagagaaggucugugcucagcugugcaucuggagauuagugcuagagcguauaaagagcccagcauuaaacacuuuccagucauccaauaaacuacgggcaaaugaacaggcaguucucaacaggagaacuacagauggccaauaaauauuugaaggaaauauucaacaugaacaugcugagcuaccagggagaugacacuuaaaacugccuuuagauugcuaacagucagagugccugucaucaacaacacagggaaccauugcugggaagaauguggagagagggacacugccaguggggauguaaacuggcguagccacuggggcaauggguauggacgcucuucagccgucugucagacagagugugcagcugcugcacucgcgggucugcaccuaagggagucuaagucaugcagggacuugcucucugugauuccugcuguccuacucacagaugucaguauggaaccacccuccaugcccaucaacaaauaaagaaaauguggcguauauaugcaaugggguuuuguucaucuguaaaaaaagaugagauuaugucauuuguagaaaauggauggaacuagagaucauguuaaauauaauaagccagauucagaaaggcaaauaccacauuuucugucauauguagguuuuauauaaaacuugaaauggguuuuaguuaaagccacauuuaccaagguccuucauuugguagauggucuguuauaugcuuacacugggaagauaaaagaagcuaagaggauuugaaacuguggagguugaaagugcaggagaaggcugagcuggcccuguccucuuccucaguuuccuguuugugugugcuacacgugcuuuuaaacaauucuuuguuuuuaaaaaaucuuuuguguggagagaaaauuguuuuguggugcaaaagaggucuucccuuacuuguuagugcguagacauuguuacagccccuuuggaaaagaaucuugcaaaauggauuuaagaggcagcucuugcaggcuggguaccugcucccugcuagagcucuggguuucagucucucuacacacaaagcaacaaaacucaggccuuauaaaguuauauuuacaaggguucuuuuguaucuguguguguacauguguguacauguguacauguggugaucagcguuggagggugagugucuucugcuuuauguauuuguuuuguaaagauugagcuggcuggggggggcacacuggcuggaggggggcacacuggagacagaggcagaagaaucucuguguucaaggccagccuggcuuacauagcggguuccagcccagccaaaacugcauaaugaaaccuugucccaaaacacaaacaaaaaauugauuuauuuuuguuuuaugauuaugaaugcauguauauauguguaucauauguauuccugguucauggagugaccagagggaugcauaggauucccugaaaaaugcguuaauuggcagaugcugggaacugaacuugggccuucuggaagagcaggcaguguucuuaaauguugagccgucucuccagugcucccugaccccucauugguuaucuuccccuuccccuucuuccccuuccccuucuuccccuuccccuuccccuucuuccccuucuuccccuucuuccccuuccccuucuuccccuucuuccccuucuuucccuucuuccccuuccccuucuucucuccccuuccccuuccccuuccccuuccccuucuucccuccccuuccccuuccccucccuuuuuugaagacuucccuuugagaucucagaggcaauaccaaauaccuucguauuuacuuaguauggggaagauuguuaugccucauugcugaggcgcugccagcugagugcuuugucaucucuguuuaucagucuuugagcugugguugguggcagcacacagccaugacaggcuuugaggaugagugauguuuccuuccuccagccucugggucuugcuuguucuugucaugucccagcugugcacucauuggagcugggagugaguauguaguuaccguuccugccacuuuccagagauugguuacugucucguucucucuucugggagaccguaccuugggagcuuuaaccacccugagcuuccugucuaacucaccuuucugcucugaggccuacagucucuccaggcucagcugggccagucacagugcuuuauccauuuuaauuuuguuggagucacuguucuguucuguaaugcaaaagaccauugcuuuguauguuuuguuuguuuacauuuugaguuacuuaaggugaaaggguaauugaacccagcucuucccucuugacuggcaguacauguacuuggguacaaaaaggagaggagagaugagaaaagggugaaaaagauugccagacauuuucuuaaaaacaugaauaagaacauuaacaaguguuuaaauugaacuucuacagugucauuuaguuacuauuuuucaaauguuaaaaauuacuauuauuauucaaaucugcauauuuguauguguaugugaguauaggcaacauguacccacaguggaugugugcaagucuccuuuuccuccucauugagacagguucucucugguuggcaagacgcuacugcugcagacagcagauaaaauugaacuguagaacagggagguguaaagcuaguacucaccuggaugcuuuguccuuacugguuuccucuguagguuucugugugugcuggugaaggagaaacagucgccacucuuacccagcugugaacugugcaagcgaccuuaacagcuguccuggcaggacaugcccacuggugaagcugcagugugugcgcauaccaaccacuuucugacuacuugauuuaaggauugucccacaagauaaacucauauuugguaccauugccgggacaaauaaccucuugcuagauaggucauagacugggagggagaaccugccaucugcuaaaggacauagucuuaaacugacucguaauaacuaaaguguuacacccauagauugauauaccucuuuuuuuguuuguuugguugguugguuuugagauaaagauucuuuguguagcccuggugguccuguaauucacucugcagaccaggugggccuugaauucauagaguucugcuccugagugcugggauuaaaggguguguccccaccaccaggcugaugaugggucucuuaauccucaucagagaagcuuucauuucuaggauacccacacuguuaaagggauggagaauacgggagugcagagugcucugcccacaucgggugucuguaucacacccuccucccaaggcucuggggacacguggacuaggcaguggugcgugaccgaaaggaaagcccuggagagcagagcaguggugaugacaccaugcacagaagcuucagcacauccggcuuaggccggaccagaccccagcacagagggggaggugagcaagaagucugcuccgggcccaggcgcuacugcacuugauaguugcuaguggaggcugagucaaguuacguuuuugagcguagucccagguuaaccauucuccaguggaaggucacacauccaagaauauauaggcaacacaauugcauuugauugguauuaaaauaaaagacacaaauuuugguggguaggaaaggagagguggauuuggggaagaguugaggaagggagaaaauaaugaucaaagaugugugaaauucucaaagaacuauuaagucagguguguggaacacacuuuuaaucccagcacuuggaaggcaaaggcagguggaucuugaugaguuugaagcccaucugaucuacauaaugagucccaggacagccagagcucccuggugagacccugucucaaaaaacaggcaaacaaaacaagccugugauguugugcaucgucauuuccagcacuugggaggcagagaccagagggucuuuuaugaguuuaggccagucuggucuacucagugacuuccagggcagccaaacuacacagugaaacuuugucucaaaucaaucuacccaucgaucagucagucaugaaaauuuauuuauuccaccggcugcaggugugucugaacauuuuuggcagggagagcauguauauuccuuauuuuaucuuuucuuuagccaguuuuagcuuguuaagauuuuguaauuaaguuuugggucaccuuuucuguagguuuugccugauuugaaaagccuugagaaagagaaggaaaacuguaagaaaaugacgacuuuucgaaaucauuguccacauuuggauucaguuggugaaauaacgaaagaggacuugauacagaaaucucucguaaguucuauaguagucaccccugaaauugcugcgcucacuuuccucuuaaauacacaucuaagucaauuaguagggcacucugugucauguguaaaaauguauguuguuacagggaauugugugugucugacacacugacacagcaaaugucucuuguguuuauuuucccagggcgcuugucaggacuguaaagucagaggaccaaaccugugggcgugccuggagguauauguguggggggugugugugugugucuguguguuuuccugaaaguuuucaguugaaaauuuaauuuuauacauauuaauaacaauuuuugauguauaaaauaauuuuacaugaguauacuuuuaaagcauacuaacuaaaaacugaaaguucaaacuuuggauggauuuuaauggaaguaugcuuagagcuuuuaguaaaccacucagguaugucugcauuuaucuucuauuggaggugagauaacauucaguuugaaauacuuaaucuggucuuugugcuuaauaccuuuuaauuauguuaucugacuauacaaaguaauucaauaauugaauuagaacauaaaaucaaaacuugagugucaauacucucuaguacugauuguaaacagagugccuaugauaaaguccuccaucuugcauacuucuuauagaauaggugcuccuauguuggcugcggggagucgcaaguggaccacagcaccauacacucgcagguagguguggaauuauugcauacauggcagugcuuggugcuggggacugggucccgggccaugugugugccacgcaugcauugugucacugaggacuuguaggacaagagaaucaguguagcauuaauucaggcugugucuggagugggugagggguuugugaucuggucuggcuguguagccuggccuagaaucuggguuccuccucccugugucucuuacauguuacuguacagauauguggcaccacaccaagcuagaauuuuugccuuuuagaaaauauauaagauaauacuucgcuuauucucagcgaaagguagggagggaacugcuaagaaaaucuguauugauacaugauuauaacugaguauugauaaaggaagucugaauacauguguguggagauuaucgguguaguaucagguuauggagguugaaguuaguguagaugcauagauuuuuguuuuuaaauuuuaguuaaaagauuguuuuuuaaguuagugugggaagcguguguguagcacagcaugcccguguggaggugaguggacgacucuggggagcugguucugggcuuccaccgugggcuguaggucugaacucagguugucaggcugugccaagugcuuuuuccugcugagccaucuugcuggcccaguguggcugccuggcugacuuccguguguuccaacucuuaauccucuccuggcuguucacaucacugacuggagugcagauguccaucacuccacggugugguccuucccucccccgugacugaugugaaccuugaaaaguguuuuguagaccuuucauguuucucagauggaugguguuuuaagguacccagugauagucuguagcauccagucccagccagguuuccucaggagaauguagccuaaaucucugaagcccuaaggcagcacuguacacaguucuucccuguacaucugaagaggugcuuucuaugggcauccuucagaaaacugagcagcuagucagcauguguauucuguagggcucagcccugugcagaaggcuaucaaucuauaugagagcuuauuuauuuauuuaucuauuuauuuuuacuguugcuugaguuguauuuugcuucaguuuaaauaaugcauauucuuuugcaguucuguuuuccugcaguuaaauacccugaaaaagucuccuguggugcagacugggcuuggcuuuucuauguagcagaggcugaucuugaaugcaugauccuugggccugcuaggguugcagggaugccaucguccugacuguugucuuguauucuuguccucaaacugcagagcugaggagccuuacacugcuacagcuaucauuguccugugaaugaggggacagacagugggguaacugguagacucgguguugguacuauccaagguuuuauaguugcucuagagaacuuuuugauguguucaugugugccccacaguagcucuucugaguacauuauuuuuugucaaaggcugcaguucaugaugagggccucugcagaaauguuuucaagacuaucuaauggcggcucccuuuuccuccugugaaacucuguaggagacaaagcauuaucuaacugugaaccucaccacucuucgaguaugguguuaugcuugcagcaaagaaguauuuuuggauagaaaauuaggaacuccuccuucauuaccucauguaagacagccucaacaaacacaagaaaacaguguccagguaauaucauuuaggucauaaauguucagaagauaauuucagaguuuguuaugugguugggaauacaaguacccuaccuuuccuguacuuuagaaagcuuaucugugugcucaggugcagcacucagucuugcuuuguucuugcauagcacagaaugaaugggaggccagugugggauucaaggugaaaaacaccuguaucguguauaagcuuuuuagggaacuguuggaagggacaugucauaccacguacagagauuuuuguuaauaacccuugucuucuuggugaaacauuaucuaccccugcagaguaccuacauucaaguuccuuaaaaaaaaagauauuauaaacauuaguucauaacguaggaaguuucuguagguuuuuuguaaacacucuuucuguaaaucuaagucuaggaagguggugggacuucuauggccugugcaaauauagccccuuuccuguucccucuccucagcgcccugucaaccccgagaaccuggacacccuacaacuuagcaucaguguuaaccuagcccugugcucaggagacuuaaacccucgugcagagauggcugaugcucguuuauagaagccuuaggucguguggacgugugugaagcaguaacucauacagagaagcugggcugucuguggaugagcauaucucucacauccuuuguugcuguaggaguuagagacugggaaagaucaggcaugguacuaaguuagauaaaguuaguucuugggcuuaaaugcagaaaugucacuuuuggggggaaauuuuuucauuauuuuuagaaaguguuuuggggacuggaaaggcgacugagguuaagaguacacacugcucuugcagaggaccugaguuugguucccagcacccacacugggugagcgagcaccaccucuggcuccagcuccgagaccugcugccucggccuucugcagccgugcacacauguaucuuuacauagauccacauagccaaaacuaccaaaaccuaaauguaaacuuuauaauaauugccaauggcacacauucuuuauguguaagugcaggcgccuuaggaacccagggagccuucagaccccuaugcgccgggguggcagcagcugagaaagaacaaccugauguaggugcuggaguagaauucggguccccgcaugcucucggcacuaagccagcguccuagcccugcuguuacgguuguuuucugagcagaguuucauguagcucaggcugcccucuaaccuuuuaccaaccaggacuggacuugagcugaucuuuuugccugagugcugggguuacaaacacgugccacuaugcuggccaguuucuguuguuacgguaauaucuuucaauauucaauaugugguguaaauguuauguaaguuaaaauuaaaguguguuuugauagcauaaggauuuauucgaguuuguuuucuuuuuauuauuaaggauuuuaaaauucccaguaauccagcauugaaaacccccaugguugcugugucugaagaucuggauauagaaguggaagaggaagacgagcugaaggcuagaggugggcucuucugucagugcuccucucugcggcccugcccauuugacuaggaagcugcauaaugaguaguucaaaacagaugagagaugauaauuaaggacagagcccacagacgugaucuuguagaccagcguuugcaguaauugcaaacuugauuugucuggugucacuuugucacagcuggacucucccuugucuucugggagccuuuagccguugaccuauuuuuggguucucaccugccagggaaggguugcuagggugaugugaagucgguaccuuggcagacugcacgucuuacccagcgcugaggaggcugaggucagagguuagcuuacacugcucuuauuuuaccugcaucuauaaaaagaaacgaaaagaaaggaagacaagaguaagggggcggcauuauuuggaaaaggagccaggcgguuccagggcuccucuugaccuagucacucagaacuuugaacuuccacacuaggaggcagugggacaggauuuccugguuuuuuuuuuuuuuuuuuuuuuuuuugguugguuuuucgagacaggguuucucuguagcccuggcuguccuggaacucacucuguagaccaggcuggccuugaacucagaaaucugccugccucugccuccugagugcugggauuaaaggcgugugcuaccacgcccagcugguuuuccuguucucaaggcucacaguacuuaauguaaacucugaauguuccgcuaguuguugggacacaggaccugugugcauauuagacaagcacccuucuacugagcugcaguaggguuuuuuuaaguuuauuuuuuagguuuuuuuguuguuguuuuucuuugaaacagaauuucucuauuacauacuuauagcugucuuggaacuugcuguguagaccagacugacuuuaagcucacagagaucuacuugccucugcuuccccagugaugggauuaaaagcgugcgccaaggggcuggagaggcggcucagcggguaagagcaccaacugcccuucccuguccugagaucaauucccagcaagcacaugguggcucaccaccaucuguaaugggaucugaugcccucuuauggugugucugaagaaaauuacaguguauuuauauacauuaaguaaaaauaaauacauaaauaaaucuuuaaaaaagugugcaccaccacaccuugcuuauaauucuaguuuugagauauuugucauuguuucuauuuuguuguguugggaguugucagucucuguuuucucucuuaaugauagagcaaacugagaaaaauagagugccaaccaacagacgagguaaaugcagccuguggaaggcacugugcuccaugcccaucacagacgucaggcugacuucccacuugggcuuugggccaaaugagaacuguaaucuuaagucagauuauuuaaaauauauucuuaaacugguugugucucacuuuuaauccaguacucgggaggcagaggcaggcggaucucugugagcucaaggucagcuggucuacagauugaguuccaggacguuagugcuacauaaugagacccuagucauugugaccaccccauguauucuuucuuacauaacaguagaaaagguuguuuuuuaagugcagauuuuuagguuaaauuaacaaacccuugaauuuaucuaaagcuuaaaaauuuagagagugagaaauuuccaacaguguggccacugaguuguucaggcgcugcccugugucuccaugugucuguguuuuuaauguuguuccuguacugugccagugaauguguguauguuugcccacuaggcauugaauucugggcucuaugcacaguaugcauaugcucugcuagugaacuaucagcccauucuauagcuuuaacuuuugaaauuguucuuaauaaacaccaaacaaauugagucauucauguuuugcugaauggugacuuaauauuucuuuuucacaggccugacagguuugaaaaacauuggaaauacuuguuauaugaacgcggcgcugcaggcucuuucuaacugguaaguagugagaccaauacggguuuucuuucuuuucuucuccccacccucucucucucucuggcuguccuagaacuugcuuuguagaccauauuggucuugaacucagagauccgacuggcuaugccucccaaguacaggaacuaaacauauaccccacuccacucaggucgugcauagguuuagcuuagauagcuuguugcuaugguaggugacuaacucccagagcagagaagcaagaaccugggugaagacaucugcugucccagugggacugcuguguaugcgucuaaguuuauuauugauuuuucucuugacaauguuuuacuuucaccaggcuggccuggaacuauguagcugaggauggccuugaaaaucugacccuucuguuaccucauuucaaguuagaacaauaagcaccuauaacaugcccaguuuucuauaaacaugccuguaguucucuaagacugaggguccuggcuuaggcuucuaguaguauauccuugggcaaaguauuuguuuuuggguuuugcagugcugggccucaaacuuaggcccuuaagcacacugcucuacugaacaauauaauaucucuagcaagucuauuuauguacagaaaacaaagaaauuaaauuuaucaacuuauaagaucauuuuuaggugggaaauuguaugaaaguauauuucuacugguagaaucccuugaauagaacauuuauuaccucccccccaccccgcauauaaauagggugauuauuacuuugucagagcaugacuugaguuuguaagcagcuuuggaaagaguuuugacacuuggaaccuggaagaaaaucuguguggcagacauaguaauuguagaguaauugcauagggccaugucaguugacguuaaaacugaggccucuggugugguaagaaaccaccgaaguccuuuuacagcaggggagugaagccaucucaucugccuugcaacccagguugcuguguggacagugguuguaggaaaaaguguaauuuggaaacagaagaugcauaauaaucuaaauaagaaauaauagugccugcacuaucuuagaauagaugaauuggagaaagacaguuuuuacaauagaugguugcuaggauaugguuagaguaccgggaaagggaggauauuugaaguuuaauaauagaaucauuugaugaaggaacuauuuggaagggcagcaaggucuuuucauugcugagucuuacugucuuauugucucugucuuuuucaaauacauacauaauguuggugacaagaauguagauuauuggaagaucagggucacuugaaaguaaaauuuugagcauuagauuaaaauaucaagagagcagucaguuugagcauuugauaggaauucaguugauacaggugguugaaggcgaacaagaauguggccaucccugguauauuuguggggauuuaagaaacccaagaaagaguguauuuagaagagaggucagagaaucagaguccuggggaaccucugaacagaaagaacaguaaggagggagacaggcugcgugagaaggcagagaagcagugcacauacagugccugaaguacauacagugccagagcagugcacauacagugccugagcuuugucuaggagcucuguacuucuguaagcagggcgagcgaggcugaggcagaauggccucagaugcauagcagucccuccuacccgccugcccuuuccuucucucuuuacccugacuuaauccuucucugucuuuucuauaccuccuucuuugcuuguuuacuucagauaggucucucuguguaucccaggcuagccuugaacucagguuguuccuccuggcccugucugcuaaguacugaaauuacagguaugugccgcccugcacaauugcaagacucuauuaaaaaaaaaauuagauauugggucaagguucaagccucugaucucagcacucagaaucaggggaacccugauuugguggguccaaaaaugauuuguuaaacuuauuagugauagaaaggagugacugucagaucguaaaggggcaaagaccuaacggagagguugacgugugcugucaaucauugugcaacuggaaagcaaugagaauucagccuugaucccacucugacauugcucucuuuuuuuaaauuagcccaccuuugacacaguucuuucuugauuguggaggacuggcuagaacagauaagaaaccagcaauuuguaaaaguuaucucaaacuaaugaccgaguuguggcacaagagcagguauguacuuaauauaguuguguuuaaaaauacauauuaugaguauggaaagaaaguagaacuguuuagagggugaaacaaauguggaaaggguauuugcguuaggucacugcacugcaaugcagaugcgggggcugaggccauugccagugucagcuggcugcauggagacugcggacgccuguuccugagaugcagugagcagagccuucccagacuaggagaggaggccuaccagcugccugggcccuguggcuuaguggagugguaauuauuugcauauuagguuaguuuugcuuuaaaacuguuuaugaaguuacauuuaaaaaaaauauuaugcagcaugagaguaauaaaauucuuuaaaaaauuaaaacuacaaaaauaucuguuuaaaacuguuucuuuuucaggccaggaucuguugugccggcuaaucuguuccaaggaauuaaaacuguaaauccaacuuuucgagguuauucucagcaggucaguuauuccuauaaacuuuaaauuuuuuguuuuuuguuuuuuguuuuuuuuuuugguuuuucaagacaggguuucucuauagcccuggcuguccuggaacucacucuguagaccaggcuggccucgaacucagaaaucugccugucccugccucccgagugcugggauuaaaggugugcgccaccacgcccggcucuuaaaauuuuaaaaacauuauuuuauuuguauaaguguguuugccuguguuuacgucugugccccaugugugccuggugccuguugaggccagaagaaggcaucagauuuccuggaacuggaguuacccacgaccgggagccauaccaucuaggugcuggaaacugacccugaccaucuguacuaacaagugcucuuaacugccgagcuuccucuucagucuccacuguaguaaucuuuaaaaaguagaaaauguuauuacacuuuuuauuucccaauuucccucuuugaucauugcuccuuugugucuuugguguuuggguuuuugagaccgggucucuuguagcccuggccucucugugguuuaggacagccuuaaguuuccgacccuucuuguuuugccucucaugugcugggaccacagagguguccccaccacacccggcuguuuaguuuugcguuucuguggauccagugagugagugcaguguuuguuggaugccaggcaaguguccucccacgcacugcaccgucuaauuucucugugcuuucucagugacauggggcagcuucagucauuuuaguuuucuguaauaccuugacaauuuauagcugguccucacaacauuucucuuuucucaaaccauuacuuauuuccuauuaacuuuuuccauauaaaguucuggaucucuagacauuauaauuugagcuguacguuggagcucugaaauuugcauuuuuaauucuuuuauuaagcauuauuugugugugaggaggggcaguauacacaugccacaccacauguguaaaggucagagaaugacuuugugaaguggguucaagagauugaagauugaauucagguggucagacuugcaugguaaucacuuuuacugagccaucuuugcagcucaggaauuauauuaucaaauaaguucuugugggucuaucaacaacuuuucuuugagauacaguucauggaugggaaaagcucuaacuuaaauccaaguuccauaauaacuuauuuuuuaggacauauuucuaaacugauuaucacuugaggaaaauccuuauuuucuguuccaucuaguuucguuacaaagcauggggcuguguaccuauuuagugugguaccauacacagcugauucauuccugccucuuagguucccucgggcauuugcuguacacugguaaugugguuuuguuggugugcuaggaugcccaggaauuccuucgcugucuaauggaccugcuucaugaggagcugaaggagcaggucauggaaauggaggaagagccucaaacacuaacuucugaggagacgguggaggaagagaagagccagucagauguggauuuucagucgugcgagucuuguagcagcagcgagaaagcagaaaaugagaguggcuccaaaggcuuuccugaggacagcaaugagaccaccaugcucauccaggacgaggaugaccuggagauggccaaagacuggcagaaagagaaggugugcaauaagaucaacaaggcaaaugccgauguagaacuggacaaagacagggacacagugugugaaacaguugaccuaaacagccaggagaccgucaaagugcagauacacggcagagccucagguaacgauuaguaaucggacugugcaaugcuagagugucgugugcagacuuaacggucacuuuuggaacaacucauccacuuauuguuuguuuacauacuuauuuguuuacuuacuuacuaggcuggccuggaacgugcuauguagaccaggcuaucaaacacaucugccugccucugccucucgaaugcugggauuaaaggugugcgcuacuauaucuggcuuuggggacuuuucauuaauagacuugcaguuuaaugcuauccucuugaaauguuaagugaaaaucauaaaauuaugaaacuauuaguaagauaauuuuguagcucauuucuuaggaauucauuuuuuucuauuauuuauauauuuauuuaauuuugguauggaagagcgcaucaggauuccuuuaugguuacaucauagucuauaaaauuagucucuuuggaauuuuccauuuuauuucaagcaaauucuguugagauccugagaaaaccacaacucccgacuuucucucaugcagguuauuccugcagugguuugcacuguacacauagcuaauguguaccugaaccucguuaaggugcauuauauuggacaguauuccuuuugagaaggaaaauaccaaaaugaaagacaugaguuggauuguuuuauauaccauauuuaucacuuuagggguuaacguaccuugaugacuacucugaauucucuaaaauuagaugauuagaaagucaucuaauuuacugugacucaguggccaggaaaugacaggacuguugaagagaacacuggcacuugaagugucugagugcaucccaguucugcccugaacaguacuuccuugccuuaggaagacuggaggcugccuugcagacugccucauggcugcccaggacacaaagccaggggugcucaggcucuguccacucuggauagaagaucuugagccagcgccugccugaccgucaguucugaugguagacuuccuugucagaggccgagggaagcuugacgcagggacaaacugggccuugaucacuugcuugugggguuuguucuuaacauacgguacuagauagugaagugaaauuaaucugcuuuaaagcuuggguaaaaacuaugacuaagaccauguaguugacaagaucuaaaccccuugcuguccccuccaggaaggguuagccagccuccggagccuuagugucccuccaggaaggguuagccagccuccggagccuuagugucccuccaggaaggguuagccagccuccggagccuuagcgucccuccaggaaggguuagccagccuccggagccuuagcgucccuccaggaaggguuagccagccuccggagccuuagcugcuccuuuggaaaguuagugaagcucucagcgccaagucuuugcuggucauuagucaugcuugagaguuuuuuccuguuuguuugaauuaaguugguauuuauuauuugugugugaguguuguggcuucaugcauguauaugcauugcauuuguaucuggaaucucuauguuaauuaacauuaaugaguauggggacuauaacuacuuaguaguuucauuuauaauuuuaauugaagguaacaguaaacauuuaaauuuuacagaaucuaucacugauguccaucugaaugaccuagcuacgucacagauccuuccuucaaaugaaaguguuaguccacgguuaucagcaagcccuccuaagcuaggcagucuguggccaggacugucgccuccacacaagaaagguaaacggucccguaacucggguccucagcuccuaaggguggaacugguuugagcugcugauguugaugcugauagagagguaggggauguguguucucguacaguugacagaacuauacaaccaugauuagguuuuuuuuuuuuuuuuugucugugguucuguauuuaagguuuagguuuuuuuaauaguuuaaaauacuauuuuugcauaugaguaucuggccugcauguauguauguaugugcaucacguguuccuggggcacacagagguuaaaagaggacaugagaucaccuggaacugaaacaugauuaugaaucauuaucuagcuaccgggaacaaaaccugcauauauaccuaacugcugagccuucccagccuucugaauucauccuuugaaaguugugugcccuuuagcccacucuguccuacaguuccaucauuagacugucacuacccuucaggccugccacacugauacucuguuccuaaugugcccuaaggccugcuacuccugaugguuucccuguccccagggugccauguaaaugaugccacacaguacacacgcuaagaagcagaccuuuuucguguugcauaauggaguuaagaauuggcugcauuguuguauguccgcuuacuuuguuucuuuuccuuaccaaguuguauuucauuugugucaccaaaccacuguuuauucauucaucaaaggauuuuuuaaauuguuuccaguuuuuggcaguuauaaauaauacugcuacaaacauauauguacaguuuuuauaugauguuacguuuuucuuugaucagaggucaggucuuagaauuguauuuccuggguuuuuaagauaauuuauuuaucuuuaaucucaugugcauuauugcuuugccuaaauguccgucugucugucugucugucuguucggggcuggaacugaaagaguuacagacaguugugaacagccauguggaugcugggaauugaaccuagguccucuggaagagcagccagugcucuuaaccauuguggcaucucuccagccccuauuucuuagguuuuauguucauuucaugcucaacacuguacaaaacugccugucuuccagaaugucuguaucauucugcauuaccaccagcuuuguaucaaaauguuagcauuauaaaauauuaaacuguaaaacgucgagaggaccccaugugguagugcaugccuuuaaucccaguacucacaggaagguugaucuguguggagcucaguccaaggacaguauggucuaaauaggggauuaagggccaauuagaauugcauaaugagaaccugucucaaaccugaacaaggaaacagcuggaggccuuaaagguuuucuuacaguagauaauacuugcuguauacagacaugaaacaugggcagagaggugggucagaggauagcagugcuugcuggauaagcuggacagcgcagguuugaucccaagaauccacaaccaaaauaaaaggaaagaacuaacuaacuucaccauguuguccucugaccucuguacuucauauacauucacucccauacacaaaaccaagacaucaucuguaaaagaagcagugagucuuggcaaagggcuuuauuaagauuuaaggaaagauuagauuguaucuguagguggacaaaccagaggcguguauacagcacaccucacucacagcaagugcaguuggaauguuguuccaaaggacagugugcagcaggacccugcucugcccuuaggcuuuaccuuccucucccagcuccauccucuuccuuugucuugugggucauaaauaucccagugauggggccaacuccuccuuuugcacauagaacaaaugacgagagcauugugcuguuucuguuguuauuaauuaauuucagauuguuuuuauauuccccuaugcacauuuuaugugaccaaaaaucacaaguaaucuaaagccagcugaagccuuacuugguuuuugauuggcuucucuguuuaaugauuuuuuuucuugguuuugguuuucugagacaaguuucucuguauacccuuggcuguccuggaacucacuaggcagaccuugaacucagaacuccaccuuugucugccuugaaagugcuaggauucaggcauucaccaccacccggcaccaaucuuuuucuuuaagauuuuuuuuuuuuacuuuuauucacguauaagcguguuucugugugcaugugcugcguguguuugggugucuaugaagccaggagaagauguaggaucccuuggugagaugccuuguguagacguuagggaccaaaacccgguucucugaagaacagcaaaugagccaucuuuagagcccuaaagugauaaucuugagugguauuugaauuccuuuaugguacaguaauuauuuuuuauguuuauugacuuaugcgugugggugugggugcacaugccacagcauacuuguagaggucaggagagaacuuguuggcuuucuuccuccauucugugggucuugggaaucaaacacaagucugagguuggacaggaagugcuucugucugcugaacauacuguaggcugaguauagcauggcucaguggguaagagaguguacagaguucagugcuuggcguuuauaucagguaacuuuaaacugcuccuaacucuagcuucagggaauccaauacccucuucugcuuuccaugggcacacagauguacaugcaacagacacauacuuagacacuguaauagauaaguacaguuaaaaaggaaauauucuagggaaagccagcauggaaguguucuucuagcccaguaucauacgagauggaaggaagaggaccaggaauucagucagucucagagccauccugaacuacaugagccucagacaacaaaaucccaaaacaauuaaaaaaggaacuaacuugauucuuuggaauguucugucucucaauccuagcucagucuacaucugcaaagaggaaaaagcagcauaagaaauacagaagugucaucuccgacauauucgauggaacagucauuagcucgguacagugucugacgugcgauagggugaguauggggugccacagcacaggacgcuucugucagauguuauuuuuaaaaaccuggagauaggaagaauuaaauagcuuauugcuauuguggaccacgcaugcauuucuugugugucaguuauacaucaaguuuccauguagaguaaaagugccacccacauccuuugugaaggaccaugggcucuuugucuguuuugguuacauguaaagaugagaaguugcuuggcaacaagaaauuguuaacagugcuuauucucccaaggcugaugaaauuagguaugcccagaaacucuugugaucacaagcaaaaggcagauaguguuuucuucuauuugccucugcagguagcuuguaaaugauagaugcuccaauaauaaugccaaauucauaaauaaggucuuaucucaaaacauaaauuaucaugaggauuugacuaacacccaauccuucaggauuucuuaauuuuuuuugagaacuaaugucucagaaaugagagagaucaacuuucaauuauuguauuauaauguuaagucaaauguuaaggacaguuaaggacugcaugugucugucauguaggauucuguuagugaggguauugucaucaucuuaguguggcguuuacuccaugguugcugaaacagaguauuucccaugaugcaucccuguugugaagugcugguugaugucagauuugguuuucucuucaccccucuuaaacagccugcacuuucauguacuuuacuuuggaggcuaaggggagagaaugccuugagaacagcuuggaugauauagcauauaauaagguccagucccugccagcaccccccaaaaagagugugaaugucagucucuggggccaggagcuggauccguugugcugcuuaccacuguaacaucucugagcugcaggaguacuaaugguuuguaggaagauuauauuugaaauaguaccugguacaaagugaacgaggcucauuucuauuuguaguauucuaaaaccuguucguuguuuauauuugcuuauuauaauaauuugcuuucaucuuuggaagaaaucuaacccuguaaauaacuguacuggauucuuuccauccuguuaaaaccaaacaccugcaggugucuauaacccucgagaccuuucaggaucuguccuugccgauuccuggcaaggaggaccuggcuaagcugcacuccuccagucacccaacuauagucaaagcagggucauguggugaagcguacgccccgcagggguggauagcuuucuucauggaguaugugaagaggugcguguuuacuuucucugcuugguuucauugauguugaugcugcugcuucugcuguacuagcagaacacugccuuuuucuucugucaaugauguuucagguuuguugucucaugugucccuagcugguuuugggguccaguaguuaccuugcaagauugucuugcugccuucuucgccagagaugaacuuaaagguaaggagcuuugcuggcuuuuguaggugggucuggcgcuccauguuuggucagugagacagugcugugugauacgucacgguggaggcaucuucaguggcagcugaaauagcauuaggaaaguccugcccugaagggauuuauacagauuucuguaauacaaaaugacacaccgugaaguucugugauucugaggacguagaacucaaggaagauaaggaauguaaaauguguccugaauugucuuuacaucugcaccaucauuaaagguccugugcagauguucuuggcuacuuuguggguucuuuuuuauucuaccauuuuuuauccuuucaagccccuaacacuagagaagagagacaagaguagagaggaaagagaccccugaauaaggucagggccacaaaggggccauguuguuguuagacuacuuccugcuauuuagggguguuacuugggacagcugugaucuuuggagucaggacaucuaauuucuuuuuucuuguuucuuuuuugugcauggccaacaguaaugaacaaccaaacaacaaccuaccaauguaacucccaccucuaggggccuagcauuaaauacccucugaaaagucuccagaauuccaaacguuacccacuugcagaaacaucugcagcuggcaaaaucaugcccccuccagagcaugaggcaaauuauagucaacugcuauggacaaucugaaacagccccaugccccacaccugggauuaacaugaaaacauauuuuuguuuuuguuuuuguuuuuuguuuuuuuuuuuuuuguuuuuguuuuuggagacaggguuucucuguauaguccuggcuguccuggaacucacucuguagaccaggcuggccuggaacucagaaagcugccugccucugccucccgagugcugggauuaaaggcgugcgccaccacacccggcugaaaacauauuuuuauaauaucuauuuuuuuaaaaggaaaucacaguuccaaaauugacacuagagucauccacuuuucucaugugcccacaccaugcuuggcauguggcagguauaguaaauucuguucagggaauaaauggagagacuuguuuuuaaaucaguccaucaaacugaaaaggagagggagggugugacuguggggaaguaaugucacuguaacgggcuggucacuguccuguacugugacguugggaacugcagaccaguuugcugggauuagcugaaugacuaggccuguucuguucgcaggugacaacauguacaguugugaaaaaugcaaaaagugaguagcugccaucacuuucacuuuccuaguuuagauuuuucucgguuaucugagcugagcauguggagguaguuuuacuugaugcuuuagaaaagucagguugauuauuuuguaaaccauguuuaaauuaaguguuuaauagccugauguaauauauuaauaaaugugaggauuuuaaagaaugaaguaucugagucugcauuaacucuacaugaaacaaagugacguuuugucggauuacuaugguaacaguagcaccagggaagugaaaggugaagauguguggaccuuucagagaggcugcccuaugcucacaguaucugcuguuaugggugcagaacagaacaguuaagccucguuuucuuuauauccacuuccagcucuccuuucugucuuguaauaauuuugacuuuuaaaaaccucuuuugggugugguggagcacgccuuuuaaucccagcccagaaaacugccaacuucauauagauacuggguuccaggccagcuagaagucagcagcuacagcaaaaaacaaaacaaaacaaaaacgcuucuuggugauaucagaaaaauggaauaggcuggauaaagcaaauauuuuugauguagagggaauugaaauuuuuuuuggaauaccuguauuacaagauuuaauuuuuauuugacguguaugaguaugccuacauguguguauguacagcauguggccagugcccauggagguuaggagagggcaccacauccccugaagcuggaauuauagaugguugugagccaucuccgucuggaugcugggaaguaaacccagguccugugucugcaagagcagugaguguuccuaauggccgagcauucucuccaguccagacagcuggccuucauacagacuuucagcuacugccaggaacaacggcgaaaccuuaacuucugcgguugguccuucuuaugacagaauggaggcgguaaauguaaacauaaauaauuacauacacacacacacacacacacacacacacacacaccccucuuacucacauggaaagauuuguuuucucagucugucuggaaguccuggaugacaguuaaaaagagacugagcugaagaggcgccagacauuucaggcagaggaaaacagacagaaagcagacagcgggugcucaccccagaugccaaguacacaucugucaagugcacguugauauugaugauuuaauggcuucuuuugaacaaaguguuuuaugugcauugguguuugccugcaugucugucugugugaggguaucaguucccuggaucuggaguaacagacaguugugagcugccaugugcaugcugggaauugaaccagggucuucuggaagaucagucaguacucuuaaccucugagccaucucuucagucccaauauugauuacuugaaauaaucacucuuuggccccccacauuuuccuaauauuaagagugaagguuuucaggcugggugugaugcuuauauacuaugucauggcccaggcguggcccacaccuuuaauccuggcucuuagcaacaggaggcaagugucucgcugccaguucgaggccagccuggucuacacagugaguuccaggaaggccagggcuauguagagugacccugucucagaaacagaaacaaaauuauaaacaaacaaacaagcaugcaaauaaaauaaugguuuuaaacccacguguagugguaagugguauaugcugauauuaucaguacugaggugggaggacuauacauuugagccuagccuggguuuuauaacaagacguuauugucuucaaggcaaaauaaaaagaauaauaagaauauaugaacuugaguuacagaucuugaagaagauuuggauucuacacuaugaguuuuacuuaauaucugcauauuauaaacauauuguagacauauuguagacaguggcaccuuaccucaugcugauuuuuuguuuguuuguuuuugguuuuucgagacaggguuucucuguguagcccuggcuguucugaaacucacuuuguagaccaggcuagacucaaacuccuagagauccaccugccccugccucuucucuccugaguguggggaucaaaggcgugcgccaccacugcucacugaugcucauuuuuaaaaagcaggaccuccguagcucaggcuggccuugagcuuggaauggagcugagggugaccuuggucuucacaguuuccugcuuucaccugcugaguacugaguauaggugugugcugccaugcuugaucugcgcagugcugggugggagcuaaggcaccacauagcuagucccuaauucuuuuuuaaucaaaguauuguguagugacuuaacuuuuaauuagugauauguugguauacguuaauuuuuuauacuaagagcuauuuuauuguuugauuauuuaguguauaaauauauaauauaacucaggaauauuguuauucugauucuuucuugacauuuucugaaagauauuuuugugauccauuuaaauauaauaaguguuuuguagauuuuuuuagcuuuucuuuuuuauccuuagguugaggaauggaguaaaguuuuguaaaguacagaaguuuccugagguaugacuucauuguuacucguuuauaagcuguuuaggacucacugugggagguuggguugaauauauaacaccaucuaacagugugcugagcauuucaccagacagcgcagggcucugcaagucugaaguuuacagcuagacagccgguggcauugagcuuuggaagagccaugcucacucugccacaugacagaugugucuggaaucaggucagaauucagggggauauuuaugauuuaacuaauucauaaacucuaauugagaauauaaaaugggccaggcaugguggcuaugcaaauuucugugcauuccaggccagccaggucuauauaguaagacuuagucucuuuaaaaugggggggggggaaagcccccaguccccccaauugaaauaacuauuuuaaaauaaacauuuaaaugaauguaauuuuauaugagaaugccacauuuucuuguuuuuacaauaaaacuugaguguacuuuguuucaaccacuacaaucucuucuagugaguaauuuggauguugaauuguacuucuuuuagauuuuguguauccaccuuaaaagauuucgacaugaacugauguuuuccaccaaaauuagcacccauguuuccuucccccuggaaggccucgaucuucagccauuucuugcaaaggacagcccagcucagauugugacauaugaucuccugucagucaucugucaccaugggacugcaaguagugaguacaauggcuugauauuuguuugugauuaaaaaacauguauccaaguugauugcuuaaauaagccccacuugaccaaagggagaaaaauuuaaaaacagguuucagugcuuauuauuagaaaaacagcagacaacacaaaguaauaacacacaguuaggagaauaccugugugugggggcacgcaccuauuguuccgguacucaggggccugaggcaggaggauuaggaauuccagaccccaaaaaugccagcuaguugaaacagguaccuguaauacagauuagcaaucuaacuuaaucuuauuggcaaaccugaaugccugccaaguucaaggagccuggguagcagagacugugaaauaaaaacgagacugugagauaaaaaucuccccgaguuuaagauauuuuauaacguugcaugaauuauuuguguguguguauggaauuacaaucuucuaacccauaaauuguacaauuauuaaguguuagaggaagcauuucagauguuaaauuuuaagacaguaaauauuuuuccguagacuauuuggaauaauugaaauuaaaguuagaaggacaaaugguaaaaaccauaacauggcgaguuuuguuuuguacaaggcuuuucagagcugcaugaccucaggugugugcggcggaacacucuugggaagcugaggugggaggauugucaguucaagaccaaccugggcuacaauagugagaucuuuucucaagacaaaaagaaaugauuaaacuugugcuuccugucuuacagugguagugcugagagugcagacugaaauaaucagagcacagacaacugcugugacguguuucagcugcucugcggucugacacguagcaccguaacacgcuuuuuccugccuuacaggugggcacuacauugccuacugccgaaacaauuuaaauaaccugugguaugaguuugaugaccagagcgucacugaaguuucagaguccacuguacagaaugccgaggccuacguccuuuucuacaggugacggggaacugucaugaccgugggaagacugucuucuuaaggauuugugcuucugagacuuucggggcuuaugggugaagauuagaagugcugugcacgcucaugaguaagagagagaagcuguuuacagaaugguacuuuguucagaaaauaggacuucauagagaagcaaagggacauaguguguuuuacauuguuuuuguuuguuuuuaaguacuuauuuuuaaauuuuuauuuauuuuauauguauggguauuuuacauguauguaugugugugcaccacaugugugcuuggugucagaggaggucagaagagggcaucagaucuccuggaacuggaguuauggauaguugugaggcaccauguagguucugggaaucuaacccaguuccuccaaagaacaguaaguauucuuaacugcugagccaucucuccagcccucauuucuuucuuuaacauguauguauguguguauguguauaugcauguauuugccugccuucaugcaccaaaguucauuuguucaaagaacaacuuuugggaguugguucucuccuucuaccaaguggguucugggaauugaacucagguccuccaauuuggugacaagcacccuucauaaugagcaucucacuggcccaggauuaguuuuuacuuaaaaagaaaaaaaaguagacaaaguuggaauuaauuaccacauuucuucccuaaaauauucaauaauaaauuaaguaugcuauaaaaaucuuugauacuuuucaguauuuuaagaaaaugcuaaauacuagaacaggaaccaagaaugcagcguagugacuugaucuuccugauaucggaugccgacauuguacaguaguuaugugguacucacggguaggauccagcgggacuccuaggguaaugcauaaugguugagcagaaggacagagaguuucuuuuggaauuccuuagggcugauaagguccacaguuacaguaugugauaaaacgaauaaugaagagaagacucaugcuguuaguuuauuguaauaaaaugugcauuaaaguuaaugaagcguuguccucaauaggaagagcagugaagaggcacaaaaggagaggcggaggauaucaaauuuguugaacaucauggaaccuagccuccuucaguucuacauaucucgacagugguugaauaaauuuaagaccuuugcugaaccuggcccuauuucaaauaaugauuuucucuguauccauggagguaagaaauacuguuagguaaaauagugauacuaaguugcuguuuaauuugcaauuaggaaagaaucaagagucuccucuccugauuauuguccauccccaucuagagcugaguguguuuaauuccuuaugauuuuagaaauuggccuugugugaaacccaguucuggagcuaaagaauaccaaagacuauuucagugucgggagagcauugauuuuacguuagucagucacauggauggcuaauuacaguugggugagcuuucuacauacacuuuccuuggugagagccauuccugugugcuggguuuagcugacaucuuuaucuguaguuccuucaugaagagcugacuuuuaaaaguauggaagcauauuuaggauuugugaacugugccucacacuucacugucuguccuggaguaauaaguagucuugugugggcuuguguuuggcuguccuuaugguuggugacuugcuaguguuaauuauguaguaaagcuacugggccuggagauacccuguauuguauauagaaaccuaacguuauauacuucugaauauucugagcgaucagagauugauggaaugguuaguuuguauaagaugcuagauucaaacccuagugcuaccaaauaaacacacaaauaaaaauacuggauguguacuucaaaacguaugcucauacauuuaggaaacacagucacuaaaaauucuuuucacuuacuuuuuuuuuuuuuuugagagauuuaagcacauugauugaaagacagauaugauuguauguauaauucuguaaccccaguguuugagggccugagguaggaaaacugcuaugaguuggaggccagccuaaacuacggaguaagaccccugucuccgcaggacuguggggaggagcggggaggguguguggaggauuggccauuuaccauuaaaaaugacuuuaugugugagagaauacuugccuauuuugaguaagcucuuuaauuuuaagcaccgccuuugaaagucauguaaauauuuuuuagguauuccuccacgaaaagcgaguuauauugaagacuuaguuuugaugcugccucagaacauuugggauaaccucuauagcaggucuguuuuuuaaauccaaaauccuaaaacaaaauaaaaaaucauaaaauaaaucauaaaacaaaauaaaaaaucauaaaacaaauugaaaguaguuacagaaguguugaauuaugucauaaauacccaguguguuauuugauauguauaaaggauauuuuuuuccauaauuuauucauucuaaaguauggguagggagauuuuuagucaguggggcuuagucuaaauagugggaauuuuuaugauuaucuguaggaaauacugugguauauaauuuuauguaccuuauuuaaaugauguaacaucuccccaguacuaaaaguucacauaguuguauacuacuaaauuggaaguuccuuuuucuaagacuuauuuauauuaugugaguacacuguaguugucuucagaaacaccagaaaagggcaucagaucccauuacagaucauguggaaauugaacucaggaccucuggaagagcagucagugcucuuaacuaucuuuccagcucaaaacuggauauucuuacuuauuuuacaauguuauuuugcuacgaagcauuuuaaauauuaaaaaugcacuaagugcuuuuuacuugagcacgggaagucuucauuugauuaaaaucuuacugggucugugcuuguauagcuaagaauuuugugcuaauuuuugagccccuuucacuugcugucguuucuaaugcuauagcggaagagaaaguuguagcuauaagggaauguuaaaauguacguaaagcagguuagggacuuggugacgaaacauaagaucgagaguucuuuuuuuuguauauuucgacuuuuuucauauuacuuugagaaucuuccuguaggauuuauuguuuaaauaauuuuuuaaaaauuaguugguguaugugcuuuugugcugcagagcauggguggcacuuggaggacagcuggagggagagaguucuuugauuccaucauguggguccugaggagaccaagacccacugagccaccuugucaaacucaggguuuauuguaacugggaauuuaaacauugaucaaagagcuagaaauaguuuccuagaacauguuuuuuuuuccugaaguugugacuuuguccuaaacuucaugcuuagguauggaggagggccugcugucaaccaucucuacaucugccacaccugccaaauugaguuagagaagauugaaaaacgaagaaaaaccgaauuggaaauuuuuauucggguaaaagaaguagcacuuuggcgcuguggaugacgucagcugaggaugcuggccugguguuagcagaggggugggggauggauggcaggggccugccugcauagccacgcccaacccugcuccggccaccgcaccucagccucucuucuucccguuugcuaugcauuugccguggcaagaagucuuacuccccagauuguacguuuucucccuagaguugucuguagccuccagcugguguggcuguugggguugguuguuacaggagccugaaccuucauucuugaagggucugagcccucagcacucuucacuguuagcucuuuucuuuguaagguuaaauuuuaaucucuggcuaaagguuuuggaaauagugaguagugucuguagcugacugauuguuggauccuaaaaggaguuucccauguugugccuuuugugaauugaccuuaaugacaaaugugaccuugaguagaaacuuuaccuaggauuuugaggugaagucauacugaguuguuuaugcagaacccaaauccagucagugucccuuucaagagacagugagaggauacacaaaggaggaagaaaaugcugugggaagaaagauggagguggagauggaagacccagcuauaggucgcuccuugaaggagucagacaugggaucucucugggucuccagggacuaguucccucacuacucugauuuuggauucuugucuccaaaacugugagaaaagagauuucccuuuuuaguuaccaaguuuguagucacuuaucauucauugagaaugcuacaaugaaugcaauaggguagaaucucccccccccccuuuuuuuuuuuuuuuugguuuggugguuuuucaauuucagaaagaagguuucucuguguaacccuggcuguccuggaacucacucuguagaucagguuagccucaaacucagagauauaccuguggcugccuccugagugcugggauuaaacguguacaccccugccuaguauuaaggacuuuaagauguuugcacagcugugguuccgggauguuucuggggggagggggggcuaagagggaugggauguugggcuuugaccagggcccuacacauguuaaguccauguccagucauuaaacuuuaucauuagucccuuuguuauuuugagacaggauuucacuguguucagguuggugagauuuguguauacuuuugccuaauuggacucaugaggggugggguuacagucaggagcuaauaaacacccagcuucgauuuauuuugaaucaugguauauauagcaaguuccaggucagccaagauuggccaaugauagcacacaccuuuaauccugcacuugggaggcagagguggguggaucucuuuauucugauagauuaguccuuuagaggacauagacugugguaaaauuccuauaaaggaacaauuuuuacacacaugcauguguguuuuguguauguguuugaugcugaaaaucagacuuagaaccuuauacaugauagacaagugcuguacuguuggccugaauaauaccaaacuguuuaggcucuguacagccccuaucaagaauuugaaagcuguuucugaggaauuugggcuucauuucuguaaucugaacacuugaaguuaaccucaguuaucuaggaagacucaaaacaacacauuuagccugguguagaacacucuugugguagaaguaggauggucagggaguugacauaaucuuuagccauauacuacuaguuugaggccagucugcgcuauagaagacagucucaccccuaauaacgucauggguugcuaaucugugcgccaucauggaugaguuugaagcauuaugcucuuuugcacguggcauauuugaccugucuugcgcuaguugcaccuagugauagcagcuuuccuggcaaacaucccaucuccuggaaucccaaaugcaaccuagucuuuuuauggccuccuuaugugggaucucucccugccauacauuugccuucuuuccuugacuuuccauaaccuugauacaaguuuccaugaauccuguuauauuuugcaugaugcaaaagcagcaguauguuguugauaccaaguucugcugccauuuuuaggugcaaccugggggcauuuaacauccaaaucguaacgaccuggucacgaaauaggugaccucaguggcuuggaaacuaagugaaguuucugaaaaauuaagaaagcagauaggaucaguuugaagaacuaaaaguccgaggaaaugaagugagcacaggacaccaacgugacuuguggcaguuggcugucuccuacuguauggaucacagggauccaguucugcucuccaugcuugcuagcaaguuccuuuauucauuggugaucuuucuuacugagucagggucucugugucccaagcugacuuugcacuuuggaucuucuugcaggucuuaguuaggguuuccauugcugagaagagacaccucagacacuuugaaagagaucaaggcaacuuuuuuaagggacaacauuuaaaauuggggcuggcuuacagguucagaggcuccgucagguauugucauggcaagaagcauggcagcauccagguagacacagugcuggacaaggagccaagaguucuacaucuugaaccgaaggcaguuagaaaacuaucuuccaggcagcuaggaggagggucucaaagccaacaaccuucaccuacaccccgcccccuccacacauacacagugauacacuucuugcaacaaggccacaccuccuaauguugccacggccugggcgaagcauauuuauacaccaccacacugcauucacuacccaaagagacuguaaauuacuacgcccaguucuugaucucuuuaguaccuucauacauagacccagaauuuuuuauacccuguuuuaugguuccuguguaaguagcuucugagugucccaagaagacucucgcccucaaagugcuugccuuuaguaaauaucaaagggucaugagcacaugucuguaauccuagccuuugggagguaaaagcaggagugucuguaauuugaggucacuugggcugcaugauacacugucuuagccccucccuuaaaaaaagccauagagaaggaaaauguugaacaaggguuaaagagcucaagaguagugugaggaguuggucaagauaggucuguugaggugguguuaaaagaaagacuugucauaaccaggcucacaggaaaugcagggacaaaaaaacagagcagagacugaaggaaaggccauccagagauuguccccccuugggauccaucccauccgcacacacuaaugaugccaagacauauuugcagacaggagccuggcaugacuguccucuugagaggcucugcuagcaccuaagacagaugcagguucucacagccaaccauuggacuaagccuggagaccccaauggaagaguuagaggaaggaaugcaggagcugaaggggauugcaaccccauaggaagaacaacaguaucaacuaaccagaccccucagagcucccagggacuaagcuaccaaccaaagaguauacaucugcugguucauguagcagaagacugccuuuucuggcaucagugggaggggaugugcuugguccuguggaggcaugaugucccaguguagggggauacuagaggggugagaugagaguuggugggugagagguuuguggaggggggaccaggaaggggacacuugaaauguaaguaaauauaauaguaauaauaauagacuuguaggauguaugggaggacagucacaaaaauaauuggagagagcgagcgagcaagaaagcgcagaagauaggaaaucaggaacauaucagggugguuuuugggaauaacugaaaggucacuguggucacacuuguggauaaaaggaagucagaucaucagguacuucugaacuaguagugaaaacauuggggggcuggugagauggcucaguggguaagagcacccgacugcucuuccaaagguccggaguucaaaucccagcaaccacaugguggcucacagccauccguaaggggaucugacucccucuucuggagugucugaagacagcuacaguguacuuacauauaaugaauaaauaaaucuuaaaaaaaaaaagagaaaacauugggacuaguauguagcucaggcaguggagugcuuacuuagcaugcauaaagcacuggguucagucucuaguacuacaugaaacuuggcauguguguauuccuagcacuugggagguaggaagaucagaaguuuaaggucauccuuggaucaaaauguuugaggucagucugagauaaaucaaacuuuuugggggggaaaaaaaaguuuggcugggcaguggugguguacgccuuuaauccuagcacuugggaggcagaggcaggcagaucucugaguucaaggccagccuggucuacagagugaguuccaggauagccaggacuacacagagaaaaacccugucucgaaaaacuaaaaaaaaaaaaaaaaaaaaaaaaaaaaaagaaagucuuuggcacuggggauauaguucaaugguaaauaacuuaccuaguaaaaaaaaagcuguugagagaauaacaaaucugaugaucacuuuuauuuuaaucucauuuaugaaugcaaacuuagaucacacccaagccuucccacuaucuuuccaguuccauuuggacuuccuuccccaaggcuauaggguuuugauuagauuuaaagaaauagccgggugugguggcacacgccuuuaauuccagcagaggcaggcggauuucugaguucaaggccagccuggucuacagagugaguuccaggacagccagagcuacacagagaaacccugucucaaaaaaacaaaauaaacaaauagggcuguuuagaugguuuugugucauccagugccaagaaggcucaccugcguucaaucccgaugucauagugaaaggacagaacuaacuuuaaucccagcaguuuguccucccacccccacauuuuaaguuuuaaagaacuaucugucugaauuuagguauaucuauccuuaucuaguauaugagcauuguuucccaacaggaaauacuacuguaauuagauuucaaacacuuuauucuuuugaggccuaguugaaucucuuuugcguaacuuuuuuuuugaucuuuacuuuuuuuuaaaaaguaggcugugguagauuuuuaauaaacauauuucauagguauauuaaaaaucuucucuuaaccuguuccucugugcuccucuucgguauguguauauuuugagacauaaucuagggucauuuauugauagacaacacuguguaucccagagcugagcuaaguucguguggcuguuagugcuaaccagaccccucagagcucacagaugaaugagagacguucuuguuggauacugcaggagaggguugugaguuccagacauuaggugccugacuuuuccucucuguagcucaacagagcauuucaagaggaggacuccccagcuacuuuuuacuguaucagcaugcagugguuuagagaaugggagaguuuuguaaaggguaaggauggagguaaguggcuaacugaaagcuuauuagccaguucuuuuguuuauuaauuuuaugaauauuggauauacaccagugaacaauaaaagacccaugcugucaggcaacccacauucuaguuuauggccuuaucgcuauaaacuguaucaaucaugccaagaauaaaaaccugaacagauuuuguuuuugggagaugggauggcuuagcaguugcaagcacuuggugcucuuagggaucugacuccaguucucagcccccacagcaggcaagagcauuaccacccgggaccccagcgccagaggaucagacacuccagucuccacuggcacugacuggcacacuugcccacacacagucuuaauguucaagaacuuuacaggcagguggaucucuuugaguccaaggccagccuggucuauaacagagauacugucucaagacaaagagaaaacaacaccaccacccccucccagaauggaauggaaaauuacacuuuauccaauacaauguggacuuuaaaaaaaauauuuaagccgggcggugguggugcacgccuuuaaucccagcucuugggaggcagagacaggcggauuucugaguucgaggccagccuggucuacaaagugaguuccaggacagccagcagggcuauacagagaaacccugucucgaaaaaccaaaaaauaaaaauaaaaaaauauuuauauaugauaauaacuugaaugaaaggcaugaugauacaugacuuuaauccugguacuggggaggcagaggcaggcagauuucugugaguucaaggucagccucuucugcauagccauuuucaggccggccaggacuaguuagugagaaucuacuuuaauacuacuauugcuauuaauaauaauaaugguuaaaaauaauauauucuugauaugguguuauuugcaaaaaaaaaaaaguauauuguuugaaucccuuugguggguuuguuuuguuucaaguccgcauacaaagugauggauuuauuucagaugcagaugguauuauacuuuguuuuacuucccccacugcccucaacuauguuauuuaagcaguguaucaugcagaacaaaacaucacagauauuaaaaccauaugccuauuuuucuguaagauuagucauuucucuuccucaugccuguugggagcuuuugagaauggacuaaguacuguacuuucaugugcaaagaaaaauggcuuuucuccuaaaagaaaggucuaucuuaauauuucauucuauaauguuuugguuaaaaacgaaauuuggaaugguuugagaggguuuuuuuuuguuuguuuguuuuuguuuuuaagcuuauuaaagaguuguuguucauuaaagggcuguagcauuaacaaaauauuuugaucuacaauucccaaacaagugguuuuucuagaagacuggagaguuggcucacugguuaagaguacuggcugcucuuccaaaggacuuggguucaauucccagcacccacauggucgcucacaacuguaacaccaguuccagaggaucugauaccaucacauauacagacaauagcaccaguguacauaaaauaaaaaaaauuaaucauuaaagauaaauuguuucuauuauacuuuggugcugagcaacaucucaccuuucuugguuguuuggggucaaaugaaaucuccaaagcugaaaagauacuaagaaucgaugacauuugguuaguucuccguaauuucagguauaaagccauguaguucuuugcugcauuuggaaguggacauguuauaaucuuuuuauccuuuugacuuagaucccccagguccaaucgacaacacuaaaauugcgguuacuaaauguggcagugugaugcucaagcaagguaaguuuaagacacacaggauugcuuuguccugagacacgguagcauggccucuaggcuguccuugaaugcagcggagagguuuaacuugugauucugucuuuucuucccaacuguugguauuacugguguauaccaucaugcuuuaauauugaaacuuuuguuaaugaguucuuauugauuaaaaaaaaaauaaccagcuauuauguaauuuauuuaccuaguucagaaauggucaggcuuacaguaacagaaaggguaaaaauuucuuauuuuuaggaagguuuuaggguuguuggagcuuggaaaauggaucucuagacauuuggaaaccgucuccauauuguuuuuuauagcauacaagcugauaaucugaagguuucagaauucucaguccuccauagaggauuucucuguuggauauacuguaaaagcuauauuaagauucauguuuguaaauaucauucuuuuugcauacauacaauuuuaggagcagacucuggucaaauuucagaagaaacauggaauuuccugcagucuauauaugguggggggccugaaguuauccuccgaccuccaguuguucauguugacccugauguacuccaagcagaggaaaagauugaaguagaaacucgcucuuuguaguucugaggacacagagcucuaaugagaaguuauucucacuugaugcacacacauucaaaacauuccgcaaagcauguugauucucuugauuuucauccuuuuuucucauuuauuccuuuguacugggcauuauggaaggguauauuaaaauguuauauaaguugguauauuuaaugcuaaguagcuuaccagaauaucuuucaguguacuguuuugaaagaaaagggacaguugguaacuagguucucugaccuuuguucuacaggcagauccagcaaacccuuuguagcacuguaaauacuuuggcuucgauaauguucuuauuacucuaaccaaucauaacuggcuaagcuuuuucauuucuccaaaaagcuaauuuaauuguauauuuugacaugaauuugcauaguaaugaaccuauguuaaauccgagagugguggucagcacauuguuaauuuccuaacgcucaggaaacaucagguggguggguguuacugcuuuugcacugcagcauauaaaacugcauauuacaauuuacaaaaugucuuuuuugaauguaacgggauguauucauuuuuaguggaauuuguuaccagauaucaguaaauuauugcugcuuauaauguaaaauguuaaacuuuaguucuguagaccugaaugguauucauuaauguuaguaacaagaaaauaccccuuaguuuuaggccacuucuauuuugagagcaugaaguauggaaugugucaaaugagauuguugauaaagcugaaaccacuugcaaaaugauuuuuuaaugaaaugcauaaagucuuuuugaauaauagaguauucacugcuguuugcuugaucaugugaugucaaaagcucaacuauaugcaacuacaaacaugcaggugacugagggacagcauucauggugacuuugcaauguuguuaaaacucauucaauaaaaauaauucuaaaauguauaaacugaauguugaauuuauuugauagacuuuuuaaaaaagguguaaagucuguuaguauuaaugccuuucauuauaucuuauuugaaagcauaagcuaggaaguuauuugcuauaauaacguuuauuaaacuguuucagaauggcagcauggugguuggcaucugucucccaguaccugguaggcuuggcuggaggaaccuaaguuugugggcuguagaacaagaccgucccaaaacaacagcuaacuauaaauaaaacuuaucaacugugcauuuaaaaau

SEQ ID NO: 1762 - RNA, 1414 nt, Mus musculus
ucgacuuuuuucauauuacuuugagaaucuuccuguaggauuuauuguuuaaauaauuuuuuaaaaauuaguugguguaugugcuuuugugcugcagagcauggguggcacuuggaggacagcuggagggagagaguucuuugauuccaucauguggguccugaggagaccaagacccacugagccaccuugucaaacucaggguuuauuguaacugggaauuuaaacauugaucaaagagcuagaaauaguuuccuagaacauguuuuuuuuuccugaaguugugacuuuguccuaaacuucaugcuuagguauggaggagggccugcugucaaccaucucuacaucugccacaccugccaaauugaguuagagaagauugaaaaacgaagaaaaaccgaauuggaaauuuuuauucggguaaaagaaguagcacuuuggcgcuguggaugacgucagcugaggaugcuggccugguguuagcagaggggugggggauggauggcaggggccugccugcauagccacgcccaacccugcuccggccaccgcaccucagccucucuucuucccguuugcuaugcauuugccguggcaagaagucuuacuccccagauuguacguuuucucccuagaguugucuguagccuccagcugguguggcuguugggguugguuguuacaggagccugaaccuucauucuugaagggucugagcccucagcacucuucacuguuagcucuuuucuuuguaagguuaaauuuuaaucucuggcuaaagguuuuggaaauagugaguagugucuguagcugacugauuguuggauccuaaaaggaguuucccauguugugccuuuugugaauugaccuuaaugacaaaugugaccuugaguagaaacuuuaccuaggauuuugaggugaagucauacugaguuguuuaugcagaacccaaauccagucagugucccuuucaagagacagugagaggauacacaaaggaggaagaaaaugcugugggaagaaagauggagguggagauggaagacccagcuauaggucgcuccuugaaggagucagacaugggaucucucugggucuccagggacuaguucccucacuacucugauuuuggauucuugucuccaaaacugugagaaaagagauuucccuuuuuaguuaccaaguuuguagucacuuaucauucauugagaaugcuacaaugaaugcaauaggguagaaucucccccccccccuuuuuuuuuuuuuuuugguuuggugguuuuucaauuucagaaagaagguuucucuguguaacccuggcuguccuggaacucacucuguagaucagguuagccucaaacucagagauauaccuguggcugccuccugagugcugggauuaaacguguacacc

SEQ ID NO: 1763 - RNA, 1414 nt, Mus musculus
gguguacacguuuaaucccagcacucaggaggcagccacagguauaucucugaguuugaggcuaaccugaucuacagagugaguuccaggacagccaggguuacacagagaaaccuucuuucugaaauugaaaaaccaccaaaccaaaaaaaaaaaaaaaagggggggggggagauucuacccuauugcauucauuguagcauucucaaugaaugauaagugacuacaaacuugguaacuaaaaagggaaaucucuuuucucacaguuuuggagacaagaauccaaaaucagaguagugagggaacuagucccuggagacccagagagaucccaugucugacuccuucaaggagcgaccuauagcugggucuuccaucuccaccuccaucuuucuucccacagcauuuucuuccuccuuuguguauccucucacugucucuugaaagggacacugacuggauuuggguucugcauaaacaacucaguaugacuucaccucaaaauccuagguaaaguuucuacucaaggucacauuugucauuaaggucaauucacaaaaggcacaacaugggaaacuccuuuuaggauccaacaaucagucagcuacagacacuacucacuauuuccaaaaccuuuagccagagauuaaaauuuaaccuuacaaagaaaagagcuaacagugaagagugcugagggcucagacccuucaagaaugaagguucaggcuccuguaacaaccaaccccaacagccacaccagcuggaggcuacagacaacucuagggagaaaacguacaaucuggggaguaagacuucuugccacggcaaaugcauagcaaacgggaagaagagaggcugaggugcgguggccggagcaggguugggcguggcuaugcaggcaggccccugccauccaucccccaccccucugcuaacaccaggccagcauccucagcugacgucauccacagcgccaaagugcuacuucuuuuacccgaauaaaaauuuccaauucgguuuuucuucguuuuucaaucuucucuaacucaauuuggcagguguggcagauguagagaugguugacagcaggcccuccuccauaccuaagcaugaaguuuaggacaaagucacaacuucaggaaaaaaaaacauguucuaggaaacuauuucuagcucuuugaucaauguuuaaauucccaguuacaauaaacccugaguuugacaagguggcucagugggucuuggucuccucaggacccacaugauggaaucaaagaacucucucccuccagcuguccuccaagugccacccaugcucugcagcacaaaagcacauacaccaacuaauuuuuaaaaaauuauuuaaacaauaaauccuacaggaagauucucaaaguaauaugaaaaaagucga

SEQ ID NO: 1764 - RNA, 3997 nt, Mus musculus
ggccagccuggucuauaacagagauacugucucaagacaaagagaaaacaacaccaccacccccucccagaauggaauggaaaauuacacuuuauccaauacaauguggacuuuaaaaaaaauauuuaagccgggcggugguggugcacgccuuuaaucccagcucuugggaggcagagacaggcggauuucugaguucgaggccagccuggucuacaaagugaguuccaggacagccagcagggcuauacagagaaacccugucucgaaaaaccaaaaaauaaaaauaaaaaaauauuuauauaugauaauaacuugaaugaaaggcaugaugauacaugacuuuaauccugguacuggggaggcagaggcaggcagauuucugugaguucaaggucagccucuucugcauagccauuuucaggccggccaggacuaguuagugagaaucuacuuuaauacuacuauugcuauuaauaauaauaaugguuaaaaauaauauauucuugauaugguguuauuugcaaaaaaaaaaaaguauauuguuugaaucccuuugguggguuuguuuuguuucaaguccgcauacaaagugauggauuuauuucagaugcagaugguauuauacuuuguuuuacuucccccacugcccucaacuauguuauuuaagcaguguaucaugcagaacaaaacaucacagauauuaaaaccauaugccuauuuuucuguaagauuagucauuucucuuccucaugccuguugggagcuuuugagaauggacuaaguacuguacuuucaugugcaaagaaaaauggcuuuucuccuaaaagaaaggucuaucuuaauauuucauucuauaauguuuugguuaaaaacgaaauuuggaaugguuugagaggguuuuuuuuuguuuguuuguuuuuguuuuuaagcuuauuaaagaguuguuguucauuaaagggcuguagcauuaacaaaauauuuugaucuacaauucccaaacaagugguuuuucuagaagacuggagaguuggcucacugguuaagaguacuggcugcucuuccaaaggacuuggguucaauucccagcacccacauggucgcucacaacuguaacaccaguuccagaggaucugauaccaucacauauacagacaauagcaccaguguacauaaaauaaaaaaaauuaaucauuaaagauaaauuguuucuauuauacuuuggugcugagcaacaucucaccuuucuugguuguuuggggucaaaugaaaucuccaaagcugaaaagauacuaagaaucgaugacauuugguuaguucuccguaauuucagguauaaagccauguaguucuuugcugcauuuggaaguggacauguuauaaucuuuuuauccuuuugacuuagaucccccagguccaaucgacaacacuaaaauugcgguuacuaaauguggcagugugaugcucaagcaagguaaguuuaagacacacaggauugcuuuguccugagacacgguagcauggccucuaggcuguccuugaaugcagcggagagguuuaacuugugauucugucuuuucuucccaacuguugguauuacugguguauaccaucaugcuuuaauauugaaacuuuuguuaaugaguucuuauugauuaaaaaaaaaauaaccagcuauuauguaauuuauuuaccuaguucagaaauggucaggcuuacaguaacagaaaggguaaaaauuucuuauuuuuaggaagguuuuaggguuguuggagcuuggaaaauggaucucuagacauuuggaaaccgucuccauauuguuuuuuauagcauacaagcugauaaucugaagguuucagaauucucaguccuccauagaggauuucucuguuggauauacuguaaaagcuauauuaagauucauguuuguaaauaucauucuuuuugcauacauacaauuuuaggagcagacucuggucaaauuucagaagaaacauggaauuuccugcagucuauauaugguggggggccugaaguuauccuccgaccuccaguuguucauguugacccugauguacuccaagcagaggaaaagauugaaguagaaacucgcucuuuguaguucugaggacacagagcucuaaugagaaguuauucucacuugaugcacacacauucaaaacauuccgcaaagcauguugauucucuugauuuucauccuuuuuucucauuuauuccuuuguacugggcauuauggaaggguauauuaaaauguuauauaaguugguauauuuaaugcuaaguagcuuaccagaauaucuuucaguguacuguuuugaaagaaaagggacaguugguaacuagguucucugaccuuuguucuacaggcagauccagcaaacccuuuguagcacuguaaauacuuuggcuucgauaauguucuuauuacucuaaccaaucauaacuggcuaagcuuuuucauuucuccaaaaagcuaauuuaauuguauauuuugacaugaauuugcauaguaaugaaccuauguuaaauccgagagugguggucagcacauuguuaauuuccuaacgcucaggaaacaucagguggguggguguuacugcuuuugcacugcagcauauaaaacugcauauuacaauuuacaaaaugucuuuuuugaauguaacgggauguauucauuuuuaguggaauuuguuaccagauaucaguaaauuauugcugcuuauaauguaaaauguuaaacuuuaguucuguagaccugaaugguauucauuaauguuaguaacaagaaaauaccccuuaguuuuaggccacuucuauuuugagagcaugaaguauggaaugugucaaaugagauuguugauaaagcugaaaccacuugcaaaaugauuuuuuaaugaaaugcauaaagucuuuuugaauaauagaguauucacugcuguuugcuugaucaugugaugucaaaagcucaacuauaugcaacuacaaacaugcaggugacugagggacagcauucauggugacuuugcaauguuguuaaaacucauucaauaaaaauaauucuaaaauguauaaacugaauguugaauuuauuugauagacuuuuuaaaaaagguguaaagucuguuaguauuaaugccuuucauuauaucuuauuugaaagcauaagcuaggaaguuauuugcuauaauaacguuuauuaaacuguuucagaauggcagcauggugguuggcaucugucucccaguaccugguaggcuuggcuggaggaaccuaaguuugugggcuguagaacaagaccgucccaaaacaacagcuaacuauaaauaaaacuuaucaacugugcauuuaaaaauggugauuuucuaacucuagcacccucacucauccugaugucggauguuacacaugcugaacacuaucuuacuuuaguuuggauaugaaauauauccugugucgaaacaccaccaccuggggguguugugagguggcugcaccugaggaugucagccucauccacaggcugcaucuugucccugaccugcguaucuuugugccuccuaguugcucccugaggcugaacagcuuuuuucugccaucauguucugccuuguuacaggucuaaaagcaauggagucaguugaccaugggcuaaaacuugagcaaaauaaaucugucccuugcuuuucuuauuuuguuauaaggaucaaagcuaacaaccacaaugcuuuuuaucacugagauauauauacuucaacgcuaacauuccuucuaagagacuuauucaaguguuuuucaaccugugaguaggagugcuuauagcucaguggaguguucucucuuaacucuuucucuucaaaacuucaugugacucaggcuggccucaaacuugcuucguagccuauaauuccaguacugugaggcagaggcaggaaaugaagaguucuaggauguauacacacacacacacacacacaca

SEQ ID NO: 1765 - RNA, 5734 nt, Mus musculus
auacacaacagccacugauuuugaccuuuauuuaaauuaugaguuucacucaucaguuuuauuaacagaaaucacuuuccaucauugauuguuacacgacaauaggacacggggaggcaucaguuaaauaccagcucuaaauaggacuaacaaaaacuggacucagaagacuaaagaucuaaauacaacauauuuauuuuacaauacuuauauaauuuaucauuaacauaugauauacaaaauauuaagucacgucuagguuugauaaacacuucaaauacagcaguaauucauauugcacacuacagcaucucucccaucugacuagcucacuagcucaggcuggacauucacccucugaagcaccucuucuggcauacagaagacagggcuaacaggcuugaucugcucuucucccagaagugacaacccagcaaugccaaauaagguaugaaagggauccaccugugggaaguucacaaacauggaaaaggcucaauuaucuaucuguccacagugaaguguaucuugaauaccacuuuaaaaguuuucugaagacaaguauuucuaauacuagacauaaacaauuaucacuacaagauauuucuaucagcucuagccuuuguaacuaacacauuuuaaaaaaacacccaagguaaacccccaagacaaccuuuggacuauuucuuacagggcacuauuuuuagugcauuagaaaugccuauaaccaugaaagucaaucaacaaugaaaaacugcaaagccagaauuguacugaccauaucuccuggucugucugcaaauccucccgucucuucaucuugacacgcuaagaugaaacuucgaagcuuuucucugucaauccaaugaagucucccgaugaucuuuagggaggccaacacccaccaugaauagcacacaucugguaacuagagaaggggaagggggagccaguaagacagcugccucuacugcaccauuguauucucucagauuugauggauucuuuuuuuuuuaaugucuaaucccguguucccagacaugauuguagggcaaacugagacuaccucccauuugucucucacaccaccucagcacuguagcuagcuacacuaauaauuccagcacauacuaauaauucucucugccuuucucacaaagcaagcuccacacaguaacuaauuauagaucuggagcucagacuagcaacauuugaaguguucacaauccauuuuaauuuauuaauugacuaggucccccuaauagagcuggcuagcuucaaacuaagacuucuugccugugccucccaggcgauuagguuaaacuaaaagcagggccacccccaaccucaguaucgcuuuugaguaucuguacaugucccaaggcagaaaugaauucagagucaaugagaccccaagcucucuccuuaagggaucuuaaaacuauaccugagaaaccccucaguucuaagcacacagcaccaugaaugcauaaagagccacuauagauaauaccuucucgggucuuccauugaguccgccugagggcaacugccgcucacaaagccaccaaccaaguaggucggaguucacuuggugcaacugacuaguuauggccaggaauccugugcaacaauagaucuaaaauuacagacauaaaguacacagguauaguuuaacaguaaaugacagacacuaccaaaauuacuaaagcuccaucuuuguuaucucagguuguauuaguagguucaaugcgacaguggaaugcuauacuuaugcacaauguucucugcacuggguaagguuaguucaucuguacgaauaaggucagggucaugccuccaaucccagcacguagcaagccccgaggacagccuggacuacacacacaguaagccucgaggucaguuaacagcacagaaugcagaccccacauaaacagacaaaugccaauaaggagcacugguguuuacuuagggugaaguuguguagacccagcauauacacaaaacucagugagaagguguggccauucacaacacaaaaccccuauaaacuuuaauugcaaaauuaccugcccagcgugagauucagagccuggucugcacccaaauccaccaucaaaguucaugcaggacaaaacaaacucaaucgccuuuuccacauuaauagcaucaagcuugcccuaugacgagaaaggaagcagccuauuacagcuaccuaguacucaaguguuuaauucgguccuuuaaugcaacagucaaagcuuaccaaaagagccaaaguugccaccgcacaaaaugagaaucuuguaucaauuucuccuaaaagacaaaaagagccaaggcagacauguaagugcuaccaagucaccuaagaacaaaacccauuaaacuccccaaagucaagacugacuaugcucacuaggaggcagucccccaacuucugaggaaaccagcuaggcaaauagaaagcaauagccuaguagcuugcaagggcccagaaaagaaaggaaccuauaaaauggcaggaguauaugccucgccccccauucgggcuaguaauuuaguaacauaaucaaagcccugcuuuaaaaaagguucacaucccacaaagcagcuggucucaggacugcauuuuguucccccccagauuaucuaaauuaaucaaaggaaaaauuuccaucucccaacucaagauauuuacuaauuugacaaacguuuagagaccuccccaggucuuuaccuucagggaaguuaauuauuauuggagauaaaacuugaaccuaccuuaucuuuuaguguggugugcugacaagccagcacggggcaugcugggacuuccagcaggccauuuuauuccaguuagaccaacugcuuagugggaccugaaaagacggaacaacuugaaaucuuaugauuacuaccaccaagacaaaagauauucugaguaggaguagcugacaaaaacugcaaucuggucuuaccccaaaugucuccagcaaaggagccaucuucuuucuguaggcucugaacauaggccacgaccuuaucuacguugauaacaugaacacugucauacagaguaagaaucugaaagacaagcgggugucacagguuuguccuggaucagagucacccaccaggcccucucaagcuuacuauaaacuucuuguucccuugauaagguaagaaacagguagggcuuuaacuauccucuggcucuucauugaaaccaaauuugaacuggacugugcuucaauuaacauacacaaggaguucaccuuccaaggucucaguguaauuuguaacuugcaucagguuagcauucagcuaauacaugccaugacaucacugaccugugggaaguagccuuuggguggucacagcaaguggcaagguuucacaagggcucaccuggacagcacugagcguguacagaaggugggggucgugcccaaugcuagcacuuauucccccacacucaugcuggcacgacuugauaaacaccaggauuucuucucgguucaugcgaugaagcugucccaugagguccaucacagucaggccccaauagacgccgcucauucucagguauucagacaugcaguauuccuaggagaagcaucucagauuugccacucugacuuuacauaacccaccucuaccuaagucagcugugaacaacucguaaggcuuuagaguggcgguugccgacccuuugggccccacauucugauuccuaacaaugaaacuaguuaugaaguaaguagcaacaaaaguuaucucauggucggagaucgccacaacacguagaacuguuaggaaaggucacagcagcaagaagauugagagccaauacucuuagucuccaagugcuaaccucaggugaauuaaccaaaagcaguauugaugccuacuguuuacuaagcaucaauuauugcauucuacaaaugaagucuaugaauacggaaagauaaaugacgcuaaagaugggaaccaaaugaagcauuaccucacaagcauuuauucaggugaaggccucacuggcgugcugccaaaccaaacccaaaagaaccaggugcacaguuggcaagaaggccacacauuugggccuaugauucccacuaacugaaaaguuguaaagacagucaaaugccacgcucucuaagacagagagcugcugcacaaauacuuuuacccaaaugacuccuccuuggaggguccccccacagcuugggccuucucaaacucagccaccccugcuugcugcuggcaaccuccccggccauuuccccaggcacaccauuacaucaaguuuagguaaaaccuuuucaaggucucagcguaauucuagagcuaaaguguuaugacacaucagcgaauucagauaauacaugccaacacaucauugaccuucaagguuuuaccccagacagaaaugagcaaaccccuucuaccugcagcccugcacuuccgcccuuuauguaccagcacaugacugauguggucaaauaccaaccucugauauacaagguacaccuauaauacauuuuaaaucaggccucucaauuaguauuauacaaguaaguauuauacuuauugcuguuagucuuagaaaccuuucaacagaaaaaagaaucauacgcacauaaucaucuuucuuugagccauaggaagcaauauaaucggcaugcuucuccagcaacagggugucaggcgcaucugacuugauaguaacgucuuucugcugugugcccuuccaagaaaaaagcagagaucccauucaccauccggaaaucgugacaucucagacucacacauagccagaucucaguacuuuuuuucuuucaggucucagaguaauucuagagcuaaagugguuuauaaucaacuuuagauucagaauacaugccagcucaucauugacccgaaucuugacgcuuaucuuuugaguuaugccagaaauacacacucuugcuuaacaaguuugaggcuucagcgcaccuuucuacagucuucacaugcuaaccccuuugcuaaauaaucagacccauuagcuccaaauuccaccuucgauucuaagacucacccaauaaguaggucaaagcgauugccaaaauaaauuuccuacuuuauucagagucucggcuaugaagcccugucuggucuggaacucccuguguagaccaggccaccugcuucugccucacuucuuuaauccaagaguguuaggauuaaaaggcgugggccaaggccgacuuccuuccaucccaguuaaaauguuuaacuaugaaacaacauucguaaaugaucauguaaccuucaaaauacaggcacguacaaguccccgauguuaagaaaaaauaucaggcggcccaauccaggaaggcucgcccacgguccgcggauaagaucccaggccucgagaagugcagaaaacgcugagccauacacagcucaagcggcaguccaaguauggccuaaggaggccgaggcaggggcauugcggagagcuccaggccagccugggccccacaagaaugaucgccuugcaggcccgccuguuccccaugcugugcgagcccgcgaugccccgcagcccgacccaccgcccagaccaccccugccuccgcgcaccgcagcgacggugcucucaccauguccgaccgccgaaagacugaagcgcgcgggagcacggggagucagggcccgcgcgccugcgcacacgcgcccg

SEQ ID NO: 1766 - RNA, 22295 nt, Mus musculus
cagccgaagucagucugagagcucagaccucaucuguguguaaagggacucccuaggccacgcccccgaggucugcagacuuugacccgcacgccuccgcaccccuagagucuaaggcccgccccucuccucccuccaagccacgccuccugggggcgggacccccguccguuuugcuugcugcacggagguggucggaggcagcagaucgaggagccaucauggcagcggcguuccgcagaggcugcagggugagcgggugaccgggugguaucgggagggucggcccuacgcggccugggggaaagcgggagccugcgggcguccccccgcgcugccugccgcccucccucacugaucuccgggcucugaccccugcaggcguggcccugcggaccugcuucauucugggucaaugggcucagccacuucucuccagucacccacgcuucuugaagggaacccggugucagaacccugcuguggcagaggcgaucacuuccaaaaaacuuugacuguagucccaccccaggaaggcaucagugugugguucuguagccacgggcgugaacaaguguuaggauccaaacagguugauccugggugugcacagaacacaggcacaacacgaaggaaagggaagugggccgcuccgcucgcaccaacaggguuaggacgccugugguuuugugauguacaggcacccuuccaaaaaacaaaagggagacaagccuaccgaagaauuuucaugaagcuugcuuucuaaauguuguacccugcagaguuuugucuccuaagcuguuuuaaccacuaguuuguuauauuagcgauguguucguacaaaccuccauuuauaccaccuaaaacuggacugaaguugccucuggcaccgaaagcuguaguuuuagaauuuacaacaccauuacuauacaacucaacagguucugaaagcagaaauugaaggguuuuaaaguuauuuuuuauucugacaacagaacuacagguuucuuggugccuccaaggacaagagagggaaagucuaacaccauaacaaaacagaaaaugcauuccuuuauccuauuuuucacaccgggauaaaaccaagagucaaauuucuaaguaauucguuacuuaguuaugcuguaguugcgggcuugaagacuaaaguuaguaguguucccauauuggaauuccuugguuuuggcagagagccaggaauaauaaacgcaauucucuucugacuuuagaguuucagagugucgucguucuuuauauugggucucauuuuguaguccaggguggugcggcgcucacagcuucaccucugccuucaagccuggcugucuuauuuuaauaaucuccaguuaucuccuaggauuagugagccugauuuucagguguaaauacaaauuguguguuuggaacuguucccagacggguguuugcaaaacuuaaacucuauguuguaaugcuaaguuuuuaacccuguucuuuuuuuuauuguuucuaagcugucuacacacagacacgugcacacucacauacacagacagguguguucacacacacagacacacacagaccugcacauccucucugcacaagcaaugagcaggcucgugcgugcauuaagcuacucuaauugaaugacuaaugucaguauauaaggagcccaguaaugggcccgccacuuaaguuguauaaaaugcagcugaccaguuuuguagagugguggucuucauuuaaucucggaaguagaggcagaagaauugagaucccaaggcuagccuggauuccacggugggcuugggggcuauccuaaacuacuucaaaagaacuuguccuaacaggaacacaaaccaaauuauuagggccugguguggugggucaagccuuuaacccugcauuuaugaagguagaguuagggagcucucugggaguucaaggccagccuuguguacaaaguaaauuuccaaaucagccacagcuacguauugagaccugucucaaaaacaaaacaaacagcaccaccaaaaacugcacuugaacacacacacacacacacacacacacacacggaaggagggaggguggaagggagggagagagagagagaaugagaaugacugagcaauuuacauuuuuuucucauuuaauauuuacugcucuugcggagggccugaguuggcuucucaacacugauguuagguggcucagaacuauauguaacuccaacuccagagaauccuguacccucaccacacauauauagacacacaaaugaaaaacuauaaaauugaauaacauuuccuuuaugguuaggcaucccucuagcuuguaauugacguuugaguuauaauuuauuuaguacugacuuuaagaacguagcucuugaauaaaaacauagccauacagaugcugugcuugcccuggggucuguaugacaauacucauuugugugcggaugugucuguguggaacucucaguacaugcagcaagguggaagccagaagacgguggugggagugaguucucucucccaccacguggguuccagggcucaggcuccggucacccgucuauacaguaaggaccucaauggccuagccaguguuuuugcauuugguugauauuuagguuauuaaguuuacuuauuauaucuauuuuuuuuccagguccugagaaguguuucucauuuugagugucgaacacaacacucgaaagcggcucacaagcaggagcccggauuaggguuuaguuuugguaugugucccucccuuugacuugaaggucugccugggcugugucuguaacaugaugucuguugaugaguggagcagacaccgcccacaguuggcucccgguaacuuccgucugcuggacugcguugccuucuuccguaugcucucccgaaaacugcguugccuucuucuguaugcucucccgaacacucaaguguucucaggcggccucuaugguguccuuucucuucuuucccaaaugguagcccaaauaaaugaauauauaugaauuguuuucaaccuacagauuaacuguaacauacuuccuuugucuuuggagacagucucacuauauagcuuuggcuggcuggagcucuaaguagagagauaggcaggccugccucucccucccuaguacugagauuaaaggugugagcaaccacacccgcuggcuuaacaaauauuucuccaaauacucaucgguucagugguguaacaauuaaaaaauuggccugauuuaucugagcugcgguuugaugcuguuauacgguguccucagaccugagaccagguggccaugugguuuuggagggaaaagaagcuagauucuucuuuuccuuuuuacaaaaugaaacauuccgaguuaaaaaugugaaguaaauccugguuuuugguguccuucaccccuaaaggguuuuuacuugaaguuguuaccuugccucuagcuaggaaaccauuuucucuguucccuuggucucugaaaaguuccaaggcugagcugguuaacaagcacgggguccuugguggcugaacgcaucuagguuuauugacuuuauucgaguauacuugagugaaaauacauacauacacacacacacacacacacacacacaacuggaauuagacuuuucauauaucaugagcauagcaaguugaauuagugggcgugugagaguagcagccuuuacucugacuguuaucuauucucagcuuuuuuggggggcgcaggggaggcggguuucaagacaggguuucucuguauagcccuggcuauccuggaacucacuuuguagaccaggcuggccucgaacucagaaauccacgugcugggauuaaaggugugcgccaccacgcccagcuuuauucucagcuuuuuacauaugaauuccuacauacuugugggcaguuccgagaaucugacaagccucggagugccagagggugaggcagauagaggaguuugggagggaguuugugagcucagacuaaagugcagguaaugagaggacugguggaggagcgcaccuuugaccccagcacuugagaccgaggcagguggaucucuugaguucgagggcaggcugaucuacagagcuaguuccuggccagccaggacuaacugguucugauggauaaaguagguauaacaagugcaauaggauaucaugaagauuacugaguugaugaaagcagguugccaacaaauaauaauaugguagacgccuuuccuucugacuuuggacucaucugucuaaagucggaaggaauuaucuccagucuuugaagugaagagaucuggaaaaccccagcagcuccgagccccaggcuccuugacugcugcugucaucaccacgagccucgaggagccaccuccucucugccuggucuccugcuuuugucuuccugguucuuuguuuguuuguuuguuuguuguacuuaguagugaaaccauagaaaccagugugccaguccccuuaaaggaagacugcuuggugugucaucaggcuguguggaugacugacggaaguacacagcuuucagccauuccuuagucuccgugucuuaaccaugagacuugaucugucuuuuacacuuugccucucggccccauacaaaugagaacuguagauauauauuuuuuucuuuuuuuaaagacaggaucuuacuguguaucccuaucuggccuggaacucaccauguagaacaggcuggccuugaaccuacaaagauccuccugccuuuguggucugagugcuggguauaaggguguaugcugccucaccuggcuuguucuucuaagcguuggcucuuacucugauugccugaaauacccagugccaccuuuaacccucccugcccugccguguguggaggguggaauggagggccucccucacagaggcuagacaggaaagugcucccuccaccugugagcuacuuuccagccucguuuauuauaucagugcagccacauugaaacaccagguaguacagcuccaaaaaugcaguuauccauccacacuuaccccagggguccaggcagcggagucgucucauucauuuuacaauaacuaguuuuauuucguguagacccauuguuuuaauacugccuguugcuaauacagaggguucaaugugucuguuaauauuuuggggagacuucucauugcuuuuaccauuuuauuugugggaacuuauauccuuaaccuuauugggggcuuaaaagaagagugaaauuuaaaucaugguguugacguucuuccguaagucccugaaacaagcuuuauugcuguaugcugcccgagugcguacgucuugugucuuuagacugcugccugaggucagaagcuuaccucuugauagauagaaaccucugcagaacagcuucaugggccuugucucuucaacucaguguugaugaacucuuuuugauguucucaaaauaauguucccuuagaguugacggaacagcagaaagaguuucaagcaacugcccgcaaguuugccagagaggagauuauccccgucgccccggaauaugacaaaagcggggagguggguaucggguugccggggaaguggggaagucguguauggccaggagauuggguggccagccugccuaggcucaggugugcuguaccuguucuccuuucaguacccguucccucucaucaaaagagccugggaacucggcuugaucaacgcgcacauuccggaaaguugcgguaagccuccuacacguuugcuccgaaaauuacaaaaaugaaaacgcccauuucucuaaaguguuguugccauucagaggcuuucugccuuuguuucccuauuggcaacauagaacuugccugcucggaggagccugguccucacucagcacagagcacaggcaucucccugucuagaugguuucgaguuuauugaguuguucuucauauuauaacgugcuacguacacucugacgcuguagguggccuuggccugggaacguucgaugcuuguuuaauuaccgaagaguuggcguauggguguacaggggugcaaacugcuauugaagcaaauucuuuggggguaagucacuaagacaaucacuuaucauggggcugguggaauggcucaguggguaaaggcgcccccauggucugaguuccaccucuggggcccgugugauggaaggagacuacggacucccccaaggugucaucuggccuccagaagagagcuguaacucgugcacacauacauagacauacaugugugcauauguacaaaauaaguaaaauuaccauuugagaaaugcuaaucgcuuaccugggcuguuaaugagacaccgaccgugaagcuggguuaaucucuguaagaacuauaaggaagacuggcuugccggccuggagcugugauucuauagcuugaucacugugguucacuugucucccauacuggccguucuggguguccuugugaggaaacuguacucuuuggcggcagcucggaagccauccccucggccugcugcucaguuacuacgcugaaaugaacugagcaguaucuaggaggccugcucgucgugcagaccgugucacauauccuaaauuuaaucugugaucuccuuacugucaaccacgcuugugugucacuaagcagccccacccaccuauaacucaaggagaagcucauguuagucuguguucuucucgcucguuucguucagagcaaaugccaguucauaaguuuacuucuuuaugggaggcagguaguucuuauucguggaacugugguuuucugaaucuacguaacuaauuuaaauaucucgacgucuuaauguuaaucucccuugguagcaaaugccugugauucuugcuggaaaugaucaacaaaaaaagaaguauuuggggaggaugacggagcagccaaugaugugugugaguauguucguccauauuucccuguaaacgggccaggagcgcuggcucugccauucagucugcauguguuuauuggaccucgugcccugaggacagaaguccggcagacacaggcguaccuggacuguccagccggugucuuagcaaucccugcucauuuccacaagggagaguccacuuguuucuggauuccaagaugguguugagcuauccuguugcuggcuuucaggaagugauaucugcugaaccguccuucugcagcuccagaugggagcgguugucuggguguuugcagccccggcuauccuucgacucaaacugcuucauuugucauuuaaaauguuucucuggcuaggcaggguggugcaccgauuuaaucccagcacuugggagccugggggggggggggucugucuucacaucucugugcugugacucucugucuuuagggucucauguaucugacuagcuuugaacucacgggguagccaagguaaccuugagcucuuauuccucgugcucccaccuuucuauugcugggaucacagaugugugcuaccacgcaugacucaguuuauggaauguccaguuacguuaggugaugccugggacugaaucaggcccuugugcaugcuaggcugugcccccaacccuauccugcguuucauccucaucacaugcagagaacacuccugcagacaauacauggcuacagaauauccuucauuuuugaggucugacuuacacaucaucucguagaaacuggcuucucaaauccugguguuuagcacccacacuucauaugguuacccuguacccggugaaaaucucaagguggacuuccuuucagcucugguuuuccaucuggcuacuacauaauggguauucaaugaacauucaaauacaucaacauagcaagcucaauuuaaugaauuuguuuauucaauuccuaauauuuucuguaguuuauugguaugcugugucuaguuuugaauuaaguuaaaauguuuuaaaagaguacauuuuuuuacauuucagcaguuuauuugguuuucuaagaacauuguaauucuagauauucauuuaucauuacugccuucaaagacaaaaugccgggcuggagcauagcucacugguagaacccuaguuagcauaccuaagaaucuggguucuauccuggaaccucaaaacaaacaagcaaaauaacacuauugccagauauucacaauuuaauaauuaacauuuaauuuuuuucuugugucuggauauccaaggcuuacugugugacagagcccuccgcaggcucugauguggcggccauuaagaccaaagcagagaagaagggugacgaguauguuaucaacggccagaagauguggauaaccaacgggggaaaggccaacugguaggccucuucauuacuguaccuuccacgucucccuuucuucuuuuauuauuaagccuucucaguuaaaacaaccuauaguuuuaaaacugggagguccauaggagauuauaaauaacucggugacucaugaacuauuuuaagcccuugagcuauuucuucgagauuaauuuaagaagucuaaaguguaaagcgcaguaaaaauagcuaaucucacugacucugucaggcgggcucagucccagugcacagucugcuaacccucgcuugaaggaaagcagaacgcuucaguagggugguucucagcaggcuugugguucuagggaaugaaccuggagcucuguauaccagggagcacugugcugugacgcccauccccugaagaggcguucuuacuggacuguggggcugccaugcaacucaggggcuacagugcuucagagcacgcacagacccccagcaccauauaaacauuuuuaaaaagcagaccuuccguggugaugauauccaccucuacuuccaguacuuggagcaaaagugaaggaucaggaaguucaaggucauuuucagcuacauagcaaguucaagccagccugggcuacgugaggccaucucaaaaaaggagacaaaaacaucagccuauaccaaaagaggguaguauuugaguauuugauguuaauaaaaucuaaaacuuccaaauguguagaucuaaacaauaauguaauguuccauuaaacaucaaacauacagacuuuuaagaaaacuauuugaccauuuguuaaaaaaagaaaguuuaacaaacaacuguaaguuuggugggaaaucacugugggguggagaugcaccucaguggugauuucaggcugagagcccacaaguacagggcuggccaagaugagcgcagucaaggcgaggauaguccaggagcugcuacugaucuguuacaggacaagccuuuggaacaugccuagguacauuuugucugcaucaauuuugaauaaaguuggaacuuauuuuugaaauaauguuucguggaaagaagagcagagcugggugugguggcacaugccucgauccccagagcuugggaaacagguagggauaucuaagcuuaaaugucaguauaggcuacgcugagacacccaaagguagauaaaugauagauugucagacagacacagacugauagauaacagguggauugauggacagacagauaauauaugaaagaaagacagacagacagacccucuugacuuuugacuaagauuaaauggaacaggcuugcaugguuauuucaggaaggcagcuuagaauuaaugaaugaaaguuagaaaaauguaaauaaaccccagcucauucuaaggacagucuucccaauaauagggcccauauguguugucguggaaaaauagcauuuuuaacucauuaauauaaaaguacaugacaaagacuucuuaggaguggucugugggaugucgucguuacugcugcauggcugugaggagacgccacgacccagguggcucuuaggaaagaaagcaguuaaauggaggcuugcuuagaguucuagagagugagucuaugaccaucaggauaggaagcagccaagaauggagcaguagccgagugcuuuacgucuugauccucaggcagguggacagacagacagacagacagacuggaccuggugugggcuuuugaaaccucaaagcccauucccagugacacacuuucuccagcaaggccaaggacacaccuucuaauaguucucaaacaguucuacacccugguggcuaagcagucagauauagaagccuuuggggccauucucauucaaacugccauaggagauuagggaaguaauguuccuguuuguuuguuuguuuuuggguacaguuucacucaguagcucaggcugaucuuaaaaucacuguuggagcauagguuggccucaaacucaugaugguccuccugccguagccucccaaaugcuagggucacagguguggugagccagcacaauugccucccaaagaguucugcugugucagcauaccugugcaguguggaaaagccucccaccuugguggacuucgaggcucacaaaucggucccucaccaugcacagacguaaaggcugggaacaggaauaacagggucauuuaguagacucacgucagccaggaaugaggaaauagagaagccaugaaaacugaacaagcuaagagaaauauaauaauuuaaguuaauaucaccguuuugagaacuggcuauaauucuucccagaaaagauagguccagugacucaugagauuagaaaauaauuuuuugauuuuuuuccuauuaccaaauaaaagcauagucaaugauaaacugauaaauuauuuuugguuuuuuuuuuuccuaacauaaauucauugcuuaaggaaggauaaaacacuuggucggucagucgucggucagucggucgcucucucucucucucucugcuaaagcugacacuauggcucacccuggacucuaccucuaagccauguggcuuuucacuuuuuguaaagauucuuagaaaaccaaucuguaucaggauauaugggaaacuauuuuggauauggggguucaaacaagaacuuguuuucuuuuuuuuuuuuccucccucacgcuucacuucuucuagaccuuuuggggaaaugucuuucugugggaaaaucaguaaauauccuuccuaauucagguguguacuggcugugcugcauggggagggggcagcccucacggcaguggagagccugucuguguucaucuugcagauugcugguccuaugagacauagacugguccagagaggagcauuccaguucccacacacacacauacuuuacuuucauacucucuuugcagaaggaaccuuuacuaauaacucauacuccccccucccccaaacucaaauaccaccuuaguggagagagagauggaugaaucagucuguccacacaggaaaauuggcauuugugcaagcuuugaaacccaacugauucuccauguccucuucuguuaaguggggaugguaauaccgggguggggucgguaguugagauaguaguuaaggagucuuguucgucauccuuauugccacccuuguguguuugugugcguuagguauuucuuguuggcacguucuaacccagauccuaaaguacccgcuaguaaagccuuuacuggauucauuguggaagccgacaccccgggaauacauauuggaaaaaagguaaacagcguguuucuuccacuuaaccuccauacguacaaucccaacugucaaugucaagguucuuaccuguuuccuuugaugaaaauacuucuaacuuggaacaaaagucugguugugucuugaugauauggggacauaguuuacaugucacugaaaaaucuuucaagucauuuugaaagaugggaccuuugugcagaacaccuucaugacagcuguagaugugggcauagccaggcuccgcccuccuucccagaggaccugcacaggccuugcuuagggcagguaaggcccugugacguggguggaugacucacagucccacagcaacacagaucaucuguaacuugaaagcaugugacaaugucaaucagugucagcugggggcugagagagugucagauagggcagugcuguauaggaacacccaaucccaaggcccacaggaggucucaaaggugacacaauagaggacagaaauggcaugaguuguccugucgagagcucacaagccagacuugggauuacgacacagacugaaaugcuuuugcgaaguggaguucucagcgagaacucugagggaugaaggaugucugcaucuauggcauaggaggcauugugggaaccaaaccagaucugaagauuacuugagcaaauuaucuucuuaccccaugugggaagguuugaauuagcuggucagauguuggaguuggucucccuuaggcuaaacuggaagaacacauuuuaacugagacauaaaacagguuucuaaggcaaccuucgguuuauaggaucuucuguuguguccagaucucuuuagaaauguguugcuugacuaugugaaauguauauaacuuuugcugggcaugguagugcggcgucccuucaaucccaguacugcagaggccgaggcaggaggaucacaaauucuagcccagugucaacagcauacugaaacucugucucaaaaaagggacaaggacgggacuugucuuuuagguuguggaaguuaaagucuggacucuacuugcuguuuacucuagccugugcugacuacagaaaccaaggcccaaccaaaucugugauuuacugauagccacaaagguagaggcuaaccugagaugagugaucucguguccuuuacuaacagacuuggaggauuuuugccugcgacauuucugauugcuguauuacucuauguuuuaaggagaagauacugaaggcugagugcgauuuacaaauagacggcuaagcccauguuuacacaggacaugagcacugugggucaucacacuuguccccagagaucggccuuggcauguguauguagcggaucacgcucucccccauagcgucgguuucuggcagacucgggccaagccugacugucucugcuaacuggaaggaaccuuagggcaguagcaaacuggugugacaacugaugucucaauguuucuaaucucauucucacuuaggaaaacugaaucaauauuuauaacugaaugcacacuguacaguagguaaugauaaauaucuaccccuggggauucacuuucuuguauagauuauuucuagcauagauuaucagcuacuuagccuccuaaaaauauacucuuuuaaacaaauggccauuugcaagucugagagauucacguuaucagaccuguuugugcuacucuuugcuucucgaucccucucuguccucucacccuccccgcucucucgccacgugcucauggccggccucuuccucucuacuccucugcccucucucugccuuucugucucuacugcccucucaacuccccuccccaugcccuaaauaaacucuauucuauacuuuuuuuuuaaagauuuauuuauuauuauauguaaguacacuguagcugucuucagacacgccagaagagggugucagaucucauuaugggugguuguaagccaccaugugguugcugggauuugaacucaggaccuuuggaagagcagucagugcucuugcccacugagccaucuugccagccccuauucuauacuuuaaaaaaaaaaaaauguuuuguguccuagaaauuuugugcuuugacauagaucuaagaagcuuuuuaguuucugugguuuuaguuuauuugaguuaacaaagucuaguuauguagaacuuuaaguuagugcuguuuucaguuugugaaauaccguuuuagauugggcuggcacauauuucuagaaagauccagauuagaaaccugugaggcggggcuggugagauggcucaguggguuagagcacccgacugcucuuccaaagguccagaguucaaaucccagcaaccacaugguggcucacaaccauccguaacaagaucugaccccuucuucuggagugucugaagacagcuacaauguacuuacauauaauaaauaaauaaauaaaaaaaaaaaaaaaaaaaaagaaaccugugaggcuuugcagccacgggaucucuuauacagcucggcccugcccucguagcugcagaggacgggcagagacaggaguguuuggauucuauggaagcucaacucacggggcaggcacaacaggcccugccuuaggaaauucaaaaggcacaaaggaaggauugacaccagcagugcuguaacuccuaaguguuucuuaugcgaccuucucucuaggaacuaaacaugggccagcgaugcucugacaccagaggaauugcuuucgaagacgucagagugccuaaggaaaauguguuaaucggugaaggagcagguuucaagaucgcaaugggugcuuuugauagaaccagaccuacaguaagccgaucacucugugggaccuuugugguuuucagcgacuagguuuauuuuaacauuguaugugugugucuuuuuaaaugucuaccuuauuuuaguaaugguggagaggagauuguugcuuguccuguguguaguucaucuuucacugcucaguauagaaacgaauuuagcaggcucuagaauauucuuugcuagaauuccagaaaauucauccuuguguugaucauuccuguugguuguggaucacuguguauucugcuacucacuuagccuggguccguggaaggcucccugguuaaacagcaaugaccucacuaggcugugagccucagucucacaguuagcugauugauugauuggcugauuggcaauggggauaaacucaggcucuacugaaagccaaacaugcccucuguauucccagccuugccguuaccuguaauuuaaaaauaaacccaagcacgcuccuccccgccccagugacgucacuuccugucuguguacuccuucgcuggaaucaggccauaagcuguguggcuugaugacaaugugaauuuuugcuucacgugaugcucaucauguucuaggucgcagcuggcgcugucgggcuagcccagagagcucuagacgaagccacgaaguaugcccuggauaggaagacauuuggaaagcugcuaguggagguaaucucccuccuucccuccuucccucucgcucucccucugugugugugugugugugugugugugugugugugugugugugugugugugugugagaaugcgcauauagcacaucuguguggagaccagaggaccacccugguguccugcugcucuuagcaguuugguuugguuuuguugauguauccucucccacuggccuugggcuugcacuuagguuaggugagcucaaggcaucugccugugccugccuccauggugcugggauuccuggcacaagccucaccauccaacuucuucacauggguucuggggaucugaacuccgguccucacgcuugugugacaagccuuuuccugacagcccucucuacccagcucuugaggugaccuuagcacuaugcuugcuuuguugacauuugaagacacgcaaugcgucuaaauauuuagaaguuacugcuaaagaacaaaauagucuucucuauuuuguggggaagaagauucuaagcuuucaucacuguugccugugagagcagaguuccuuuuggcuaugucgcucacaguugaucacucuguaaauuguuaagaaaaagaauauaaguauuacgugccgucuguauaacugauacucugcuauaggucuuaguguguguccucaguaaauauguuuuugguaggccaggcuggccugacacucacugagguccacccgucccugccucuugagugcugggaugaugugugccccaucaggacacgggcaccguucagccuggcuucaugacuaucccugugggucgucagaaacaucacuucuuuacuucuuucugccucagcucccgcuucaguaaaguggagugguggaagaugacucccugucuggauccaucugaugccauggcucugggcuuuccucugcacggagcuccaugccuccaugugcaggggucuucugucagucugucaguguccggccauccucucuggcuugauucuccccacauaugcucuuucaucucuuucuuucuuucuuucuucuuuuuuuuuuuaaagaucuauuuauuauuuauauguaaguacacuguagcugucuucagacacaccaguagagggcgucagaugucauuacgggugguuguaagccaccaugugguugcugggguuugaacucaggaccuucagaagaauagucaguguucuuaaccgcugagccaucucaccacccccacccccuccccccuuuuuucuuuuaaaauauuuauuuauuuauuauauguaaguacaccguagcugucuuagacacuccagaagaggcaucugauuucguuacagaugacugugagccacccugugguugcugggauuugaacucaggaccuuuggaagagcaguuggcgcucuuaaccccugagccaucucaccagccccccuuccccuuuuuuuaagccauuuauuuuauguaugugagcacacuguugcuaucuucagaaacaccagaagagggcauccgaucccguuacagaugguugugagccaccaugugguugcugggaauugaacucaggaccucaggaagagcagucagugcccuuaaccacugagccaucucuccagcccccuuucaucucuuucaaaucccucuaacugagccuccagcucacacguaaccucccagcauuaccucguacaugguguggcgauggcgggcuccuuacucucaccgcaagcuguuccaccugagauagaguugagucacucguuuacagauucuuuccuuuguacggaaaagaggcucugcaguuucuacucucgggaacauuuacuuuggagaucaguuauucaucauagaacaaacacuuaacagaggauacagagccaagauuuaaguccccaaaugaaaccuauaagguggaguuaccaaagucaaaggagagaggguacuacguguugaacaugucacagagagcaacucuucuuaugaaucacaugcagcaaucaauaaaagcaccuacuuuggacccauauuuuuuuaaaaacgcuaucccuggggcuggaaagacagcucagccaguuaagagcacuggcugcuccucgaggggacauggcagcucacagcugucaguaguuacuccaaucccagggaacgucacacccggcacgcauguggugcucaugucugugcgugcagcccgaacacccauacacauaaaguaaauaaaucuuaggaaaaaaagauagcacuaagauagcaccugugucacaucuacccuucgcuucagcacuacgcagaaauaagcaaaauauuaacgacccacggaagagggauggagucugagcaacuacaaaagcucggagaauucuucaugcauugauacagcuggguacgauuuacugaccagaaaagcagaaugaaaaacuaucagcccgggcggcauuugcauuccaguguguacacugccucugcaaagaaaacagacugauaccauugcuuaccugcugggagggggcugggugggugggcaguaggcagggaugacugaaaggaggggaaauguuuaccaaguaucccuuuacuuuuggaacauuuacuugguggauauucugucuauucaaaaguuagauucuagccagacauaguggaccaugccuuuaaucccagcacucaggaugccagugcaggugaccccauguuuagaccagccuggucuacauagcgaguuccaggacaaccagggcuacauaaagagaccuuguauggaaaaauaauaauaaggguaugggggacuuuugggauagcauuggaaauguaauugaggaaaauacuuaauuauauauauauauauauauauauauauauaaagaaaauaauaauaauaauugaucuagagaggugacucagugguuaagagcacacgaugcucuuguagaggcccugggcucuuaccaccacccaccuagccgcucacaaccgucuguaacuccaguugcagcagcucugacgcccucucuggccugugagggcacugcaugcacaugguguacuuaaauacauagaaguaaaacaacacauaaaauaaauaaaucuuugaaauuaaucccaagucugaagucauaacacucagcaggcugaaacaggaagaguuuuaggcagcguaagcuauauaacaaaguccuuuaaaacaagcaaacaaccgggcguugguggcgcacaccuuuaaucccagcacuugggaggcaaaggcagguggauuucugaguuccaggccaaccuggucuacagagugaguuccagggcagccagggcuacacagagaaauccugucuugaaaaacaaagcaaaaaaaaaaaaaaaaaaaaauccaaaagagaaaaaaauaauuugaaucaauuugugauauugaaacagaugacagaauaauugauggggaacuuggccaaucuggcuagggucuuuagagcucugaauguucgggccuaccgcccucaucuuacaguuaggggaagccggguauaacuuuucugcaagccuacaacuagugcaaaauaaaagaguuuuaaggaaaaaaaauuacaauuuuuuuuugagaugcccuuuaaccauuuccuccuuaauucuagcaccaaggaguuucauuucugcucgcagaaauggcgaugaagguugaacucgcuaggcucaguuaccagagagcagccugggagguugacuccggucgccggaacacuuacuaugccucgauugcaaaggccuuugcuggagacauugccaaucagcuagccacugacgccgugcagauuuucggaggcuauggauucaacacagaguacccuguggagaagcugaugagggacgccaagaucuaucaggugagcccuaacgguuuguuucugagggcacaggauacucacaaaugacagcaguagguaucaaacaacugcuaaugacauuuggaccagcaaaauggcacuuguuaccuaccgcccugacaaccugaguuggaucccuagaauccacaggguagaagaagagaacugacuccuaaccguugacuuguuaguucuguaugaauguaaaaacagcuagauagacuaaaugauaguuauagauuggugugggucgggcuuuauaaucaacacauaaaaggaaugcuauuaaguguagcugcuaagagggaaaggguuacaccaguagauggcacaggcauggaucaccugucuaaugcugccuuugagccuucaaaauuuuuuuaacaaauuacaggcuacauuuuuuugccucugaaaauucuauaugcuugucuugucuuggauguuauaugacaucucucucuuuuuuuuaaagaucuauuuauuuuuauaucuaugaguacuuuaguacuguaucugcauguauacuugcaugucagaagagagcaucagaucacauuaguuagauaguucugagccacugugugguugcugggaauugaacucaggaccucuggaagagcagccagugcccuuaaccacugagccaucuuuccagcccgacuucucuuaauuaagugaaacuuuauuuacagucaaaagccaugugucuuugagaacuaauacuugacucugaaauuaaguuggcaauuagaaaaaauuaggguaacuucguaaagaagauaggaauaugcauguucuccauugugaguuauagucugugcuucuuagugccccaucuucuucugcacaccccuagcaaacguucauacaacagaaagccuuguguccuuagcccuacagaagaaaagccccguaacuauaacauuaucagcacuaaagauuaggggcuggagagacagcucagcaguuaggagcacuggcagcucuuacagagggccuggguuugauuuuucagcacccacaugggagcucauaaccaccuguaacaacaguuccaggauaucugaggcccacaaacaccagacauucgugugguacacauccauacauguaggcaaaacacucacauacguaaaauaaaaauaagucauucagaauuuugucuccacaauucucugccucuacaggcaagucuauucaagcacaggaaaacugaacacugcaguucguauacuagcugucuuagucaggguuucuaguccugcacaaacaucaugaccaggaaucaaguuggggaggaagggguuuauucagcuuacacuuccacauugcuguucaucaccaaaggaagucaggacuggaacucaagcaggucaggaagcaggagcugaugcagaggccauggagggauguuacuuacuggauugcuucuccuggcuugcucaaccugcucucuuauagaaccaaggacucccagcccggggauugcaccacccacaguggacugggccuucucccccguugaucauuaauugagaaaaugccggaucucauggaggcauuuccucaccugaagcuccugucucugugauaacuccagccugugucaaguagacccacaaaaccagcuaguacacuagccaagucaccagucuuccuggggcucuuuugccccuccuaaagccuguaucuguuccugccaaccacuugacuuucccuuaccacccaacagugaaugaaugcaggagacaccaagguuagaaguguggaaugggaaagaugguggauuaccagggacuaaagcccaaagccuccaaucuguauaauaguaagaacagaaugagucaaggacacagccaggaauagcugaggaaaacuagauaauaaauccucuggugauacuaaacauuagaccucccaaacaucuugaaauguaaauguuauuuucuuugagguuuuaagccugccuucuaauuuugcaaaauaauuuuuuauacuuuaaacuguucuaauaaaauaacauuuugcuggcuagggauggugcacaccuuuaaucccugcacucaggaaucagagacaggcagaucucugaguuugagacuggccuggucuacagaacaaauuccaggagagccagggcuucacaaagagaaaaccugucuugaagaaacaaacaaacaaagaaauaauuuauauguauacauauguauuguguauauaauuaaauaaauuuacauuaaaucauacacuauucuuuauauuuaauauauaacauauaugacuauauuaauauaauauauaacacauuauuauaucuuauauaauuuauaugguacaugauaugcauauauacaauauauuaugcauaauauauuagcacuauauauacaguauaaauaaauauauuuuagaauauauuaauauguuauauuaauaugauauauaauauuacuaguguguaaugcuauguauuaauuuuuauugauugauuguuauuaguuauaaauuauauauaguauguguaguauuaauauuauauaguacguaauuauauaucauauauucauauauaugaaauaacauuucaauuuggugcuacaguagagcugagacaucaaaugaauccagauguuuaaacuccauuguguuuaucuuucagauuuaugaagguacugcacaaauucagaggcugaucauagcucgugagcacauugaaaaguauaaaaauuaacaggaauuacuauugaacgaugcaucacccucguguaacuaagcuccaagcacuguugcugcuucaggggaaaagggcuuuacugucuucccaaggaaaugagaucaaagacgaguuuggaucugugcagcggauucccauggcggaggaaccugucuucagcucuauggugacccuuucuagauagguuuggcuuuuggacaaugauugguccuuagccccgaauuguguuaguuugcucuuugaucacuuaaaauggaaaaacacccuggacuuuuaauguucauucaagugacaggaaaggcggcuugucaaggaagaacucaugauucuaacauaaacacugaaaauuugugguagauuggacacgucagacugugacauagcagcauuucugugcugaacuguuaauuuuauaauuuugauuauauuugcuuuguuuugcacaaaagaguaaaaaguuuauauucauauucucccauuauaaaacuaaaacuuuucugggaaucuuaguacugaacgagaauuuuauuugucuuguuuaaaauaauucaauaaagcuaaccuuaacuuauuuuu

SEQ ID NO: 1767 - RNA, 20670 nt, Mus musculus
caauauggcugcgcccauggagaagaaggcgcauuccagagcagaaagccgaccccagcucgcucgcucgcucauggaccguagcgcggaguucggccgguggaaggcgcagagucugagcaaggcggaccuuagccgcaagggcaguguggacgaggacgcgguggaggugguggagcuccugaacucgcgggaagaguuuuucaccaccagcuccugcgcagggcgcauccuccuucuggacggggugaggcccgggccgggggaggcugugcaaugcuaaugcguccuccgggugaugguggagcuagcuuaaguggcgaaggcuggggauuggauuuacagagcgcuggaggagcucgagucuccaagucccuucggucacgcucgcccucgagccgcgcuaacccaaucacugucgcuaugagaugggcgcccgaagguuaaggggucgcugcccccugguggccggugucauuauuacagcccugggcauuuuagcucuaaaugaaacaguacuguagauacauggucaaagccccuggcugcacgcucucauccucuuccugucccacaacacaggauaacuagacaacacgugaaauaggguaauuuauuuccaacauuucucaucgugccuggccccauauugcugguuaaaagucgcuagguuccgcuugguucuucacguacugaagucccagauuaucgaggucuguucauguuuauauugcuuccaccacucccguucuguucauggacacucuugcucacaagcuagcugcccacaccucuucuacaacugcccugccuggguuuauucagacgagucuccaaaacacuguugucucuucuccaagccauguuucacaacacauucauauguauaugcauaugagggaugcauacacauauauguauaauauauuuauaaauguauaaauauauauguauauacuauguguaaaauaucuauaaugaaaacauauuauaauuaugauuauacaaaauauaaucauaauagaauaugauauauauuuuauauauuuucauuuuuaagcagaauuuacuuuagaaaauccaaauuuauauuguucuguaaccugcaauccuuuccucauuuuaaccaacugccaagauugaacuauuuucuuuaguuacuugucuuugucuuguuccuguucuucauuuaggaguggcagaguacugagaaccgaacuuagggucucgaucaugcucagcaaacacucuaccacugagugaaacuuccagccuccucccuaccuuuuguuuuuuuuuuuuuuuaaaccuucuaaaacaggaucuuucaaagcugcauagacugaucuugaacacauuuaauagaccaagaacuccuggaaccugugguccuccugccucagcuucuggaguagcuguccuauaaugcuuccccuauaucuacauagcugagacacgacucuccaagcuccacuguuaugccagacacagaaagaggugcagacaagcacagugcccacuuaagaguggcuguccauucugaguugucauaggaugcuuucugaaccuugucuagcuuauguaucuuauacuugguggcuauuuauuuuuacucugcuuuauuagaaaagaaggaaagugaaaaaaaaaaucaggguggagaaaacauagguaagccagagauguuccaagucguggugugacauuguguacauuugcuaagcauaaaccacucauuuggcucggagguuguuuauaacagccagcccauguuccuagagccucacuaugaaaaccggucguucagggcccacgcuucccccaccagcucccagaggagccuccagagcuuugugugcgugguuguuguagagaugcgguggucuucaugugugugguuuucugcucucccuuugcagacucugagggaaggaucuguauauaccgauuagaauuugcaaagaagcaguguuuaggucgcuguuggaaugacagccucuccagagcuuugacacauugcuccucgcugcuuugcauaugcagucuacuuuagggaucucaaauacauuuccauaguggugaggaacaugucgaaaggugugcccaucccagacgucagcaaauggucggccuuccguaguguuagccacccuguucuacaggaggugccuucucccuuuuucacuuuuuuauggugaaauacugcuaacauauaaguccuucauccuuuucuuccagcaaacacaugcccagagaggcuugugacccaggguaggugugcucagcugccauucauaagaucuuggguuucauccccagcagcacaacacaaacacagaagcaaaccaaaagcacgccccuguuucugaagacaccugaguacuuuuaccaucugagcccuaaguuacuugaauugauuuuucuccuagguuaucuuuacccaaaauacacugaauuauuuuucagucaucuuucugaguacuaacuuaagaaugcccaccauguucuacaaugcaaauguacucaucuugcuaaguuuuacaguugaguugucugucauuuuagagcacagaaggcucuggaguucagaagcaacacugcugcuggcugcuggucacacacaaaccgugugcgagagacgaugugguaaguuuuuaaguuaaaaagugaucugcaacucagcagggaggccugccucuucagcagcacagaggugagggugggcacauggcucacuggguucaaaucucacauucagcucuguuauuuaauaacuuugcaaccugguaaaaaaaauauaaaagaagaagggacuucacucugccuugcuagcuucaauguuggaaauaagaguauaucauuuaccacgaucccuucuggacacgcucauggcugugcccagugugucgucucugagccugcagagugagcacagggaagguuguaccaggcagagaccuucccuccgggucccuguggacauccggccccauccucugcagaaaugaggaaaggagagaaguggacacaaagagguguggcugguuccagcauucucguguggaauggggagggcuccaugcccuucauaggcuccacaggaaacuaaguaaaauaagcaaagaauaauguuuguaauaaaaaugagggcagaggacgcagaugucucagacagaguggguagugagagcuagaaugucuaggaagcagaaggugggugggagaacagguugacaggacagggcugggcagccgcaccucaugcugacccuugguucccucagauggcagcucugaagggugcaaccagcgaagcuguuuugaaguuugaaccuuuuauccuccaugugcaaugccggacacugcaggacgcacaaacccugguaagacguugaacuugcucuugaauugagaugucuuucaguagaauuaauuuuaagcuuuaagccaccuuuuaaaauuauuuaauguugauugauucagcuaauguuuugacuuaauuguucucauauguuugcuuggucuagcuauuuaugucaaguguuaggaguagggacucccggucaucucugggaaaguaaaaugaguacccacaccuggcccgcggucucccucagcgggaggauucauguggauuucacagugcugugucuuugguuuucuggcugaguucuagacgagagcucaagaacugcaugucugaggucucccugcucaccuacaccuuuuacuccauuacaugcagagucgucucauugcaacauaauuuaguaaaucaugagccacagagcauccggguagagcugugugcaguccuugcucacaagcugcucugaagaacucccugaagcugagacugaaaaggacgaagcagaguuaggccugcagcugggagaugaagauuccgagcagauuagaguguucccuguuucagaagcaagaaaggucugguguguucacagagcagaagaagcaggccauagaggggaggggggaugaggagagaggaagauggaggccucuaggccagaagaggucugguugccuugucaggcaagggcuagcugcaaaggcuuggcgcacuguacuuugagagccuaguucugccacaguauauuagggcucagcuguaguguccuggagugugguggcauggccugagaggacaccaaagaacaugagagggugacagagucaaaauguuuuagcuucugcauuaacagagugaugaggccgcucaagaauuagacagccugaggggagaaguggugaagagaucacagcagugccauagugucacagcgcccuagugucacagcaucacagcgcccuagcaccauagagaaguguccaggcuucagacgugcgucuuauucuggaugccuuacagacaaccaccucucccuugccucucucauggccuuccucugugaaugcacagcaguggcaucucuuauaaggucaucaucaccccuguugacuuaggucccuaccuugacaaccuuauccagcaugaccaacauaaaggcccuuucugcaaauguugucgcugggguuagcacaacuugaaagccacuucaguucuaacaccaaaaugugguugguguuuguguaaaaggcugcucuggaguauagacuggccugcagaugcacacuggagagauguuagcaugcaccauuuaaagccaugugcccggaagcacucacuguggagagagugagaggaagcaggaacacuuagacacgcuuucaaagccuugguugagacacagugcuccgcagccugcgacuuuguuuccccuagacuuggaucugccuuguucucaucuugcuccagagcaaacaccagugcugcguccacaagcuuuacucaccauccauaucucagugcugucuuaguuaggguuccauggcuguaaagagacaccaugaccagagcaacucuuguaaagaaaaugucuaagcaggacuggcuuacagcuccagggauccgauucauuauccuggugagaagcauggcagcauucggacagauguaguacuggagaaggaucugagagcucuacaucuugauucuucugcagguagccaggaggaaacuguucuguacuggguggagcccgaguauaggaaaccucaaagcccaccccacagugacacacuuccuccaacaaggccauacuuccuaguaguuccacucccugugggccaagcauucaaaaaacaggcucagggagccacaccuauucaaaccuccacacaggcccagguccaguucccagugcuaaucccaguggagcccggaugcgcucuccugggccaaagcugugguggaagucuaacaugcugacugcaggugagagcucagcaguagagcacaauugugcccugccugugagcacacucaguguugcccagccugucagguaccagagaagaguagaaagggccucuggugucuccccauaguugguauuuauuccaggggagggagacgagcagucagaagacagacacuuucucacugggguaagugcuguuggcggcauggucagggcacugugcuagagagcagugaggagaagcuccaagcccaacucucauagcugcggcuuucuucaggacuggaaaggaugcuaagggagcuuuccccuuucuuagagaaaucgcuucauuuguuugaaguuugcuucugucuagcaugguuuggucaucagccguagcuugcggucacuggccagagccuguguuacccucuguuggugacguuuccaaggcugcucuugggguguguguaacaggcauugugauggcuuugaagcgcaguccacacagcccagcacaucaguggguuuauaguuaucuguuucugccaccgaugggacucagcugagggucuggcuuguuggcacaccacaaccuagggugcuauguuuucuuacagcacucaguggcaauugauucuggcuucaggaacucuggcaucaccgugggaaagcgagggaagaccaugcugguaaggugccauuggcaggaacaguucuguaacugcugucuuuucuaccugugccccaguucccaaauaaggacucugaggauuauucaggaguaaaugccuaggccauaaguuugggcuuguucccaauucauuuauccuguuuaagcuggucuaaguucuguuauaugacucguuaccacuccucagcuuccuguguccaacuuccuagaguccagguggugucuucccgccugacuaucucccagcauuccccucucugugucuggaugccccacccucuaacccugcaucagcuuacuggccaucagcuuuuuauugacaggugaugcuuccacacaguacagagacucucuugacacaguucuguaagucugacaugaacaagaucgcugggacugucuguuagcacuccugcccauucccuccuucucagaauuccuuacuguugucuggaccccaggaaaaguguacaggccccuccuuaaauaggaaauccagacuuuggauucauaucugagucccugcuuuaaaccacacucucugcuuacuuugaaccuguuccuugcucuacuggccucauccugagacauccaggauaaugggauaaauaugguugugcuguguagagagauucauaugcaucaagucuuucauaucgauacaagucuuucauaucaauaaucucuguccacggcugugcuucauaaacacgugcgagcuccauaaugccugcaucuguugucuccucagagcucacacagaucauuacccuugaaccaaguccagccuguggggagcaguucacucuacccucugaugaaugauugcacacagcuugcuguguaucacugcaucaaaacugaguagugugugaucugcaaaagcaaggaaauuucccuucacagaaaauguuugccagcccuugaccuagaugaccgcaggguccuuccagccugucccugucccuuccuggccaagccggcccacaguaauuuugcccaauucugaucucugguauuugcuguucacacagcacaggcuauagcugaacauugucaaauuccugcuauucuagauccuuccacucuuucuauuuuuaagaaggagccuauuucccaaauagagguggcuuucaaggaacguaaagcgugacuaaauagucagucaaaguccucacucuauaacauaucaggugcccgaggaaaaguucacacguuucuuuaucuuucucuccauuuuucccuguuuccaguuagucacuggucugaucguaucugccucugugccuuugccagccaggcccugcacccuggcccugguccugaggcagcacccgcaucuaucgccucauuucuaagauugucuccugacaggcuucugugaggucuccuucagcccuuccagucucugaccaguauugccagaaucucuccuuaaaacacaaccagggucucccugauacucacaggcuuaaacugugugugugugugugugugugugugugugugugugugugugugugugauguuccagccauguaaucuguucuaccgauguugcugcuaugacuagaacauccacuguuuuuaugucugaugaaauuguccuuggcccuggaaauaccacucaaaugcuugcuuugguguggagcugagccucagacuucaccagagcaucugucauguucugcuccaauguauauggaguucuguaggcuucuuguauguucaugggcaucucuuucuuuagguuagggaacuuuucuucuauaacuuuguugaagauauuuacugguccuuuaauuggggaaucuucucucucuuuuaugccuauuauccuuagguuuuaucuucucauuguguccuggguuuccuggauguuuuggguuaguagcuuuuugcauuuugcauuucuuugacuauugugucaauguuuucuaugguaucuucugcaccugagauucucucuuccaucucuuguauucuguuggugaugcuugugucuaugacuccuuaucucuuuccuagguuuucuaacuccaggguugucucccuuugugauuucuuuauuguuucuauuuccauauuuagauccuagauaguuuuauucaguucuuucaccuguuugacuguauuuuccuguaauucuuuaagggauuuuuguguuuccucuuuaaggucuucuaccuguuuaccuguguucucuuguauuucuuuaaggggguuauuuauguccuucuuaaauuccucuaucaucaucaugagaugugauuuuaaaucagagucuugcuuuucugguguguugggguaaccaggguuuacauuggugggagaacuugguucugaugaugccaaguagucuugguuucuguugcuuauguucuugcccuuaccucucgccaucugguuaucucugguguuagcuggucuugcugucuuugacugcagcuugucccuccugcaagccuguuugucaguacuccugggagaccagauaucuccaggaggaauuuggguauggagagcuguggcacagggucagcucugggguguagacagaaaccagaaggauccuguccucagcuguuccuuuguuccuguguccugauguaucuaucugggaaggccccucuugguccaggaguuugagcagaagugguagucuuaccugugcuugcaggugugucaggacuccuggaagaacagcucucuccuggcaguauuugaguauggagagcugugcacaggcuuagcucuggacacagacggaaacaugauauuagcauguuucauuugugagugugugcacacauacaaggauucaugugcuucuucugucaguuguuuauuucuaaaugugagcucuuauaggcaggaaccaggcuuuucucggcuacugggaagcuaggaaagauccauuacaugaguuucuauucuucagugcaagugggcuuuguuuguuuuguuuaguuugcuucugugcuuacucuguacccagcuuuggggcgcacaaggaugggcugacuguuuccgugacaguugcugagcucacagccucauagcccugaggaggcagccgugcugcaugguggaggaagcagggcuuccugauugccguccucagcucacgcagaugcuccaagacacucauuuuuccuugaggccucuguugaugugucaucuauuucuguucuuuaaaucaugugcuaaggcuucuaagccauagugagauugaaacuguacaaaguuauuaaauucuuugauaucaucuccuucucugaaaaaggauguauagacuguccuugcagaagucuguuucaucuccuuugguugguuugagguugauaaauuccaugaggucaagggccuacaagcuguaacggaaguuaacuguucgaaccgagcccugacugggacuugacucaacuucagaggcucuguucuucacgucuaaacuccuaccuauuccaggcuguccgggguacacauggauuggaagucccauuaacccacaagggaaagcugauggugacagaggaauauauugaguuccuguuaacuauagcaaaucagaaaauggaggaaaacaagagaagaauugggagguacagucaauuauuuauucccauguuacucgcaucugcccacgucauacuuggaauuggggagcauguccuuauaguccagacugcuuagauacucaucucuguccuacggaggaaaggaagguuaacugaggucugcaguggaacuagagccacugagaagggcgcuccaugauugcagaaggaggcuuugcagaguagauagaggugaccaccaguaacacugcuaaagagagucugacagcgguggggacagcuugaggggaguugugcacacugccuucuccuuucacccugacagugucuuagaccccaggcuaguucaacaaccagcuauugucauggagaaaaucuggaauugccuuguuggucaacuaggaaggagacuagauuccaaugcacaucuuucuacuguggcucuccaguuggaccugcuggcaaauggaugaacuuauggugcccuuuaaacagaguuucuguagauguugccugccuucuguguacaagcagugccacucaaguccccuagugcaugacuguguacguguguggacaucugugugcaugacuguacauguguggacaucuguguacaugacuguguauaugugugcauguauguauaugugugagugcauguguguaugcaugcauuguaugugugugcaugaguauaugcauguguguauauguguaagugcaugugagcaugacuggguguguggggugaauggguuugcauguguguugcaugagugugugcgugugugugugugugugugugugugugagagagagagagagagagagagagagagagagagagagagggagacagagcaagccaaagcacacuguuguagaggucagaugacaacuuugugaauuacaugauuuugaagaugaagcucacaccaucaggccugugugacaacuucuuuugccuccugggccaucucacuguggcucaccaguacaaguuguaccuuuccaaguuacagagcgauggacauuuuuauguaacuucccuuguucuuucuccccacacuuuuagaagucucacauuacaccacugccuaaguaucucucggucagucauuuuucuuuccaucuacauugccucucucuucaagaccuguaaagcagccccucaggcugcucucagugcaggauguagacaggaugucugucugucugucugucugucugucugucugucuucauguuagugggucucugcauugaugucagagucaugucuuuauacuggagaagagcccgugccuugucuugccugccugaacccccuaacuaccuagagauguccaacugcagcuaagacaaaggugccagugacaacagugggaccuagucucuacagcagccuggguucaacccugucccaccaagucacucagcccuggucugucacgacacucuuguauuuugauugugucaucaguaacuuaggggagaugccaccucagagaagaguugcccucaucauuaaguagcguauacuucaugauaggcuucagcaccugccguggacgcagaacagggagcccuuccuccuucgccacucacaacucugaaggcuagaauuccuagagguacugaaaccuccccuagggagcugugugaccuguaccagacuggagugggggcuggggacagcugauuccuuaccacaguugucaucucagcaugcagccugaggauccugguuuaggaaaauugaugacaaauccugccacaaagcauggacaaucuaaccaaagcaaagccuucagguaggcagcuggcaccugcagacaugaucugcgcacggacacccaccaccacagagcuuacuguccaccagguagacugggcugugggaguggguacaauaccacaggaagcagccguucaguuucucguguuuucugcccugaauuccaacaaguuuauaaauauagcacaagaucaacuaacucuacaccuggcaaaguuaauugagccaugcucaccaaccauaaaaucaaauuaugaguuaaauccauugacucaaaaauguguuuugagaugauaguuugcaugccgcuaucaagagagcaggcucaucauauaaaaucagggaaaaauuaaagaaggauaaaagugucuuaagauccugauuagaagaaugcguguggauucagagugugcgagcaaauuagggcuccucagggagcagccagaugcaggcacagaacuccugauccuaggagcgaaagggcuguuagccacgggcagguauggggagggacauaucucucaaagaauuuggaagccucagcccaacaaguaacaguugaucaaccacaaauagcuuagcagcaugacaauuaaaguugaguuaaaguacuuaaaaauauuuguguauguauguguuauuuguguacauguguguguauagguaugaugcauguguguauggcguaugcacaugugauagguaugcauacauaugugugagugugaaguaugucugaucacauguggcauauaugugagacugguguauguguguaugguguaugugcacauguguacaagcuuauguauguauaugauguauguaugugauaccugcagaugagugcagauauguguguggugugugugugugugugugugugugugugugugugugugaguguggggaaggguagaugugugugguaccugugugcaaguguacauauguguaaagcccuguguccugcccugucauucuuuaccuuauccccuugagacagggcuccucacucagccuggugcuaggguggugucaggaagucccggcaggcagccuucugggcccuguagcucacaugagccuuuuacacgggugccaggaucugaaguccgguccucaugcugaugcagcaagcacuguuaccaccgagccgucuccucaugcccuaaaauagucuuaguagagaaaaggucuuguuccuguuccugcuuaugaagcgcaguucccacgccuguuucucugugggaagggacucagccaacagaacagcggagagccugcagugucuggagcuaggcaggacaguccagggagcauggccugcuuuguaaagagccaauuuggagacuggaagagacagggacugacagacacuguaagauauuucauacauaacaacuuccagguggaaaacuccaaguuuguaggucugccucugacuacaagaggaaggguuucggugucuguuagcagaagguuaagaccuggaucccacaaagccauguggcccugaguagaaagaaauuaaccauguucuucuuuucaucagcuguguaauaaaauauuaaauaaaacagaauaaagggcugaauauauuggcauauaauauuguuaagaauaaagaaaucagaaaggcaauguaauugagucuguuugcagcaguugaauuuuuuuuuuuuaucuuuuuuacugugguaaaauauauguaacagaaauuuaccauuguaaccaauggcauugcgugcauucacaugauuaguaaccaucaccauccaccuucagaaccuucauccuccugaacagaaacuacauccucugagcaccagccacucucagaacaccccauucucugugugugugcaccagacucuguccuguuguguagcugcugucucuguacucuguuguguagcugcuauuucuguacucuguuguguagcugcugucucuguacucuguuguguagcugcugucucuguccuguuguguagcugcugucccugcacucuguuguguagcugcugucucuguccuguuguguagcugcugugucuauguacucuguugugucacugcugucucuguccucuguucuguuguugcugucucuguccuguuguguagcugcugucucuguacucauuuguguagcugcugucucuguacucuguuguguagcugcuaucucuguacucuguuguguagcugcugucucuguacucuguuguguagcugcugucucuguccuguuguguagcugaugucucuguccuguuguguagcugcugucccugcacucuguuguguagcugcugucucuguccuguuguguagcugcugugucuauguacucuguugugucacugcugucucuguccucuguucuguuguugcugucucuguccuguuguguagcugcugucucuguacucauuuguguagcugcugucucuguacucuguuguguagcugcugucucuguacucuguuguguagcugcugucucuguacucuguuguguagcugcugucucuguccuguuguguagcugaugucucuguccuguuguguaacugcugucccugcacucuguuguguagcugcugucucuguccuguuguguagcugcugugucuauguacucuguugugucacugcugucucuguccucuguucuguuguugcugucucuguccuguuguguagcugcugucucuguacucauuuguguagcugcugucucuguacucuguuguguagcugcugucucuguacucuguuguguagcugcugucucuguacucuguuguguagcugcugucucuguccugugguguagcugaugucucuguccugugguguagcugcugucccuguacucuguuguguagcugcugucucuguauucuauuguauaguugcugucucuguccuguuguguagcugaugucucuguccugugguguagcugcugucccuguacucuguuguguagcugcugucucuguauucuauuguguaguugcugucucuguccuguuguguagcugaugucucuguccugugguguagcugcugucccuguacucuuuuguguagcugcugucucuguacucuguuguguagcugcugucccuguacucuguuguguagcugcugucucuguccugugguguagcugcugucccuguacucuguuguguagcugcugucucuguauucuguuguguaguugcugucucuguccuguuguguagcugaugucucuguccugugguguagcugcugucccuguacucugugguguagcugcugucccuguacucuguuguguaacugcugucucuguacucuguuguguaacugcugucucuguccuguuguguaacugcugucucuguccuguuguguagcugcugucccuguacucuguuguguaccugcugucucuguacucugugguguagcugcugucccuguacucuguuguguagcugcugucucuguccuguuguguaacugcugucucuguccuguuguguagcugcugucccuguacucuguuguguagcugcugucccuguccuguuguguagcugcugucucuguacucuguuguguagcugcugucccuguacucugugguguagcugcugucucuguauucuguuguguaguugcugucucuguccuguuguguagcugcugucucuguccuguuguguagcugcugucucuguacucuguuguguagcugcugucucuguauucuguuguguaguugcugucucuguccuguuguguagcugaugucucuguccugugguguagcugcugucccuguacucugugguguagcugcugucccuguacucugugguguagcugcugucucuguacucuguuguguagcugcugucccuguacucugugguguagcugcugucccuguacucuguuguguagcugcugucccuguacucugugguguagcugcugucccuguacucuguuguguagcugcugucucuguccuguuguguaacugcugucucuguacucugugguguagcugcugucucuguacucuguuguguagcugcugucucuguccuguuguguagcugcugucucuguccuguuguguagcugcugucccuuuacccuguuguguagcugcugucucuguccuguuguguaacugcugucucuguccuguuguguagcugcugucucuauacucuguuguguaacugcugucucuguccuguuguguagcugcugucucuguccuguuguguaacugcugucucuguccugugguguagcugcugucccuguacucuguuguguagcugcugucucuguauucuguuguguaguugcugucucuguccuguuguguagcugaugucucuguccuguuguguagcugcugucccuguacucuguuguguagcugcugucccuguacucuguuguguagcugcugucccuuuacccuguuguguagcugcugucucuguccuguuguguaacugcugucucuguccuguuguguagcugcugucucuauacucuguuguguaacugcugucucuguccuguuguguagcugcugucucuguccuguuguguaacugcugucucuguccugugguguagcugcugucccuguacucuguuguguagcugcugucucuguauucuguuguguaguugcugucucuguccuguuguguagcugaugucucuguccuguuguguagcugcugucccuguacucuguuguguagcugcugucccuguacucugugguguagcugcugucucuguacucuguuguuuagcugcugucucuguccuguuguauaacugcugucucuguccuguuguguagcugcugucccuguacucugugguguagcugcugucucuguacucuguuguguagcugcugucucuguccuguuguguagcugcugucccuguacucuguuguguagcugcugucucuguccuguuguguagcugcugucucuguucuguuguguagcugcugucucugcacucuguuguguagcugcugucucuguacucuguugugaugugguggaaggagcugaaggucuagcagaagggaagcagcaggcagagauggaaacacggugcucaacuagacauggcaccugcauggcuggcuucaccugugagugcugcucuuaaagaguugaaaacacaguuuuacagugaugaaggcaaagaaagauguagucgguugacuuuauaagguuaaaacacgacauugucacgcuucgaaacagaggaccaguucgaggaugguuucagucauucauuuucaaaauacucaucuauuuaaccauauauuuaauucguuacagguuuuauaacuaccuacaacaugcucucaaacgagaaaccauuucaaacucacauuccaagaucaaagagagaaauaacccacuuuguacucauaagaauaggcggagccaaggaaaagcgcagggcccaucgaccacugaagacaacgggagggagcuggaagacggugauggccuggaaaucagugcugcacucuuccugggagacgacugaggccuggcacagugucgucucuggugcacgguauaaggcugcucuuuacaagaguaucaaggcuugcugagggcaucaacccuacaggaggcaagaguuaauuucucuguuuuagagaaacuuaaguguaaauggcuuuucaaaguagcuuuguguauguuugcucucugaagacugcuuuuuaagcacauuaggagucacucuacaaauaaacguaaagcuuccugugucuauuuaugucaaauaggaaaagcaagguuacuucuucucugagguggccucagcaucaugagcaugcgaguuggagccaugggaacaaccucacuccaacccugagccuuucuuacagggcagcucagaauuugcauuucuugcccuggacaagugucuccucuugcuuuggccguguggauaaaaguaacugauauacacgugaguauuuuguucagggaaauaccugugccuucugucuacuuugucucucaccaccagagcuugcugcuagcagccgcugagacacauggggguagcuuuuucuaagcuugcuuaggaaugaucaccaagacacagacauccgcauaaaacagaacacaugugccaugacagcuugaaggguuaggacuugaguucugacaucagagguccuguagcaaaccauuucauuuuguggguuuccauuucuucuaacaccugcuguguucgcacuugagggaugacuggaucagauaggaagugagcauuggccagcaauagucuauugcagcauuaccauuuuuccucauugaagggaaggugacuucaucguuuucaaauguaccagucaugaagauggcauugacagcaucagggagcaucaugggagcagaggccgucucuagcuuuggcagcaggagcuugaggcaacuugucacauugcauccguagucagggagcccaggggauggugccgcccacaucaggauggaucuucuugauuaaaacucauaaaacagacagcagagguaugucuccugggugauuccgaaucucaucaaaucgaguaaauuaacugucacaaguucaaccuuugucagucagauguccagacacauuacuucuuaaacuuuuauuaggauguauuuuauuagcucugguuauacaucuauguguuugaguguggauaugaacacaugugaacaguugcccauacaggucagaaguuugagaagcccuggagcagacaagugugaucugcuuagcacaagcacaucuccugagucaggcgauuucaaaugccggcaagcuggaaaggaagguuaacuguaacugucaucuuuauuuuucuuaaaucuguaaguaaagucagucaagucggcauuuuaggaacccuuccugaccggcuuauuccagacagcacgagaagaagccccaugagcggaggcuggagcagacaagugugaucugcuuagcacaagcacaucuccugagucaggugauuucaaauacuggcaauuucaagucggcauuuuaggaacccuuccugaccggcuuauuccagacagcacgagaagaagccccaugagcggaggcuggagcagacaagugugaucugcuuagcacaagcacaucuccugagucaggugauuucaaauacuggcaauuucaagucggcauuuuaggaacccuuccugaccggcuuauuccagacagcacgagaagaagccccaugagcggaggcuggagcagacaagugugaucugcuuagcacaagcacaucuccugagucaggugauuucaaauacuggcaauuucaagucggcauuuuaggaacccuuccugaccggcuuauuccagacagcacgagaagaagccccaugagcggaggcuggagcacaccugcccuguagguuucuguggauuccuuagaugagcaagcaccugugauacugucuaugcucaggacaaugcuguguuugcacucuggugaagggcguggcaggaagcccuggugcuguguggcgugugccuugcacaacuugcacucuuguaacugcagcugcacguuacguauaagcauauacagcuugcugccagguagggaacugggguagggaaaggaaacuuacagucuuagaaugucuugagcauggcuucugaauuacugaauaaaaucuaaaugaucugccagguaagcagucagaaggagugacaacauguaaacagaacagccagcauggugguagugguggugguggggggacccuagguagaaccaccacagggaagggaccugagcugcagugaccacccuggguuuuagccucugaacuagaaggcauucucugcuucucccuggggcaaccauucacugcccagguuugacuccuccagguuccacaagcuuuguuucuggaguucuuggaccagacaucaaccaaguuauggccaagcagauacguuucauguggcucacaugagggugguuuuccuaauugggucaugauuuuaaaguacaauuagcucacagugggaguaaaacugcaucucuaggguuuguuuuguuuguucccuuuaauuggaaaacuuggguuguuggaggcacacaucccacaugacacucagccagccacauucuggcuguaacauuugaaaagagucauccaguuccccucagacccuucccauugcuagcucucugacagacaccucauuaguuggucccuaugggugucagucugugguggcaagccccggauaaacacuggagagaaacaaaccuguuaacuguauuaguguaucguaggacaaaaagauaaacugcuacaauuccuacggaugcaagaucaaaaugccaagcccuuuguauaacgauguuuaggaauuugaagauagcuaccaccaagaaugaaaucaagguugagacuucucucucucucucucucucucucucucucucucucucucucucucucucucucucacacacacacacacacacacacacacucucucuccuuuugagaugguauuugguauauuuagcauugucucuaguucaugcaggcaugagccacuacauccaauguaugugcuaagaaccaaucaaacccaaggcuuugguauacaccaggcaagcacucuaccaacagagccaccucuaacaccauagagcaagauacucugagcauaggcaacugcacagcucacacacucagaaagccaacucuacauaguaaguagguguguugaguuaacagagaacaggugccuugccccuaacauggcaauuuagcuguccuguccucauuaggaaaagagggagggcacugguuccuggaauaaaugcuggggggcucugaaaaaugaccacugccucccuccugugauggaggccagaagugacuuuaaucgaauuggagauggggaaauagaucugacacugcuaugcaaggaauacaauaaaaauauauuccuaccccaccauggugcuuugcacauguggguggguccuaacagggauucaaauaggcacaaauguuaaugugcuaaaacccaauaaaguaguuuaauuuccuagaauuuugucuguucuguugcaguaaauauuacuugggguuuguauugcacuuucgaucauuuaacucucaaauaaaagacacaaaaccuuua

SEQ ID NO: 1768 - RNA, 26474 nt, Mus musculus
cgagcgugaccgaagggacuuggagacucgagcuccuccagcgcucuguaaauccaauccccagccuucgccacuuaagcuagcuccaccaucacccggaggacgcauuagcauugcacagccucccccggcccgggccucaccccguccagaaggaggaugcgcccugcgcaggagcugguggugaaaaacucuucccgcgaguucaggagcuccaccaccuccaccgcguccucguccacacugcccuugcggcuaagguccgccuugcucagacucugcgccuuccaccggccgaacuccgcgcuacgguccaugagcgagcgagcgagcuggggucggcuuucugcucuggaaugcgccuucuucuccaugggcgcagccauauugccgccacgguggccggagaggaccaaaguuccccauuggcgcaaccaggagcaagacgugcgccgccagaccguacaggcguaaaccgagagggggagccuagcgaaguuagggaaagccagcccaccucuuuccccacagaccuucuggagcuuaggagguuuuguuuccuacucuagaggaggguaagucacccaggaccgcaagcaagguccuacucuugucugccgggaggcuuuuuuuuuuuuuuuuuucuuucuuucaaguucuaggcuccaggagaucuaucugcacuggagaacugcacagcaggcggccggugguuccgacugggguagcugccuacugaugccuggggauuucugccgccacccaggcacucgcgccccaacuccggguucacaacuucccaggugcagguagaggaggucuguguucuguccuccgguguguaugcagugggcguuguuauuccuauuuuuagacauaguggcacccaccuacaguagucuucaaaagaaagaagagagaccuagagagagucagagacagagggacacagagagggacagaguuagaaaaaccuaauacauuguuaacuacaucuugcgcauuuacaguucccagaguuccugccucagucuugugaccagaaaagaccuguuaaugauugaaagugcagaggccacuguguggacuucguguccaccucgagccccugaagccaccauaacuccccgcuggcuccugcccuaggaaaugcagcuuguagcaagcagcauucugucacacugaagcggggccugcccuguccaugagaugcugcagggguacagagugaucagugugaaagcaagaccgugacaacaucauauagccagaagacuuggacuggauacuuuaauuuucaucauuuauucguguuuccaaguuaauaguaagccacaagcuuccaugagccauucuggaacaguggcaguacauuuuauaacuaugaggccucuuuuuuagucuucauuuaaaacucucucuagaaaucaauuuuauuuuauuuugcucuuuuuuccacaccguguguauuccuggugcacucaaaggacagaagaggguauuagaucuccugggacuggaguuagaauagguuucgagccugagucaccaaguuggugcuggaaagccaaaugaagcccucagcaagaggauaacaaguguuccuugccgcuagcccuaaccuuggcccucugcacuucauuaguaauaugucuuuccucuugaguuugagaguugacucacuaacucuauguuaagauauacauacgucuaacauauccccuacccauuuaacuuucauuuaaaccaaugaaugaguuucaaucagucuagaggaggaauuuuuaacuguguauguccuagaaauaaaaaguaaaauaaaaauaaaacaagguacuauaaacaguuuucacaacauauauaugauagauagaaaagcccauuuaaaccauagcauaguuaacaaaccaaagaaacuaggcaugauggugcauauacuaggaaagcugaggcaggggaguuauccagagcuccagaccaaccuggacuacagugugagaugcuccaaaguggcagaaagcuccuccuuguccagugugagaccaugaguaacaauaaagcuuacauuguugcagccaauccccacagguagccuagacuagacaaccuauaccaucaggguagauuagcuuucccuguagaaccaugucuuuuauguuucuacuguauuucccaauuuguaggcauuugaagaauacccaaguagacgccuuuauuagauaauauaugccccagccuauagcuuggugacauuucauacccaauugcucauacauuccagaauucauuucagaggcaugaaggacaaucgaugccaacauuuccaaaagugaaguuggaagauucuaaguuaaggaaauaaaaucagccaacauuuaaggcacugaacuuggguucuagcccugcugugaccucugugaccugccaggguuucugaaccucuucuaacaaaggcaaaggucgucuccuucauaaaaggaaggcuggcuuuuuaguucugcauagcaucuuuucccuuuggucuuuuguaaagauaauaaaaugaauggagauuuaaaaacuaugcuuuuuuaggaaaagcucacuauuaugaaggcuuaaguucauaacugcuguuaguauaucauccuauuuuauucuugugguucuugucaggagccaucgaggaaaggggaccuuccuggaggcuuaugauggcugagcucugagaggcaagcucucaagaggcuucaucucuggguugcuuccugcagcugauaugccuuuccugucauagauaaucuaaggguuccagagcaucacccacucuauugagcagauuucguauagaucaaccuaaagaugaacuuucaugaauuaaugcuguuuagaugaauuaaugauuucauagaauuccugauuugauucaaauccuuuugggaagaaagcuuuaagaugguuuuaguuguuuugcuagaaagauguaauaaaguuagaaucaggaauagacagugcccgugccucagaauaguaaguaaaggcugcauaauaaaagauacaacaagcuuucaaaauuacacuaaaaggagaaaauaggcuugggacaaauuuguguucaaggaaaaauauucagguccaaggaugaagccacaggugugcacuaugaucaggccagggcauguaaaaacugaacuuauagugagcuuaucguauaaaacacugcauugcacuuguuacugauaccuuuccguaacucccuuuuauguaacauuuuaucuauaagggaauucuuucuuagagaacuuuuugucuaaaaguauaaaaagucugacagcaauaaaggaagguggugcagcacacacauuuuccgguguguguguguguguguguguguguguguguguguguuguuguuguuguuguuugugugagggacuucucucugguucaaaaacaguuaaggagcucugagccucuuaccuggccagccaggggcuccccacucacucuccagagagaggagcacuaacaauaaauccuuucacuuaauucccucugcugaagagcaugaguuaguccaccaggaacugaguuagagagcucagugcugguucucagugcugguuaaagcacggcauuaaaaaaagauuuauuuuuuuuucauagcaacauuuuuuuuccuuuuuuuccccauuuuuuauuagguauuuagcucauuuacauuuccaaugcuauaccaaaaguccccccauacccacccacccccacuccccuacccacccacucccccuuuuuggcccuggcauuccccuguacuggggcauauaaaguuugcaaguccaaugggccucucuuugcagugauggccaacuaggccaucuuuugauacauaugcagcuagagucaagagcuccgggguacugcuuaguucauauuguuguuccaccuauaggguugcaguucccuuuaguuccuugggugcuuucucuaguuccuccauugggggcccugugguccauucaauagcugacugugagcauccacuucuguguuugcuaggccccggcauagucucacaagagagagcuauaacuggguccuuucagcgaaaucuugcuagugugugcaauggugucagcguuuggaagcugaucaugggaaggaucuccaaauauggcaaucacuagaugguccauccuuuugucacagcuccaaauuuugucucuguaacuccuuccauggguguuuuguucccauuucuaagaaggggcaaaguguccacacuuuggucuucguucucuugaguuucauguguuuagcaaauuguaucuuauaucuugggcauucuaaauuucugggcuaauauccacuuaucagugaguacauauugugcgaguuccuuugugauuggguuaccucacucaggaugaugcccuccagguccauccauuugccuaggaauuucauaaauucauucucuuuaauagcugaguaguacuccauuguguagauguaccacauuuucuguauccauuccucuguugaggggcaucuggguucuuuccagcuucuggcuauuauaaacaaggcugcuaugaacauaguggagcauguguccuucuuaccgguuugggacaucuucuggauauuuuuuaaagcauucauuuaaguacagagcaguaacaaagaguuagguuuccuagcacuuacucaagcacaaaacauuuucacagcgcuuacuuaagcacagagagcuaaagagaaaaaggagccugcugggggccagcucuagcugugcuuucugguucucucuugaagguaacugagggggaagggugucguugggggcaagacuuagucuugcaagauauuuaggguugccuuuauuauaauaaaaaguuuaucugucuuaagucuaagucacauuccuaugguagcugaccugccuuucugaguuguucugaggccagaaaacuucaagucucuggccuuuagcaccucauaguagaacagcaggggguuaaguaaagagccuuugcucugucucugcauugacugcugcucuaacucccagccugcucguugaagucaccugaagaaaaggggacacuuugaaaagugauuuuucgguuguauuucuaaauucucucuuaaaacuucuucucuugcucucuaaaaccuuucccaaaaaaguuuucucugaaaaaguucuuuuccuaaucuugcucucuccuucugcucugauauaacgauggccuugcuuuugauacaauguaaccuuccuuagucuuuuguaccuuuucuaggagaauagaucacaugguuuauccaagcauucuuguuuuuucaaaaaaguucccuagaaguucaaacauaaauucaaaucauaaauugaacaagaaguauacaauagagaauguuugcaugcauauccauuaagaguaauuauuuggcugaacauucauuaucuauccuagcucuacagguuuauggagaguuaaagaugcaacuaaguuauugaaguuuuguauagaaaaacccagucaacauguuaucuuauguccuugcaaauauaauaaaucuuugguucucuuuuaugaccuuugauuaauuguuuuacaacucuuggaaugugcucuaaguuguaaaugccugcuuucuaucucagaggcaauuaaauugaagacuggcagaguucuccuugcagugugauaucaaaaggacuuaaugacaguccuauuauaaaagaucuuaauaauuacuaguguaauuuuaggaauucuuauagaaucaucauuaagaacuaagacaucaucuacuugucuauauagcaucacuauaagacaguacaucauccuugaucugcagaaaccugcucaaaggauaggcuagugauuguuauauauguuuaaugauaacaggaaaagcauacuaauagcaggaaucuuuccucagauguaaucuuggccuugccuaaaggagugaaucugucauagcuuuauagucuaugauagaacuaucucagaaagaucgccugcuaguuuuuggcuucuuuuagauggcuccuggcagaaaccagugguuuucagccacagaauaagcaagagagugugaauuuuccagaagccaucagcuucuacccucaguacaguuaaagagaguuacaaggccagagagcaucagucuuuuggccuucauucaacuccguguuccaccucagcucugaaccccagaaugcuggggcuagcccccugcagauucccuuugauacagugagaguguuaugaagcagaugaugagacugugauugaguucagagguaauaaguguaggcuggagccaucggaacgcaaaggcucaguggggaaugagauuaagagaagcaaaggguggcuggugcugccaggaccaggcugccucucugcagaaucaggauaaagugugugugugugugugugugugugugugugugugugugugugugugugugcaguucauagcagccuuacauuuaguacagugaguuacuauugaaaagugcuauugucugagcuguggccugcagcagaaagccaugaagacuuacucacaguagacccucagacccuugaggucaugauuguugacuguugauguucccucacagaaggauggggguccuugcaccugcacuuggccucuuagguccagaaggugcuagguuauuuagaagguagaggguuaccuggagaggguuuccaucuaucuggccauggggaaguccuuguccaugcugggugagacuuuccaguggugugguugguuuggagucaucuucaccccuguaaguaaccccucacccauguucuguaagccuuacaacccugccugagccagacacuggggaguuguauuuuguuuuguugcugagagcacauaaggaugugggggcauuaguguuuugucugacuuguuuucuggacuggauagaaaacugucuuuucucagguuuugaguuuugugucucaaacaccuccuagguagcagcagaaucucacuauuugauuugauuuauuuaaagaaauuaugauaggccauaguuaacauuauggacauacagauaaaaccaguucaucacaucuaccaguaugauguuuccaguuacauaaauucaucugcuaauuagcuuugcuuuucuuagcauuuauuuuuaacuaccuuuuaucuuccuuauaauaggaugacagaaaaguuugcugggccauuguuauauauaaaccagugcacuaauuuuuaacuuugaguuuucuuucuccuuuugauacaaggaacuauggaggggcugugagacaguucagcaguuaaaagcacuugccaccaaaccuagccaccuccguuuggucccuggaacccacauaacuccugguuguucucugccuccacaccugugccuuggcuuguguccauaccuccuuucacacaugcaugcacauauaaacaaaugugauuuaaaaacacugcaggaagucuguuuuuauaaccugauaaauuuaaaacacuuagugcuaagaggaaaaaggaaauaccacaauucaguacaauucaaucuaaauaaaguuagcaaauaugcaaaaauaauugcacacauugcucuuaaaugcauauaaacacacucaccaauuacuagcauuggauuuauggugcuaaucgauucuugaaagugaugcccagagguagucuggaggaugagugcaauaggcuucaauuauaucuauagugcuuuagguuauuaaaagauuaauguguuaaagcuaggcauaaauguguuuauuccuuguuucucuguuauguuuguaacacuucauaaucugacuaaagaucccuaaaucuaauauuaguucauaacauuucuaaggcacugcaacccaagcuuauacaaaaggaaacaucagaugugguguccuguguugguccagauguuuuuauuugcauguuugccucccuuguugaaggcagugaaucuucgcaggaaguccuauggaguaguuugcuuuguagcugacggguuuuugagaugaaagguccucaggaaugaagggagaucagugggaagcuccuggcuuaaauuguuguuugaaaaauuauuugaucugcuuccucuuggggggagagaaagaacagugauagccuagauacaauaugauaauauguuaauuucucuuagccucuaggucgccauggcaacugggcagaaguugaugagggcuauucgaguguuugaguuugguggaccagaagugcugaagcuccagucggauguggucgugccuguuccacagagccaucagguggauacaaucauugccguggcugaccagagcaggggcacagugagcuacaguuacugaaacagggcaguguucuccugucugugugaacucugaaaaaguaaggcacaugauacuuaguaaaguagacacuugaaaaagaauaacuucuggcuacaaaguuucugauguggaaaaucagcucuguaacacaauaacagaaucuuacugcuaucaugggaacucugcauaaguucugcuggugggaaaguaguuuccccucugcacuaaugcuuggucagauuauacuuaagggaauucagcuguggaauuuaauugucucuagugacuuuuaucaguaucuuuugguacacuuauuaaggcacguucuauaucccuuagucuaauauccuuugaaggccuaauaugauuuuuuuuaauuuuauucauagcucaacuuuccagguucauuucuuaucacccucucagagauuuuaauaacuuuaaguuuaucccguuuccccaagagacucucacuccaucuuuguaaauaucuccccaaugagcaagaacucaaauggaacaggaaccugaagauggagcugaugcagaggccauggaggaguucugcuuacuggcuugcuccucauucuugcucggccugcuuucuuacagcacccaggaccaccagucuagggguggcauggcccacagugggccuuacacaucaaucacuaauccaggccuaccuauaguccuaucuuguuugugcauuuucucaauaggucccuuccacucagaugacuauagcuugugucaaguugauauagaauuagccagcauaauucaccuguggugagcuugacaaacacaucacuguuaacccacaaccuuucuuguucauccccaagaccacaaaucaaugucagcaucacauuaugaaauauuuugcaaacuuaaaaaguccugcaaucuuuaauaauucaaacacuuuaaaaauccaaagucuauguaaaacuuaaaaacuuuaaaaacuucaaaaaaguggagcaucuuuuggguacaugcccaggagugguaguagucuucagguaggacucuuaccaauuuugugaggaagcaccagacugacuuccagagugguuguaccagcuuacaaucccacgagcaauggaggaguguuccucuuucuccacauccugaacagcaucucaaccuuacuuccuacugcaugcagacuuagaacacaggcuugcuagaggcaggggcuggcuuggucuugcuuuauugucuugguuucuccaacuccaucaguuuccacacagcacuauuguaaggcauuguuucagugcucuguacaaacugacgaguguugucauuucagguccuaaucaaaguccacgccugcggugucaacccaguagagacauacauucgcucuggggccuacagucgaaaaccugcccuacccuacacuccaggcucugauguggcugggaucauagaauccguuggagacaaagugucugcuuucaagguaucccauucugaauuguuucuauuuagaccuagaagcucuucugaaggugaacuuuaucuuuaaaggcuuugagaaacacugcacauuuguugguacuugggggauuccuagucaaaaagaaaggucccuuuggucuaauagaaaugugugagugacagaaacaaacagggagaugacagauggacagcuuuuguccugcacagucaggauguuuuaauuuccuuucacaaaauaaagggaagguuaacucuuuuggagggugauaaaaaugugugcauaugccaagacucugcaguuuuggagucagaauuaggacuaugaucauggcuguccuuacucuucugcagaagccaugccugguguggguagugccuuuguagcauauuuauaauaccuucuuuccucauaauuucucaaccugcuuaaccuuggcaccauauuugucaaaauugggcugaauuagagaaauuuaacuugccccugugcaggaaugggguggauuccugcagcuuuuugcuucugucuuagcauucugguuucuguccccacagcaucucuagaucguuuucgucaaugccaccgauggucucuagacucccagagugaauggacccuuuuguguuauuaucugucuuaauuucacaaugacauuuggaacucccagucacuuaacauuuucucaaacaaaaccaaaaccaaaaucuaacauucacuuugguuucugccacaccgucugucuugccguccucccuccgagcgcccuuuguuuuaugcuugcucuuuggauucucucccaauccuguugccucuagccuucaaucccaucagaccucugcccuucuuucauucuucuuucacaguaauccacagccacagguaaccuuuauuuccuuucccauacccaaugucucuagcuuagaguauucagcuaagaacugguacugucugcaauguacucacauucaagcccaguuuguauguuacaguagugacucuugaguguuuaauaguccugugcaucuagcuguucccuuccuagacagggcagguguaugauauauccaucacuacagauucuucucuucaggaagggcuguguccuucuggucaucccucaguauagagggauuuuaauucagcaacauaaucacucuagaugaaauauagacaugcccuuagcacacaccuuugaucucucuggcuggaccagauaggcccuaaguauguaccuuuaauaccaaacaaugaagguaaaauuaguuugcagaaggaagcacccauguuugaaagugauuucugauugaguggcagaaaaguaaugaaucagaaagauuugacagaauagaauauacccaacucuaaugagaaccaagaggaaagaaaggugacugaagagagagcagcaacugggagugggggaagcaauuguauagaaacagguugcagagacagaaaaaaagcuagauacaugaauacagaacaagccagagaauaagaaggagccaaauuagaacauguggccaaaguuaguaugaggccaagcagggcaguucaguccaaagcugaaagaaaccugcuuaagucagucagcauuugcauagcugaguugaccagucagccagaaugaacuagaaagggugagcuuauucugcaauaagucuuaggcugaaaacauucuaggucuagguaagauuuuacugaggguagaagcuuccagguuagcagcuggaaauuaccucgggugaauaaaacuuacauuuguacccuaggaggcccuucuuccucagucuaucaaaagcugagaucaccugugcccacugaggucgucuuggugacaucugcuguuugaggcucaucucagucuucuggcaccgcucuuccucuccuuucccuguggcugcuaucuguggcuuaguucagguugucucaccuauugaaguaacccaaugaccuggagucuauagacauaugcuaccuucucuccggcuccugagcuccuaacucuagaaagcuucaucuagcucucacaucuauugcuugugggcuuuggcguugaugaccgugaggugggacuguugcagcucccuacacacuugucucccucuccuucucugcugcugcuuucuucagaacugaacugcucuucucugugcagccccugcucucucagggcugugccugugccugugccugugccugugccugugccugugccuguggcugucugugucugugccugucugugucugugccugucugugccugugccugugccugugccugugccugucugugccugugccugugccugucugugucugugccugugccugugccugugccugugucugugccugugccugugccugugccugugccugugccugucugugccugugccugugccugucugugucugugccugugccugugccugucugugucugugucugugccugugccugugccugugccugugccugugccugugccugugccugugccugugccugugccugucugugccugugccugucugugccugugccugugucugugccugugccugugccugucugugccugugccugugccugucugugucugugccugugccucugccugugccugugucugugccugugccugugccugucugugccugugccugucugugccugugccugugucugugccugugccugugccugucugugccugugccugugccugucugugucugugccugugccucugccugugccugugucugugccugugccugugccugucugugccugugccugugccugugccugucugugccugugccugugccugugccugugccugugccugugccugugccugugccugugccugugccugugccugugccugugccugagccugugccugugccugugccugucugugccuguaccugugccugugccugugccugugccugugccugugccugugccugugccugugccugugccugugccugugccugugccugugccugagccugugucugugccugugccugugccugagccugagccugugccugugccugugccugugccugugccugugccugugccugugccugugccugugccugugccugugccugucugugccugugccugugccugugccugugccugugccugagccugugucugugccugugccugugccugagccugagccugugccugugccugugccugugccugugccugugccugugccugugccugugccugugucugugccugugccugugccugugccugugucugugccugucugugucugugccugugccugugccugagcuugagccugugccugugccugagccugugccugugccugugucugugccugugucugugccugugccugugccugucugugccugugccugugccugugccugucugugccugugccugugccugugccugugccugugccugugccugugccugugccugugccugugccugugccugugccugugccugucugugccugugccugugccugugccugugccugugccugugccugagccugugucugugccugagccugugccugugccugugccugugccugugccugugccugugccugugccugugccugugccugugccugugucugugccugugccuguguccgugcuguuucugcuauuuggcaggauggcccugaagcauaaauucagcuucuagggcuccuggacuccuguuuggauucuuuccauguuauuucuggcagugacuguguucugcauauaagauaccuaccuacuauuuggaauaugcacugaaguuuccagaaaauaacccccgaucccauguuagcauuuacagcuccugagcuacauuaacuuggucugucuuuaggcccugcuaaagacauccaucgcucaccucuuuguuugaccuaacauccaucuuugugacuauuagguaaaucccuugggacugcacacauagaccacaaacuucuaccaacccuaaugcuaagauuaucaucagacaccauuugaagccuauagcagcaaauuccuugcuuucccauaacucccuaccaugauauuuccaggaaugcauuugaaaagagccuugauuuaugccuuccuuuguucuuuuacuuaaugaaccuguuaacacuugggaauauagcauuugagcugacuuaaaucccugcacccaggcuauggcugcagaauaaacccuacucucuuugaggugagagcgauggcuugcaugagcaggaggagaugcuuggccuggcucaguauuugcucuuggcugccuccuuugcccccgggcuucuuucauuguuuccuauacaucuuuuaaagauguaggccagguguucagauggccagagugcagcagguggccauuaacagagugcuuugugucuugcucugagagguagugggaucugcuuggcucuuuguacuauuucaacauguugcuuaguuggaggaaacuacgguauccucaucugucguggggaugagcacacaccuucggggggucaccgugaugcuuauguggaagagcacagcacugagcucaggaagugcucagcugaacugcuguagccuucccaguguccucaugcaguugaggggugucuucugguguccuugucuccuugagcgcuucuguucucacguuuccucuugauaaaaccugcauagagauucgcuguuagagcugugcuugugagacacugagcuggagacauccacauggaaaugaugauuucucaguggaagcuggcacugucaaggucccagccaucuuagcccaauuggaaucucuuuuucagaaaggcgacagggucuucugcuacagcaccgucucugguggcuacgcggaauuugcucuugcagccgaugacacuaucuacccccugcccgagacacugaacuucaggcagggggcugcccuggggaucccguacuucacggccugccgagcucuguuccacaggugagguggcacucugaguucacagccucucugccuggacuguguguggcugcuugcugcuagccauuugugauuaagcauuuuggggucaugccaaucacagaggagacagaaguuugaucauuuugagaagaaagagaaaauuaguccuuugaaugaagaucauuuucacaaaacaugggagucagggaggagauaggagacucugaggaaaauguguaucuuugucuuggucacuguuuuauugccgugaagagacaccaagaccauggccacgcuuacaagggaaaguguuuaauugggggcuugcuuauaguuuuggaggcguaguccauuaucagcauagcagagaacauggcaggcaugaugcugaagaaguagcugggagugauauccugacccacagcagcgagaaugagccugggcuuggcuugggcucuugaaaucuccaugcccaacccagugacacuuccucccuuccuccaacaaagccacacccaccccacugaggccacaccuccuaauccuuguaaucuugucaaauagugccacacccuggucauugagcauucaaacacauuagccugggggcuggggaagcauucuuucguugauuuuugagacagggugucucuauguaucccuggcuguccugcaacucacucuguagagcaggcuggccucaaagccagagcucugccuucugaguucugggcacuaccaccuggcuaagggacuauucuuauucaaaccaccauaguccuacuuuucuauuacugugacaaugaccccaugaccaaggcaacuuauaaaagaaagaggauauaucaucuauaucaggccuuacaguuuuagagagcgaacuaugauagaagcaggccuucaggcauggugcuagagcaguaucugagagcuuccaucugaaccauagcugugaggcagagagcggggaaggggaaaagggagggagaagaagaaagggagagagagagagagagagagagagagagagagagagagagugaguuaguucuuuuuaaacugccaaacccacccucaaugucacuucuccacaaagccacaccuccuaguccuaagcagccccacccccuggagaccaaguauugaaaugcauggaccauccugguucugaccgccauagucuuagaggagguuuugauuuacuucuuuuuuugaaggaucagccagccagacgugguuguguuuagaagcgagagagaggaugcaauggaagaguagaggaguacaaguagacccuacauagaguuuaaaugaugaccugagauagugaauauccaaacacggauggauaaaggauggaaaggacuccagacccaggcagcaaugggcuucagaguuuacaagaaagcccagccaugagaccuaguagaguaaagauguaauugugggaacauuuguagguaggagacaggauguugaagaagccaccgggaaaccauaaccagggauuggagcuaguguauucucauuccagagugaacagauuccccccaaagcuguccaccauaucccugggaugagcuggaccacaaggcaccuaguggugaagaaagauucaugugauugagcagggagauguuccccaguaugggguggugucuguuccuagcauucagagucugaaagaauguaguaguguagcacgggagaaaauccugggcauuuuagggcguggccuggggucuuggugacucugcacagccaguugauuuuuagagguguggagaggccaggcauugcuauuagaacuggucagaagcagcccaccugcugcuaccugaguaauccuggaccgcaggauaauggcugaucugcagcaaacuugcuuggggacacuuggggauuucuacccucgaggacacaugggcacgaggaacuccagucccgguucacaaguuccaccaacacacagggacggcagcuaagcauuauagugugauccccgugcccaacacagccucaggcaggugacagaugcccaguggcauauccccaguggguacugcauagacagucuguguucauugcagccgugggggccaucauugagucuuggggugagaggacauuuggcuccauguuaggaugcagcaucucuuuggguguuaacugaagcaaggguagaaaucccucaccgaugaugggauggcagcuccuggcuccucugaccaagagcaugauuacaccucugcuuuuuuuccugcagugcccgugcucgagcuggcgaaagcguuuugguucauggggccaguggaggagugaguaucuauucaaguuuguauucaagcgagcauggaguuaugggucucacgugauaguucuugaaaucucugcaccauuuaaguuuucaguuuuaaaaauuuauucuccaaggacuucauucaugcacucugugugacugaucuuaucucccaguaugcccuucccaacuucaugcucuauucuucuucuuuuaaaauaacccacugugucuacaagucaguaguacccaggugagaaucugcugcaggagcucagggugcucuuccaccccgagcagccagcagcagcuccucccuggggcaaggccuugggagccugucaccuggccaugcugggcuucugacaucguacaugaugaagucauuuugaagagcuguacccaccccaccccuagcccccuuaaugccacgaggcuuuaagauguagcugcuaaguagaauccguggcugaugcauuucuuacuuaauaaauucagcagaccaccucauaaaacaauuaaugugguagguuuuccaccugugcugggagugcaccaagacuggccuugccucugccuucacguggcauaguucuuagaauuaugcggccuuuuaagcuguccuaaacauuaacaguaguuguuccguauuccuuuagguagcaaaauaaggcucauuaaaccucccauccagugaguggucagcuuuccuccuauccggguucccuguugugccagcaggcucauacuuuuaugguaaccaaagggugcacaguauauagcuguguccucaacaccacaacccaaggcugaaagugucacuaguuggggaaaggacugagaacucagcaccuaagcgcucuaaggaguccccaggcauagcauugucagacugcucaagcuccucacugcugcucauucuccagggagcauggaggagaagccagaguugugcauuuggaauucacuaagccagcacagagagacacugcaaaugucggagacaaaaccaagggccugcggggcgauggcucaccuccagggagcuggguguucuagggaccacauggaaaggaguaacucauuacccagcaugccccacauaacgaugauagcguccugacaguauggcucuacaguggccagguaacucagaaagucaggcugccgugugucucuauagagaugagcuuccuuauggcacaucuggcuuccucagcgacucggagaucaaucugcagggauuucacaugucagacuauuuaccaagaaagcccaaaguugucucuguagggcuugaaaagacagcuaaacucauuguuaaccaucuccaaaggcugguuuuggaugaguucaauuuaaucuaauaaccgaagguuugaaacacacguguuuauuuaaauggcuaugguugucuaagagccuugugcucuguagagaagagagauguucguacaguggagagagaggguuuagaggaaaucccuuuacacuccugaagaaagcccugccacuucaaagggauugguuugcuuuuuuaaaagguaaaauccaaacugcuggguuuuggagcuggcugagucugcuaaauccuggcuggccgggacaggcuggcggcccauguguggaucgccucugauccuccugcccuaucagagggagacagaacacuggcuuuugccuggcuucugugugugcuuuccguccucacuuaauccacauucuugcuggauuauguuguggguuuaaaauggcguggauuugcgaacacagccauugucccaguacauuggugggagagucucauuuuaguguucuugaaauagauuggagagaaauaacuggcagaaaaugccaugcaaucucuugaaaaaauauugugaaucuaauuguuggcaagaaaacagcagccagagcccuuuagaaaacugagagacuuugcucaaagagagcuuuaggugagauguuugcguuaggucugcaccuuagaaugugauuuuauuagcaucauaguuuuaauagaaagguuaaguuuugggggucaauugcagugaccccacaguacagugcuccuccugaugggcuggcuguauccuuccuuacauaggguccugcauacuugcuuugguuagauuauagaaagccuggcagagccucauccacugcaugggccuucaguccauggguugcuucagcccaggaggggcagggcugucgcuauccaguggguuucucguauuucccacuguaauuauuucuccugcuuuacccaauucuauuggccuuccagaucauaguugcuugacuuuuuaucuugaguuuuuacauuuacuuugugagucugugcaagcuugugcugaucagaggacaguuugccugacucgugcugaucagagggcaguuugccugacuugugcugaucagagggcaguuugccugacuugguucccugccucuaccagaugguugcugacuuuuggcuugguggaaaguagcccagccuacgacccugucaguuaaugcucugugugaacugcgcuggguuagauuauucagguuuaaaaggauggucugguaugagaggagacaugcucaaaguuggccucuggccucuacauguacacugggcacauauggcagcaugcacgugcacacgcgcacgcacacacacacagaauccuugauuuuuaaaaacuacuagugaauugcugccuugaguuucauugaaaaauaaugcacuaaauuuuggcuaaagaguaaaauagaauuuucaacaauuucugaaguaggcccaaacacgucugccacuucaacauuuauauaauuugauaaauauuacccuugaugcucauaaagucagaguaaugggucagacucugagacugcugauucauauguauguuucaugugucuauaauaccuaauauacaaaauccagauaaacaguggucugguagaaagcguugaagaaguccuggucugcauuugaaacugauacguaacaggaaauaacagccaaucauggcagcucauggugagaacccagcacuggcagggacuaaggcaccaggaguucaggccagccuggacuacauacugagcuugcagggacuaaggcaccaugaguucaggccagccugggcuacauacugagcuugcagggacuaaggcaccaugaguucaggccagccugggcuacauacugagcuucucaaaagaaaaagaaguaccugaguauuuauuuccuuuucaagaagucagugcuuuucuaaaugugacucugaauaaaacuggggauagaaaaaacuuaauacaaaccgcuguugggaaggguuuuguuuccaaugaagaaagaggguaaauagcugaaguuacaaacuccaugcccugcucugggccagcaguugucuacagggucguuucacaccauccugacuuccuggcuguauauuugucaggucuaucagggucuuugccugauuccagagucuaaagcugcugccacuccuugagagcuuaggcucuccgcaccaccauggcucucaguguuguccagggccucuaccuugccguggaccuuggccgucagucuccacugggcggugagcuugguuccugagacacaccauccuucuuucugccuuuugagcaccccgagcguguucccacucuacccuucccuuuaccaccugcacccucgggacagggauugccuggaucccccuccccccacccccuuucuccucauuuucuccaggucaccuuuccugauggccuagacagccccucuccacagcucuaacccugggugguuuucuuauuuccccagugcuuucuguugacuucacucacuuguuaacucacaucaccuguuuucucuuuggaauguaauuuuuuuuuuuuuacauuaaguccaugggcagagccuauaucucuaacuuacacaauagaggcccuaugcuuguuauaaagaauguauuauuuaauugguuaaauaaagccagguagaagcaucaaggcaaucuuuaaaggcuguaccuccugcacaaagcguguauuagcagcuguccugcugcaguaguuaguggucaugggcugcaguguggcuuggccugcugcaguaguuaguggucaugggcugcaguguggcuuggccugcucugcucugugagacuugcucaaagcugauguauuucagagcuuacagcuccucgucggcauagcacugacagugauggagaacucagcaagcucugugaggugugcugagcacggcauugggagaaugauucuuuccugcaggaaaguucaacaccagagcagcgguccucagccuuccuaaugcugugacccuuucauacuaugaugaccccaaccagaaaaucauuuucauuguuacuuuauaauuguagcuuugcuacuguuaugaauuguaacauaaauauauguauguuuccugauggucuuaggugacuguuguaaagggaccaugacccauaggcuaagaaccacugcacuagugagauccacacuucccugugggcacuggaggcuuccagggaauguggagacuaugugaugucaggguuauguuuugucuuucagguuggauuagcuacaugccagauugccagagcucauggcuuaaagguuuugggcacagcugguucugaggaaggaaaaaagcuuguucugcaaaacggagcccacgaaguguuuaaucacaaagaagccaacuauauugauaaaaucaagguacacuuuucuacaguuuaaggucaaacuuugcuucugggagacuuacuuggcuuuaaaauaagucauuuuaacaacugccuucuuaacgaguuaacaugauuuugcuuaguaaguaacauuguuucuguuuucauaucuauauguucucucaccccuauaaauguuuuaauugauuuaaaaggacaggcaucuaguuguccagauuuugcugccaugcuuguaauacacuugcgaauuaaaugagacggagccuuucuaaagucaacugaaagaucacguuguaaguaaagcuugcagcuacaagaugcucauagugcaguuguuaaggaugugaaauucccauugcacucgagguucccagaauuacaaaccagauguaccuauccaggaaagaugccgcuugcuaaugggguccuuggguacggauuaucacuauuccacccaccacagugaggcacauucagauaauguugcuuaccauacaguucacacaggaucuuaucugucugucugguuugccuggcaagugcucagccauugacuucuguccacugcucaccugaauccugaaguccuuauuuauauaucacugauaauggaaucagcacuuacucccuugcucauccucaaaagcacuguccuaagguaggacaaugagaauuuugcaggcauggagugccuuaaggaggucauuauccaaggaagaagaaugugugcaugggguuauuuccaccauaccaccuugccaaaaaaaaaaaaaaaaaaaaaaaaaaaaaaaaugccagccagagcucugaccugugccaugcagagaggagcuggcuccuggugcucagugcugaugugguucucaggcgugucugagcugagagaagacugguuacuggggaaaguugcugcuuguuucuccagcaucugacuuuaggccacgagggugacuccuucacuuaccugcuggcuucugcuuuuucuugaucucaggaaucuuccccacgucucuccacuccgcucuccucucccauccccucaucccaucucuucuucccaugccuaacuucuagaaacagcaggcuucacugcucccuugcccccucucucccugugcaguucugccuguguguacucugacauucacaguggcugcgucucuggugaguggagagcucuuguguccaggcugcucugugucuguccuuauccuaaggagcaugagaucuugauuggcucucuugaaacucucugucucccugcucacuggcuucacuaguaaccuccucuucuucacauuauuauacguuguguaucuuugugucuguguguauguaugcccuuuguuggcuccaucgccugaauuccaucucugugucacuagccuaguaguccuugguacucaccuguuacccugacaagaacccuuauaucauugucuauggcuguuuucaaauuguguguguguguguguguguguguguguguguaugugcaugugcacuuaugcauggauguguagagggcaaggguucaccuugaugucauccuuugucacccuccaucuuuuuucugagacaaggccucucagugaaccuggaacucacuccucccuguagacugccuggcuagcaggaccagaucucugcaucucugcccccagcucugggauuccagcuuccucuguggugcuggaucuggagaagccugugagcgggcacuuuacccugugcugucuccgcgugagcuuugcuuaugcccauuuaaaucagcuucuccuggcugcccuccagucacccacccccauugcucugccaguuucaccccuugacaaggaucucucaaguuccuguccucuguuauuuaagccuccguucccucugaccugaugaguguuacugagcucagaguugcucuguccacucuguuccuagagauaccugucccuuuaaauauuuguaccaagaaauaacugaaauggagcucuguucaaagaggaauuuuaacuuuccugucuguuguugagcuucuaguaccuaaaacacugaauuaaugaacaccugaaaaauaaaaccaaaccaaaacccaaauacggaguucuuuaccuaacauguuguucugcauguuuugcagccuguaacaguuugcauuuuccucuuccucaaugcugcggugugaggaagcauuccccaccucucccacaaugcugcggugugaggaagcauuccccaaaggcccuugugugucauuuuuccuucauuuuccuacaucaauuacagugccaggcuuaaguacucauuacuuagaauguuauauaaaccuaaugcaaaauaauuauaacauugcuggaucuuuaagaaccaguuuaaaauguagagaaccaacccaacagugcaggcagaaaggaucaguauaucaagcaaaugauaaaccacuuauaacacaacuugauaugcacacaggcagaaauacacaccacacccacccacaaauacacauccacaacccccaacccccacacagguacccauccguacaccacagauauccacucauagacaugcucgagcacacacacacacacacacaugcacaugcacaugcacaccacacacacacacacgcacaugcacacaccacacacaugcacaugcacacaccacacacacacgcgcacacgcgcacacacacacacacuaauccauacaaauuugaccugaccaugguaucgcacccaauguuucugaguugguacaguagagagugugacuggucacuuuguaauuagauuauuuuaaaacaugcacuguugguucugaugcgugcuuagagaagugguuuuaccgacucucgccuccaucuuguucuuuuaccaugcagaugucuguuggugacaaggacaaggggguugaugugauuauugagaugcuggcgaaugagaaccuuagcaaugaccugaagcuucugucccacggaggacgggucgucguaaguaugacuucagcaccgugaauuucaccagggcucaagcccguuuuacagcaaccuucaacuguguaccuguuguuuccaugguagguuguuggcugucgaggucccauugagauaaacccaagggacaccauggcaaaagaaacaagcaucauuggggucucucucucuucuuccaccaagguaaggaagggaaguucugacugugcuggucagcagacugacaguuuagucaugcuaagcuaggucaccuggcuggagagguggcucgugcgagccgcaguauggagagggagcacuagucaguuacagcugugucaagacgguacuucguauacuaacacugucccaggcauaugcaaaugacagagaauuaaaguguggaucugggaaaacugucaaucuucauacuugcaaggggaccuuucgggucaugugguccacugccaagaaacaaaugacuauaaacacacacuuuuguuuucuuccaaucccuuuccucuaggaggaauuucaacaauucgcaggccuucuccaagcaggaauagaaaaagguugggugaaaccugugauagguucugaguauccauuggagaaagcagcccaggcccacgaagauaucauucacggcagugggaagacggggaaaaugauucuccucuuaugagaccugugucacugggcuccuucuuccucaagucucugcaccaccaucuuuaaacaguguuauuugauugagguucacguauuaaaaacaggacuuuagggaguagacacagugagugacauaauugcagagagcaggugugcccaauggggucugcgugcaucacaaaacucuuuucuuccuuuuucuucauuuucuuaguuugguuggauguuuuuguuuugugcuugagacaggaucauucucuguaguucaugcuggccgugaacucacagugaucuuucugccucagccgucuaaaugcugggauaaucaguagugaugcacacuaccacacacagcuucaucucagaccuucuugucugauuaaguucagaccuuugaauaaaauguacaaguucaaaaugguccucuacugaccuuccugggcucccaagccugcuacucuuuagggagucaccugcccccucagccauggcugucuugggcccugaagacuuucugggcugaaaaauauccuuuuaaaacuaaugucaucucagucuguaagccucuggaaagcuucggcaaaaaugagcaauacuugggagaccucccagucagcuuuccuaacauuuuugagaauaucagaauacugcaugccggucaccagccaccuguagucuggggggucagcagccaccuguagucugggaggucaccagcuaccuguagucugggaggucagcagccuuauccugggucuguggucuucaguauggucacccaucaaaugcuucauggucacuuauaguuugcuguauaugugacaugagucucauaguuucacuuaaaauuguaaguucacaaauuuaacauguuaagaccugucugcuuugguuuucauaguaucuuaaccuggaguaaauucuguagaacacugaag

SEQ ID NO: 1769 - RNA, 3244 nt, Mus musculus
caucugguaaucucugaagcuagcuguuuuaguugucacuguuaagagcuuguucuucaggugacucuguuagccccuauaagcagaccuggaggguagcacucuccuuaguuucagugggcagaguauucucugcaggcaagcucucuucuugcaaggcagguacccagauaccugguguucgaaccagacuccuggcagaaguuguguuccacucacuagaggucguaggaucacguguggaauccugugugagcccuugcggguauuaggcgacucagcuggcaagguagcccggggcuccaguggaguggaagggguuugugccccagaucaagcccggguagccugcuuuccuauguacagcagucucagguuccgagcgauuggauuggggcaggcgcuguguuccacucaccagaggucuuaggaucccguggggagucccgugugggcccuugcggguguugggcaagacucugcuggcaagguagcccggggcucgagucgagcagaagggacuugugccccagaucaagcccggguagccugcuuuccuauguaccacagucucagguucugcgcgauuggauuggggcaggcacuguguuccacucaccagaggucuuaggaucccguggggagucccgugugggcccuugcggguguugggcaagacucugcuggcaagguagcccgggggucgagucucgaguccuaacauuucuuuuuaucacacuauaguuuccuucaaguuuuuguucgguuggauuuugcuauucuucuuugguuuuuguuuguugguugguuuguuuguuuuguuuugacaagcaucagugccccguuccugccaauuccucuggcguucaucagucugcaaugaaaccacaagaaagcaauguguucucuacacaagacuguuccuuuaccacuguguagaaagauguaugugggcuacuggccucauuggcagucagucucuguugauuguccuacuguaggagcuugucaagaaaaucuaggggcucaggguuaagaagaugucuggucuuacuauggguaaaguuuucccagugcuguggaucuaaggggacucuucuuuuagagugcauggcguguuagaagcuuggagcuguugaauacguaccugcauuuaacaagauaccacuguagaaguaacacauucaugcaacaagcucugaauauccgacuuccuaucuauuccauuguggucugguuuucuucugugagaauucagguucaagguuuaguaaaaguuggcagucuuuucugacauacuagccuuauuuacaaaaccaaaaccaaaccagccaaccaaacagaaauaggcccuguccucagcguauuguucaggggaaaggggcauuaauuuauccuuuugucuuaaucuuuuggauuuagauguugauguagauuuacucuccaauaugguuaagugguugcaauguguuccagugccuaugggccacagucacuuuauaucuuuaauaaaaacgguccuugccuucuuaccauacggcuuuuguauucgggaaauuuacaggauuucucucacagugagagaugugaaaauuguuacauguguucuggacauagcccauccaauuuggaccuacaugcuguaacuggaagguaaaaguagcaaucgcacuuggauaacgggcacuacaacuuaugacugauuuaccccaaaucuacuuagauguuuaugaauagauagucuuauguuuuguaacuauuuuuguuuuuacagauacuuauaagaucuucuuaaguuauauaaucacuuaaacaaagaaaaauaaugucauguacuugaugcauauaaucuaacauuaaacacauugcacaguugaugugugauugauaucaauuauaggauaauuacuuagucuauaacauucucuguuuuuccuuuaaaauaaguuacuuuaaauauuuauuauuaucacacuuaaaaugggaaaaugagaguuagugagcauaaagauuuacaaauucaaaaccauggaaacccccagcccagaccucagucuugguuuuccgaucucuuugucagaucaggaacuguugcucuugcucauacagcugauaugauuuaagauggggcagaggaauaagaaggugggcccucaucuauugagcuugacaaagaagccuccucaggcccacagagacagauucucaagcaccaggcauggcuuuagccucuguguaaaggacccacaugguccccaguugugaucauccuccagauggucagcagcauaaaaaucuggaugaaaauuagggcaugcagaugaucuauacaagguucacagcuugacaccacugaagcaauuucagacaucaugccugaagcucacaauuuuuauugcuuugaaacagagaaaaaccagagucuuaauuuuuuuuuaauuccaguaaauucucuucaugauucccaugcuuaguuggcuauaauuuuaagcuuuuggguuguuucuuuuguuuuucaaaauauauuauagguacaucauuucucccuucugguucuucccuccaaacccuuucauaugggcuuuuuuugcauugguuguuauugcauaugugugucuauuacauaugccauauauauauacauacauacauacauacauacauacauacauacauacauacauaugugugugugugugugugugugugugugugugugguuuuuuuguuuauuuguuuguuuuuuggggcugaucauuuuguauucguuagccaauuaguguuuucuucccuaggggcuacuauuucaagggcuuucagcauuucugaauuccuguuguucuucguauuggguuggaacuuuaugacuuuugcacauccacuuuggugugucuauuauugucuuuguucagcucauguuuagacagucaugcuaaugauauuuuauggguguagcuucugacauuacuaggagaaacagucucacuaaaugaucugauacucuggcucuuaaaaauuuugcucucucuucugcaauauugugaauauugugcagcacuguuguaggcacaucaagcagaauuuacaugaacauagucuacaucuauguuaacuaagucaucugaaucagguauacucuacauaagcaacuagaacacaaccuucuuuauaaauccaggaaaacucauuugauaccuagaugcuucuucaacuucaucuauaaucauaaguuccccaauuugca

SEQ ID NO: 1770 - RNA, 14237 nt, Mus musculus
ucagucagagcuuacaacuuucuauuuuauuucuaauaaacaacacuugauaguugacucacggauuuuauuuacauuugucuacaguaucauuuccuuaugaaaugaacuaguacagcucaauuaaaccaaaucaaaucauaaucaucugaacuguuuguaaacuccuauuagcuaaauuuauaaucuugcauuugccuaguacaguucaaguuuuaaauacagaaagcacaaaaacaaaccaaggcuaacacguuggaucuagaagaucugggcaacucagaaagucgacuuucgagaagucugaggcacaauuacaagagaguaagaguucgugugcaaccuacaguaaaugcagcaaggaaaauaagacaaaaaaacacaggaaagcuuguaaaaauauuaccaaaauauuucuacguacgauacuuuguuuucaucuuuagaucaguugagaagagaaacacucacuuuaaaauaaaaacauuuuguuugaucugucuacuaaacaucuuagaaggcuuuacuuauuuaaacugcagcagacaaauacuaaaggagaaacaggaaaaauaauucccucacaaggagccccagcacaacuguugucccuuauauacuuaccuugcuuuugcugcugaagagacuguuaaagagaaaccuuuuaacuuuuaaaccagagaacaaaauggaucucaagugaccagauuuuaauuugagaaauaaaacuccaaaagcauuuuaagccauaugguuuucuuuuucagauguggagaaaaaugauuuugcuuaaauugugcagaaauaagaauucuucuguuacuuagguaucugcaauguucaaaaucagacaucacaaggcaaauguucacuuaaauucaugucccugucagccugccacugagaaacagguuucaaaagcuuucuucaauuugcucauuaacuaugauuuagccuuuuuuaaaaauccuuuaucgaucaaguacaauauuugguaacuaggauuugguaaaaggauauccgcauuucuuaaacuuugagaaacauucugaaaugaugugauuaaccuuuuucuucuauaauuucuacaauccucuugcauuaagagguguaaagcuguuaagagacaaugauucuaaggcacccucagcuuguucccaguugucagcuuugcaacguaguuaacugcugguaagaaauuacuggcagagguaaauaacauaaccagguugacuacuaaccccauaugaacauaaauugguaauuccaacuagcuuauuagcuuugcccaugugucugaaguccaggcaagcccaggcaacccugucucugucaauagaacauuuagaaaugaaaaggacaaggauuuaaaguaggaaacaaaaguacucuguuauugcuaggaugguuuuaaaugaagcaaaugguuguaaauaaugaacagagcauuuaucuggggaacaguauauggcuuaaaaugcaauuuacuuucaguuucacaaauaaacacaguuguauuguuuugaaaagcaauaaaggcaugcaccucuacuagcagauguaguacuucugaccaaaugagacaucaacuuccuaaaaaauaugcuucaugcacuguacucaauguuuuuuaaagauguaaauuuuaauacauuauuucuuuuuugaacuugaacgggaaccagaauguguugauccggaggacgaccuguggugccuguaagacauaagagagcagaacaaucuguaaacagcacuagaccaggugucuguuccuaagacugcaaacaccagagaagagcagagcacacacuagguaccuugaugcucccaggagaacuuaaaaccuaagauagcuuauaaacuuuuuugauauaagcccagaauuggugugauuugaacucaaaacucucuauaauuuaagaauauaaacucauuucaaauauagccaccucucaauuauucaagguaaugaagggaaagccuugaaaaaagcucauaaucucauauauguacaagaaaggcaaagaauccugguaaggugugacaaaaucaauguaugcuguaccacagagaacacacugggucucuauggaacacagcaaggcuucugagugcacagugcaugagaaaguacauucaaagcaaugaaguuuuggaagucuagaucacauaaggugauguacaguuagugcuuuuagugcuagagucaugcagccaacaugaguaagucaguaucaaccugggaaaaguggugguguuccguagggguuggcccugggcucaggguuguuuaauguuuucaccaaucaccuggcuuauagaauagagaacaugugcauuaaguuuagaugacaacaaacuggggggggggggggggaauuauauguggcuaagauaaaaacucgcagaagaaguagaauggcaacauaaugaauuuaucucaaguacagaguaauuuucauaugaagaaacaaugcacagaaggaagacuggguacgaucuugaaauucgaauguggaggacauguaauucugacccuacccucuaaacccagccgucaccagaucuaaugagccuucuuuucuuucacaaguugagagaauauggaaaauuugcuaagacuacaagugaagccacaaaucauuauuaugacauugaaagccaagagacaauuagugaaaucaaguaaucaagucuguugcagaaaaggcugacacaugucaagugcacucuagauacagggacccagagaagguccuuuucaaaagaggaaaauggaucuggacugcaagaugaaaaaaguauuaacuccaagggcguguaaagggcauaaaagcuacgugcuacagaaaugcacuuguaaaacuuaaacacauuuaaaggaggacagauccccaugauuuugcaaguucauccugacuagguacccuaggaucccuaccaucucuaacauuuagucuuaaaaaacaaacacauguaaaccauuucaacauauagcuuuuggguuuagaucuuuaaaaacacaaaaauaaccgagaguuggcuauaauauacguggaaauaaaauuugaacaguaaaaugauuagagaauauucuguccuguaauuuuuuucuaauaagcaagauaaacaaaguaaucugaauuuugaaguuuaaagauaaaaaauuuaaagaacaaaggagaaagaaaucuaacccuugccuacaaaguccaccuaugaaauacacauaagaacacccauucuuauucuacagaaacccaaaccuuucgggugaccgugaucucguucgucuuuuuuugcgaacagcuggugaagaaggucuagagcgacuccucuuccugucucuuucaggagaugacgaagaacucgaauaagaucuuuuucuuggggaagaagagccccugugggaccuggagcuggaucuucauugauugagagacaaagcagacguuucauuaaaggcagaagugaagacuguccaguucccaaaagcaaacaggauugugacuaugaggacuuuaggagggaauacuuacugcuuacucagaaggcuucugggucaaccaucaacaaguucuauuuacacacaaucauuuccucuuuaaaccauucuaaauaguuacccuugguaauuaagaaguaguuuacugaauuaagacagaauauuuuuauaauugcuuauaguguuccaauuuaaaguauacaaacagugaaaucaauucuguggugacuuuauagucagaaaauagauccucccauuugucaggaaaauucacuuuuuauaaagcuugcugaagacaaugaacuuaacuucuuacaggugcuacagacaccugagggacauggcccagaaaaagaacacugaagcugugaaguagucaaugaaaauggcaacucuacaaugugauuuguaugagaacugugcuaugaaguaugaaguaguaacauuuacauguuuuaaguggaaguaaauguguaauuuaaagagcaaauuuaucucuauuuacauauuuuuaguugaaggcauuuagcucaaacuucccaaaaaauucaccuuagggcuuaaaauaaaaugagaaagcccaaaaggagaauucuuuggaaaguuguaagcaauuaaauguuugggaaggauaugaaggcuguccuguaaaccucaguccuacaguucccagagggccacaccaagacuccacagucugaagugagcacggauaguuaaugcaauaagaaagaaaccuuugcucuacucagcgcuggucagcagagcacuggucagugcuccauuaccccucucucuccucagggggacucaauggcagcugccuucaaauguuagaaugggcucaaguaagugagucuuucuacagaagaguuguuaggaaacgucaauguaaaagccacaagugagauuuuagaggcuuucguauaaaugcuguaugccugcaggacacaacaauacagugacugaacaugaaggcagcauagugagcaaguacaaaaaaguuuuucaaggaaccaaaagccuaaugcuucuauugccuuuuuuuuuuuuaaccaaucauuuuccuuugaaauacucacagcauggcuuauaucaaaccauacuuaagccaacauccuacaugacuugguuuuaagagggguguuuguuauacagguaauuuauaauauucuuuaaugucagggagauguaguaaauacauagagcacucacuagaaacugagaaaaaccaggcaaagcuauuguaaacauuugccugaaauauaaaauguuucgaagcuagaugauggaaugguuggucuuccucucagaaauaacuucucacuuguaugucaaauuuaaauuaacuguaaacauaaacuuaauauaccagguggaguaacuugccuucaccuuccuacaucacacguaucuuagcuauaugugcaagccccacccccuuuaaucaaccgugggaauguguggcacgcugugcggugggaacacuguguggugagauuaagcugagguaggugcguuagauucccagggcuacaacagaacggacaaacagaagcagggcaaugagagaagcagcggagccgucugaagccugugagcacucuccucugcucuacagaggcgcuaccucauucaccuugauuucgaaccacgggaucuggaauguucucuggaaccggagugagaccuggacugcgaacuggaagagcuucuugaacgggaccuggaacaacacggaagcauuuuuuuccccuaggaccacauuuuugagguuugugauaugaacacugaaagaaagacauauauuaagagugcauuuuucacauaaaaagaugucuaugcaagagaugcauuuuccaagcaaaaauacuuaaaacaaagcuucuuacuguaauaaagacuaaguuuacaaggaaaaaaaaauuaaaaguuucagugaccacuuuccaagcccaauuaaacugccaaaagggaaguaacaagcaccauagcucacugcagacaaugucaccucacagcucacugcagacaacgucacauuuacauuuagauucuccaguucacuuuucauuuucauuugaaaaccuauuuccagucuaguaagcagaaaacccuaacugcuauaucacauuuugaugucuagccuucauuuuuagagaacuaaagauucaacaacccagugcucuacaugaauuacauuacuaacagacuguagagccgagggaaaaucuagcccucacacucugaaaaccacaaaugacaucccugacaccauuuuuaguuuguucccacagagacuaucacaguuaucucagaaucaacuuuuuuugggggagaggggagggacuaggaauugagccuagggccccauauaugcuagacaaguaucuaucacugagguauauuucuccagcccccaaaauuagcauuuuaggcuuuauaguacaaauuaaguagcuggcaacauauuuucuucucaaauaucauuaaaaauuggccauuaaugaauguugugccauagaaaaucauuguuuaguuuuaauuauaauaucaaaugcauguuuuaaacacccaaauauucuggacucucuggaagcaauuagcaucaugguuagauuuauucucuauucagaagauugacaccaaaauaaauuaucaaaaauugugugucauuaaugcucagaaaaaccuaaaaaccagagauacugaaauaaauguccacuuuacuugacaguaccugaacacacacuaccuacuuagauauacauugcuuacacagugcuuuugaacuugagguacuauagucaaagccaaaagggugacacagaacaggcaacuuccaagguuugaauuucuaaaaauacaggguaguauuuucaggauacaaagauaaaguguagcuaaggugacuucauugaaauauuuaagauaaaaagcuuauuuaaguuaaguaguaaaaaguuagauacugacauuuugacugguguuacccuuggccugcacccguuuaccuggaccuggaccuugaacuugagggggaggaugagcgugaugaagaccuugagugagacgaucgugacuuugagcggcuccgccuauugcuuuucuuuuuguuacuaucuucuucuucgcuggcaucaagauuauauuuugagagaucagcaucaucuucauccucguccuaauaaaauuuuaauuccauuuagacaucuauauauuaauacuauccacccaaaggauaaacauuuaucauaccaagcauuuucagaugggucugucaccaaauacuuuaaugcaagcuuauuuucaauucaggaguucauucacuuaagucaccugauagaaaagacuguauagacaguucagacaggcuccuagaagccaucccacugguucucacagcauacaccaaacuguuggcaauuuucaguucugucaggaguacuuggccacuacuaccaccaccagccuuaguuuagaauacuguuuucuguucucugaauuacaauaaccauuugcuugguucugugcaccuaacaccacaaugugcugacacacaucacccugaagaacaaggaccuggcuccuccaggaguauguauggccaacaauuguccaggugucaaaagcaucuuuugcuucagaauaguuccaguaaauaaaggugaggggagaggacagggaccauuaccucaucuagcuuauacuuagauagaucuucauccucauccucuucuucucccucugacucuuuaucuucaacuuccuuuaauauagaugcagggccaacugcuuucccccuguauuuuuucuuuuuacguccaaacuagagggggaaaaaaaaaacccaaaauagacaggcugaaaacacauaaaaauauuuuauuuucaaagccuauuuguacccuuguggaaaagcagauguggaaaugugagcauguaaucucuguacuugcagguagagauggaggauuuucccacugguccaccaguccagccaaugguugaauuauaggcucaaugagaacuaucauccaacauccucuacagauacacacaagggcacauguacccccuauaccguacaugcauacauccaugcacauacagcuuuucuaaacuccagguauuaacauuucucuacucaaaauauacauaucugagagcuuaccucaucauauuccccaucagauucuucucuuucuauguauucaacauucucucuuucauuaaaaccaccuccauauccuuuaaaaagagaguauaaauugcuguaacaacucaaauaucaaaauuaugcucacuuuucccagcuaauauaaaaugaagaucuaauaaaugguggucauucacguaacuaauuacuagucuuuuacaaguuaaaaucuacgauagaaaacaaguaggaucugcuuuaguuguaaagcacagcauaccuacagauguuuacaacuuaaaaauuucucauggcaggucauucaugaaauauauauguaaaacaucuuuuucuacuaugacaaaguuuuaaaaggaauuuccucuccauuaaaauucuucuagauuugaacuauuaacuaaguaccaugggcuaaacuuguauucauuagguagcuaacugagacuuugaagguaggguuaagaugaacaaagugccaggaagcauacaacugaggggcaaauccugauguggacaguacuaaucacaagacacagaucucuucaagaagcuaggucuuaggaggaaaccacaaauucaguuauaauguaaugaaucugacggcuacaugacaauguaauuuaaguagcuauauauguaguucaaagaaaucuugauauuguuccuuaagacuuuggcuuuagaagaaaauauacagaaaacaaaggaaagaagguucaaagaagguccuugaagaguccaaauacccagucguaagaugaaguacagaauaauauagggagacaaagagcacugagaagaaggaggagacaaacgggguagcacuugcagaaggcaaagcugccucugggaguuaagagguaggaucuaagggaugaaaaggaacaccuaggaaguugguaguaaggcucuugaacucaagaauuauaaaaaaaugaacaaacaauuggggguaaagaaaauuuggaaugacucgaucccaaagaucuaccuaccauuaggccucugacucccaaaagucaaacagggacaguaguaugcccucagagagaacaggcaagcaggguaagcaguuuuaccuacucaggaaccuugcaugcugaacauguucacugucucugacaaugguuggguucauuguuggcaaugggaaaacuauauucugcugagguucuccauugacauacagaaacaaguuuguaauuacuuaagucaacaauuaccaaauaucauccacacaauuacuagguuuugggacccacucucaagcaagcccaagaguugacccuuucauaguucuuugacaauaugaagcucuuacaagaaguacuauacacuugagucacaggacacggaaccauuaagcugguacugaucugaaagcuuuauccuuacuggauaaucucauagugcuagaagguucuaccaagggaagaaagguaaucaacagucuucacucaguugcaaacccuaccuuuccagaaaagcccacagugcaacagcaacaccauguuauggaaauaaccaaauccugaucagauuuagcucucuacagaagacagacucaagcauggcaccauuaauagggcaaaaaaaaucccauggcagguaggucacaggcccugagggagcugagacaauguuaccgguaaauggacacaguuaagggacacaugcaccuguguucuuaucuuuauacccauagaccaguucucuauuaaccaucaucagagaagcuucuuuuccuauaaguuggagaucaauacagaagccagcaacguguggagugcuuagcucugaauggcacaucuauaccauauccuuuccucuaaggcuggugaucaucaaaagggcacggaaaaauuuuaaaagcugggggacggggacgggggugggguggggcaagguacaugguaguaaaaugguuauuagcuggaccacaguaagcauaugaacuuauaguggcugugacuauguguacaaagacagucuaacaagaucaagccaccaaaguuccagcauaaacuggggagggucuaugaagucccauucaagcugggauaucaucgagaauugaaggcuaucaggagucaauguaagcuucaugcccaugaaagcuacccauguucuaguagacagaugguccuauaccuacacacauagagccagcacuaauguacucggugguuuaaaaaggaagagggauggggaggagggaggaagggagggagggagggagggagagagagagagagagagagagagagagagagagagagaaagagaaagagagagagagagagagagagaacgagaacaaacguauaugagguugaggagggaacauguaguagguuaggagagaaacugaaggggagggaaugucuaucuuaugaauuugaucaaaacacacaugcacauauaaaacucuuaaaacaguaaaaagaaaaugcaaccaaaacucccaacaauaaaaaagauuuuaguuuuaugcuuuguaauuuuguaaauuuaaaguuucucugcuaucuaaaauguggcuaagauuaagaauuaauuuuuaagcuuuacaggaugucuuuaaaauguccuuuaccuuucugucacacuaggauauaugcuauugcuguaucauuacuaccuaccaugcacccaccaagcagaaggagguagaaaagcacuuaugaaaguauccuagaacccuaaaugcuaguguaaggcugccuagcacuacuucauaaauugaaacuaucacauaaaauuuuuuugagugcuaagaggaaaaaauccccaguaaauaggguguggugguacaugcuuauaauaccagcauacaggaugaggcagaagcugagagaugaaagcuauccuuuguuauauaucgaguuugaggccauccaggacucaaacagaacacacacacacacacacacacagacacagacacagacacacacacacacagagacacacagagaaguaaacagauucccuuucuugcuaugcucucuugagaaaguaguauauuucuuaccuguucuuucuucuaauuuagcauacuuuggaguauuacacauguuacacucugaucuucuagcccaauucacauuacugcaacuacaauuauaaaacaaaaccaaaaaccauuaaacuagaaggccccuaaacauugaaaaaauauuauucaaaacauuauggugaaauaauuaauacaaaguaauccugauuaaggaguaaugaaaaugaaauuuaaaaaucuauuuaauauaacauacugagaagugacauaacuagaaauucugcuacugaggggaaaaagcagugcuuuaaucaaagguuccauuuccuaucaucucugaaucuaccuuaaagaguuuggucucaccuuucacaaauauguuugcuauucuuagugcccucuaugaaauccuuugcaguucacuaaauccugugacuuaguuuguaagacagcuuuccuguaaagguucaaggucugucuacaggaccaggacuuuauguaagacguuuuucugguccagugcuuuuucauauauguaggauuuauuuacauagcacaaaauguggagauugagaaaaucaauacaaaaugaaaucuaaaccugaaagaaaaaaguauucuauuuuuuucaagcugucauguggcugcugggaauuuaacuuggauccucuggaagaucauccaguacucuuaagcgcugaaccaucucuccagccuaaaaggcaacaauaaaaaaaaaaaucuaacaagaagcaauuuuuauggaaggcaacuuaagauuuuucaaguugcuuucauauuauaaaagagacaaaaaguagaaucaaaacaaaaaccccaaaucaugcaauuauucagcaacaaaaaguagaccacaaggucuucaaugucccccagaccuuugguuaucagcucauuacacacuaccacagcaacaacugguaacaccccugaaagauaccacuuaaaauuucccuuuuacuauaguuagccuaagaccaaugaauguuuggaucaauauggcauagcaucuugucacauaauuagcaagaguucaucauguuguugcaguaacagacagcaaucugaagcacauacguuuugcauugccaaucauuggcacuaaauaagccccggcucuucucugccagugucuuuccuauuucuguucccccagcuuucaucaucuuggccucaguugucuuuucugcaaacagacaagaacucgauauaaauccugggaaauaaagaaaugaucugcauauacaguauuaagagaauuaucugucagcgcucaccucgaccacaucuguuacagcugguucuccuagcaaaguuuacauuuccacaccugcaaauaaagugagaugcacuuagaguaguaauuccuagauacuuaaacuguuuacauuuuaaacuguccucacuacacccuggaacgcagaacaagcuuaucccauuauguuaauauaagcaccagcagggagaaggaaaagcuggguaaaaaucucaaccuugugcuuacaguuacugugggaaccacuuugggacccaaaccuugcuaucuucagacugguguauaucauuaguuacauaaaagucucuuguuccaaagugucagacucuucuauaacaauuagacaagauaccagagagaguuaaaaaaaaaaaaaggaauaucaacuuucaucuuguuuguuacaaguaauaaaugugaugaguuuuagaagcauaaaauucaagcugggcagugguggcacaagccuuuaauuacagcacuugugagcuagaggcaaacagaucucugugaguuccauagagaaacucugucuaaaaggaaaagauuaaucacaaaauccuagggauggauccaucaggaaugaacaguuacagaaggacuccagagaauugaugaaacauucuuugagagguaggaagugcgaugauaaggaaaagacugauauauuaacuaaagacagaauuaaauuguaaagaaauuugaguauuauaguauuuaucaaaucuaaaacuaaagaacagaaaacaaaaccacaaccaacagaaaaaaguguaaccuuaugacauuaacuaguuaaguuuucacacacuugcacuacuuuaguauuuguuaaagcaguuagauacuccaauuuaaagcuuaaauaaguaacgacaaagaauccaccacccuauuaaaaaacaaugaaugagauaaaauagugaaaggaaguguaacacuaaacugaauggcuccagacaacuuuaaggucccuuuuucuguuaaaaaaaaauacacacguuccaaguaaaacugaaaauauauucugaaaacugucuccuugauuuacauauucaguacaaauaacauuuaguuucugccgaguuuagguguacaggacuuugaaugaaggguccucccaaaauauacaugggugcuuucaguaagaacacaagagcacaguuuucuacgagucacacagaaggcagagaggcuggugucuuaaucucugaaggguuccaaagugucacacaguuccugcagugacaguccaagaggaucucgguucuagucugcugacuugguaugcuuagccugauaucagucugauaccaaccaaguggaucugagugacaucauuuccuugcucuccacacacugcccauguuauuucgguguuaacuguagucgagcaauguauuuucuagcaaagguacuucaggcuagacgcucugcaguagacagaagaguaaacccggguuuccuucagcucugacucuggcuuuccaagaacacgagcugguacaucacuuuucuuuaaaaauagggacaccuauucagaacgaucucuguggccauaagcggagcacaccggcuucccggccacguacgugcccaggccuccugccucucggcaggaggaugagaaaagccaagucacuggggacggaucgcaggcccgaaagcacggcggccgcagggagggagcgagggacggagggagggagggacagcgagcggccccggcagagcucggagcagggccacugaaccgugagcucagcuccgcgcggggucacgugcgggccgcccgcgaccgcucaaggccggcagcgaccgccccgccguccccacaaaggccgcgaccccgucgccgcccucacagggaccucccggccaccccaggucccacgguaucccgccacgcucacuucuugucagggcagauccaguccccgucacugacucggaaauucuuggucgacaucuuggacgccagcagcagugccgcccgcagcgacguccccaccggagccgcgggggccucgcgccgggcuguccucgcgccgccggacccgcccuucccuggggugggggagaacucacaccgccggaccgcgagccuggagcagcggugcggagacgacgcccaggagccagcagcccguccugaggcucugcuucgcuucggccuuaccgagcuccugagcaggcguugugaggacagcccggcccggcggccaucgcagcc

SEQ ID NO: 1771 - RNA, 1488 nt, Mus musculus
acaucaacucuuggucccauauugaacucgaguuggaagaggcgaguccagucucaaaauggagggccaugacccaaaggaaccagagcagcugaggaagcuguuuauugguggucugagcuuugaaaccacagaugauagcuuaagagaacauuuugagaaauggggcacacuuacagacugugugguaaugagagauucccaaacaaacguuccagaggcuuugguuuugugaccuacucuuguguugaagagguggaugcugcaaugugugcucggccauauaagguugaugggcgugugguggaaccaaagagagcuguuucuagagaggauucuguaaagccuggugcccauuuaacggugaagaaaauuuuuguuggugguauuaaagaggauacggaagaauauaaccugagagacuacucugaaaaguauggcaagauugaaaccauagagguuauggaagacaggcagagugagaaaaagagaggauuugcuuuuguaacuuuugaugaucaugacacacuugauaaaauuguuguucagaaauaccacacuauuaaugggcauaauugugaagugaaaaaggcccuuucuaaacaagagaugcagucugcuggaucacagagagguuguggagguggaucuggcaacuuuauggguuguggaggaaacuuuggaggugguggaggaaacuuugguggaagaggugccuauggugguggaggugguggcagcauagguaguuauggagauggugaugguggauauaauggauuuggaggugaugguggcaacuaugguggugguccugguuacaguaguagaggagguuauggaggugguggaccaggauauggaaaucagugugguggauauggugguggaggaggaggauaugaugguuacaaugaaggaggaaauuuugguggugguaacuauuguggugguggaaacuauaaugacuuugggaauuauaguggacagcaacaaucaaauuauggacccacgaaggggggcaguuuugguggaagaagcucagacugucccuauggugguggcuauggaucuggggguggaagugguggauauggcagcagaagguuuuaaaauaaaacagaaacggcuacaguucuuaucaggagagagagcgaggaguuaucaggaaagcugcagguuacuuugagacagucgucccaaaugcauuagaggaacuguaaaaaucugccacagaaggaaugaugauccauagucagaaaaguuacugcagcuuaaacaggaaacccuucuuguucaggacugucauagcuacaguuugcaaaaaguacagcuauugauuaaugcaauguagugucaacuagauguacauuccugaggucuuuuaucuguuguagcuuugucuuuuuguuuuucuuuucauuacaucagguauauugcccugugguagugguaccaggaauaaaaaauuaaggaauuuuuaacuua

SEQ ID NO: 1772 - RNA, 26169 nt, Mus musculus
acaaacuugaaaaaugcuuuuauauaccagaauucaauuuuaauaauuuauauccaaaccuuuuagacuauaaacuugucucaaucuuccuuucucuaagccacccaacacuagccaucuaccuguuuaauauuguaauacaguacaaaugugaccaacgacaugcgauuuuagaaaggcaaauuucuguaauuucagugaaaauauaaauuugcuagguauaggugagaucauauuuauuccuaagacacuguuggaugaacuuaguucuguacuaaaacacagguuaaaccauaauuuagacagaagguacuggugacgauucugcaggcaucuacaacaaggggguagacuccaguuauuguuugaauauguagacagggaaugaugcagcugacauauguucaaccugugaauaaacacaacccagcucuacagaagcaugacuugugaguuuaaggguuuuauuaucaaagucuuguaaaacaauuucagaaacuguacaucaacauggcacagacuguagccuacuuuuguuuuaacugcacaaaaguaaagcuuguaacuaagaaaacaguugccuaccuagucugcauauaacauggaaucacugugcauaagauacuacugcaaucaaaguaacacaaguuuauugguuuuauacaacuugagaucaaauaaaaguacauuaucaaggagagcugucguauuuuaaaagcacaugaaggucaauuuaaaaugcaccaccacuucuuguucaacagugagcuuuaaaaacuaaaaguugaaaacugaaaaucaggacaaggucauuuucuagugaugggcugcguucacugguagagaugugaaauaaauuauugggggaaaaacauaaguagcuaugaaaaagugaacaacuaauucaaaacaucauauuuuacagccaguuuucuuugaaaaauuuuuacuguaauuuaaagccuacuuagccaucaaaaaagguuagugcauauauaaccuuugaaaguuaaacaaagccacaaaaauuuagccacaaggcucaaaaggcuuaucuaucacaaauguuuuuuuucagauguaacucuaagaauguuaauuugucaugucaacaaacaagaccauuaaauaggucaccgugucagaaaguuucaugacguuugggguaacaugcaaucagugcauucccuacauggcucuaucacggcaaggacucaaacucuagaaauauucuaagugaacgcacugaggaucauagacagagacaauccaugccugcuggagaugcaugcagcuguucaucuguguuaaagcagcaguugcacagcugcuugaucacgcaaauggauguaaccauggcaaugcuggucacccggguaccacuuuauagcuuuugcuauaaagcacuagaggucacaaucagguguucugaagccauugguaaugugcagcuguauacaccuaggugagaugaacacacacagcauuagagaucacaaggaaugacacugaggaccaucugcagccagccuugggcucagucacucauauccaugucuucuucguggugaucauccccguucacuuuggacucucgaaggucgcccacccccuucuccacagagcacuccuuuguuuuaggggacacugcuucuguuggucucuucuccucuuucuuuuccuucucacugucauagccuugcuccucuucaucauaaucccgagucaccugcuuugacaaggagaaugggaaaauaagcuucuucaaaggaaaaacacuucuuagucaaacagcagcagcagcaccauggugucagcaccccagccuguauacuuacuuugacgucuuugucacucucagacuuccuuucucgcuccuucuccuugucuuugcuccucuucuuuuuacuuguugaucguucccuuucaucucugcuucuuucuuuguccuuaucuuucuucuucucuuuuuuaugucuagaaagaauaguuaaaaucuguuuauaaaguugcuuugcaaaaacuccugacaguuuaauuccuaagugagcaacaggucuuaagaugaugagcuuaaucaagcucucuagaaaggaugcaaagagcuggguaaucaaaguaagaauuuaagcuggauagagcccuaaagugcuaaucaucccaaaaaaguacauacuagaaaugucaagagaacaaugccuuaaauuccccccaaagaaaauuacugcacauguauaaaagaaaucuaauaauuuaaaaaacauuagucccaaauauuacaaaucacagauauaaaugauaccccuaccuccuuggggauggugagcgagacagcuuucuuuuaggagaccugggcuuuuuaggggaucuuguaccacuccuacuucgccgucgucuucucucucuagaaucacaaacgugcaaacuaggcuuuaaaauauaguguggucucagcagcuccacuaggagcuuccacagcccgagaccugccucacaauacuguuuuaggcaauaacaaucucaagcuuaagaaaagacuaaugugauacauagauccagaaggaauucuuuaucauaucuaauguaaaaaugugaccuacagcuagcacucuggacuauuuuuacuuucuuggugguauuuuugagacagggucacauaaguuagccuugaauuggcauucuucugucuucaagaauaccaaagcuuauuuuauuuuuuuuuuaagauuuauuuacuuauuauauauaaguacacuucagacaucccaaaagagggccaccauguggucgcugggauuugaacucaggaccuuuggaauagcagacagugcucuuaaccgcugagccaucucuccagccccauuuuuuuuuuuuuuuuuuugguuuuuagagacaggguuucucuguguagcccuggcuggccucgaacucagaaauccgccugccucugccucccaagugcugggauuaaaggcgugcgcaaccuccgcuguuauuuuaguuuucuucuaaaaauuuuacaacauugguuuucaacucuuugguccaacuuuucaaguuuuugaaaaacauggcacaaacauggcaaaugcuguacccaagaaucugugaacauccaacugaaaugguauugaacauuaauuaagaaagcuuucuauaaagcuugcugcauuacuucuaucuugacuguaauaauuuauauauaguuacuggagccuuaaaaugacacagucagcccuuaaaauucuaccauucauuuauaaccaaauuaauaucugggaauuaaacauuuugagcaugacacgugacuauaguaaacauaucacaaugaagcuaccccaaacaacucaggauaccuuagucauuaagacuuggcuguuuaagucucauuuguucaacacugagguaacugucugauucuggacuucucauggccugcugaacagccaugcccccaggccucaggugcugcugccuuaccugcuugcacuccgagagcgucuggcugugcuguagcuuuuugguggaguuuuggaacguuucuuuucuuuaucuucuuucuuuuugucucuagcaaacaaaauuuaauaaagggugaugacuaacaagucauucaauguaaucucacccuucuuaugacaaauagcauauuuguaauaaauuuuuucuaagcuucccauuuuuuuuggauaguucacuagaacuuaucucugauagaaaaguggccuaugcccccaauggaggagcuagagaaaguacccaaggagcuaaaggggucugcaacccuauagguggaacaacaauaugaacuaaccaguacaccuggagcucgugucucuagcuggauauguagcagaagauggccuagucggccaucauugggaagagaggccccuuggucuugcaaaccuuauaugucucaguacaggggaacgccagggacaagaagugggaguggguggguaggggagugggggggagagggucugggggacuuuugggauagcauuggaaauguaugaagaaaauaccuaauuaaaaaaaauaaauuaaaaaaauaagaaaguggccuaugcacugagaaaaguuuuuaagaugcuggcuaguuuccuguguuuaguauugaguucaaugggcuuaauugcuggguccuuuucacuugaucacaaguuccugaacucuggcaacaugucagaauccaugucagaauccaauaaagcaccauagccaauccuuugcuagcgccuguuuccuucaauacacccaugcugaggaaaaugcccaucucagacuaagccaaaacagcuaccuuuuuuugcuauugcuagucagugacaucugaagacucucccaccacuaaagauagguaucacaccacacucaauuccaaaauucuuuacagauccuuaccaauucauuuuuauuuaaaucccacaguacacacucucuaccuugucuccuuccuacucuggucguaguccuccaacaguuaucuucucuugucaggcagucuuuauuaccaaauuucccaacaggcuccaguauaccuucucaaguauaccaugcacuauuggucguucaaggcauaaguguauacuauaucauuauauucucccuucaauaacuguucaauauaccugaauuucuacggcuaucacugaacaugauuccuucucaucucacuauuccuuguucucaauagaaaggucuuaaggaaaagaauaccaggauuccuucucuguguacauaaacaguuccuuucugauuaguuaagguacaugcucucaaaugauaaaugauugaaggguagggaaagcagacacuauuauuuuuaguuacucaaaacuagacuguugacuuaaaagaauuucucucugaaugaaaagauggguucuuuuuuaaaagauauauuuacuuauuuuuaagcuuguuauguuucuguaugaauuuaugugcaccaugugcauguaggugccuagaagccagaacaguguuggaugcacuagaccuggaguuacaaguagauguaaaagaaccugguguuaguuccaggaaccaaauccaggucaucuaucuauaagagcagcaaauacucaaacuguuaaaaguuaucuuuccagccccaagacuagucuuaaaaaaagguauuuuuaagugggagaaaaaaaaucuaccacuuauucuuucgucuuacaaauccucaauuuaacuuuauugguccuauuagagauuuucucuaauauggcuacaugucuagaccauaaaugaucuuucaagaauguucccaaauacugaugaugacaugaagauaaaugaacacagcuagcugucugcuuagagcuccuuggcacaaaaaggauaucuaggaguccuaaauccacacccaaaacagugacuaaacggaaaagaggaacgccaacagguagguaacuaaggaauguuaagaguggcuagagggauggcucagcaguuaagaccacuuguugcucuuauagaggacucagguucaauuccagcuaaucuuauggcagcuugcaaccacuguaacucuaguuccagggaauuugauucucauagacugugugcagcaggcaugcacauaguacagauacacagauaggcaaaacacucaaacacauaauuuuuuuuuuaaacggaaaaaaaaauuuaagaaaaaaaguuuauguuacacuuucaagguggcaggagacaagaaaaccaagagcagcauccucaagccauguuucuuuuccacccugucuccucuccauaccucaauucuguaacaaagaagccuggcacugggguuucaggaacuguggcugccgcuucugcuuugcacaaacguaccuggcuuuggaugugcuccuugaccuucuaccccucucucgggaaugagaucgucuccgucuuggacuuuuggaucuccuucuacuccuggauuuggagugugaccgccuccuugaccggcuucgugaccgccuaaaaauguacaucaguaaugugugcaucgaaauaaaauguauacugaacccaucucagagcuaaguaucaagcaccagagaaaaguccccucuugucagcugcgaucaucauuuagcccaguuaucuucuagaccucacaaauuacugauguguguguucaugaugugcauucacuugugcuuguguauacaacugagagucuauaacuguacacucuacaaguugauggcagaagauuccguaacaaacuauagucucccaagaaccaacagauauaaguauuuugaacugaguaugugaaggaugauuuuuuuagaaauaaacaaagcauauuauccuuuuaggaaaaaauaaucuauugucaauaauaaaaaucugccuuccaaaagaaauaaaaacauaugaaaaacuaaguaugagucugauugguuuucugaugaagucugagauaucauuaaauagugcauaguguuggguagcaaccaaaagacauacuaaauuugggcaauuuaucaagcacuaauuauaauuuccugaaaauauuaaaacuuuucuaagugcauacucaagaggcuagguuuuaaaauaugcaaacaaggcugauuaugauaaaaauaaucuauguaauuuacauauuaaauaugugagccaaucauggugaagaaacagguggaucucugugaguggccugguguacaugaguucuaggccagcaaagguuacauacucagacuaucucaaaauaagccccccaaaggaaacagcaaaaguaaacagaaauaguguaaaauuugaaaguagaacccuguuucuucuauuaaguuaaaacuuuagauuggugaagaacaacaaacccuuguuuucgggguggugaguuauguugcagagcuauguaaaaugauauggauuagcuguuaugacuuacacaauguuuaauauagucagauauaacccacauaagguacacugacuuuauuuuuuuuaaaugugaaagcaaagacuccuaaguuuggagagagacccacucugcuacagaaaaaaaccuuacauauucacaaaaggguauaaacuaaugugagagauccacuacgcagaucuagaucugauuuuggguaguagaauuucaaguuacuugcucuuugauacaauucuaacauuuuaguguuuccuaucagugaaaggacuuaacacugcuuugauuuuaaguaggaaccaucuguucacacuacacauuucuccuaaaaugcccaggaaacccccucucggacuccaugagcagcaaugucuaaugauuagaucuacuucaccgaggagguggucuucagggcaccgcugauggucaagagagcuaaccugugucuggaggaugaggggguccuccuccuccucgagcgagaucuugaucucgaaugucuucucuuuucuuccuucuugucugauuuaagaaaagaaagaaaaaacuguauuaagaaaugcuuaacccgaggugugugugagucuaugugugagauucaggaaucaaaguccagcccuccagguguccagaggcaugugugaccaaugagacaaugugcuggccuucaaagaauaucuugucuuuauuucagccuuuauuaagauacccucaaaugcuauaaaugauccuauuuccacucuaggaagcuuuagagacaggauuccucagcuuucaguaaacccuauggcgacucuaacuguuaacugcuaucugaucugaaaugcuccugagggcucaaucauccccauaaggcaccucuguggcuuucucauucggucuuuagaagucucuacugaaggugguucacaaaugcaccuaccuuuaucaggcacuaauauaaacauuucaaauccugauccaaugaaauguucucaucauacacaacugugcauguauauauaaaggauaucaagaauacugucucuagcaccuaaguauaauuuauaucaaaauuuaaagcgaaaaccaugacucauucucccgucccucuacuuuagugacagaaucugacugauuuuaggaagacagcuauuuccuaauauaugcccauucuucaaggccauucucaacuguauacuuagagcaaaacugccucauuucuaacauaucaaguuucuuuaacucaggaucuaagaggcaacuaaagccauugcccucuucacguguucaccauuaccaaaugaugccacuaguuuauuuugucauuucauucauaggcuuuaauuuacagguauuucacaagugaagccauacaaucauagaauucauuauagguaaaccuuagucauuucagccuguuuuuaaagagaagcaguuagacauucuauugcaguacaaacccagcuguacaucuaugaccccuaucacuuaugugacaccuuaucagaugauauacuuauagcauuugcuaucaguuuauuuuuaccaguuuaucaaguaauaacauucacacuuacuaaggaauaggaguuaaaaaaaaugaaucaaacauuuauuuaagaaaaugugcuucguuaccacagauuuacauauacauaacacacauacacugggaggauucaucuaaucaaccucaaaaagacaguguccagagcuuguuuaguggugguuauaccugcuuagcauccacaagccuccagguucccucucggcaacuccuaccaccacccaaaagaaucugauuggcacuguacuacaugauuuuugugucucagaauacagaaagucuuaaaaacaaaacaaaacaaaaacgacaagaauguuauucaacaacuucuacauguaggccauuaccagcuuuaccaagaacuaaaauuuaacauguguaugagcauuuuaccuggcucaauagcggcagaaaucagggacugggcuucacgcacucucuucauggcuuccucuauuucuuuacuagaggugucugacuucagacuuggugaaacaagaccagcugcuacaugauucaaucuggagcaagaaaacaguuuaaaauuuaagcuuccauuucaaguaaacagguauguuucacauaccaucauuauuuguaaauaauccuugaaagcaaaauaccgggaaccaccauuuuaauaagcagcaugcagugaagugccacuuucaaugcuuacagagaccuggaguaagaaaauacuuauuuuggaaaaugcuaguauaagagaacauauugaugcucaaguuaaccuuucaccauaggauuuaggggaaagcauuacguauuagacuacagaugggaagaaacuaaggcauuggucaauagcucauaaacuuacacaugaaaucuuaaccacaaaagguaaugaucuguguuuaagugcuuacacaugcaagggaaaaagcaaaaacaaauccaauaaauuagacaaccucaguuaucaguggagagggaugucaucaagaacaggcacaaauggcccuugagacccagcaggcaaaggcuauugcuguuaagucuaaugacugugaaccuccuuaaaaccguccuaacccgaauacacacuguagcuuguaugcaugcacaccacugcgcuaaacagauuuaaaaaaaacaaaacaaaacaaaacaaguuuuuuugaaagagugcugggugugguaguacacucauuaauccuaccacacaagaggcagagggaagcagaucucuaugagcucuaggauagcuagccugaucucagccaaggcuauaugagagugagcauaagagcccauuauguauuggugcuacuaauaugcugggcuguggggauauuaaucaacuaagccauguccuuuguccugcaauguuccucuacucacuaauagugauguugacuaccuccaaauuaggcuacauuggaaaaagccccacaaaucuguuaucuaucaaggagaaaagaauucuaaguacugggguaaaaguaccuauaagacaugguaguguuaguccccuaauauauucuuccuucuccaauuucuuuuuuuuuuaauuuauuucauauauaugacgaauacacuguagcugucuucagacacaccagaagauggcauuggaucccauuauagaugguugugagccaccaugugguugcugggaauugaacucaggaccucuggaagagcagucagugcucuuaaccacugagcuaucucuccagcccccuucuccaauuucuaccucccucagggcccagacucugaucuaaaacccaagauuuuuuucucuguggucccucccccuggcacuucuauauguuucccauuucaauguacguacuuugccacaauaaaugcuuaauauugauuacagaaauccuuugugcuuuuuauugauuuuuuuuuuuggagucagguuauuaugucgccagucuauagaccaggcuggccucgaacuuacagagauccaccugccucugucccucaacugaugauauugaagaugugcaccaccaugcaugggcuccaauguguauuuuguauaaaucaucaaaauacaacuuucacacuauaacaagccacucacaacuauuaggaaacauucaaaacccuuauuuuuggauucccuuucuuguuucuacaauauaaucuauaauuauacaccaagcauguccuaggaauagcuaauuuuuuuuuucuguuaacuguaacuguucuacaauguaauauauaacagagaaacuauucuuaacuugguauaguggucuaugccuggaaucccagcacuuggacaggaauuugaguucaggcuugaccacauagugaacauauggcaaaacuauauuacacagauauaaaauauauuacauauaaaacuauauuauauguaccucaagaagaaaacaaaaguaaguguucuuuugacaguuauacaguauaaaaccaaaagagacaaauacaaaugagaaagcuuacuugggaucaacaguacucauaaguuucaauagcuggucugcagcaagggacuaaaaaaaaaaaaaaaaaaaaaagacaaugaacacacagcaauaagugacuguuauuuuaaguuucuugaaaaguugugggacaaacuggcaaccuauaaagugcaaugcuuuguguauauccauggcaaaaagguaaaaugcaaauuaugaauucuaacaauggguaacuuuguggcuaagccuauagaagaggagggaagcaaauuaucaagaguaaggcugagcagucuggguuuauuaggaucagcucuugcuuauucuaaagacuuaaaauagaaaaucugaaacuccuuagaguaacagaacaucucuaaaaaguacaaacuccaagaaacaaaauauucucuaaaugugucaaggauuaaugacugauguaauucaguggucauuuaaaaaucucuuucaaauaagucaacagaguaaaaagauuacaacacaaucagcuaacccuugcuuugaaaugcaaaccaagguuuaaugaaauaauacccuacaaacacaagcucacaaaugaaagguaguaagauauaccugagaguucaaguuuguuccuggaagcccaagagcagcaagggcaggaucaagagcuggagcucccaacgcagccaggggaacagcgccaaucugcaacagguaaggguuuauuauauaaaacaucuuuaacuuucaguauugggcuagacacuaacuuuuucauuuauaaaaguacuacugccaugguucaaauucugcuguauaaacuaucuaaaaacuggacauaauuaugucccaguaaaaauauaucaacagaaaugaggguugugguuuguaguuccucacaccuguccauaugauggucaaccucucauuuucuuauaaaacauuaauucucuaugaucuauaaagagaaauggcccucucaauauagccuuaaguacuaauugcauccucaaugaaaaccagcucugugcuaugaugacaggacccuaaguacuuuucuucuggcugcugucauuuaugcaugcugucuacugucuguuuggauacuaagguagaggcuucuuuuggaagcccccauauccuguucucccaguuuuagcauuaucaaguacaaaucucaauacuaaauaaguccucuggucaaaauguuuguguuccuguugugcagcacuguuccucacaggacugcuagucacucauuagauguaugguaacucuuauucccuaaucauccccccuuuuuuuuuccugauuuacacugccaagauccugucuucuugacagaaguuuuaguuaaaccacaauuaaaucaacacaaacaugcaaagucuuacagaggcagucugacuuuccauucaugugcugaagucgucuauugucaaauacuaccucaaacacuaaacauacccuuucuaaauucaauggggccauaccuggguaaguggguuggggguaggcaggaguccaccaccaggcagaagaccugccacugcauuagcuggugccaauagagacaaagccuuagucucaucaggaauaacuccugcagagaaacauccuugcaugagaacacacucucuuugaagacagaaaacacacaaaaacacccagaaaaugucucccugauacaccaccugaguuuguugaaaguacuuauguucgcuaaaauauaaaguuugaucucuaugauuauuuaucauuaauuuuaugucagaaugaaacuucaaugugugaaaauuuguuuccuuuuucucuacaaugguuaaguuucuagaguaaaaaaaaauagcacaauacacacuacuguuuuguuaacacugccaagauuucaucaccuguacucgauuuuuaagucaugaaccaaacguaagcaagcacagucgguucuccaggggugugcucucaacuuucaaaagcuguuuuaugaacaacgacucgugucggcugcuucacuauaaagcacacagaaaaaucaagauacacaagacaaaaaaaguuugauuuagggguuaauaauaugguacaguuacuaugauuuucuuuacaccuaccauacaaauuuuguaaaaauuaaaagaaggaaaguauguaaaggaaauauucuguuggaaucaagaguagggcuuuugcugacucaugacaugaauaugaauguuucugaaggucucugaauacacaggggaaauguguguaaggggaguaaaggggagagggagggagagggagguagagagaaagagaaggggacgcagagaggaaggagggaagaggaagggagggggaaaagagagagaaagagagagagagagagagagagugagaguagguaaaacauggcacauuccuuaccuguacaguaaaaugcuuuagguuccaauaugugccaugcuaaccauaucaaaaaaauguugcuauauagugucaguucaacaucuaacuuguucaaaacuccuuaagcccaaaaccacauguaugccugcuuuuaaagccuaaucuguguauucagauaaaaucuaaagguccuaagacaaauuauuuauguagacaauuuaaauucuauccaacagcaaaagcccuauacagauggauuaaucuguuaaugugcccaagcccccaaaaugagaguucaauaauacaauuaaacuacauauuugcaaauaccaguaguauuucuguaauacauauuaagaaacugcaucucaucauaaaacauacaauauguacagggcacuuaagagaaacuggauaagcugcagaagaaaacuguugggugguauuuucagcagggccugguauauaguucaggcugaaccagggaaaagaacuguaaaacacaacaacaaaaaagaaaaaccacuguuaaauaaagguaaugguuccuuccaccuacacugagaagugccgauaauauaaacaaauguauacuacacagcacugcuaucuugcuugugucagagcugucaucaauuuagauaccgagaguuauggaggggaggggagaugaucauuuggauauaggguauuaaugcaucaauauuaacaaaccuacaaagauaaagggauaauuuugcaugcaaaauuaugucucaagaggauauauuaaguauaacauauuacucaaauuaagugcaucuccaacauuucuggcaaacuaaaauccucuugaauuuauugugagacaccugagagaagaucugcauccauuaaaaaaaauucaugcaucugauccucugauuaaaaaaggacuaaaaacaaaacuacaauuuaaaaauagcaaugaggccccucaccaguuaauuuucaugcgucaagaguauuuuuuuuuuacugcugcuuugauagaaccaugaaauacugcaugaauguguagaaaugaaagaaaaagaaacagacaaaagaaacaaacauuaaccaaggaaccuagaugcccccaaauccauuacuauuaagagcaccuuccacauccagcuagcuaucucuguuuuaccaagugaggcuauucuuaccguauacuuuuuggucuauuguucuaacacacugaccaagagccaacaccaaguguuaagggcuaaaaccaagugacuggugacaaagggauugaauauaucaguuuacuuguggagggaacauuaauacagcacaucauaccacaaauuaaaugcagcaaaaacagauuccugaacuaaguauuucuaaagcucuauauauacuccccaaaaccucacuuucaaaaucacaucuacaaaaauuacuauggcuuaaaauaauuauaaagacccagauauaugauauacuauauauuccaucccaagcucauuguauuauggcuaacugaagcacucugcacauuacucacaugacaugaccgucucaagaccuacugucuacuuuacucauccugaauugaguucuguaaguucucuguugguguaagguggugguuaagucuuaucuuaaagaggcauacugaaauaaaaggaauugcuuauccaaaauacacuaaaucagcuucuuucugacuuuucuuucauagaaacauuguuacuggccucacaucucucacuuuaguacacuguuaccaaaauagcaugccuuaacuuaucuccgaauauaauuucuuuagaaaaaccagaggcaauucucuauuagacauuucacaacuuucacaaaguaugguggcaaaucuucacauuugucuucaauuaucuaagaagcaucuaaaaagcaacaauuacaagauacagcuuccacuaaccaguuuauuaaaggaaagggaaagcauguagaucauggacaguauauucaauuauuaaguuaaaauuuaguacguauaucaugucaaugauuuccucaaauaaagauuuauaguuaccaaaagcaaaccaagcagcaguuuacugggaacaagcuaacuguaaaguaugccuuagaaaaguuuuacaaaauggcauuaaaauagugcuguccugucacaguggcuuuuagauccaaaaaccugcucauuuuuuuuuccugucaaauuacuguaacagccuaaaacguaaaaagagagaaaaugcaguuaacaaauggugacagcaggaaacacuugggggcucgagugcucgcugguuuaguuagugucuagagccugcagcugcagagcacccacuguguccagccaucugggaggguuuugcaugugccuucuccacuacaaaagucacacacacaacagagagaagaguuuauuauuuugagauauucuagaaaauauaacaagaacaagaaaaucugccauuaaaaacaaacacccaguguccaucuggcaccuaaacuauaggaaaucuuaaacuuuuacaaaacuaaaauuauugcaacccuugguauacuggaauucagcacgugguuuuuguuuuuauucuauuuuaagguuggagugagugagagaauaaaggaaauaaagcugacuuagcuacugacuuuagaacauaagcaucaugcauuaauuugaagguuccugugaggaugauaugaauguuuaccuuugggacuucuuaauacuuaacauuaauagaucucagaguuuggaauucaguuuaaaaagcuuaaaaauauuuuaaagauagcaaaaaguuaauuaccuuauaaaacagacuuuauuucucaguuuuagaguaagaaaaaaaccuccaagucauaauuauggagugcaguauaacaaggguuucaaaguaauacuuggaaucugacaggcuagugaugcuuacucuacaucuacacuguggccaauggccaggcaggggugcccacauagguagugaaacaaagcacaaaccuucagcauaugguacgacuaucaaagcucugucaacgaacacaguguuugucagaugcugugccacaacugcugagucuggaucauggaacuuaacaaagcagacacgagaggagacuggcaaaggugagucacuaaaagauaaagaaauaucauuagagaaaaacagcacuggcuaaaacacauacacaucaccaaaaggacaaugcucugguaaaaauacauagaugaauguuaauuuguuuuaaauugaaaagagaaugucuugcaugaccugaugacuuaacagagugagaugcagugcagacaugcucuuauaaucaccauuuaaauuguaacacagcagcuuuaaaaucauuuaagucagagagacaacuauaucauuuuagugacugugcauacaugugcuugcguugcuuaagcucaggguagacacugaaccacugaccuacaacccuaguuccaacaccaacuguuuuuauacacagugacaguucugguguagaaaguuuuuauuauagguaauuucacaguguagcuuuaaagguagagaguagacauaagcaggcacaaugacacaacccuauaauccccgucucuccaggaagcagggacagaaacuguaaauuccagaccagcauaggcuacacugaagccuugucucaaaacaacaaaaaaagcuacaucuauuugauaaucaaugaacauucuuggccugaacaacaaaccgaucgacucaacaccuugacccuacaucuguagaauauauaagaauucuuuuuuuaaaaagauuuauuuauuuuuuauauaugugaguacugucacuguccucagacacaucaaaagagggcaucaaaucccauuauagauaguuguaagccaccaugugguugcugagaauugaacucagaaccaguggaaaagcagucaguucucaacugccgagccaucuuuccaccucuauauaagaauucguaagcacuuuaaauaaggcuuucuggucuaaagccacugucagacaaaagaaaaaaauagcacauacccgggcauauauacauguucuauagcagcuccuccccguacuacacuuuaagaagagcacauugcuuccacagauaagugauaaaaugcaagcuauggaagugaaaggugauagugaagaacaggcuuuuaaagagacauaaugggucaauuccuagcauaacccagaccacaaguuacuugggaggucaguuccccaggaccaguaacaaucuuagucucugacugugagaaacccuauccaggcucccugacagcacagcaacauuaacccuuccuucuacuuuaauuuuuccugauaugugaauaugagcuuagggugcagaacaaacugcauccauaaagcugaaagcucaauguuucuaaaaggauaggcuuucuuuuaagacaggguguuauguaaguucaagccuugcaagacuccugauccuucuaccuacaccuaccugcugagauuauguggcucaaugaacacauuuuuaaaaaaugugucuagaauuugagaaaaaauuucgaucagaaacagugaaaagaauguucuagcaugagugcuaggacaccuguuuuguuuuguuuuuuccugucauuuuuguuuuaaauuuuaaccauuacauuuacaaaguucuucaaaacgaaguuaccuucuguuuuuaaaacccacagaacagcaccuuaggaaauuauaggcauucuuuaacaccgguaacuguuggcccaauuuucggugaaaacaaccccaacccaccaccacaauaacagcgaaacucaaacuaauucuuagaaugaagagaugguuaagagcacuucuugugaaggacccauguucgauucccagcauccagaugggcacuuacaacagucaauaauucaaguucgaggggaugcagugcacucuucuggccucacauuaggcauacacaaggcacagaaauacaagcaugcaaagcauuuauauacagaaaaggaaucuuaaauaaagagagaccauuauugaaguauauauaaaacaauuuuuuagaaagucagaaaaaacugccuucaaguuaacuaugucccacuuaccaaauacauuuuauucuguguaaggaagcaagauaagaaaaacaguucccuuaugcuucuacugcugaaagaauuucaaaguaucuucuaagaaguacauagaaaauugugaauucugguguuuaccaagaguccacagaaucagaauaucuuucccaggagggacauucuuaagaucccccuauucauggacacucaaguuuaagaacuugugguuuaaaagcaugauuuuuggcagacaaaguucugaugcuguuucugaagaggaugaccauccagaagaguucaugccaagcucacuccuaaacacuguauagaccuguaaaauccuauuugcacuccacaaugaaacacacacacacacacacacacacacacacacacacacacauguauaaaauaggaaacagauucagaaaaaaaaaaaaaaaaaaaaagaacuugugguuuaggccauuacaccagucuuuuaacucuaccuuaguacugugucagccauuucuaagcagaagaccuuuacgcuuuauaaaguaaaaggcagcacagguaagaaaauaacaaucacuugagaacaauuuuacugaccucauaugccucuuucuaauuauaucaugaaauauucaauaacucauuaaaguauauuuuucuugaaaaguggguaagaucauuaaagugaucacugaucauguuugguuaugaaggcuucaaaugaauaucuguugacaguagccuucgaguacagcauaacacugacaugugucacugggauccuuaccuagguaaguaucccauugugaaauuccuuuaaaacuaaauacuuuacuauccacuucuacaauaaacaccaugucuauaaaucauagcaauugagaaguaaaagcaggaaaauacugauuggaggucagcauagccuacguugaccccccccccccccccccccgacacacacacuuacgaagcccuucccuggucugaaguguuuuaguaaguguguuugggguaugcauucuucaaaauggaaugcugaugaacucaagaaucuuguucuaugaaaggcaggaaggcugaccuuauucugugaauuggugacagcugccaugcuacuguuugaaggugaguacacaguacccuauaucauuucaaggaauaaacaaacccugcaacuauucagcuuaugauggaauuacccauaucaccacaaaaagaccagcuuaagucuaucacaaccuccuuuaaaguauuguucacuagcuagguaggucuacaaggggaaaaaaaaaaaaacuaaacaaacaaaaaaguaaaaagcccaauacaacacccacuucuucuucuuuuuuuuuuuuuuuuuuuuuuugguuuuucgagacaggguuucucuguagucuuggcuguccuggaacucacuuuguagaccaggcuggccucuaacucagaaaucugccugucucugccucccaagugcugggauuaaagguaugcgccaacacugcccggcuaacacccacuucuuuuaucuuuuauaauacaguauagauuugcuuuggagaauaaacaaagugagugacuauaauaaaacuuuuaguaaucugcaagauuaaaaucacaaguugaauauauaaucuuuuuuguaguuuuaauauuaguuuuaggagcaaucugaaggguaggauguguugaaauaaacaacaucaauuucuguaugcuuuuuuauaaggagcuacccuguggauuuccaaggucaagauucugcuccaaacaacuguuccuaaaacacuacgaaacuguuaacauacuuaugucaagcacuaaacaguuauguaaaaauauuucaaguagggaagucaugaaaauuaauaauuaacacauaagacuuguaugauuaacuucagcaugauuagugauuacacacacaacagaugacugugaugauucucauuucuuauucugaauuuaagggacagcauuaaccaccaaaauuuggcugguaguuuuacuaacauuaaccacuauguuuucaguaaacguuauaauuguuucuagaggacauacaauuauuucaaauguguuuucuaucuucauacuuucuuuguuccuuacaaugaauacacguuuaauaccgcggcaauaaaaaccacuuuuaaaacaagacaaaacccacauaaacccuaacucaaauuuaaacauuccguaaauuauuuaaacacaacaggauucagcuaugaugaauuucucugaauuauauaaaaacagcauucaggucuauugacugagucuucugucuaaggguuauaggguuugaugcacuucccuaguucaaaauuacuuaagagcaauccuuauuuacaucaagugaauauaacagcaacaauuuuacuuccuuucuaacaaagcacuggguuaguuuuuccuuuaaaagggggauuuaaucgaaacauuaagugcccaaagcaaaaugaugguauaaacaacaccaagaggaaaaacauuccuuaaacuccaaucgggcgcuuaucccuggccugcggccuggcaggcccgcggauuuuccacgcuaggcuccggcggaccgcgcgccucgccucaccggaagggccucgggcccgcagcgccccgguacucacuccggcgggaagaggcgcagcucgucgaucuugcccaggaagccgaagagcguacgcaucugcucugagcuggcgcucggagacacguuggucaccuggaucaccucggugccgccgccuggcccgccacuggggccugggcccgggccuggcgcgcuggggaccacugccgugcugcucauggcgcgggcugccuccugcucaacacaucaaacacaagacagagugagagcgcgcggcaccggccgccggccgcacacaaacggccgcggaccucgcgcagcgcagccggcccacaauuccacacgcccgcccgcgcaugcgcccauaucccggaaguacgcguccaguucgcgcucccgcaacugucccggcugcgcccacccagcugagccaccucagaaaugguuccugcuuacuccacauagcaccagaagcauuuucaggcagaaucccuccaccuagccgcugaaaccuccagcaaagacaguuuaacacacacgcccugccucucuguucgcucacugaacuuagcuuaccuuuacuguccuucaauauauuacaguauacggucagcaguuugaaauacacccgcuuuaacacgagcauucuucacuacaaaaacaaaacaaagaccccugccuuauuucuucagccacaucugaccuauuccaguucuccaacauaaaaaacccaaauuacuuucucuaugccuuuacagaagccacuaaguucccuaaucucaucucaauaccaccuguuaguaacagcacugcuuuuguuauucaaauguaugucucagacugcagaaccuagcacaaauucugaguuacuuccaacgagcacugaacacaugaacacucaccccacccuacuuuaauuagucauuuaucauacaggccacgcuaauuuauuugacucaaaacuaccgagagcuaaaaaccucagacuuuacacggagaguuacaaaucucuacacuuggcaaauaacucuuggccaauacugaaaaggaugcaacugacuugcuaggucuacucacuaguucagugacauaguucuuaagcacagaagggaggggcugacuaaugugccucaucagaguuuaaaacaaaacaaaacacaugaucacucaucaaucacucccaagauaguguuaaguaguuucucgaauaacagguaucacucacuguuaauuacagauucucacagaucaacguucuuaguaucaggaguacauacaaugcccaugacagaacaaagaacacaauaauaagagcucaagcuuugucuuuugauuuucaguguuauuuaacaucaguuuauuagcuguaaaagguauaugaaaaucuuuaauacuguuuuacauuucaaacaaaaaauuuuauuacuuauuuauaguguaugugugcgucacagugcccuuugaaggugcccucauuccaccaugugggucccugaucaaacuuggguuuaauccaucucuacauuuuucuauaugcuuuauguuuuauaauaaaaauuauaguuaaaccaacaggguuucucuguauagcccuggcuguccuggaacucacuuuguagaccaggcuggucucgaacucagaaauccgccugccucugccucccaagugcuggaauuaaaggcgugcgccaccaccgcccggcaugauaaaaucuuuuaacuacaaaucugauuuauguaagacuuacugagcacaguaaucgagggcauuugaugcagaaaggcuagcaaaaaaguaauuuauuuaaauauuuuccaucuguuuugacuaucaccauagagcuacuaaguugaauaggcaaugaaauacuuaucauuguuaaugacuuucacagaaauaauauagcuaaaagcaggugacaaaaaucuuaagacaaacaguaaguauaucuaaucuaugacaguuuaagugaucguaauuauuugccagaaaaggcaacagaauuauagaaucuggauauaggcaacaaauucuuucuucuuacuauuucuccaauauuauaaaggcaucccaaacucacaaauuucuccaaauacuauaucucuacuaacuucuagagauuucugagaugcuagaaguauagcauaacacagaaaacaaagaaaagacagccaauguucccaaucuauuggaauugcaguucucuccauaagcaaacauagagauguaagaaaugcauguacuaaaaaggcaagaaacucugcacaaauuaaccucuuuuucucuuacuagaacggaaacuacuuauuuaauaagucagucaucaacuauagcuuucaacuaugaaaaaagucuaauauauaaacaaaauuucaugagggacacagcgauguuugaaaauguacuauuaaauuguagugguaagaauggauuucccuaucuuuauuugauaauaaguuuuacuuucugucacgaaacaaaucagcacuuucugggugacuugauugcuuauuuuuuuuuuuuaaguaaugucaagcgauauuaaauaaaaugcauauaauaaaccauagccaaacaccuccauuaaaaaaaaggcagguaugccuaaucuuuagcaggacagaagagggcugcuuuucaguauuccagagcuggugauagaacccaacgucuuugcaagauauguaaguguucuauaacugaacuacaucccaaaagaugugaucuuuuauuuuauuuggcgcuacuucaauaaugcagaaugucuaauuaaaaaaauuuuaaaauuuaugucuguguguguaccuguaugagccuuuaugugcaccaugugugugcagaugcuggcagaggucauauucucugaaacggaguuaaaggcaauugugaauuguccuggaacucacucuguagaccaggcuggcuuugaacucagaaauccuccugccuccuaccucccaauugcuaggauuaaaggggugcaccaccacugccgggcuucaguaggugcuuuuaacaacugagccuuccaauuguccccauauugucuaauuuuaaaacccacaaauacuuugagugccacuacugaaaaauguuucauuuuaaaugcauuauuagucuuaagguaauucaacuaccauaaagaacuaguugucaagacuacccucauauauuuuauaaacaagcucaauccaugaauuaccuuccaguuucuaucaauuagcaacaaauagauaauuuucucaaaugcaagagauaauuuuggcuacaaccuguuuauuuuucacaugcuauaugaguauaacauacaguauauuaugaacuuguauuagccaaauccuuaugccaguucauaccuauugauauagaaauaugcuggaugugguggcacucauuuuuaauauuagcacuugauaggcaggguggauuucaaguuggaguccagugugaucuacauagugaguuccaggcuagguagggcuacauagauucuguagacucuaaaacaaaacacaacaaaacucuaaaauacauuugggugaagaaacugcaugugauacaguauggucagaccacaccaaaucuacuuuucaacuaauacuguuuuucucauuaggaugacaaaagaguuaugcagccuucucccugcauauguucuuuacauuuaaaagaaggggagaaaaucggggcuggaaagauggcucaguguuuagaagcacuuaagguuuuuucagagcaccaaaguuugauccaggcacccacauggcaggcggcucacaaucauugcauaaccacaguugcaaaggaucugauauuuucuuagagcaaaaaaacacaaacauaaauacacagaaaacaaauuaauuuaaaaacucauuucugugauggcugacauguugauggcuaacuauguuuaaaaguuaaaaaucucuguaguuaggcaaaauuagaccuccuauguuaaggacugcuaaggauauauauuuuuaacugauguuccuguaaauaaauuuguucugcuugaacauaaacacauuguaauuuugcauucuuugccuuuauaaacccgacugagguggcugggcgcugcauucuagugaaucucuaaacaucccccagacucauaaccauuucauacuggugagauggcucugcagguugguggaaaaaaaaacccacucccucaaguuguucucuaaccuccugaggcaccagggcacgugaaacccuauucacgugugcaaaaagaaacacuaaacuuaaagaggaauguaauagaaaaucaauuucagucaaagaauuuggucugcgcuggacacaggauucacggcccugcccacguuagggaauuauauccccagcccuggauaguugagggcuacuucuucguuugggaaaauauaucaauacuuuguaaacuccaggaaaaacuaagcaggaaaucgcuacuuauuaaauaaaauuuucuuuuuuguauuuacaacaaaacuacgcauuuaaauuuucuuugcuuucuuucuuucuucuucuuuuuuuuuuccuuuuuucuuuuuugagacuguuucucuguugcucuggcuguccuggacucgcuguguagaccuggcugaccuccaauucaagagauccauuugacucugccuaaucuagugcugugauuaaagacgugcgccaccaugccaggucaguauuuacauuuucauuauccgaaguuauuuuuaaaacuucuuaagacuggauuaucgguaaaucagugaaaaaugagcuucguaagcgugggaccaacugcauaaguuagucuguaagcgagcaggauucgaaguccgagcccuucaccacagcuuuuagcugucagguggguacuuaagcuuaagggccaagcuucgugucacucgccauccuguucuccgggaucaauucgaucaccgcacugaacucagcgauccccaggccuggcgcccagggccacaggccgcgccucagguuucgacgccgccacguucugaugcgacguuggguagcgcagccaugcccgaccgcgcugucuagggagcccauguuccccccacgaggaccucucagcccguuagacgcacuuacccgaaagaaguuucuccugagggcgagguuggugagggcaacggaagggcucgucgguccugcggucccgggagcuggcggugacgacaucagcgcgcgcagcuagggcaaggcccggauuacug

SEQ ID NO: 1773 - RNA, 35084 nt, Mus musculus
uauccagccauggcaccuugaaacgucacagccguggucggggcuuccggugugagcuuuugaauaugucgcgccagcugagagccccuagguuugacccucgugcgggauuccacgcggagggcaaggacagaggccccucuguuccccagggccugcugaaggcagcgagaagcagcggccaacucaacuuggcgggaaggaaccucggggaaggugaggcagcgcgcgaacauccucuugguccccugugcacccacccgcgccugcuccguggcccugcuaagacuggccuugacuuacucgaaguguucacugagauguccacagaauacgggauaaacaucguaguuugggaguaaauucgcugugagauagaggauaggcagguauuugauucgccuuccucuuauuuucguuuuaccagcuccccucugugagcuuagaauaauuuucuuucaagccuagccuuuuuuuuucuuccacuugaggaaaaucccaaugacaaacauacuccuuauccuaaguacuaauucagaguaaaugcugcggaguauaugaauuugagaacauccugagaaaccuaugaaugaucaacaagcacaaaucuacauauuacuaaguauaaauaaauaccuuuguaguguauguguuugguaggagaggacagagacaaagagaggauugagaagugaagcauucuuucuguaauauuuuuuucuacuugcauugauuaaaaucuuccacuucuaauaauguacuuauguaucuguaagguugacuaaguaaagacauuauguguaugcuuacugaaugugaugauuacuugugucaaguugacacaaucaaugagggauuauuuagaucauguucucuaugaagaacgucuaugaagaccugucuugauugauaauugauguaggaagaucuagcccacuguggguugugccauucccuaaguugggucuugaauccaaagguugagucguauaaaaaagugugcgugccuuaauucauuucucccucugcucuugauuguaguuguguugugaguagcuguuccaaguuccugccaucuugacugauggccugcaaaugaaauuaugagcuaaaauaaacuuuuucucuaagguucuuuguuaugguauuuuaccacagcgucuggaaagaagaguagaauagaaauugguacccagaaaguggauaaaucugacuacaugguuccuaggauauuugaacuauuuuauauggcuagaauguggaaggcucuggaauguaggucuaggaaaaaagcugaauguuaugggcagagcauaauggacuguguuuugguuuguuuuguuguuaugggaaguuggaaaauaagaaugcugacagaaauguagacauuggaagccugacuuuugaaguuuuacagggcaacaaggacuguggugggaacuggguuagcugccauuuggauuauauuguggccaagaaauggcuuccuucuuucuacccauguccugaguaccugagagaagacagauauacugguucguuuggcagaggcaauuuugggagaguauucagacugguauugaaaaccguuguauaauugcuauaccauuguaaagcagccucuugcacagcauugggacaauaggaaagugguuuuuuuuuuuuuuuuuuuuuuuuuuuuuuuuuuagggucaacacaaguaagcuugucggugggucugugggggauugucuuggcuaugcuaauugauguuaagauccccccccccccuugaucucaguuucugaauuuuucuuccauguuucuaacuuuucauucauauuguggauguuuucauccauuuugcugacuuucuucucugagaccuagguugaaaccaucuacuuguuuguauccucuuuuaauuaauuaguaauuucuuacccgaaaauuugaaaguuucauguggcauuuugucuauuucaguaucugugaagaucaguugcaauuuuugagggaucauauuuccuucacuuuuuuauaguucuguguugcaguuugcacaucuguugguuuguauaucuagucuagaauuuuaaguagacauauuaaguagacuguucuugaaggcucagucuccaguaccacccaucaagaaagaaacagacuauugugacuccaaacccaccaaacuauaaagauaucuauacauugaaaauacguuauugcucacuaauauaccauuacuaguuguuguaguaaggguuaccauugcugugaggaaacaccaucaccaaaagcaaguugaggaagaaaggguuuauuuggcaucauugaaguaagucaggacaggaaccuagaaggaggagcugauuuucugcucuuuuccuauguucuuuccccuuuuaaauuucuaaagcuuuuguucuauuugucucuuugggauuaaaaucuauuuuccuuauucugacucuuuacugagucauacagaggcaagcuuccauuccugcaucugauugggaagucucuggugaauuugaaugacagugagaguagggcauaacuagugauugauuggcuugaguccuauuccaaguuuugugucacccuccugcagccauaccuuugucagggacugaaagacucuuuggauaguuggcuacaccagguuuugauucagcuugucgacaagcuuuuuccuagaaauucaagcuuuugcuuaucucagugagggccuugccuggaagcaagcacucuaguggagcuuccacuucauagugauuguucuacucacuacacuauagauguuaccuuuugcuacaguagaauaacacaguuuugugugguggguaagaaacaaaauuaugucugguagaaugguagcugcuaggaucagaaaccuuucacaggccauaauggcaaguggcucugcagagcuuagaguacagugcuaacguacccgcuaaacucuggguagucacacauuuucuugaugccucauuuuuuuuuuuucaccuacaaaacagggauaaugaaaccuccugucucacagaguuaucaggagaguuuagcauuguaguuuguguuuucaugcuagggaucaaacucagggucucauguaaaauucacacuacagucugggucccccccaauaaaauacauuguguuguaauuuauuaacauuugguuuauugacauuuaaauaccuuuugaacauuuauuuuuuauuuaccugcacaugggcagucagggggcaucgugugggagcuggguuucuccagcaguguuguucugagguucagacucugagcagguuugacagcgagugcucuuacccacugugaggguuugaaugagcauguucuccagaggcucaugugcuugaauauuuggucuccacuugggaaagauuagaagauguaaccuuguaccauuuuuuugcuucaugguuguagcucagggugcaucauuuacuccaccaucaugagcucuaccccuuuccacccagaaccauaauccaaauuaaacacuuucuuuuauaaauuaucuuggucaugguguuuuauuacugcaauagaaaagucacuaauauacccuccaugcugucccucaggccuugaccaugcugucccucaggcccugaccaugcugucccucaggcccugaccaugcugucccucaggcccuggaguuacuugggaccauuguaagauaaaguauucaaugaguaugucucuaagucuucacuucauuuuuauucuuuuucccuuuucuucuugaugugguggugauggagauagucccucaguguguuuggagaauaaauguggacauuccugaagaggcuaaucagaaucuuucauucaguucuacugaacgauggugggaucagacagaucugaccaaacucaucaucuccagcaauaaacuucagucucucucugaugaccuccgacucuugccugcccuuacuguucuugauguaaguugacuauaauuaugggaucuuaguuaaacaaacugaauuuagguaaguugaagagcuaaauuuagaaguugcuaaacaggaagccuuccuugcugagcuuguagaaugcaagacaaauuuaaaaaacugacuuggaagaucggcuccaugucucuauguccacagaccugguguagaugcugugauuaaaugagucaugugugcaaacagaacuggcacuuggcuucuuguuuuuguuuuuuauuuccccuuguuaaauuuuauuuuagacacuaaagcaaauacaguacucaggggucuuuuguguuccuguuucagaacuugcccuuagacucauugacuguaacuauuuaccugaauuuuuuguguucuuaguugggucuuuuuuuuuuuuuuuuuuuuuuuguagugaaaguugaccuaucaugugauaagugaaccaugaaggguguacuuuagaaucuacaggccuuuagugaacugggucauguccaaacucuucaacucguguguggaaaugguggauguaaacagugccauucuugaggaacaaaaaguuuuguuuugugucuguaaaauaacaaaacaauagucuggcuuauucugagguucuuucuacugugaagaugcuaugauucugugagacuguaaagcuguucucccagcucauaucuguucugugugugauauuaagagaccaccagaacucugcugcuguugacgccuccucaagucaagucuguguuuguuucuuuucauuuuaguaaugacuuauuuguucacaauuucuggacagcaguuuggucaauauacacagaauaaauuacuaaucacccaacacauugccauuuaauaugaaaaacaggaguuuaguaaauuauuuuuuuucaauggcaaagcucaacuauugcuaauuguaagacuaagaauauugacuuugucuuguaaucauuuuagauacaugauaaucagcugacaucucuuccuucagcuauaagagagcuagacaaucuucagaaacuuaaugucagguaaagugugaaccuguuucuaaaacugaaaucccuuuucuucacauagaaaauaaccuugaacuacaguguggcccaguaggaaucaggcuugguuaaacaccugccagaugcuguauucuacccaagaggagaaaacaagaccagaucuuuacaucaucccagagaauuuaaugaaucaauuauuuguuuucucucuuuaguggaaucuugcuguuuggcccaguguaaaaccacagugcugugcuuugggacucgugucuuagucacacaggucuguggggcucuucacagcaacuuugucuguguguuuuguuuuuagcauuuauuacauccucuuugauucuacagauuuaaggccaauugauuuuuguauauuuuauguuuaugagacacuuuuggcucuuguuuuagaaaacuucuuucucagaaucucaaguuuuaauuuacauuuuuagccugaaaaucuagguauuacacaguagauuaguacuaauuauuucauuaauggugaagaguuuugugcucuuuuguugauuuuggcuugaguuuuuggguuuugugguacuuaguggaggucaggaccccauguaugcucagcagcugagccaaaccucaugacuuuuaacuauuaguaguaauucaacauguccaagcaccuuugggguccauuauuuuaauguaauauaauuagucaaaagccucuggucuuucaccuuuccccuauuauauguaaaugacaauaagaaaauaggauaaauuucauaguugaauauuuaaguuaugaugcaucugaaacuuauucauaccccucucccccccuuuuccaagagaggguuucucuguauaacagccuuggaauugaaccuccugaaacucccuuuguagaccaggcuggccucaaacuccagagauauauuugccucugccucaugaaugaugggacuaaaugugugugccaacacauccagcaauuuguaaagguuaacuacaguuaaaaacaggcaaaggugcacuacccuuuaggccauacaaacagcaccuguaggauucaaaccaaguuuauaagacaggugcuuugaucaaguaagccaugguuccucguuccucucuuaauuaccaggaaguauauuguccucacugggacuuuuacaucaguagauugaguaucucuucagaaggauucaacuaaaaaggcuaaauauacagucaaauugaggauugccagacuuaccaguucugaaaauaggaauaaaugcuuuuguuuugaacaugaaacuaaaaaccuagccuccauaucagacacagcuucaggggcaggagagaugguuaacaguuuagagcacuguguacucuuccagaggaucuggguucaaguuccaacucuacauagcagcucauauuugucuacaacuccaguuuuggaguaucuucuucuggccuuggaguacucuucuggccuugauguacacaagacagacauauaugugguaaaacagcuauacacauaaaaauauauuauuaacaaaaauuuagcuccauugcaauguguaugugaacguauuuuuuuuaguaacaauguaaauauuuaauaagaguuuaguaaguccuuuucacauuacauguuauauaaacagauuguaaacaagcaaucaaaaguuuacaaauuauuuauguuuacuuaauauuuuucauugcugguuuucuuucaaacccuaacuugguugguuuaaauuucugcugaugguuguauauuucggagaugggggucuugauaaacacuugaaccggacagcaccauuugauaguuaugaugagucuaugugguugguugacaaaagccuuugguaaauacuucuuagccuacuaagucauucagcuuuuauuuuauuaacuaauagccauaacaaacugaaaauacugccugaagaaauuacaagcuuaaaaaaccugaggacgcugcaccuccagcacaaugagcugacuugcauccccgagggauuugagcaucuuuccugcuuagaagauuuaguaaguuaugacuuuugguuuuugcaugauuuggggcuguugggaauuuucacuaggcuggagaacugaauguaugauuuaaacuguagaacauaggcaacugauuuuaugaguagcuuaccagaaauuauuuuaauuagauugcuaauuaguaacuauaaacauggcuuuucuuuguuaucaagugaacuuuaaguugcacuucaggaauagaguuuagaagaaaacaggggacaagccuuuguuauucagaggcuuuuuucuuuuucuucuuuuuuuuaaaagagguugucagagcuucauaauuucaguuccagagcauccaaugcucucuucuggauaccaggguguaacuagauuuacagacaguuauaagucaucauguaggugcugggaaucaauccugggccuucucuaagaggagcuagugcuccgagccgcugagcaaucuguccagcccuuaacccauaggauuaucccauauaccuuaguugaauagagggaagcagucuugaaaguacaucuguucuuuuuuccuauccucucuguauuuuauauucuguucucuguauuacccaacggccuuacugcccuauguauuccaauuucuuagugguuacuuuaccucaguuuucaaauuuaacacuccauuuggcaaaacuuucaugcugccuguuaucuuccuuaaccaaagucaaucauaaaucaguacaauauuauuuuaagaauaaaagccauagacaccuugcauuggcuuuauauauaacaagguaaguauaaguaugucugagccuuacuuuauacaguaagaaacagcagcuuauacaacaggaaauuuguccugaguuauacauacaacugacaaagaaugcauuuaagauuuaaagaugucaguuugccucuaaagcacauuccuggucuguguaacaggaugagagucuaccauaagauguuucagcugaaagguuucaguccucugacugagaggcuccagcccauaguaugugcugucauuucauacugugcccuguccuuagccuugaaugauucagaaaacugauuucccauuuuagccuuaaguuuuauuucuuacuaauggaaagguuauuucugaguguuuaaguauuuauucuguguauaccucuuccuuccuaugucuaccauuuuaaaaugaaaaauugucuuucagucugauccuauuggaaguaagguuugagaaguaaaagacauuuguagauaaaagaaaggagggagcuauuagcuuuucauuuaaaaaaguuaauuuuguagguuaauuuuaaaauugauauaaaaaaauuuaaguauaguuuuauuuuaugaguauauguuugugugaguauauggcauguucaugcaagugcugaaagaugauauuggagcucuugaagcugacauuacaggugguugugaguagccuagugugggugggugggugauggaacugaauuuggaaacuaaauuagauccucugaagagcaguuagcucucuuaacugucucuaguucugaaacuuguuuucuguuuuguuuuucucuagaaaagagcaucauguagaggugaaaguuaaaaagaaaccuuacaauaaaugaaguuuucucuucuucucggguucccagauguuuucuuccuuccuuccucccucccucccucccucccucccucccuuccuuccuuccuuccuuccuuccuuuccuucuuucugcuccccccccccgcccccccgcaccucccccauagaaauucuauuuagugguggcuguccaggaacucuguaguccaacuaguuuuaaacuccuuugccucacaaaugcugggaauaaagauguucuucaccaaugcccacuucaagaauuuuucuuaaagauucaauaugcuuuaauucagggccuggagagagaacagagagcaguguucucugguuaagaacacuggcugcuugcucuuccaaaggucccgaguucaaaugccagcaaccacaugguggcucacaaccauccauaaugagaucugaugccuucuucuggugugucugaagacagcuacaguauacuuacauuuaauaauaaauaaauuaaaaaaaaagaaaacaaaaaucaauaugcuuuaauucuauagcauuuaauuaaugcuaaguaaauaucuauauagaaaauacauuuaaaaagauuaaaauauaaacacuuguaaucaauuacacuaauauuuccugacauuauguagaacuuguuuagcccaagagugccaaguaaauguuuaucgaaagaaugacaugucaguuuauauaucuuauuugcuuuaaaauuuuauuuguucuauguguauaguguuuugccuguauguguguuuuuguaccuugaauaugccuagugccugcagaaaccagaaguggguccuaggauucaagcauuugugagcugccaugcaggugcucuguguccucugcaagagcaacaagugcucuuaacugcugagccaucucuccagccccaaauauuuuauguaauaauuaaauauuugacugucuugauacuguuuagaaguuaguaggaauuuuauuaaaauaauuugauuuuuucacaugguuucagaauuucuuaauuucuuuguuaggaacucuucauugucaguauuaguucauuuuggaauaauuuugggauuguguaaaaaguucuaaaaauacaguaaagaguucccaaaugcccuucauccugacuuucaauuaacuuaauuuuauuuuuuagaauaacuuacuuauucuuugaaauuuuuguauguuguaucuuaaucauacccgcuccaguuuuuccuuuccagacucucccauuauaggcccucacauuuuaacuaacuuccuuccucccucccucccucccucccucccucccuuccuuccuuucuuccuucuuuguaacccgggaagucuaauuagugcugcuuguuggcauguugguuugccuuguuggcuugaucgugugcugguggccacagcuacugugagucagugaccaucuuauguucagagaacagcaucucaacagcauuucugcucauccuccagcucuuaauuuuuucuaccucuucuucaguguuuccugagcuuugaagggaaugcucuaugugugucauucaggauuuagaacuaauuuuuaaaaauuauuauuguuuauuauugguuuuuguuguuguuguuguuguuguuuuuguuuuuguuuuuguuuuuugagacaggguuucuuuuuguguaucccuggcugucuuggaacuugcuuuguagacuagacuaggcuggcuuugaacucauagagaucugccugccucugccucccgagugcuaggauuaaaggcauguaccgccagcaccaggccuaaacacuaaguuuucucaacauuuugaccaguuguguuugauuaguaacugcugccaacugcaagaggcuuuucuagacaagauugauuaucucugauuauaaauauuuagaaggcaguuuaucagcacguccacuuagcaaaaccacaguaguaaauuccuccaccuuagcccuagaggcuuuagaaugccagcaugaauucucuuccaugggacaguccucauauccaaggguaaagcuguugucauucucaugacagccaagccacuacuguaaguacaucuugcuuagccgauaguaucgcagcaugcaguauuaagcucauuguaucuuuuuucccccaguggcugcaaguucuggcauucugaaagcuagccagcauggaggaagcuuccuauucaauuccagauuaucuuugcccugcaaccaaaguauguggggucuucaacaauagggucuuaucaucuaguuauggucgacagccaaaaauaauagaaauagcuuuuguuguuuugggggccuuuggaagcucccugaccaauaccucauagggagguaagcuauguaugccugacacaaagaguuuuguuuaaugacccaugucuucuggaagcagcucugucuaccaaugaauggcagcuguccuagaacuccccuuuucuuuaagcuuuacacgaguaugugcauguaaguaugggugcccaugguagaggccagaugagggcauuuggagccccuggauuuauuguccuaggggauggugaacugccugacauggguacugggaaccaaacucagguccucugcaagaggaguaugaacuuguaaccacugagccaucucuccagccucuuuaauuauauauauuuuuaaccuagcuuacacagugcugaguuuuuauaaggauuuucauacauccuagaauugucuaccacccccccccccccaaaaaaagcauacacauacacacacacacacacacacucacucuuugguuuuccaucccucugcccuauucccacuuaacucuuuaaccuccagaauucuuuuaucuccuuuugaaucacauguucuacugcagagguauuacuugagauuaguaaacaccaucauguaaaauacuuucagaguaggaacugauuuuaauuccugcucaugacuuugauggacagauaauggaccugcagguguugaagaggagugaauccuggucugucuuauuucaaaauuuucuaauaacucugaaauuccuuucauggguaucuguuuacuguuauuuccucacuuacagauucauucuguccuuuuuuuuuuuuuaaaggaucuuucaagcaaucgucuugcaacugugccugcugauuuugcuuugcuguccagucuguugcgacucaaucuuuccaguaaccagcugaagaauuugccagcagaaauaagcagaaugaaaaguaaaucgccauaguaaauucuguaugaauucgagguuaaugcaacuuucuuuuggaaaaacaauuguuaagauaauuauagagaaagaaaguauguuguucuuuuuuuuuaauucuaaauucaaaugcuacuuaguaagauuguucuccagacaauuguaucuagggucugucuaaagaaugauuaucaaaagacauguagcuuaugacaaaaugaaauuguaacuggugaguagccgaaagaacauacaggaacuugaugaagauucugcuucauccuaucuucagcugacucccccugugaugcagagggauucagcuguugcuucccuuggcuuggaaguaaugaugucuagugagaguccuauuuugucucagugcucagauuguuaauucuuuuuuuaaaauaaugaaauaguaaacgguagugguucaucguuuacagagguaacacauacagguagaagcauucuagugcuucuguauuuguagucaugacuaucucaaagcucuuaauuuagaaugaaaaacauucuuuuguucuuguuuaaaggcauaaaacaugguuaguauuucuggguucaugacuacacuacuacccacuguauacuguuuaccauagguagucuuuuuugguuaguaauauauaagauauuuuucuuguaaaaauauaauuauaaguuacauuaaaauuauauacugagaaauuaaaaguuuugaacuaugcuaucuccuaucacucaggcugcccucagacuugcuauguaguugaagauggcuuuggucuuccugaaucuaccugccuagugcugggguuacacauuugaguugucaugccuaacuccuguucauaguuuuagaagucauagaugugauuuuucuacaauugauuguagauaacuuucaauuaaauuguaaauuugugauuuuuuacuuuaacucugauuuaaaugaaauuauuuugggcaggcuuugacuuuaccauuuucaaugucacauaccuuaacuaacauaauauaaaaucagaacaauguauggaacacugcccuucuuccuuccuuuccugccaagaucaaacuuagaaccuuguaugugcuagacagugguaccauugaaucaaccagaagcaugguuuuguuugguugguuggcuuuuguuuuucccaacuagagcaugcucaaacagcagagggcaucugaacucacacauaccguauuugcuaguuauuuguuacuggugagcagagccuaggauuuuacauuugugugaugcuauguaaccagaaugcuuucucuugagaguuugccguuuuauuacuaacagugguucugugagauaaaugggacagugauacauuuuucccccacuuuaaaaauugauaauuaugagauuagaaaucaaauuuagaacugaguguuuauccccccaccccagaacacauaguccacugcuuuguuccucagccagugcuccugauuugaccccagaguuuacaauagccuuuuucuuuaaauuuuguuuauuuuauauguauguguguuuugcaugcaugcauuuaugcgcaucucguuugcagaggucagaagagagauccccuggaacuggaauuauaggugguuguacaucacuagucauuaugugggugcuggaucuucugaaagagcagucugucagugccuuuaccuauuagguaucuagccagcuccuacaaugagcuuuuguuuauagaauuuuacagacuuggguggaucaguucaucaccuuuuuuccccucauuauucuaggcaaguaauauuuaaauuuuuggggaagguagaacacucaauauaaaauaaaugaauauuaagcuuaaaaaauaaacuuauuagaaguuaaaacuaguacuacaauuuuuaaaaaaauauguggcuagcuucucuacauaguagaagaauagaagcugaagguggcaugucaguacaguuuucaauuauguuaaaauugaaaggauugaaguuaggaaaauaagcugcaaaaugcauauuccuuauuccaguuuacuggaggguugaggaugaaaugugugaaguauauuuucaaucuuaaaaugagagaaucuauaauaugguuaagggagaaaauugcuuguuaacuccuuaaagaauaccuuuauuuagacaguuuuauuuuucuauaaaaggcacacaucagacaaaauagcagucaggagaaugaggcaagagguuuugggaaucuagaucugaggccagcuugggccucauagaggagaggacacccugucuccaaaaccaaacaagugaagaagaacuaucaggagaugaagaucuuguaauggaaggcauuguugagauacaguauuugcuuuuauugggcagauuaguuuagguguuaaggaaagaauguuggcacuagggagauggcucacuugguaaaauucugguauauaaguaugaggaucccuggcacacacuuaaagucucagcacucacuaaccuaaucauugagguccugggucauuaagggacccuguuucaaaaaauaagguagaaaagauagaagaagauaccaaacggcaacaucuuuccuucacacgcacaagcauauguacccaugugcaagcauacacauacacaucacauaaaauucaccauagaaaagaagagagggaggaaaagaagaggcaaaauggaugaaagaaugggaaggaguacacacaaacccaaggcuugcuuuauaguguauguaagccacugucacauucacucauccaacagagaacauccauauugagaugccuuaauuacacuaagcucuuuuaaagaggaguaaaugagagcuguacaguaaauacaguguauauacuucagaguagcuuagcaaaguaccuaaaaaccuugcucauaacuguauuuuaaagauggccuuguacuauucacuauugauuaucauuucucuuuauuuaaauacaaaagucaauuuuuauuuguucaguucaaggauguuugcauauuuuugauugucguauucaucggaacagauuaagaagucuuugugauauguuuauuaugauuugauauuuuucuauauuuaauucuccaauaaauuauucugucuuguauacaauaaaaaaaauuaaaguauuuuuuuuauugucucugaauauauauuguaggauuaaagcacuuggauugugaugccaaucuccuggagacugugccuccugauguggguagcauggaaucacuggaauugcuuuauuugcggaggaauaaauugcguguucuaccugaauuuccuucuuguaggcagcuaaagguacuguuuaguuaauaauuauaccucuguaugauuucuaaaacuuuuuuaugaaauugaaguuuuuaaaaacuagccaauuuuugggguauaaucuaugaaugguauuuuucucuguugauaucuuucaaaacuucgaucuacuacuaagaguacuaauguuuucuugguaauaaaaagaaauaaucauuucagcaguagguuuuguguauuugguguagugaguaguuuuucccuaaagaaggaccuuauagugaggugagaggcucugcugagcuguacuguggcuggccuguagcagcugggggcacggggacuuguuagguugccacuucucaggauuaccugacugcagucacacuuccaagcuaaucuuuugguuugagguauagcauuagcacugccuccuagguuugaugugcuuuagcucuuuuuugagguccggcaaguuuuuuuuuaaaauagaauugugauggugaguuuuuuaaaaugcugggaaauuccauucacuaugguaaguuuuuauugguuauagauucuguuaggaaguugguguauguaaugauaauaucccguaguauuuguuacccugaaaacaguuuugaauggguuucuuaugaaacuaguuuaucaucaguauuguguuuagauuuauacuuuuacuucuguaaguauaauuaauaaauuguuuuacugauuuaguuuuguaaaacuguuucugcaagguuaaacaauuauuauuuugagauugucagaaaaaauucuuuaaucauauuguagcuuuacaagagguuaugucuaaaugacaugauaauuacaauguucuuguucuauauguugcagugauuuaaaacuaaaguauccacacuuguuuucauuguuuaguauacaguugaaugaaauauguuguaccugguuucauaggaauuacaccuagcugaaaaccagauagagaaguuaggggcagagcaucuucagcaccugcaggccauccuuguccuggaccuaaggggcaauaagcugcggucugucccugaggaaauggcccugcugcagucuuuggaaaggcuugaccugagcaacaaugauauuaguagguauguuuaaagauuaaaugguagaaauuagaguuuauucugcauugaauuauaauuaguuuuguaaguccuuuuaaaaaaaucuauuaauuauauauugaacucauguuguauacgaagaagaauuaguuuucuucccugacagccaaguuaauacauuaauggaagcagauguguagucacauuucagaaucccucaggguugcuuugugucuuuuccaugcaugacuccauuuccagauacuuacuguccaugcuucgacaaagcaagugcuucauugggcuuggguaacgaacauagaauugauauaugaaguucucaggugacuaaaggauuuaugauuaaagaacuugaaauaggacugagauuagucagucaguuagcagguuaguugccugauauacacacaccuaacagcacacuuaugcucaggaccucugaguuccaccaguugagauauauauauauaaaccaggauguuuaauuccaugugaaaguugguguauaugauccauaugucaggaggaaacaacacacauauagcuuugggaauucuaaauaggguccaacuagggaagucuaagaauuuagaccaaauagucaguuuuuauuaguucagagccacuagcauaccaugaagauacuauccugagugcaagcccauuaaagagccacuugauggcaaugaguauggugcuuugagugggaagggguugugggcggcaggcuuuaaagaugaucugucaguuuagcucaauaauaauugucacuaagaaacauuucuuuguucaguuuguugacagugugugauguggcugcaguggccaugggaagaaggggaugaagugaggaggugaaccaggauaaguugucucuaguagcuguuagcugucuguuagaguuggacagagcagagugauaagcaaagaauggugaaagcuacagaacacagugcuaagaaaggauuugccuacagagaugagacuuuuggguuuauaaaucaagggcacacaugagucuuugagcuuuguggaaaaagcaguucucggcuguuguagcaguuuguguccuccugacuuccuggaaggcuccucauugcugcuggagccacuugucaggagaacaccagucuucucacgccugaaacuccauguuacucuccaguggguguggcuagcuguuuccuagguggguuugagaucacuuaaaaagcagugaaggaaaaaacaaaacaaaacagcaaacccgauggugagacaccacugaauuagaaucuuauacacugagagcuuggaauuuguucugguuuuuggagauccccuucuguaauugggugaagucuucuguguuacugggcugcagauugcucacagcuguugguuuuacuguuucagaaugagcacuaggcagauagagcagaugcuuuguagugcauguucuuuagcagcuguagugugagcuuggaaauguaucuggccaucuuucuguguguuagcauuaaaaggaaaagauuuuaggggcauucaugccucuuccuugagauuauuacaggauauguuguuuucauuuguuacuuuguagucaugacuuugauugaauuagacuuacauguaauguuuccuugaaaucaauuuguucuguagucugcccugcucauugggaaaucuucauuugaaauuccuggcacuagaaggaaauccucuaagaaccauucgaagagaaauuauagcuguacguacuauuaggauuuagcaacuuauuuuuaaauuaaaauucagauauguauguugaugcacaaaacuuccaagugugccuugcuaacaauguguucugucuccacucuuuuagaaaggaacucaagaaguucuaaaauaccugcgcagcaagaucaaagguacuacuguugccuucuguauuuugaaggaauauaugaaaagucgugauguuaaaaggacaucaauuuaaauguucuuuuguuaugcuuauuagagguacagugccuggcauucaugguucuaauucuauauuccuguagaauauuacuuauaaaagugcuggagagaugguucagcgauuaaaagcacuuguugcucuuauagaagaccagauuuguuucccagcaccuacauggcagcucacuaggggaaccauugcucucuucuggucucuguaggcaccaggcaggcacaugguucacaugcauucaugcaggcaaaauacucacauacauaaaagaacaaaaaaaaugaaucuuuuuuuuuuuuuaaguucuugaauucaugauuguggaugcuaugucucaguccuuuagauuuguguugaaaucuaccaguuaugaaguaucaacacaaaguuuaauauuuuucuuuuuuuauuuuauguauauggguguucugccuacuuguauguaugugcacauaugccaucauaggacuuuacuauguuucuuuuuuguuuguuuguuugguugguugguuuuucgagacaggguuucucuguauagcccuggcugucccagaacucacucuguaggccaggcuggccuugaacucagaaauccaccuuccucuaccucccaagugcugggauuaaaggcaugugccaccacugccuggcuuauuacuauguuucuuaaaugaugucucuauuauugggaauaaaauauaugacuggguauuaucaguacuggcuagaaaucaugaauacuuuuauauaucauuacaaauuuaaagauagcuguguaauuuuaauauucacuuuaucuaacuuuucuuuuccagaugauagaaccaaucaaaaugauucuguuccugagacugccaugacacuaccaagugaagccagagucaauauccaugccauagccacacuaaagcugcuagauuauagguaugcagugucuuuuaguuguuguucuguugcugugaucaagcagcacauuuuuaaaauggagcauuuaacuuggggcugacaguuacauucaugguuguagagaguaagagcccauaaccaucauggcagggaguaugucagcaggcagucaggcguaaugcuguucagcuaacuggaauggugugggcuuaugaaaccucaaaguuuaccucaaaguaacauacuuuuuucaacaaggucacaccuccuaacccuuccccaaacaguuccaccaacuguggaccaaauauucaaauauaugacuuuguggaggcuagucucauucaaaccaucacacugcccaccuccauaguacggggggacuuucuuggaccuuccagcaguauaaugagacagagacugauaauaaaaaguuugaagcuuaggccuuugcucgggcaguauuccagcuagcucaucuaacuuaacccaccaacuagccuucaacccaccacauggcuagcucuguacuucucugcuuuggucugucuuuuccauugucuguucucugaaucuccugucucuucuccuuaagaccucuuuugccaggaaauuccacccuaguacuuccugccuuagcuauuggcuguuguauauuucuuacaaccaguuagcagcaagacaaccucagauacgucacuagauugccuuuaggcaggugaaggaugaauauuuacgaaauagaaaacccggugauggccauagaaaugacaugccaaaauccugccagcauuuagcucucugccuguacagaauuaacaauuguaaauacagagacacaccuuacaaguaagaaaggucaccccaacagcaaggcauugaggaugcaguguccaugccagucacucuaaagcugcuaacuacagauacauaguccaucugcacuacaguauugcaaggcccaugggaaacuuuugagaaagagcucuucagagaaaggacagcuaguaaggaaaagacagucagaggagcagauuuccccuuugcagguucaucaucucacagaauuuaaaagugggcacaaaagagaacuugagucaaagagguaaagugccugaauauccggggaaagguauuguggaaaggagguggagugccugaguaucuggauguuuggggagagguguuguuggaaggagguagaagauggaaggagggagagaauggacuaccguggugaaauuaaggauugggaagaacgugugcucuggaccuuuuuuuuuuuuuuaacaaucuacuuuauuuugugugcauggauguuuuaccugcauaugcaccacauaugugucuaguaccugaggaggccaaaagagaugucagagcuucagggacuagagguauagaaaguugugaaccaccauguggguccugggaaucaguccuggguccucuggaagagcagucaaugccuuuaacuacuuagccagagugugguuuuuauuaaaggacacauaccuuuguugggaaugaggugggcuuugguauaaggcggugcuccaucuaccuggauagugucuaggaggcagguggcuguagcaguccuuucauucucuuccuuccuacucuccccuaucaaggauauuugacacaaagcaauaucaauuguaaaauaugagagagacagguaggugaauuaaugcuaaccuuuuaugguaagauuuuauuauaagaauuaugaaugagaguuugguauuuaagcucucaaauucacuagcacuuagagagcauuucauguuugaggguggauauguuaaauaagaaacuaucguuuaauuaaaacuugacuaacaggcagcuugagaagugauuauguuugugaauggaacugagaugucucauaguugcacugcauucugggaacacaguaacaccaaagcacugacaaugucuguguacagaauaagggaaagcacuaaagacucuuaaguauuguggaagauuaucauauuagggaaagaagcuggauaauccuucaggugcuucaguagugaagcaguugcagugaggaugaguaaugcugccaacacuuuugcugauccuccuuucuguauggugucagagagauguaggaauauagacuauaggcagauacagagucuaugaacagucauguggcuccucaucuaugugcugggaggaacccuuucgcagugaagaucuccauugccauuguucucaccucuuguugccacccuguaauguguguggcagucacuuagccacacuaacagcuugaauuccccuguaccuguucuguaauccucuaacuuuagggcauuauauauauuuacauuugcaaaaccaguggaguaaguauugaagacuacuccugagauucuaaucccaaaguaaggacaagcuacaacgcucaacaguguggcagcaccaacagugaguuuagccuuuuuccuacugcaucuccuccaccuccacauaauagaagcacgagaaguaguguaggugauuacacgcauuaacuuaguacagugguacaccugccagucuucagucaccaaagcucacagauugcccacauuuuaaggaaagcuuaguuauaaaauuagauuaagcuccaagcacagguagagaaguggaccaugcauucugugaguuucuggauuucccaagugcuucuguuucuguuucugcuucugaggaugaacagagcguccugaccucacaaaacuucuucagcuaccuugaacuuuuugguaaaaucuguaaaagccuucagauguggggaauggugauuacaucuuuuuggaauguugagaauguuuuuauuuuugaaccacuuuuagugauaaacaagcaaccuugauuccugaugaccuauuugaugccacaaaaacgacccucaucacuuccaucaacuucagcaaaaaucagcugugcgagauuccacaaagguaggauuguccagugauccacuguugagcugggccuucuguuuguugugucuugacaaaugaauguuaguuuccugaacuauuaaugugagagaaugcugcacacugugguucuacuguucugagagauguacaggaucuuaaaacuuccaaccuuacuuugugaacuugggaaguggguguuagaauuauuagcucuaaaauuauucgucuuauauaaugcaguauggcagggagagucuugagcagccacccaaguaccagacccacaguggaucagagggguuucacuugcaggcucaggcuagagaaacaugagugauugauuuuucuccuuuagaacuaaagccaaaaacaugaacugcuagugucaucuucuaggcagaggaccuuccacucuagccacuaguugcuauuuauguuguacuuucuucuguucaguaugucauuguuggcauuaauuaacaaaaucuuccaguuaaaggagaaaacuaguauauuguugaacuucaacagaguuuguuaacugucugcacccaaaugaugcuggcaaacgaaugaccucucacuauacacagacuacaggacaggauguguccuggugaggaaucgcagcaguacagcugagugugcuguuugucugugacaagcugcucuuagcuuucucaccuaugacaucaugcucagugucuuaguagacacgacacauggacaccuaacgaaagcagauagaaaaugacaaagcacaagggaacugauggaaugguaaagacugcuauaucaaaagaaaaaauaaguauaagaauugcuucauagaacugcccagauuuucaaauguuuaaaagagcaaacuauaaaaugugucacauuuacagagaacacuugggauguaggucuugaagcaagauagccuguuagaaaagcagagcuguccaucuuuuuguuccuguuguugaagggcuagaaagaugucugauuugaucccagauguacaugguuuguuugggcagacguggaucaugccaacuaauggagucaagauggagagcugcaggggaagccccugcguacauaggcuguacuuacuacuuuauucuacagucucauucuuacacagugugcaauucucuuaccagggaugcuugguguuuuucaacagcaacuuauaaagucaaagaacacagcacaccuugcucuagaguauuucuaagcaugcucuuauucuuauagcuaaaacuuauaauucauaaugaguauucauaaaggacuggaugaaauggaaggauguugcaugcagucuuaucacugauauauauguuaaugacauuuuaucuuaagcuguuuggaauuuuauguguaauuugugucuugaaugcuuuauuuaccauauguauuuaccuauuggauucuuuuuguauuucccaacuucauaaguaauauuuuuaaaaucuaucuuagcuguguauaaguaaguaggguccuuccuuguagcaauuaaaaaaacauacuguuucuuuaagccaaauuuccagaaaaacuacuguguugagagauaugacccuuaguacauauauacccaauaacauuuuuaaagauuguuaguuacucauugaagcucaccgccucccugcaccugcaucaccagcugugauggucuucucuuucuuucucuuuaguaaugugguagauuuaaaaaaaaaaaaguuuguuaugugguagauuauaucagucacauaauuaaaauguuuaaacuugguuaggcuuauuagagauggucaguccuuacacuuggaccuccaccguuuagggguggcacuugccagacuuagaaacuguuuucagauauuguuuuaaccaugauuauauuuaaugcuaauucagauaauaaauauuaaaaaaaaauggauagaucaaauuaaaaaguuacuuucuguguauggauguuuugucugcaucagugaaucacuuaaaugucugaugcuuguggaggacagaggcgugugggagccucuaaaacuggagucacagauggcugugagcugccacguggguacugggaaucaaaaguggguccucuaaagaguagccaguacucuuaacaucuuagcuuucucuccauuaugcugucuaaaaugcugugauaucagugucuaacaaaacacuucaugaauuuaguucacugccaaaauaaaaugcuauagaagccaccuaggucugauuuuucucuuuugugucaugauuugguuaaauguauaaucagugaauuuuuaaauuaaacuucaguauccauccauugucagauugaagccuuggucagucaugguaaggugguuuuuaagauguuuagucuuugcacagccaguuucugaaguuucugugaggaaguaagguccuguucuuccucuuaucauggguucaguuuugaguaagugcugauauuuaaaauuguuuuuguuucaggauuguugagcugaaggaaaugguguuggauaucaaccucaguuuuaacaagcuuucauuuauaucccacgaguuaugcuugcuucagaaauugacauuuuuagauuuaagguacuugauaauucugucacuugacaucuuaaauguuaugauucaucuuuugaguuuuuauguuguauuuucuuggugaguauggaauuuggucuuuaguguauuaaguauauuaggggaaauguaaaauuaacuuauuuaggcauuuuaacugucaauuguaaguagcuuauaacuuaaguggugagauaaaauuaucuaaaguauuuuuaaucaauauauauucuuuagauccuaaguaaauuggcaguucgugcauggaaacuguuuccuuccucuuguuugucgcugaaguagauagugacuaagcagcauguccaccccucugagcagcccugcgguugcaccaggcccaaccaggacaguagauaggucaagcagaagagcccugccuggagcagagagagagaaccuaccuuaugcuguuuggaaaucauagcaagcuagauuuaaacaaauucagugggaagcuagcagcucauagggugauacugugcaucccagggucacagcauuaacauuguacuuguaaacucuguuuuuagggccugcauuuuugcuaaugcuuccugugguuagcuagaguacuuuuaguuggcauaaaguacaguugaggcaggagggugugcccuaguuauggagcuuucacuucucugggguagcagagcauaaagcugauggaacaaaaggaagggagcuccccacggcugcuguuuccuucuuuuugccccaagcucuguguauaugucucucuguguaacugucccuuaaaucucugauagaagaauuaaaucugcuuccaugucucacagcagaaagacugaagaaaaagaauaggacaggugugagcucugcagcauagcgugaacagccguugugcaacauagcauacacagccagucgucauugugcaacauagcguguacagucagucauugugcaacacaguguauacagucagucauugugcaacacaguguauacagucagucauugugcaacauagcauguacagucagucauugugcaacacaguguguacagucagucauuguguaacauagagugcacagacagucacugugcaauagaguguguacagucaaucauugugcauagaaacaaaaggcugcaggagacuugugucauuaacuacuaccaaccccacuuccuagggucauccuaaggagaucagauuaauaagaauugacaaacauauuuguguguuuuuuauucuuccugggauuuaaacaguaaagguuuucaaacuuuaaaaauuguguuuugauuuucaaccuaggaauaauuuuuuaaguucuuugccugaagagaugucaucacugacaaaacugcaaacgaucaaucuuuccuuuaacaggugaggaaacaucugggagccagauagaucagaagccuuuauuuuuaucauauuuuacuagcagauuuuauuuucauuuagauucuacuugaauguaauauugcuuagaaaucucaugauuggugcuuagcugauuuguuuguuuuaccacugcaagaaacccauagucuagaagaaagauaaacaucugacuaauugugauuguuguaguggaaaguggugccuugagguaaacagauguuagccaggcacaccugucuuuggcaucugauagguugguuuggacaaugaagccugugucugugauggucaggaaucuugaaagaaugcaaaaugcccuuguucuggaagccuaaacaaaauuagaucaagaaagaguaacuuccugaggguggccuguagacaccucaagauauguugcccaucagugaggagcuuugccucagcuuuugcucauuuugauucuuauaaucaauaguaucuucuaugucugcugaguauguguuccaaaaucagucuuuaauggaggagcuagagaaaguacccaaggagcugaaggggucugcaacccuauagguggaacaacaauaugaacugaccaauaccccccagagcugugucucuagcugcauaucuagcagaagauggccuagucggucaucacugggagaagaggcccuuggucuagcaaagaucauauaccccaguacagaggaaugccagggccaggaagcgggaguggguggguuggggagcagggcggggguaggguauaggggacuuucaggauagcauuugaaauguaaaugaagaaaauaucuaauaaaaaauuguuuucgaaaaaaaagggaaauuuugauuauagaacuuaaagcacacuuaaacagagucauccauuuuuaagggugauguaacucuugcccauuacaugaaguuguuguguucacauuguaacagguucaaaguguuuccugaaguucuguaucgaaucuccacacuggaagcgguucugaucaguaacaaucagguuggcucuguggacccucagaagaugaagcugauggaaaaucugaauacuuuagaccuucaaaacaaugaccuuuugcagauucccccagagcuugggaacugugugcagcuacgguaacuuccuuacuggggguucccaauugauuuguugauugcuuuuuucuuauaggaaauugaaauaacagacuuaauaccuucuaacaauaauaguuaagcaaacaccucauuuuucuuuuuaaauuucaccagauguuuucuggcauguauauaucaugauguaugcauaaacaccauuucucuuaguauuauucucuguauaugcuuauccagaauugcacuggggagagggauuucugaggucacacuacagggcaccaacuuuggaaacccaguccuuauggucuuucuccacuugcuucucccucagcccuuacccugaucucaguaguaaccaucuuaguacccccugggaagccuuccuccucuucacacagaauccuugcuacuguucuuucugacccaucuguucuagguuuuuuuuuuuaguuguguuaaagcuucagucauucuaagcaccucauuaagggcugguuaaacaguagguggagggugagggcugcagagcucagcuggaagaugcuugauucuugaaagcagcaugauauguuuuggcuguuugucuuagugggguuauaguuguaaaauuucaucccuggcuauuuggauccauuuugaacagugaaaugauaaacaaaagguacaaauacuuguuaacuaugcacugaguaggccauaggcuggacgccugauugcagugugauuccagaugcucuaucagacuucacaggaaugaagucuugaaagacaucaauuuuuuccuauucucagcauaaccugcaaauccagugauuugggauuacagacagauuuggaguggguagauuaacagauaacagaguacagugagagucaacugcaauucuuuuuuuuuucuagaagcuaagaaaauuaaguguauaagaguuuccaagugccgggugugguggcacacgcuuuuagucccagcacuagggaggcagaggcaggcgguuuucuuacuuugaggucagccuggucuacaaagugaguuccaggacagccagggcuacacagagaaacccugucuugaaaaaccaaaaaaaaaaaaaaaaaaaaaaaaaaagaguucccuaguaacauggaaauaguugaagaauuauaggugaaccuuuauaauguugugugagccuuuuaauuuuuuuuacauaaaacuuuagauuauuaaagucuuuugauugaagauauuuuacuaaucccauuaaaaacaaaauaaccagcccauaauuuguaaauuguaauugucuuauuuccaaauaugggagggcggacaugugugaaaggcccuucuggugcagauacuuacagccaaccuuuagacugagcauggaaacgccaauggaagaguuuggggaaggacugaagaagcuaaagggcuuugcagccccauaggaagaacaacaguaucaacuaaccagaccccccagagcucccaggaacuaaaccaccaaucaaagaguguacaugggccggucugcacuccucacuacauauguagcagaagguugccuuaucuggcaucaguaaagggggguggagauguacuugguccuauggaagcuugaugucaagaagggggaugcuaggugggugaguggguggguagaggagcacccucuuagaggcgaagggcaggggcagggggagggggaucaggaagggagacaacauuugaaauguaaauaaauaauuaaugaaaaauaaaauaaaaaacccacaaacagaaaaaagauaaaaagaaagggaccuuguaggguguggagugagcugugacuucaauguucuuggcaugacccacauccguuuguucacucucuugcuuaaaucuauuguauuaccuagagugugcuuguagcaaaucgagaggagacucaaaucacagugccaccauucagcagcuguuuauuuugaaugggcuuuugucucuccagauuuguauuucucuuuaaauuagaaauauuaaugauaccuauaccauaagucuuuuuaaacaaaaccuacagagucagagacuauaaacaccuuaaugugacuuucaugugauaguuagccagugcuguuggacauugucauaauucuagcuguuugcaugcuuaguuggacuuuuaaaagacacauaagaaaauacacacuuuauuuauaaaauugcaaacaauaguuuuauuucaugaaaagaaaaucacuaaugggaaauguuugauuuuccuguuucuucuguuuaggacacuacugcuagauggaaauccauuccgaguuccucgagcggccauauuaaugaaaggcacagcugcugugcuggaguauuugagagaucgaaucccugccugaguaccgcugguuucuuacucugggcauggucacucgggauaggacagagccagccuccaguguccaggugucacuagacagucacuguuugggcuauggucguuccuacuaaaugucuacaguuugugaagugaugugaacauuuauaaugucaacugcuacagauuuuaaauguuuuauaaauucauuccuuuaugacacugcaagaacuuuucauaugauuuuuauaaugaaaaagcaaccaucuuuguaaaucuggguucccccugguaucuuuucauuuuccaucuuauaugaacugagcaagacuauauaagguguaaagucagcgaacuuuuacuaaauauuauuuuuuggcauuuaaaagaaaaucggacuuuucguuguccaggauaggacuugcuauguggucagugucagugcguguuuauguuuaggguuuugguuuugacuuuacauuuuuuuuuuuaauguuuucaguguccuuuauuccaaugugauacaucuuauuauuuccacaacguugauucugaaaucuccuuacagucugauuaaaacuagacugguaguuuuacaguaauuuucuaaaaaggaguuagauauagccaagcuugauuuaauaaaaguccaaauauaaacauuguuguuuacacugaaauuaucagaugcagcuuuucagccguccugguucaucaugugauugagucgagaguagccagcucaguagaagcaugugucagcucagugucagccugcgugcggaggguggagguagagaaccuauaggcgguugagguuguugaucuuaggaaaaucagugcuaauaaagauacaugcuucguguucauaauaaaagcuacauuuuuaagguauugguauaguguuuuuguuuuaaaaagaaacauauuuuuaccaugucacaguuccuaaguucagaaucugcuuccauaguaaaccagacaucauguaauaaggugacauuuuauuauuuauacaauagacuuuuauguuauucaaaacacuuuuuuaaauucugaaaaaauugaguacaacagaaccuaaaaauggcucugcuauacaccacacagcgcuauuaucuguacaaagcgcaucugcagaugcuuccaggcuacacccuaccccuaacccauagugucagaacguaagacacagcuggagaguacagaucacacuugcaaagucauuggcuuggcagaguugaaauacagguuagugggacuuugcacauaaaauuaaacagcuuucuuucaagguuguuauggucucauauggcaaaaaaccaugaaguacauucacaaucuaaguuaguaaaguaguaaguguuucuucauucaguuuuauuuacaccaauauguaguuuaacuaaaaaguacuguuaaucaugguacauuguuuguuuuuuuuaacacauacaaaaaugacaauuuuuauauauaauuuuaagcugaaaaucacaauuaucucaaaauauuaauuacaauacagccaguucaauuaaacaugucaugguuugauuuucuuuaauauaaaaugguaaacuuuauuauuaaaguaagcaauuuguuuugaauuggcuagaguacacccaaguagaaaaucuaaaugugaugugugagguguuugcugccccucccacccaguuuguauacagccaccuaggcuagcaaagagacagaaaaggccccagguuauaaauauugagccucguuugcuaaacugccuuggcuucuugguucuuccauaaaagcucuacaaagggcauguccauagacugcagugaaaugcaugcaauauauacagcguguagaauucagcucacugacacacaucagaauguccacauagacagcaaaggauggacagaaggaacacucaccugccaccugucaucagcuagaugggagauuuaggaaugaggucccaguucugguucugagggaagauuccugcgguuacugcagaucuguuacccggguacugcacuuaugguaaugaagccagaucccaucagagaguauggucaagagacccaaagcugcgucaccacuuaggaauuucucuuacgacuuuuuacgaggaugaaauguuaacuggcaaauaugaccucaaaauuuuuaugugcuugacacauaaaacauuuacagaauaaugaaauacguucaucucccacaaauuacugagggcaagaaaucaucaaucugauaguuuugaaagugaaaaauaaauuucaugaguguuuaaaaaaaaaucagucuguaguguguuuguauaauucuuuacaaaccucuuguaaacccaccauugucuuccaucagaauuacuuuucuauucuuccaucagaauuacuuaauguuucuuuccugaaaagaaugagacugcaguaugaguuucucauacacagcugacggugaggugcccuuucauggcuguaaguaggaaagaaaauucugguuuuguuauaaccuguagugaccuugcaaugaccuuacucuuugaaguucaauagaucuaccucuggcuuccugccagcccuggacagugccccuuccuucauguauaaacaguuuuacauucucaaucugccuuuggucccucacauucacugaguacaaagagaacuuaacuggcucuuccaacaaaagugcgguuugccugucaauugccuuugucuuuacuccaucacaucacaguaaggcucgcucuucagaggagggaagcaaaggaaauaucaaauuguugggagcagaaauacgaaccauuccuugcaaucuguugacacugacaucaaaacaaaaguuuccuaagaguuauacagcacucagcaguccugaucuaagccagauguccucucccuggucugagaccagugcgugcccucugaguggaaaaacaaguauugaaaauaauauuuauuucaauaguacguuuaggcaaauacggaaagcucuuuaucugccugagagauucgucuugguuucuccagagacuuuucacaaacaaacaaaaucaugugagauuucccggcuaacuguauuuaguggaggcauggagagcuaugaaacaacaauguggcuuguccacaugucaaguaccuuccuuagucucgcuaucaggcaguuuagcugacugccaugcccaggcauuauuccaccucaaaacuccagcugugcaaaacaaacuagcaaagaaaaaugugugucuaaaagacacaaaaccugaguugcaauaaaagguuuuaauaaacuucuuaauauaggaaaauaaccuaugaacagccaaaaauacauuuauacaauacaagcagcuuagugcuuaagugucuuauuagacuaagcaagaagaucaauuacauuugaucguuuuuccuaacuauacuuaagauaaccacauuuuauuuaauaucuauuucauuccccugaauucaucaguuuuucuuuaaaaaaaaaauccuacacauauuugggucagucuguucaauuucugacaguagaccuguugcuucuggauacugaagcaguagaaggagcugccaaugccaagccaugauggaaccuaaaguuuaaaacaaacauuuaaucuugggguugggcuuucugcauaguccucuucccuuuaucccuacauucuauuucuaaagcauuucuaaaggcuuuaguaggccuuuuagguccuaggaauugaaccuagcaccuugaauccuaguccuugcaagaucuucccauguagcccagacuggccucaaacuuguaauccuccugccuuugaccuuccauugcuggaaucauaggcauacaucaucaagccugaugcaguugcuugcuuuuucauacuugaucacaaacugucugaacugaagugccgcuucccccauacaaguagccaugucauuugcuuuccaccugagucuuugcugcuucuuucaagaacuuagagcuugcuuggccucuuugccauuuacuuacugggaggaaaucugcuuaagugccucucaucuugccauuagacccugacuugaggcucauuuuaggacauguguauuuccucagauacacuggguguuucugauagaaauugaaaguugucuucuguacaucccugauagaugcauucauauuuuuaacacuuggaacgggaagccaugggaagccaaagguuaaauccuugaagcuguagcugccucaaaggccucugcauguuuuucugugagagcuuugcuuggggauaggaugggaaaucaauauaagagauaaaacguauuagcaagagaauuccagucucugcuuguuuuuguggcacuugccuaaaaaggauuuuacauugugaucaacacuaaaagaguuaaauuuucucugccaacagacacauugccaugggaacuaaugcaagaagaugaaaauaugacaaagagugaagaauuaaauuggaaaaaaaaugacaaggaguugauuuuuaagccuuuggaauuuaaaguguuacucaucuggugagaucaaugaaaauggucggaaagacuuggcagaugcaggaagaaaggaaaaaguagcaagccuauuugguuaaaggaacucuguaaaaccuaguuccaucccugauaaguuaagcuuuucagauccuaugugaauuguguggguaagcaggcaaccugcaaaagacuuaaaagcccagcauaccaccugacaggauuaccgcauaccucacguuauugcuugaagcagccucccaagaaaaagccagagaacaucaacaaaggccaugauuuaaaaauucucccccuuaccccugucaggcaaccaccugagaauuuaguuuuucagggaaaugaggauuuaauuuucuucacuugcucaaaggcucccugagcuguugucaucuucaagccagccagcugggaaguuggcaguaaggaccuagcaguuucaacucugauaugaguugugggucugcauuugugcuccugugagccaccccucuuauccuuccaauuucccaaaaagcuacuuucauaagccuugucuaugacagauccuaaaaugcacugugacaugcagaagguccaaggaaggucacucaacugcuucugagagcugauuuccaaaucacagugauggcuuucauuugcccucaccuggugaccuuucaaauucacaugacaaaacggaacauuacaucuaccaggcaaggagucuggacaguuggaacuaagucacacuaaacugugagccucagugucuaacagcaaauaaucugacugaagcagcacccugcaaaacauuucucuagaagccuugauuuagcagugaccuguuagacucccucacugaagccuuuggcaauguucagaguccuucagagacuucuggacucuaugagggaccuggacacucaggauaguaagcaaguuggaacacaaaaccucguguaugcagacuaaauuucuuuauauuaauaccacaaugaaggucaggauugaauaaugucaugaaggacagccccauggagcucugc

SEQ ID NO: 1774 - RNA, 4112 nt, Mus musculus
guugcagggggugggggcggggugucacuugucucugcguucuuagacaagggauggcaggaagcuguuaugccugcccagauguauagcuguucugaggguccugacucaggcucccauaguuguguggucaguucuuuacauacugagccaucucccaaggccauucucuauuuuuucaaacauuugauuuauucucuccauuucuuugguggugauuuaagagauucucugugguaucuggugucuuagugugacagacacagauuacaaguuuuuuuuuuuuuuaauuugucauguaaaaguauaucauuaaaaaagaaagucuguuuuuaauuaacaaaguauauuuacuguuuuucacugccccaaacauuuggggauucuaaagauuggcuuaagaaaugacagcgucuguggagcaggcacuaucaacuuccuacaaaguggacuuuccauuacuggccaauauagcuguggggugugcuucagugacucccaaccuagauaucuagcaugcuuaaagugguaccuggaggucaggaaauacuucaaguauuuucaaaacgcaaucucauuuuuuuauuuuuuauuuucuuggaguuuuugagacagaguuucucuguguagcccuggcuauccuggaacucacucuguagaacacauguggccuugaacuccgauaucuaccugcuucugccucccaagugcacaaucucguuuucaaaugcggcuaugcuacauguuucugcuaaauauuuucuaauuuaaugcacagauacacuaagucacucuaggucuucaccaucacagguagcuguguugucacaccugaaugcguccuaauuuauuacugcugccccaacucuagacuaaucuggggugggggugggacucuaguuuuaaccucaaggaaguaaaacaagcaagcaagcaagcaaacaaacaaaagccccuguucuccuugccauguaauacgguagcaggagagacuuuauaugggaacuuggggaguuaucacuucuuagcagcuaauguggauaaggcagcugaaauagucacuaggaccaaacacuaauaaucucagcugcuuaugagguacccacaagguguuuacaggaaacccuaguaccaggaaaucuguuuguuuuuuucuuuuuacuuuucauccaauuuuauuaucuuaggugcaguuuaaauugcauuucuuguuggccucucagggucuuauuuucuguacagacacaguaccucaaggacauaaguugaagcaauaggccuuggcuuuccagccaugagaagcccuaucucuacauucucucuggcuuuguuccuugauggcagccucccugaaggacuaaauuaaaaggaauggcaagccaggccuaauaacuuauccuggaugauacugccuccucugucucuaaagacuuguccuuucugcacaauaaacacaggugagaagcaagagcuggccuucuagaauguucuguauccacagugugaaucgguaaagcugaaaggaauccuuugcugccgugugggagugagggagaucgugaguauguggucucugcucucacauuucucgaagacagcaguuuguagacuuaagcaucuaucuccccaccugauuguuucuugacagggcuuaguuguauguuuaacugcugccacaguaaaacuuugaacauaugccucuuuuuauuuaauuuaauugcaagggcaaccagaaaaggaaaggcuuaaaaaaaucauuacauuuuuuuuuuaagucuuaauaccacaggcuagaacucuggaaacacucccgucaucacuucuguauggguuggguguagcucagggguggggcauccacaugcuccacaggcacaaacuccuagguagaaugccuagaaacaacagucccugaacuacauauauucaaacuacaggucuggaagcacuuaaacaaacaaacaaacaaacaaagucuguacagugguauaggugaacauguugggguauuuauuaaaguaauuuuaaaaaagaaagccgaagucaugauuucucauuuuugagcuauuuaugacaacccagggcuguagagccugagguccagauuuugaagagaugcgugaaaauuaaaaaaaaaaggaauacuaauaccaaaaaggacagagguguguguuuguguguguauguguaguuggugggggauugguucccacauuugacuuguguugggaggcaggcacagggaugugcagguugggcaaccguaucuaacuguaugcuugcuggagucucucuuggucugaaggaaucuuugagauccuaucaagagcaaaguacuuauugccaaguugaauguucccacaauaaggcugugcaaauguguuugccagcuaguuuaaaacaugaggaacacugggucaagauagguggcuggggacagguuacauagaguuugggagaagcugggacuuaccagcugccugaugauuuucucaugaaucaaauucugcuauaacaaacaccaaaauaaauaaauaaauagauagauagauagauagauagauagauacauagauacauagauagauaugaaagaaagaaagaaagaaagaaagaaagaaagaaaaagaaagaaagaggaaggaaggaaggaaagaaacaguuuugcugaucacgaucacucaucuauuguagaaugugacacaaacugggacaggguuagggaaggugucagaggccacuuaaguuagugccaguuuuucuugcaguuuucucuuucuacacugaaggauaacuccacuaaccaacaugaauaacucuaacauucugaacagcuaaaaacacaguccugagcacuucauacugcagaguagaaaaggguguuugcuuugcgucagagcuggcaggguagacagcaagagccuuaaucuugaagggcuuggugaucucaggacaagagggaaugugcuaacugagagacuauuccaggaacagaacacuaagauuacuauguagaccaagaaaaacaagcaaaaaauacuucaaugguuuguaccaaaauuugaguggcacuacaguaccagagccacaaggaagauucggcaguacuguggaacacagaagagcaucugggcagccucucagcauuguuccaagguucuucccaguucucauucucuugcuuaguucuacaaccaaaaauuuuaggaguacaugaaagucggaaaggaggauaaugaugaaauagagaagaaagcaaguuaaaagucaaacguuuuccaaaagaagagaccagugguuggcacuguugcgcuugcuggcagguaacacugcucaaguccaagguggcugggggaugcuuagccuccuaaaaggagcagaaguucaccuggugagccuuccugguaucauaaaaccagcaggcuugauugaggucacagcgauuagucccagccccuuaaagaggcugacuagaaucugcucagagcucacuauaggagcuggugaccugguggccagaagaaagcagcuuccuuuggagaauaacaccgggacuuaaaguuuuaguaagcuucagggaagaacauucugucaucuguuuacucuugcugaaagaggagauuaaguguuggcagaggggagucugaagcucaaauggggaugguucugaugggaucagcaagggaaaagcuugcugaggcagagguuacagugaagacauccuuagcuuagauguggcuuccuccaucaggacccagccaucagaggcccugaaauucuaaauaucucagaaccaugugcacccugaagguagucaauagucugugcuugcaauauguggaucuucugauugaaagaggcuggggauggguuuacuguaggccuuucuugaaacccaauucucacuuuaugcgaugcuuuuuaaaaaagcauucucuaugcaauaaacuccauuuaggauaggcuaauuacuuguacacaugaauaaagugaaaagugaguuuacagaggaguuacuaccagaugucagccagaaauguacauucaggcaggaccuugauuaguauuucauuaagagaggccauucagguaaacuugaugcuuaacuuuug

SEQ ID NO: 1775 - RNA, 37430 nt, Mus musculus
cggcugcggcggcggcggcggcggcggcggcagcugcaaguugagcugcaggggcagcgcauacacuacaauggcugcuggaaagaggcguaaggaaacaauuuccaggcccgccgcguccagcccgaaauaugagaaaaaaauuauuagaaauuccgcgggcgguguaaaggcggcggacgggccggagggaggauguuaaagcuccgcggugaguucuccggggguccggggcggcggggaggcguuuagcgggaggaauaucaggguuauuuaaauuaugggacuagccgagggggcagaggagccgcggcggcggcaggaggaggaaaaguuugugcuacucccagccccugcucaggaccccagagagaaaaauaauaauaaaaaaucaaauaaaaucgugcggcggggcugcaaggacucccgaggucgcugcugacagggcagggggcgacgcgacuggggacccgaaggugaggucggugggaaaaaaaaaacccuuuuauucagggucuggaaaguuugaaaaguuuuccuccuccuccuccuccuccucucuggugcugugaauauugugacagcggcagcggcagcagagagagcggaagacauuagagacccgaaaaauaagggaaaaauuaauauaaauucgguuuugagaggaaacucuccgcguuuuccaccaaaacaucccgggggaaggucgcuucccagagggccuggcggagacccgcggucggcaauauuugggggguacugggagugacuugggguaacuuugcccccuuuuccgaagagguuuuucuuuucuggagaaaugcauuuguuuuugcccuccugcccaggugggagagccgagucggggugcgggguccgcggggcgccggacccagccggguggcgacgggggcguagggggagggggugcuaaaugaaagcaggagaucgggacggagcagggacagcuuguugucaguaucauaaacaaccaaaauggagggagaacucaggcauauaaccaaauaaaaauuguuaaaaaaucgcaaaaaaucccuaaaaauccgggaugcgccccccuuucucgccaaagguaaaagugugaaccgccuuuccccugaaguccauuuggacuuugcagggaccaaggaguuaauauuuauuuauuuuuuaaaacuuucgaagggcaaaagccuuuuauaacuccaccgacaaugagaaaacgugaaaauccaaugcaagagaagcagggggagggagggggaggugguagugcagaaacuacuaaacuuauugguaauguggacugaucugagauaagauaaacacuauauuugcuauuuuauaacucccuuuuaaugaucugugaggagguugcuuuuugggguaggaaaaaaagugaugccauuuucuuaauagaguuaauaugugugauuggaagaauaaaccuuuccggcuuuagauugcauuuucgucgcauuuaugccucggguuuuguuaguggcucccuccuuucuuuaagcugggcucuccagaggagggguggaaaggugcuguugcccagagagacuggagggcaagacuggcgaaccuucuggggagggguggggaguuguuugguuucucccuuccuggcucguuugcuucaccuguucgcccucacuaaggaauguuggacugaaguuuucugguuuuauguauauaaaaggauggugccucuugcaucacauugauguuagugggaaagugcugcugauguugguuccacgugggaucugggacagagcagggcauuuuaaagggacagcuucucuuuucuuaggguuuucaucaccuaugcagacuuacagaggaccaaagucagaggugcuggaaguguguggugauggaagagccuucucuuuccauuacucaagugcaccccccguuuaggagugauggagggagaggagggauaaacaagcccagcagaagauggauguguguguggcuuaguuuucauccacgcuguucuuuuauguaacaagcccucccagaaacuuuucauguuacauugcuuugcucuggaagcugauuuuggaaagaauuguggaaaaauggaaaaaguugaaggugugugguguaaugguauagcauuauugaacacuuaugaauucugugcagugagaucaaagagccauguaugcccauaauggggguuuacagccauuuuguaaaauaccuaaugcucaguuuggcuucagguacacugaggacuucugguugaaacuuacaggcaaagugguggagacuccuuaacauuguaaacaguagacauuucuggggaggcgggaguggcucucaugaagaccauggaaaaguuuauauauauauuucaaaauuauauauaguccauccuaugcauauguuauaacuuugcacuuugaaaaugaaaaugcuuggauauccugaaaccuauggauuuguaucuuuuccgcugaaaugauuuguguuuaccaggaaauguuugcuaaucguuagcuccuaucugcucuugugucugcucuugugucuuagauguccgcaguauuuucaaaagguaaaauguguacauuguuaacuguacaguauuuaagauuacaacuaaucugggauggaaacuacuuauauucaguuuccacagccauauagaguuugggaaauaaaucucuauuuugcuuuguuuuuacaauuuauagaaauggaccaaaguaagaacugaguuuuuagacuucuuagguaguguucucuuuugccauacugcauaaaaauuauuuugugacaauccauuguguguuaguuccuguuucuaacugacuuuucucagcacuuucuguccauaccuacaugaaaacaguaucagugaccugugagcacaucaucuugugguuucccacuuugggaacaacuacagcuuucuaagaagucacuaaggaaagcacaggggcacaaaucccugugaaauccugaugcuuggaaagagauuaaagucucaaugaagaagaugaccccuccccaccauaaucuuguguccaaagauuucagaauuccaucacuacuuacaaaaaaaaaaaaaaaaaacccucugaaguuuauuuugcauguucauuauguugcuggcucaagauaguuacucugacuauaaguagucaggauuauacuuugugcuuaaaaugcaugagacuuucggauacugagcgguugccacuuugacaaaccaaauacaauuaccaauaaauucagugucaguaaaagucaaggcaaguuuugcuuuugguucuguuagcucauugagcuacugaagguguuugggcacuuaaaaauaggaucucauucuuuguugucaaccucaacacaaguucaccuauuaaaauagagguuauucuuucucauauagaguaauauacacuuuguugggguuuaguaaaaccagcucuuuuugaaguuaaaaaaaauacacucauaauguccagaugaaaaccuguaacucuuagagucuugcuuagauagggaguagcacaagagcugaguugaguugauuguacuaaggcuuuuugaugcuuagaaacccugccuguugaacuuccuuugcuggaaguccuauuaaauuauaccaauacagagagauagucuaaggacagcagcccaugcuccauacgaccucacuuacaguuagagaaaccccacagaggagaauucuucucugagacuuagaugcccaguggcacuacugaaaauucugaaaugauuauuuccugcagugguggaugauauagugagugugggauaauacugauaaaaccccuuaucuguguauuuauuuaugauaaucaaaauaguucaauaagcagacauuuucuaguuaaaguaguugaauuuuccuuuaucacuauaauuugaaauuuuaagaauuuuuuuugcuuuaguaucaauucaaaaaugagaauuuuuccuucauuauuauaauaauccugguugcuauuauguacauuuucauaugauauucuagaaauuuaccuaaggguuaaacuauuguuuuuuaaauuaaaugucauguuccuaucacaacugggauuuuaaaagacguacaacugaaaccuaugccaugccugccuuugaagguuacuucaguaaucauuuuacucaagcuguauaaucaaacuagccauccuucuaggaaugcuuuaauauuauuucuuuguaauuuuguucuuugacaauuuaacguguaaaaaauuaaccuguuaacucaugagaugagaguuucagaagaagagugucuugucaaguaaaagcuaagcaaguagaucuguucaggguggaagggaaacugucccuuaagccaucguuuaaaggguuuuaagaaccugguaaauauuuuuuucugaaacacagacuauguugaaagcaugucagucauugcuugaaaacaaagauggauuuuuauuucuuuaguuuuaacaggaauuaauguaggcagcauauuuaaccaauuaguaaguguuuagguacccuuagaacaguauuuacaaauaaguucaguucgagggcaggcuacaucggauugaugaacuguaagguucacugugguuucagagcucaugaagaagaacucuuuuccauucuaacacaaggacacaguagaagugaugugugguugcuuuuuguaaucaucucacugcuaaccuucuuagaaacucucaaaucugaaauccaccgguuacugcuuuccuucauaucaaggcaacuuuuuuaucucauguguaaauuuaauuucagguuuaauuugagaaaguaaaugaauauuucuagguuauaaauuuuuaugaaaaauuggugugaaauuauuaaaauuugacauuauaagaaauauaucuguauaaaagcuuaauagaaauuauuacagaggcauagcuugauuuuuacuuuuaaauucauuggccuaucucccuaagguuugcauucuaccuagugugcccuccugucucugucuacuccuuacaggggagaguugaccaggauaucaugauguucacauaucaaagacauuggaauguuuuuguauucugauuuuguauuuauauugguguuugccauucuuaaggauuuugcuuuucuaaaaugcauaucaaguacaaaaaauguuacaaaacaaauaauaucucauuuuuaaaaagugaaguaguaugauauuacacuaaaauuguuaguauuuaaaagucccugaacgucuuguaaauagaguuacuacaggaucuugguauuaaaacuaaccacaguuugugcugggagcuuggagugacuccuuaugaagggugcaugugagugaacuucugcacuuauauccuagguucauagggaaagcaggcagcuaaaaauaacguggaaccuuuuccuaauuuaaaauuauagaaaaccuagaaaugugaagauaccagagaacaaaaauaugguuuugaugccuuuuaaauauuaauacuuuugaacaaugagaauauuguacaacaucaguguaaacuaaaauauucaaaaauaauaaugagaaacugaaaaacuaagaauuucagaauaaaauuggaauuaugguaaauuuaaaauucagcuuaugugaauaaagaauaaccaacuacaaagcaaacccauaaguuuacaaaagaaagaaagaaagaaacggaaagaaaagaaucagagugguacuuuggggaauuuuaucagagaauauuuuuagugcaaauugcaggauuuguaaucaccuuugaaacaagaguucccaagccuuugcuccuucuucuguagauguggauuaaacuaaauccuaauuaugauuucuagugaugauuucuuugaaauucauuuuuaacaaaaggaaaaagagaaagucauuuucugcuguuuuuaaaagagauuuuaaagagguaucaaauguguagcaaugugaaauggucugagagccuuagaaaucaucgaauaauacuucccuuguuaauuaucagaaagcuuaaaacuuguuuagguuaauaaaauaaauuuuaaagcuucagucuaagaauaauuuugcucuguggauuuuuuaagggcaauuugaauaauuucuuacagucuuaauagcccuuuaaaaacuuugacaagacaaagauaagaguauuucaccaauaagauuguuaauuucuagaguguuuuaagguguaagcugcugauuaaagguaugucucuuucucauucauuaguuaguugguuuucuaaaggagaauugaaaccuuuugugauaucugaaguagaauuuaccucgagcucuggaaacugcucagagaaugcauggggcucuuugcaguggugggagagagagcauugcagagucuugaaaucuaucuuugagcaggagacucucauuuuacgcuuuuuaguuguuaguacuuaaauuauugucucauauuaguguugguguauugcauguaagcuguuuacagucuccuauguuauaguuucugaagaugaaaauacuaauucucagaguaaauaccacaauuaaaaagcugacauaugacuuuuaaaaaauaucuaaugucugaucagugggcauuagaaucuuuaauauacauuuuugggaaacuaaaaucaguuuuuaaaugaggacuauaaaucuuuuguguaaaaggcagaaucagaaaguguuccagucagcucuguuucucugaagacacggcagucgauuguucuugagaaagagaauuuuaagaaaccaaagcuggaagcuuaagguuguuuaacuuugcagguucaaaacaucaccaauugauuuuacucugcuacguuuucucaguaaaucaauuuuauuuucuuguauuguuuuaaugcuauaauuucagagcccaaguuaauucucaucaugcccaaagaaguuauaauaaaaauguucuagugucuugucuucaggcagugagguagaacaguauuuguagaagagugcauucccuuucuuagguugucuuucgcauucucuagguauaauuucugagaguguaccacucugaagaagagaaauuagcucuauuacguugacaugaaauuugucauaauuuuuuaaguucauugaaaaaauguuacuuugcauauuugaguaaaacauaucauauucuuuaaaucagcacuuguguguccagugugcccaauugcaugcucagccucaaauacaaauuugcucuccuagcgccuuuaaauuugcuuagguaaauguuagaaaauguucuucccguguuucgguaauuuguuauugucugggauaauuuaauugaguaaauuucuaucuugguuuucuuucucuucaaauauuagucuuuuacuugaaaauuguugguaaaugcaugugauuucagcauuaagauagaaucggacauacaauaaaauagguuaucccaagaguggugaaaacaacgcugcugguucuugcuuggacguccuggugaguacagugugugcucugucuccugugcauccucagagcugaugcugugcagagcugacuucauuuugcucuauggagagugcauggucagccuucccagggauuucuuucucaguucuaaaaaaaaaaaaaaaauaguauuaaggcauuccuugaaaauacuuugucaugcaucacagcacugugugugaagauguguuaccguaguuguuuacccaaauugggauuaaaacaaaccaucaaauaauaaacuuaacugggcaaaaaugagauuuaaauauuuaucugaauaaauugauuuacuggugaaaugacagaauuuuaaucaaaagaauugguuuuucuuucagaaucuguuuuucagccccagaaguuuguaaguaaaauaauguuaaaaauaauaguaaugauauaaaaucaaaaaguguggagcucugcaaaaggucuuaagcauuugucuuugaugguuaguaaacauauuuuaaaugaucaaaaugacaucaaagaacuuaauaucuucaaucauuuugguuauuuuuguaagaaaaguaguaacagccuaguaccgaacugcacaucuguuguguuugggagcuuuaauuauuacguguuuacuaggacagugcuacuucaguguuuuuuaaaaguacuguuaucaguguuuucuucagaagcccucuuuguggauauuaaaacuuaauuccguuuuccugaagcuuuucguacuacuuuuauuuuuuaagcaugcccuguucucacagcaugcuguucuugaaagaaagugcuguccugaagcacuuuaaaccauagcucagauuagcucaacauaggcacugcagguauagccauucuguucgacauuggcccugcgucauacuugaaugaaauuauacucaauucacccauuauuggucacugcaugaauaggagaagaaaacagcugagaagaggagaaaggaucccguuccgaggcugacucaugauagccuuucugcagacuaugauuucuuugccagaauuaaaaggagcuuguuaauuagaaccaaaaugcccgugugucuacgaacucuuuuccuaaucaggauucagacacacuggugugcuuccuuccauuggcauccaagugugcuugcugcuuggcucugcucucuucucagugcugccacccuguggauggcagugccgcugcggcaggcacacauuugcuguguuaucaagugguaccguucuggagcacugguggaaagaagcugagcugagcgcagagccuguuguguugcuuugccgcugugugugcugcuguacuccaguuagguuuguaaaaguuaugcagcgcagaaggacgguacucagcugccaaaaacaugaaaauuuggaaaaacuuuaaagguaaaugcuguuguuugucuaaucugccguuucacuaaaauaaagcagaguuagacuagugcuucaaauguggcuuacaaguagccaaguaagaacacagagguucagaguguguaaagaugagaaacgucaugagauuuuuaauguuagccaaguuauaauugcaaguucuuccuuaguaaaagcaaaaccaaaaaacuaacacucucucucucucucucucucucucucacacacacacacacacacacacacacacacaugggugggggagucagggacuguuucugcuuaaaaggaaaggaaaccuaacuugauugguuacauucuucucugaaucacugaccaacacgacuugcauuguaucagcaucauauuuaaggagugaugcugcgccucggccauaaagcgcuugggcuggaucacaggauuagucccuugcuuuucccugccuuaucucauuucauuuucaaagcagucugugaguaaggcagggugugcacaacaagcacuaaguaagccucauuauagacagacuauaaaagcuaauuauaaauuaauuucuuaguguaaaccuaaguugugucaguacaaagauuagcauauuuauaguuacaaauuuguuccaaaaauuuaaauuuuuucuuaaaguuugcagaguagcucaaguuagaaaguguuguaagaauucuuauuaagaaauaaggcauugauggaaaauguaucugcucuguaaguuaaaggcgauuuuaaaauauucuaaaucuaagcuuugcuuuacaguaugaaucucagacacaguuucuuuuagacggauuuauggccaagccaccagacuucugacugguuacuguuucuuucaaaaguuuugaaugguuugcucuaggaaacaauguaauuguauaugguagcuguagaaaguauugcuuagguugguuaguuuuagauacugagcuucuaagaccaaaauguguggauggguguaaaagggaucacuguaguauaugugcuguccccuauuaaaagaccaaguucaagugcuccaguuuguacuguuccucauauuugaggguugggaauuucuuucaucucuguaaauaccauuuuauauuuuuuaaaaauuauugccgugaaaaugugauuaaauuuugaaucaguacuaaagaguuaccacuuuaaaagaaacuuuaagaaagacuauuugcuucaucuuguuccucuucauaguaagcucagauaagacuggauccgcugaccuuauuuuaacaaagcaguauaaacaguuguacagauuuaucuaaaaucacaagcuuuuauaguguuuuaaauacgaguauaacuuucuugucuucacucagcuacagagcaucgugccacucuauaauuuauucuugugcuaagugggagacaaaauaggaaggguaccuuaggccacucuguugggguaccuauauuuacugcacacuauuuuuuuuuucugcuugcuuuuaaaauugcuguuuagaugguggguagacauaccaaaagaacacaaaggcagugcauguuuaaaugcccagugaauaauauagauaucaaacacuauaguauucuuggaagggagaagggaaacuugagauggaccuugggaaaggcacaaguuaaaaauagacaaggagagagagagagagagagagagagagagagagagagagagagagaaugagaacacaacaucuaggucaaagaaaugguuucuacaggaggcagaaaugugcugcuugucugguacgcugagguaguaguacugaagaggguguuucugaggagaugggugugcugaggucugaccagagcaagaccucauaaccagccacagaauuugcuccaugugugguagaaaguuuuuagcuaugcaagcagaggauuuuggguuaggaaacuuaaggugccucuuaauccagaauaacuuaagcaggaagaaaugagauauacuccuacuuugacguaggagccuccucugcucugguauuccccauuagguccaugcucaccagaacgaucugaacauuuauuuauuuauuuauuuauuuauuuauuuauuuauuuucaauaaugccuggcucucaacacaccuacagcuugcagcuuagacgucaguaaugaccccaggacucgugcuucuaaucauaaaacuacucaugaucacucacuuggaacuggaguugcacuucuguuguaggggcguaaucacagugggcagguggaggaagaccaagagagccaggcucacagaggagcagccugggaacaaagguacaccgcuccauggaacucugucccuuggcuaaguaucaggaugccagugagcagacacuuagcaagggaggcuagccgaugagacaaggacugugcucuaacaggucuuccgcagcaccuuguggugauuauccugauugggagagaagcugggccucugguaaugcagugguacucaguacuaugcucaguccucucccugcaggcuccacccuucauuucuacugagccucugguaaugcagugguacucaguacuaugcucaguccucgcccugcagucuccacccuuaauuucuacugagccucugguaaugcagugguacucaguacuaugcucaguccucgcccugcagucuccacccuuaauuucuacugagcccuucaccagguguccugccuccacuccaaagcagacugccuucugcauagucucuacuuggcauuuccuugcuucuggauuucuguaguguugccuaacacuucuucagagccccagggagaauauaucuagcugucuagcuaccuagcugagguggcuauaccauaugcuaugcauggcaugucgggggcuguggcaaacaaccuguuaugccagcccaauuuaggcugcccucccugggcuggaauuucccacucuuccucucucccuacauccuguccccaguaucuuuuuuccucaacaaagccaaucucaugagaaaaguuuguguuuuguguauggucccuuuucuuuaucucuccauucuugccauccagccuaccaugaaagaaaacaguaaacgccccccaggagucaaauccagggacaucuuuauuaucccuaggggucuguucuguagugccaucacucuccacauucgagccucuuucuuuccuauccucuucugccaccuccuuuguacuuuccuuuggugcacauucuuccaccuguccuagcucacuagcauguuggcauuuccuggaacuugccaagcuccuugaccagcugauucucugugcaugcucucccugagcaccagcucccucccaugguacccuuuauaugaugcuucacacuaacgaagccgcuaccucuccuuccuuugugggccuccauacuucuuucuauauaagccagcucccuacaucccucaguuuuccuccugugucuuaugcauaccagacuguguaguaccugcuuugaguuagguucuaagcuauauccuaucagauuauaaacaaggcuuccucaggcuggcaggugguaggaaagcaguaagaaggaauccaaggaugaauaguucugaggggcucaaugaacaaggaccauuggagacaacagcaaagacaaacgagcauuuguauaggagcuguaacaaugaggaacagucuggaaaaauccuggucagauaacuaggcagaaguccuguucuaguuaggggagcuaacuagacacaaagggaacaaguugaagaucagccugagacacaaaugccuuggggacuguccuaaaugucuuuggggacuacuagcccaaaagugagugguacuccugaaccauguggagguugcccuuggcaaggugacugugacaaccauccucuugcuugucuuaucaucuugugcucuguggcuagaggucaggggcaucugguaggcauaacacccugaaaagcacaacuccuugagacaagagagcccucucuucuguguccccuaccugcucuuugagaugugguggaacugccucaucuacagcccccguguuaaccggcuaagagcucaguccuauccuguguguaucuggucuuccuacugaacugacauuggagggcaaaggccauagacaaccagcuuucucuuuacucuguuugagaauuaggcauauaguaaaugucugguacagccuacaggaccaauuguggugaagugucugaacaaacauuguacagcaguuaggagcuaugugauaaaaagucaucugccugaaaagcauccugaagaauaaauauuucaccaccuugaccuugaaccccuacauuuggaggaagcugugacuacugaaauuguguauuacaguguuacuuguacaguguuacuuguauauccaucucaugcuaagaaaauaaguauuuagccucaguaauaugaauaucauacuagaauaacaguucaaagucucaaaccaguugugugcauuucuuaguuccuggagccugugaccauuguacauuguacauaaauuguuugucuuugacaugauccacuaucuuucaugacagaaccaccguguuuuuagcauauggacaacagguucacuguacaacacuaagguaaugcugccuuuacagaucguuugaacucuuuauugugggccaauacaagauagaaaaaaguugacagaugaguagaauuaauucuuguaucauaaccaguucugacaacuccagagcaguuaggcuugcuucaaccacucccccacccaaauacagccgccucauggagaucguuugauauaaaauuguuucaugucauuuguauauuguuuuaggucuuuccuaaaaguacagacucuaaaaguuugacuuuacaugggaugauugacauuuguuugucucuaagcuucuacuaauaccuuugugcaggugagggggaggagaauaucuauuccauuaaggaagaggaacuuucuagucaugaccacaagguggcacaaugacuacagcuuucugguauccauugagaauuggccaacucaagaaaaaggucuuaucuccuuaaauguuaaauaugcauggaacaugcagagaauuuuccaaucuguccauccucagucguuuguagagacaacugucuuccuuauccguugggccaacagaguagaaagggcccucuugcccuuccuuccucucccucuuuucuauucacucagcaaacacucgaucacauuccuccuauguguuccggauucuaaaugcugagaugaagacaugggcaguagaagcaagacccuggcucuugcagucugaauccugugccugagagcuucucugcuguccuuguuacuucugaagccaucguuaucugucuuccucaagcugaauccaaccauggguuuauaucaucuacgucaguuuuuguucagcaugcaaaagaaguacuaaucagcaucuaucagugauuaauuuugguuuauucaugauuaucuguggcuuuucuacuucccauuuacccaguuagucaagaauuggcaguguguuccuuauaaaugcaaaauuacauucagcguuagacggauauaaauacaaauaaauguauacauugaaguccacauagcauuucuuuaugaucaaugccaguaaaacgguuucaaaagauaaagaaggccaauaaugcagccaauacauggaguuauuacagauuugaaauauacuggguugguauuaacuuuuuaaccaagugaaccuacuguaaauuuauuuaguuaaaauuacaucuaguuuagaaaugucuuuugcaaggaguaaacaagaauguaaaaguauuguuuagaaacuauugcccaaauugccauucuauuucacucaaaaauaguuucuuuuaguugugauuuggguuuaacugugacuguaagauauacucugucccucuauauacauagaaucauaaguacuucaccaaaugucacuuuacugcuugagugcauaagccuuuuauaugaaauguucuuuuucuuucucuguugacugguaucuauaacaggaggaguggucaguccuuauuuuuauaauuuaucauuaugguaugaauguguguauuauaugggagagacauacuuguaucaugacacacaacaugcaaaguuacauucagcauugcacagauaaaaauauauauaaguguacacauugaaguccacauagcauuggaggucagaggacaauuuuguggaguugauucucugcuucuaccuuuuacuuagguuucagggacugagcacagguuucugggcuugcucagcaaauaucuuuucccacugagccaucucaccagcccuaguccuauacauaucaggacauuguaaagcagcacucuuugcugaguagcccacuaaaugcaagagauauguauauuaagcccucaggacuauacuaaagacuaugcguguuacucuguuuagcuaacacgacauuguagauuaaguauucacuucuauccuucuaaggaaaauguugaagauaaauaagguucccauggcuagcaccaguccugauggccugaguucaauccccaggacccacaugguaaaaggggaaccgacucccacaagcuguccccugacuuccauaagugccauguacaugcaugcaugcauacauccauagugcauacauacauauauacauacauacaaucuuuaagagagaaucaacuguacaaaauuacgcugguuaggcaggauuuggaccagcccuuguucucagaaguaguucaucuuugugguugucuccugcacugcuuuagccugagucagauugagaaguuuuguuuuccaaauaaacuuuuaaaggagcagugugcaaaggguaaaugccagaagaucgcugcccuauaaucauacugucuagaaguaugaagugacucucuaaagcauaucacaguaggaaaaggacccagagguguggagcaaacagaagaguugggguggugggaaggggcuugcauagcugcugugcccuaagcuacuuccuggggaguuuuuguuaucccucuugguuaucaccuguuagcaagcacaacagaguaaguuuacaguuuuauaauugaagaaguucuuuguuuguuuaaaugcuaagcuagcuauaaaccagaagguaaugaccacucauucuguuuuagaaagcagcagaggcacacaaagauugauucauucccaacagucuugagaauggggccaguaugcaaauuucaggaggaagcagggcaggcaccuacguuugggauacuuuguaauugaucaggauaauuuucaguuuuucauugucugguaacaagaccccuucauucaucuaaacacauagcuccagucuccagcauuuuguuugaaauauaauguauccccuaguuaccuagcccuguugcuagucccuucuaccugggauaccugcccauguauggcucauacuaguucucugggucacacuugucuuggcucugguguuuaaaauaaaaacagaaguauaauucauaaacauuaaaugucacauauugcuuguucuaaaacuagaugaagauguuucugguggaacaugucuaccaguugccauggaugucuuugcuuagaagguuguugcugaugagcacacaagugcuuuagguccugccguaaauggaccacagucuuuacuguaagauaaaguucaucagugcugcggcuuaaacauuucauuuucaaauuuguuuucuaaauuagcauacaaaguaaugugcuuuauuguggcagaaaguauauuuauuaugccuugucuaguaagcaucacauuagccuauauugaaugaaaucgccaaacacaaagccaguuuuauaaugaaauauugaacaucucaugucauuggccaaauacugaaaguaaagucaaaaggauugucugggugcauagaucuuuguagaagugugacguuaaaacagaaaucaaauuaaauggucguuggaaguccaagagcaucaguauuuaaaacagcaguguagaagcuacacccagacacugcaacagauacuuccuugguauuuaauaaguggaauguauccuagaacuauuuauuauccacaggucucaauuccguuaggguauauuccuggagucuuuaaaucaugugguaugauaugccaguuccuaagcaacaggugagccacacuggcuccuccaaguagaacagcugagaauguagcuccaaagccucuuagauguguguccuuccuucucagggauaaaggccucaagcuacacugaauuuucuuacauugucucccccucugaaugggaaggacagauuuuagucauuuugagacuuuguccuuauaacgaccacagcauuauaaucauuauauuuuuauauauguauauauauauaaucauuauuauuaugguuauaauugucccuauaauguccauuguuagaguauuuucucuugagaguucaguaaauucaucuggagauuugcuuguuuguuuauuuguucuguucacugauauuuucaauacaaaaacugccauuuguuuucucauugcuuuguugagguguggcugguguuuauaagguagacagaugugaagcauacaaugugccauuuggagcacugugaggccaucaugccaucagauacuaagcuuaucuaccguuucugcuggcuuaugaacuccucccuaucuaccuccugucccuagacaucuguuaaugugaauggaaccaugcaauauguaucuuuuuuuggccuggcuaguuucaacaagcauaauuaacuaauuugggguuuauuuauguuucugcaaauagccaucauucaguccuuauugcuacucacuagugaauuguguucacauugauaggcauuuggguuauaucuuauuuugacuauuaaaacaaagcuguucuggguacucaugcacaaaucuuuguaaagaugcauguuuucaucucuuccauaaguagauagaaaugaaauaaaugacugucacauggccagcucauguuugacuuuuuaagaagcuacaaauguucucaaagugaauugcgucauuguuaccuucuucucauucaugggugugcccacuguauaauacaguuucagagaggucuauugcacaauagcugccaaauccagucagccucuuaugaccgguggaaugaucucacugcuauuaauuugcauuucccuaauaccuagugaugccaaacaucuauucauguagaguuggguuuugccauuuguauauuuuuuuuaaaaaauacuauuuuauauguauauguguuuaucucuauguaguaugggcaugugagugcccacagaggucagaagaggccaccagauccccagaaguuauagacaguuuugagccacccgauagggguacuaggaaccagacuuggauucucugcaaaagcagcaagaacucuaauggcugagaaaucucccuagccccuauuuauauauuuucaugaugaaauaccugcucuugucucucuuuuuuuaauuaauuuugaauugaacuauuaugaucucauuggauuuuggaaguucucuuucuagguaagcucuugaucauaccaaugcccuauaaggguucuguccauccucuccaggucagcucuugaucgugccgagccccugugagggcucuguccguccucuagccuccucuccaggucagcucuugaucaugccgagccccugugagggcucuguccgugcucuagccuccucuccaggucagcucuugaucaugccgagccccugugagggcucuguccguccucuagccccccggcuuuugcuuuccucggggaugucuuuugaacauuauuugcaaguuugcugaaacccaguuuaugaauuugcucuuguaagggcuaugacuugguuugcuguaaacacauuuuuuccuguucacagauacuuuucuuuccaauauuuucuucuaaaaguuugagaacuuggguuuuacacagacuagucucugacccaucccagaguaaaggccuauaugugcuuuaagguaugacucaagguuccuuuuuugguauuugaacaucaaaauuuccagggcauuuguaaaaacauucuuuuugauaaaaauaaaauuuucuaauuauauaaauaagacauauaguaugaaugaguguucaguuuuuauguuaccaaucauuuauuuauauguugugaugagagugaauuuaaauacauaguuuacaaaguuagaguugaagcuuauauacugauuccauguaccagugguuaaauuuuuucacauuguggcuggagagaugccuugcuggcguugcucuuacagaggaccugaauugaauccccagcacccacauucggcagcugacaacuaccaggaguaacacugacuuagcgcagaggugagguagccccugagucuggccucugaggauaccugcacauaugcacacacacaauuaaaaauaauauaaguauuaaaauuagcauuguauauuuucccagguggccuaauauauucaauucuuuaauugcucuuuucuguguaauuucaugauuuuaaacuuuguaaauuuuuugauugguugauugguuuugucuuuuugagacagcguuucucuguguaucucuggcucccuuggaacccacucuguaggccaggcuagccucaaacucauaaagaucugcuagaaauagaaaaugccucgugaguucuggggauuaaaggcaugugcuaccaacgccaagcaaaccuugguagguuuuaauagcuguauaauacucugucgcaugcacacugacuuccauccguuuuaugaaacaucaacuuuauucuuaaaaugugaaauuuugaauuuaugcuuaaguucucucuuucucuccuccccucuccccucacucucucuuucucuuuaacuuucaaaaguaaauuauaaguccauguauuuggauuuuaaagaacguaaagauucaacacuuuaguuuuccauaggcaauaacugagauuaaguucuuuguagcaaauuguuguuuuauaaaacuggaggcugucuugguuccccuggucuuucuuggucugcuaucuugcucuuuauucuuuuuucuuuuuuuuuuuuuuuccccccuuugguuuuuuucaagacaggguuucucuguauagucccggcuguccuggaacucacuuuguagaucaggcuggccucgaacucagaaauccgcuugccucugccucccaagugcugggauuaaaggcgugugccaccaccgcccggcuuguucuuuauucuuaagcuacaaacaaaacccucuguucugcccuggccaaugugaggaaacugaauuuccucauucuggaacaagaaaagaucagugggugaacacacauaccgccauguuagcuagagaagcggguuuucauacuucagacugacagcugacugguaucucugggugccauucugauucgugacuuuagaaggucucacugcuuuccacaacaccuucccuacaucuggucccacucaagacacacacccagccuccugaucuugcagacucugucuuccuccucuccuccauccuucugggaugguuagugcuaguuaagaagaccuaaaaaccuggcacacaagcuucugggcgcaccugugagggguuacuuacucucuuggcaugccugugaggcaucacauugcuuagguuaacauccucaaacuggauagcacaccauucucgggcuuggguccuagaaucuauaaaaaggagaacugcugacuacagacauccacagcuaucucccuccugccuggaugcaauggaccaacugcuuccagguccugcugccaugauuucccugugugauggacuguaccaucaaacucugacccaaaauaaaccacccuuaaguuguacugcccagguauuuuaucacagcaauggaaaaguaacuaaaaaucuuccuuuuuccucccuucuguuuccucucccuuccucuugccccucccaucuugcccuucucucccuuccuuuucuuucuaguccugauuuucucuccucuucuuccuuccccuccuuuccucucuccuccccucuuccucucccuucuguucuuccaggccucuuuuguacuuccuugcugccuccccugucauuauaagcccccccgacacacacacccauaguuuuuaucacuaaauuuaauguauuucugcccaaauagcuacugcucagcaguguuugugggugguuccgugacuuaguaacuuuuuuuuuaacuuugccaccuuuuccuuccuuccuugagaaauucuguugucuuaucucuugucuuaucucuuagugguagcuuuugguguccaguggcuuuguugugucuaagaauaagcugcacuacccuuggcuccccuccucuuacugcuuugagaauacugauacaaggcagucuuucuuuugggaaauguuccuuuugcugguugucacuuugucuucagacucuagucacaucuuucacucaagagaacaugcuguccucuccugccuccccaaguuguuguguucucagcacuuucauuggguauauauuuuucaaagccccugcuccuuuuguuaguauauauguggaucuguccacagcauuggagcugcacuguccuugucuuggcccuuggaaaaugugugaccaacauuacacaaaaucagcaggcaucuuagacuccagugcuggugguucuaaccugucggucucugcgugcacacacuuuugggggguuaggggguuucuuaagguaacauucuucaaggcaagucgugagaaaugaauaguacuuuccuccugggauguacuguggcacuuguacugucuaguauugugucccacugaucucaccagcaccaccucguggcaguguuuaccaacuggaucaacgacaggcacuaguuugcacacuccuacagagcagagaccauaucugucaguagcuguggcaauucagaucagcacuguauauaauagaugcugcuaauauuuauuacaucacugucagauacugacauaagaguacauaagaauauacugguauagaacugcacauugguucucauuuccacauaaagcagaagauuuuucuauauagaacuuggggccucucuuuucugucuugauuaugcuccuagaggucuaucuucauaauuugcagucaugggauaccaaaggcugacugcauauauggugcacuucaggacgcauuuuguuuuucuuccuauauuguugaugguggaucuggcccaagaaacucacauaaggcacacaauaguccugggaugagcugaggaaagaguuccuguccuugcuccaccuccaccuuuggccaucuacaguuugcacuuucugagaucacgcacagggcacacuuuuuccuuagucuucgcuuagaccaagaaagauaugacagaagaccuuuuugaaaauguucuggagaagaccggaugugcuuagaaaauauaaaacggaaguaaaugaucaauuuuaaaaauaccagaaaacauaagaauagcugaauuaaauuagaguucagagagaaaauauagaaguuguaaauauucauguguuugcuuuucacuuucuaauagauuauaaauauuuuguuuuacauuugcuuuuaacaggauuuaagauuaauccacuccccaauaaaguaaaaacaauaagugauaaugaaugaaaaauaauaugauugauauaguaauaaucauuaaccagauugacccugaacuuuuggaauuucaaacuaauucuucuuuucuuccuagguugccugucagugcugccugggugguauugggcacccagaaugcuucagucugugaugaucuauuaauaagguggccuuacuagaguuuggaacagggcuucagguaggugguuuuuaucauuauauggcaugauuuucaaagugaucaguuacuccagauccuuaauuauguaugcugugauagugaaagcuuugaaaagcaugccacauaauaagcaugccacuuaggaucuuagggcuuaugcacugguccaugggacuucaguaaaaucugugcucuguaaauggccaagagcggucuugcuucagaaaauaaagcuauuguaaagcuuguugguuuuuuuuccuccucucugagaccacagaugagcucacaaacucuugaucuucugaauaucccagaagggaaaacuacccuauggaaccacuguguucauguguugagaugaucuuaacugugggcagguauggaagcagauuaggucugcucccagaguacagaacccagugugaccagagcaacuuccuaucauuucugggaagaggacacacaaaaguaucuagauuuccaacguaguuauaacucaguggcacagaaucaagguauagugauauuuucagugucauccucauaucuuaaucuuauaugaagcauauucucuguaaaggauuuggaauuuugcuuuguaugauauuuuuccccacaaacugaauuccugugcuuaugggguuacuaggacagaacaucugaagcgcucacaaguuaguuuucaagccugucucgucugaguagcaugugccugaguccccugcuuucaccaugccuagucagagcugcuuaaaaggauguggaagcagcauugcugucaaauggcuauacugggcaugacaguuccuaccccucugccaaagcacauuuaccaaaccauuuaccuguucugggcuuucucugaucuugcuuuauagcccauugggauuuccagagcucacaacauguuuccccugguugcuuugauuccugaaacccuacuacaguugaucccaacaaguauuuaucagcuaaagccagguguaguggcacacaucuuuaauccaagcacucagaaggcagaagcagacagauagaucucugugaguuccaggccagccuggccuacaaauugaguuucaggaaagccagggaugauacauagagaaacccugucucgaucgaucgauagauagauaggcagacagacggacagaauuuaucauauuacugcaacauggcaggacaacaaagauaacuguuagcuuucgggguaaaagaugcagucacugagagaugguuuucaaauuggucaaggaguacaacugucaugucucuuaaugauguugcccaaaacgaauucuguuuauguccgagaugugguaauaaaaagaagucuuguuucuugaugugacuuuauccuugccagccacacaguguggcacagggcggacaggcugguggcaggugcagagccuucccugcggacuggacccugugucccugcauguccuguuccucgagcaucagcaugcagccugggcaguauuuauagcucuucauacccuacagguugcacuuauggguacacacuacucuaagguagcuuaacacugauuuccacaugaacauuuuuaacuaagugagcugauacuuacuccuuuucucacauuucauaugcuuucuaccuuuucccaaauuuauccagggauuuggugugagggccugaguguugagauaugaaacuuggauuguguuucugugaucugaauuguguaaugauuacuccuucuagaaggcauacccuaccuguuuaaggacuucaguguguuacaguaggugaugucagaagcccuuaugguaccccuaucaacucacucaauggcaguaacauugaccucauuacaaguugagaaugugaccugugggcuuccuccuuucuaauguagcuucauggcaaauguggaaaugguuugugcauuuuuagaagcccagaaacuucuguagagaugaggugcucucucaccguuaagguugcaguuauccacucguucugccugccauuauuacuuccgcuuucacaauuccucuuuugcuuucuguuuucaaggacugauuucccugcaugaagagaaagcugccuaguauacuuggugugccuugguuuucauuuuccuaacaacauacaaucauagagugucucuccuacacauaagacauaaaugcugacuccugaguccucauuaauccucuuuaccucacuggccuucucacuccauaauagaacuaaccaagggaagcauuugaauuggaaaaucccacuuguuugcuuuguccguguucuugggugguugguauucuaugcgggcccuccagagcaugcaugaccagaaugugaccauugaagacuaguaagagaauuucugggaacuuugcagugccaacuuugaaaucuguugacauuucccuacuguccuuaagaaacaagaaagaugagcuauuuccuucacuuuucuuuagguuuuuaucuacauuaaauauaagaugcuucuaaacauaauuagagcuaauuuugugguaaaguugaaaaagauuauccuagaacuauauuuuaaccaauuauucaaaaacaaauacaaaaaaaggcaaauguggaaaaauuuuuaaaggcauccccaauuuuccugguuaauuuaacuacaucuaauguaggaaaauaaguauuguggucuugcuccagucucaggacugaguucuugaggacccauaauucaggugaguuaaguguacaucuuggcugugccuccugcuucuucucagugagcuuucugcuccucaguucucuguagauaucacuagcucuacccaagagucucaccaucuuuuucccccgcuucagcccagguagcccagguagcaggcauguuuucacucuaagaauuuuuauuaagaguggggaugaauugaugcuguguacucaugccaguuaauuuuguaagaauaccaucagucagggcaugcuagcaaaauggauauuuugcauaacuuuuaaguuauuauaagugcuaguauuuaucuuggaaauguauugucuucugucugcuaugaugaugaguaaacuuauaggucauuauguuagcaguaagcacuuacucuguuuuaaucuuucucguucauucaacaguuacuuuacugucauuuaugggaaacagcagugaauaaaacuggccugagccugcccugagcugccuacaguugacugcuuauucucugaaggucuuuuuuguuuuuuguuugcuugauuuuugcauuuguuuuuaauuuuuugacagucuaauauguguacugaaugcauuuugaacauaccccauuacccuuucuuaaguuuuuauaaauacaagauaguuaauuuuuuucuucauuagcaaugaacucuauagaaugagagcuaacugauaacaauguccaaguuaggaucaaugacauuuuaaagcaauguuccuaauaugguaguaugucuccuucaaaguuauauuuaguuauguaaucuaauucaucuccuucauauuauucaagauucuauuagugcuucuuacauaaaaagcauuaucacugcuacuuuuccuucugugagccacccuguuggaaaauguuguaagcauacguugauauuuuucugaauugggaacuaaugguauguuaugauuaguauaaggaagagcaaagccuuggugagugauagcauuugcucuuagcaaaaucugacuuuuaaaagugaaaaaaaaauuaaugcugguaaguauugcucaaaauuuacaacuguuagcaguacaacucucaaaacugugggacauccaaugaaaacaacacaaacaaacccuguuuuaguauguacucauccuuuggcugacaucucauagagguugguuucaguagacccccugaggugcaauguauuugcuuauuauuuuucuucaugagccacuauuugccaagaauaaauuaaagcauaagaagaugaacuuuugugcucaagcauauaaccuucccucuucucuagcuucuauuggaugcagagucaccuuuggaguagaggguagaggcggugugucugcuuggguaucaucagaagcugggguauaguauucugaaacauuucacugcagagcaguguagaguggguauguguagucucugccuucuguuacaauucuucagacaaaggcaagguggaauuuccaucacugauguaaccagucuuugauaaauuauuuuaacuagaaacgaaaaacaugaauuaagguuuuuuccucuuugguuauagacuuuuuagagcaguaaagagacuuccuccauugccccuuugggugcaugaaagaggauacucagauaacuuuaguuaacauguuagcuaggauuauaugaauauaaacuauuuaauuuuuauguuuauucugucaaacaauucaaaucaacucuugacaucuuaugucuugggaaaaaugagcaguucuuugaaauuaauuggcaacuaauaaaaaauucaaaguaagguaaaaauuuagagaaauuaacuguaacuugggaguucuguuuuaagauaaaccaaaugugauggcuuuauuuauauuuuauauuuauauuauuuauauuuuauaugugacuauaagauauacaguggagguaauuuguagacagcgauauuuaugcauuguuugaaauacuuacagccgggcgugguggcgcacgccuuuaaucccagcacuugggaggcagagacaggcggauuucugaguucgaggccagccuggucuacaaagugaguuccaggacagccaagacuauacagagaaacccugucucgaaaaaacaaacaaacaaaaaaagaaugaugaaauacuuaguuucuaaagcauuucuguuauaaaaugccacuguacaaauaagcauagaauuuuaugaauacacaaaucuauuauuugcuugucagcuuuaguuuuagauuuaauucugcuuaaaucaucuacucagaguuacuaauuauuuuaaugcuuaguuaaaauauuuaaaauuuaccuugcaaauuguuuuuaaacuuuuuuaaaauucuuucuuuuuggaaguuuuauuuggaaguucucauagaaaacuaacccagaacauucuucuguucuuuaaguguagugccaacaugcauccacacacagguugauguauuaaucugcccuugucauagaucacaauacagucuaaguguagugggaaucuaagacagaaaucucaucgugaccacacaugugccaucacauagcccagaaucuuaggucauugacugcagggaggagauaaauagggaaguauucuauuugugaaguauuuacauuauucagauagugguguauaaaaugaucuuucauauucauaauuaccauaccaaauauucaguguauguccugggcaaguaaguauuuacaaaguaauuuugcuauuuugcaauuuuguuguucuucuacuuaugcauguccugugcuguauaaaaauggggcuuuugcuugaacuuuuaaagauaucuuuuuaucuaaaauuuuauuuuucuuuuaaacaauaagaguaauacugguuucuuauauauacucaguaauuuuguaaugaugcuugaauguccucuauuaaauauuuuuguugcauaucaucuuuacauaucauugaauucugaaaguguguaaagauuuuauuuaaagagauacuguuagauuguuauacaacauuagaagcuuuuuaaccuaauaugucauugacauauccuuuuauuacugauuuuuaaguauuugauuuguauucucucucucucaaguucuucuaauuaauacuugugaauacuuaagauuaaucacagaaugcuaaccaguguuugccuuguauucuuuguaauaaguguagguauuuuuuacuuuauaccauucucauucuugucuuuucuuuccuuuguaaauauuaacacaguuuauauguguguuaucaaucugcuaaaaaccuugcuacuaacaggcaucuuuaagcuaucuuuaagauuucucaacaauggucucaugcaacaaauauugcuuuuuucaugauaccugccuccuguagcaaaccuauacuuaacuucccucacauggaugucgaaucugagcggcagagugguugcugcuacauuccagccauccuuacggcauuccuuggucuaaauuggcagucugcaaguagcagaaggguggcucuaagaagccccagucacaaguguggcaguguggguggcagugcuguggucaggaggaaaccgaguuccauuauauuaagcucaaugaauuuuuaucaguuucccuuaccgucaguaacucuuguuuagauuucuuuuuuauuaucaacugggaagucauucagcaucacaaauugacauuuuuuucuagauaauacuauuuuuuuuuaauuugugcauuuauuuggucauguaaagugugcuuucaacuaaucaaaacaagcaacuggugggaauuaaugcacgacuaucagcaaaguagaaugugagcaugugcuaugaaaugcaguuugcucaugcuuuuuuuccugucauaugcacucuaguuucauuuauauuauaguccauucuuucuuucuuucuuucuuuuuuuuuuuuuaacuucuucauagauuggccaaaaugggaaggacuggauucugcucucucccacgaagaguuaguggacuggcuaagaucaaagucugaggcuucuccaucaccaaucagguagguauugaaugaaaaucacuaauucuaugcaugugccuuucaaguauuugauugauagacauauuaugaauauaauuuuuauuagacauuaaguuugcaacauuauacugauccuaaaauuguaaauguaccuaugauauguaauuugaauuuuguaauggauuaaaauaucagccaugaaaauuuucagcuggucuuagaaaaguguaauauuugguaucagugcaauuccucauugcucaguauguacauccagauacaauucauuucuuacaucauauugaauaucaccaaguuaauauaaucaaaagcuuguguguuguuucauggugcccuuuuaauauuuuggaggggaguaaucacauuaaaguugcuuuugucuucuggaauucucaacaucacaacuguguuguuacaguggugauuaugaccaauuuucagaccuaguuauuaggcaccuugcauucccuuugauuuggcaauuggaaaaugauugauuucugcauagucuaaauaagucuaugaaagcaucaagugaacaagucacaaugaaaauuaaagcucuacuaauuuacugucauuacuugccugaagagcgacuauuuuaucccuaaauaggagggagacaaagcaucugucucuugaauaagcucauaacaggaaaagaugagcuucagaaagccuacagccagagcuaacaguagcaucagugcugugacaucauacuuaacaacugcgucaguacugugacaucauacuuaacaacugcaucagugcuguggcaucauagcuaaaagcugcaucaaugcugcgacaucauagcuagcaacugcaucagugcugugacaucauagauaaaaacugcauuagugcugugauaucauagcuaacaacugcaucaaugcuguggcaucauagcuaacaacugcaucugugcuaugaaaucauagcuaacaacuacaucagugcugugacaucauagcuaacaacugcaccagugcugugacaucauagcuaacaacuuuaucucuucugugacauagcuaacaacugcaucuaugcuaugacaucauagcuaacaacugcaucugugcuaugacaucauagcuaacaacuacaucagugcuguggcaucauagcuaauaacugcaucagugcugugacaccauagcuaauaacugcuucagugcugugacaucauagcuaacaauugucgucugugcugugacaucagagcuagcagcugcaccaguucuauaucagggcuaacagcugcauaagugcuuugacaucagagcuaacacccaaaucggugcugugauacugguugcaucauauuaauuuuauuuguaaacugcaagaggaacauccugauauuuagaacagagcaaaggccugcaucugucuuacagaaaagaaacuguaugucuucaccuuaccugaaugcuguacugcuuuaaucaaaauagugccuuucuguuguuuuguuugcuuaggaacagcugcugugcuaaaguacagagagauguaacguacaauaaaguguuaccaaaauguagguauuuagaauuccugaaaacuuuuccuuaaaauugggcaaguaaguguaacagaccuaauuguauaaagacgugugucagucuaauacuagaacacaggcaagauaaagaaguugguucuauucuuuauaggauggcagauuuuuuuccucuuugggcuucagcuacuuccuuggacucauuaauugauaagucauuuaacucuaauauucagauccuuuuaaaaagagguuaugggugcuaucauuucugugauuuauuggaagaaccccuuuaaauuaccuuaagaaacauauaacuuagugguucucaaccugugggucaagaccuccaccagagucacaugucagauauuuacaccaugauucauaagaguagcaaaaguacaguuauuaaguagcaaggaaaauaauauugugguuggggggcucaccacaauauaaggaacuguauuaaagggucacagcguuaggaagguugaggaucacugauuucauuuauacaccaguagaaucuucaagcugauuuuccuacucugggaaauagaguuauauuuacuauuucuuaucuauggagguuucuguuuaguuuuauuucauuuuaacaaaugaaauacccuucguuacacaaaugcacauuucauucuuucucacagaauugaucauaaauuaaagcucuaacacaucuuuuacuaaccugaaacaucucugugagguuacauucaagaacaggugcugugcacuaagagaaagaaaucuccacagcugugccacacucagguucagguaugucagaggcccaucccuucucuugggaaggccuaauggcucugguuaauuaaccuuagagcaccuaguaagaauagccuucucucugauguaaaggcagcuggggaaaacugagcaaaccuucacaaaugacaaggauccucaucuuucaccucgugcuguacaaagguuuuaccauuucaagaauaucuguuaugaagauaugucauucugcuccugaucagagauccuuggagugucauaaugcugauuuacagagucaggucucacuuagggcagugcacccucucuacccuauagugucugggcuucagcuucuuccauggacucagugcuugcaaaauucuaagugcucaaagugccucuaguucauaugauccgugugcacagagugaugugcacagauugaaguggguguucagcuguaagauguguuuucuaaucccugcugaaaacugaaguuucuggugcuaccuuuagaacaaugcuuugggaguuccuaaauucaguaguuaugccuaaguacagcguuugucagguggaauuucaggguauguaugaacuguucauucugagcaaugcauuuauaucuguuuuggaaaauaccaagaaaccaacagauauuacauuggaccagcugaauccauuuuaugguuuccuuuuuuuaauucaaaagcaucacaaagcaaguaauuuuuuugaaaaauugaguuuaguuacaaacuaguuguuucuuauuuuuuuuuccagucccuuuuugcuuucuuuuacgaccacaugaaacuugagaagccaccuaaagcuauaucacuuaguggaguugggcaguucccagguguccaacaagaaggccugguuuaggcugcgauggccacugucauuccuggugauuugucagaaguaagagauacccagaaagccccuucagggaaacguaagcguggugaaagcaaaccaagaaaaaacuuuccuugccaacugugugacaaggccuuuaacaguguugagaaauuaaagguucacuccuucucucacacgggagagaggcccuacaagugcacacaccaagacugcaccaaggccuuuguuucuaaguacaaauuacaaagguacuacacucuauuugucuuucagauuauacuuucucuuguguuggcccucugaagccauuguaaguguguguauaucugaauacacauuucucagcugauuugcagagaggaaauguuaaguagauuagauauuggcuagcuugcaguauuuuaaaucacauacauuuguauuagugucuuugaauuuuuuuaaguaaaaugcuuaaugaguagaauuuucauuuauagagagaaguuucuacaugagaaggauguggacaguacaugaguauguucagucuugcuugcuuacuuuugucaacacugaaguggcaauuagauggcucaaguuuugcaguguguuaacuauccugugguguguguuaguuagguagauccuuuauuaauagagagagcugugucuuagcauuaauagauuaucugcccauuuuaaaagugaauacauaccuuugugcuaagauaaucacucacucacagaauauaucuauguuuaaaggcacauggcuacucacucuccugagaaaacccacaaguguaauuacugugagaaaauguuucaccggaaagaccaucugaagaaucaccuccauacacaugaccccaacaaagagaccuuuaaaugcgaagaguguggcaagagcuacaauaccaagcuugguuuuaagcgacacuuggccuugcaugcugccaccaguggugaccucaccugcaagguguguuugcagaauuuugagagcacaggugugcuccuagagcaccugaaaucucacgcgggcaagucaucugggggugugaaggagaaaaagcaccaaugugagcacugcgaacgcagguucuacacccggaaggauguccggagacacauggugguacacacaggaagaaaggacuuccucugucaguacugcgcacagagauuuggacgaaaggaucaccucacucgacacaugaagaagagucacaaucaggagcuucugaaggucaaaacggaaccaguagauuuccuggacccauuuaccugcaacaugucugugccuauaaaagaugaacuccugccggucauguccuuaccuuccagugaacucuugucaaagccauucacaaacacuuugcaguuaaaccucuauaacacuccauuucaguccaugcagagcucugggucugcucaccaaaugauaacaacuuuaccuuugggaaugacaugccccauagauauggaugcuguucaccccucucaucaucuugcuuucaaaugcccauucaguucuaccucauacgcaaucucuauuccugaaaaagaacagccauuaaagggggaaauugagaguuaccugauggagcuacaagguggugcaccaucuucaucccaggauucuccagcaucgucaucuaagcuaggguuagagccucagagugggucgccagaugauggugcuggggaccucucccugucaaagagcucuaucucuaucagugacccccucagcacaccagcauuggauuucucucaguuguucaauuucauaccauugaauggucccccuuauaacccacuuucagugggaagccuugggaugagcuauucccaggaggaagcacacucuucugucucucagcugcccacacaaacacaggaucuucaggacccugcaaacacugugggucuaaguucucugcacucacugucggcagcguucaccagcagccugagcucaagcacuaccuugccccguuuccaccaggcguuucaguagagucugggccgagggacucacccgaggugcuuguguagcccugccugcaaugaccauuuauauucuagugccuacuuuuaacauaauacaaaaacuucugcuuuuguauaauaucagguuuuaugaagccaguaaauaauaggaacuagccucuucgauaagcuuugaaaucguucguguuuaacuacguuugcuauuucuccugauuuccugccaguugucauagucucagaguuuaauuucauauaggagcgccauuauuaucacuaaauuuuacaaguccuauguucaaauuacuguuagaucuuaaauuuuucauuuuugucuaauagcaaugggcauuggacuuuuuuuuuuuuugcaaauauucaguacaguguaaaucuuaugaaguguguugugugaauaacugaaguguuucacauuuuuuuacuagccacuaaauggauucauaauuaaguguguuuuaaaugaguuaagaauccaguuuggggagaguauagugguuucuuaaauauaccaucauuucagaucaauauauuuugaggacugcuauugucuggcuaaaauauuuuaaguuucaguaucuaucuaaaagaaaccuagagagguagcaggguguuguguguuaguacuagcccucaggcugguuugccgcauuucaaucaucuuuccauaaacaguguguggcaucgaagucaucaggaucaguguagaaagguuuuguuauaugccugucaccuuucauaccccaggauggcuucaguauaccagcguucucauuuugcaugguggaccacaguuauuccagagucuuagagccauugugggacaauagacaguaaauaugugaaaccuacaauggcugggcugccucaaucgucggggugauagacuccucaacaggaagauggauguaaaacagccaaaccccagaacuuguccagagaauuccacuguugccagagcugaaaacugaacuccuugggugcagaguaaaagccuaucacaucacuucuaaagcagucuugcccggugagcucuugcucagugcguauccaucuugcccugcuguuuuuggauggagaacuuaacaauuagacccaucagaaagcaacuugaggaguucuacaguuuuacacaaccagaaguuguaagacccuacuuuuacucugggaaucaggaggaauguuagaaacaaguugaaucuauaguggaaacagaggaaaauaaagcaaacaccaaacgcauaugagugcaccuaggauguggaaugcacugagugagguagcgauggacuuccucuugucagacagccaccaggaaugcgaucgaugguuccauguauaucuuccuaaggguuauuuguggcaucaacuuaugaaauguaucuauuaagcacuuguuaacaccuuauuuugggaccccuucuguuggggcaggggugaagggagguuuauagaaggcuauguaucucuuuuuuaaaagaaagaagaagaagaaacuauauuuuaauuucugagcacucauuagcccuguauggggaaacucuuucccuucuguaagggccaguuaucacugcauauugcauuguuuacccaucauccuaaauguaauuacagauuacugacgauaaugcauuauuuacaaugccugggaauagucuaaauugaggagaaguguaaacugucauuugaauggggcuuucacucuaugucauacacacaccuagugcacuucguagaaucagaguugcucucuagaggguucaagcuccugguucuaacccuagagcaguaguuuuuauacuuauguauuuaaauuuuauugugaaaaauacauuuuauuaaaaaguuuuccaaaggcauuaaaauuauauauguuaauaaggaaauacauguuuaacucuucaagcugcuccuaagcuaugagugggagugcacucacucugaaagugggcucuuagcucugcuucaugaccgcuuccuuaguuucuaugaaacagaucacuuaccuaauguucuaguuggaugguuaguguucaauauugcuuuaaucaccacuuaaaaaggaggggacauuuggugacagagcacaaguaaauaaaaaaaccuauuuuuauguagaguucacaagcaccacauaugaaagcacuaguuuauucuaucuaaaauuugcuuaagaagucacauuaaugaccugagacguuggccuucauaggcuguauguauuucacugcuaauugaaaaaagggaguaccaggauauaugaaauaaagcauuuugaaaugggaauggcgccauauauguguguguguauauauauauauauauauauauacacauauauauguguauguauauguauauauauguguguauauguguguguguauauauauauauauaacaaauauauuuuuauccuaacucuuacccugcacggaacucuaguacacaucuuccagggaaccaguguuaaaauguagagucuuaauuuucuuguauguacaccucuuugccuguugcugcccccgcagacuugaauaacacuucaaaguaagagggaaagaagcaaauuuguuuuuuguuuuuguuuuauugacuacaguggucacuaaacccuuuuuugauagauuuucuauuaaaaaucaggcagcuuuuuuaauugcacaauauuuuaacaaggacguaac

SEQ ID NO: 1776 - RNA, 5443 nt, Mus musculus
cacucgcacccgccacccucggggccgcgugcuggggggacguccccucccgcuaggcgucggcgcggguuggcguagggccugcgucagcugcagcccgccggcgauuggggcgcgcgcgccuccuucgguuugggguuaauuauaaaguggcuguggccgccgccagcaaggcaggcgcacagagccccgcugcccagcgacgcugcccggcgccucgcagagcuccccgacgcggccgcuuuacacuugccuucuuucuuucucuugcagaguggcaucugguacacgcucuuccaguaaccugcgccaucuggagcaacggcagcgugagugacuuugccccaagucgcccgugccuuggcgaccgucgccuguucccucggugcaugcguucguccaacuuucucgggguuccucauugcuuuggguguccggguccuauucccccaagcgccugcucccgagccgcgaacuucaguguucgcuccagaaucuugcccuaagcaaccgacgccagggaagacagggcgcccucggaaggacaggaugucaucaggaaaacaggacuccccgugggaagauaggauaccuccaggaagauagaauagucccaggcaucacuagaacagcaggaaacacuaggguccaagcucucauugaggcacccggggagguuguuggguugugggcggggcucaggaaagacugucccugcugguccugauccacgaccacccacccggcaagguucucucuaagagaaccuugucagagacagaacgggucccuacaggcgcguucuucucuccuacagcccauggcgcgguuccugaggcuuugcaccuggcugcuggcgcuuggguccugccuccuggcuacagugcaggcggaaugcagccaggacugcgcuaaaugcagcuaccgccugguucgcccaggcgacaucaauuuccuggugaguugaauuugcggugaggggcuccucgcagacuucuaguggucauuugcgccggaaggugcguggcaggagccuuuguggaccaaaguuaccuggagcuuccaaauguugauccccaagcuguugucucccaauuuaggaaccagucucucugggacccuuaagggcugagguaucuaucuccacauaaacaaauuuuguuuugcccccggaguuucggaaccccaagauguguucucuucauuaccucggauagcacuucaucuaggcugucaguaaacccaacuuuaacacccaaacccuucaaacauccuuccugcaaagaauguaauguuuuuguuagugagagugcccccacuaccccaacugccaacccauugcucuuccuggggucccuuagcuuugagucccuccucacuggaguaaaaggacaagggggagagguagagaguugccagaagaggccagaaaaagcucauuaacagccccuugagcaagggacacagaauucccuuugccuugucuugacugcacuuuuauguaacagcuuugauuugacugugagaagggcucaggagagaugguugauacccaaagacgugguaucuguccaaagauagccugucguuuacaggagcuagaagagacaaaauggcuguucucuucaugauaguccucgggcuuuccaaacaccagugggauuccaucgagucugaaucuguacauuugaaaucccaaaggcuucuuuuauacucucucaaugauccauugcccugccuuuaaaauuccuugauagcucaaaggagagucagcuuacuacacuuaagccuuugagaaagcuucacauuuaaaaaaaaaaaaaaauuugaaaugaagaaacaaaggggucccaaaauccaagccaguauuuccaguuaaauguuuguuuucuucguuuaaguguuuugauuauauggucuacuucaguugauggagauuaacuuggccaggaaagcacuagguguuuacauugugagggaaaauuguuccauuguaaguaggagcagagcucacacccgacuuuaugccaccuccuauagucaggagcuugcaaauaagaaucaaccuugggaauaacagacuuuauacgcaggagauucauacuauacugaagacugucuggcuccugaugcacagccacugguauuuuuauuauuuuauuuuugaguagucacuugaggcauuuuagcucuauucacucuuugaugagcacagaacucaacauguagcauaagguucuucaccaucuauguaauuaauggugauugaauccuagaagaguuauaaucugaccucaaauaaugucagauuuacuaaguuauacgaucugggaauucaaauguaagugauauuuuaacaacaccuagucaagaaaauuucucucaacuguucaguuuaccaagugcaaaaauaaugcucaucuuccuguuccaaggagcaugagcagagguucuuguuuagcaaccaacccccagacagcagagacacuugcaguuuccuugcuauguuaaaucuuuguacucuguucuuauccuugauucagaugacgaagggcacauacaguaugaaccaauuaggaaaaagccaucaaaaaacaucuucagaagaauuuugauugaguaauuguagcauacacuuaauauuacuuucucacugacagagauuuaguuaaugcccagauguugaacccaccgaauagucuguagagggacugcaugauaagguucagcucuugacuuccggucugcagagacauguggacuuugaaaccaguaacuugcaauaagcuacuauaagaauaaaauuuuuuaaaugugaaaaaaauaauaauagcaguuauggaauaguagcuagaggucaugggcaaaaugagguuacccagccaaagguauguaguagcuugguugauuuaccaaguucugccaugagguagguaaaggguacugagauaagauugcaugcugucuagaccuuuccaucuggugugcucuagaguguagaaucuggcaugcaauaaaugucucaaaagcuacaugaaugacauucauuuuuggcaacaaggucaugaacacacauuuuuagaguggaaaucuuacugccacucaaauaucuuaagcuuuuaauaauauuuugagucuucuuuaaucauauauguucaagaaaaaaauggaauuauuuuaauugguuccucuuuuaacuuuuuccuauauauuuauuucuauuacucuauauauucuaauauauauauauauuccuacauauuuauuuucuuacacacaaaacuaaaauaaccauucaaaguugguuaaaacuauuauuccaaaauauuuuguugugaaaaugagguguguauuuaauaugaacauaugauuuuuaaguaccaagaaagggccuaguuuucuaucuaaaucaagggacuguagccuggcauauguaagauuauuucaggaaguugugaugcccccuaaaaggcuuaggagcaccauaggauuuuguaauguuaucugauauuuguguuauuuuuauuguaagcaagcaauugaauauguuuuuaaaaaauauagucugagcaagguaauuuaaaaugcauagcuuaacgcuuaccauagcuugaguguaauuacucuauaacggcuugaguuaauuacuguauaauaagaaagugugauuacaugcagcuaaucccuccuuuauuaaagauuauggcuacugaaaacaaccuguuuguauaccgauggcuuaauccuaagaaaauaauaugaauaaucugugcauuugcauccagguaauuggcaggaauugguucaaaaugauggaaucuguuuuuaucagcuaagaaaaaagcaaaagaucaaagugucucaauuuuuaaccaaucguuacauaaggauccaaauaacuuauaguguguuauagugccuugaauggcuuucucuuaaaacuuauguagagauuguaggcuuuuccuuuaaagguuaaaaguauuugaaagacaugggaguagaugagguacuuauuaguaaaucccaugcaugucguuaaugaagaucgccucucuaagauaaggacauggagagaauguuuaggaaauauccccaaucagguacacagagauuucucccuuggggcucacaaacucucagacaaaauugcaucuucuaugggaaacagugcagcgagauuguguucugaaagcagccacuugacucagaauugaggauguaucccuuguaacacugacguggcacaccauauacaacaagaucucuaacaagacucuaguacccucucccuucuuuguuccagugcuccuggaccauugcuaguucaguuugagugaaagcuaugacagagaggagcuggucuuuuucugcggcaguguguguacuaaagcagaaaauaguccaccauugguucagaagggucucuuaaccacucauccccuugacuuugcaggcgugcacacuggaaugugaaggacagcugccuucuuucaaaaucugggagaccugcaaggaucuccugcagguguccaggcccgaguucccuugggauaacaucgacauguacaaagacagcagcaaacaggaugagagccacuugcuagccaagaaguacggaggcuucaugaaacgguacggaggcuucaugaagaagauggacgagcuauaucccauggagccagaagaagaagcgaacggaggagagauccuugccaagagguauggcggcuucaugaagaaggaugcagaugagggagacaccuuggccaacuccuccgaucugcugaaagagcuacugggaacgggagacaaccgugcgaaagacagccaccaacaagagagcaccaacaaugacgaagacaugagcaagagguaugggggcuucaugagaagccucaaaagaagcccccaacuggaagaugaagcaaaagagcugcagaagcgcuacgggggcuucaugagaagggugggacgccccgagugguggauggacuaccagaagagguaugggggcuuccugaagcgcuuugcugagucucugcccuccgaugaagaaggcgaaaauuacucgaaagaaguuccugagauagagaaaagauacgggggcuuuaugcgguucugaagcccuuuuccagcagugaccccgacccccacuagccugcuccaucccccaugagcaacugccuugucaaugauguuucuugucacaugcugcuuugugcuguacaguugcccccguggucuagauaacuacacugccugaaagcugugauuuuagggucuguguucuuuugagucuugaagcucaguauuggucucuuauggcuauguuguuaucaauaguuuguuaccucaucucuccugacgaaacaucaauaaaugcuuauuuguauauaaauauaauaaacccgugaccccaacugcacaaugauauuguaag

SEQ ID NO: 1777 - RNA, 4840 nt, Mus musculus
uggggucuugauacaacuucagaacgguuuccgugucguuauucguacaagacccucgucucucucuaccccccauuugguucuuaggaggagguccccucgagauccucgaauaacuggaccugcuggacgggucaaguggcgcccgacguggagcacgagguacgacugcccuccggacaacggauuaaggauuaaagagguaccgcgcagacagagaaacagugggacaguccaccgacacuucacucgagugucgaguacagacgucgggagguaagccuaggcauucaguuguugucccauuaaccauggggcauuuagugaagagauaaaggguucucuuaaggagagagggauaagaguuuuaaaaaaaagggggaauuuaauaauauauuuuuguuuuguggacaagaaauguccauggcugguauuaaaugguucuaaaacuuagaauaaaguaggcaaagaaauuaauaguuuaauaaaacaaggagaagauguccaugaguccuuuuuuaguuauuggggaaucaucagagaucuccuugagcaggcagaaaagggcggaaaaggugcucgccuccuagcccuuacugaagauuuuuuagaaagcucccaaucgccaucucacaaaagcaaaacuaagcugccggcgcacaguaucucuauuagaagguuuagcagaaggcuacuugauacccaauaaauggaauaaaguuauucagucuguccucacuagaggcuaauauuuaacuugaaagucagaguuuguggaagacagccuccugaacugcugacaaaaucugugguuaaggcaauuucgcugcagacauaaaacaauuagggcucuccccuguuguccucgcccagacggcacaagcggcccugagagcuuggcgcgcugucccugcuacaggggcgcuaacuaugccccuaaccaagauuauacaagggccccaagaguccuaugcgcaguucauugccagauugcaggaagcagcugaaaaaauuuugggaccugagaaaagugagggucuguuaguucgacaacuugcucuugaaaacgccaauucagcauguagggcugcccugagagguaaaaccaaaaguuuagauauaaaugguaugaucaagcuuuguaaugagguagauguguuuucucaacaaguuucuaagucuauuaaccuggccauuggggcugcucuaacuccagcuccaagauuggugccgagccccauuggcccaaguuagaaguagacaucuguguccucacauugggugcagaugccgccuggggcaccccugauuauuauaugccucaauuaacagcaguuaacacaggugaauuugggcccccuccccaaaagacguuuuuucucaucaccggccgaguguccagacuuuugcaaggccuaauggugacuccuacagugguugacaccgacuaccauggggaaauaaaaaucuuagucaccgccacgcaggaaccacuuacccuuagggcuagagagcacauagcccaagccuuaccacucccacuauucggccauuucccuuauaugaaagaggagcgaggaccuuccucccugggauccucagaagucuacugggcacagaaaauaacugauucauggcccaugccgacuuuguuucuagaggacaaacaguuucaagggcuccuagauaccagggcagaugcgacaguaauuuccucaacacauuggccugcagccuggcccuuaacagcccacuaaggaaugguguaauccacugaucauaaaauuuacugcuaagaggagaaacuuagaggcuugagaaaguucuugcccucucaccuggggccuaagauuguaucaagauaacuaugacaauggccugaccuuuaaaaccaucccuaacaaucauaaaggauccauaggacuuccagguacccgccccccuguuccugccccagggugugcuacgacccuguuucagcccacucucccugcggggaggcuccccucuuccacugauuuacuguggucuauauugaaugcuucugcuuuagccuuguugcauaagacacaaagagauaacgcgucagaaucugaagauuguuggaugugcuuuucugcuucccugcccuuuuaugagggcauagccuuauuugaaaauuuuacccugcuuucagacgcuagacagcuucaccuugagucaguucagcuuaccuugacagaacucucugggguaagaaguuguguguugggcccaggcaugcuuccgcugaggcccuugcuagagauuugcaauaacacguuuagaguaaauaaaaauggguuuuaaagagacuuuguaaaggucaaaaaauucauagauuagguuuuauugaaaguuaagaaaucauuuccuaaaacauauauaauucauuuugucaaugguguuuuuguuggucgcagaaaauagagagcguuuuuacagauggcuauaaaauauuuaacuaaguguggacugauaauggcuucaaaaaagauuuaacaugguaaacuuuuaggcuauuugagacauuuaguguauagagauuguguguuuucucaaaaauuugcccucagauuaaauaaauuaaaaguuuuagaugcuugccagaaacuguuagaaaauuuuggauuuuaaucuugguuugacaagcugccucuuacaagcaagaaaggaaaggaaaaaauagagaaauagauuuuaaaacucucccagggacagagagaaaucgggggacacccuguuuuauucucucuggccccuacaggagaagcucucuacccucuuucuauugucugugguuggugcaccaaucacgugucaauucauguauguuuucuguuucguugucugaaugauuguuucauugucugaaugacuggcuguuuuauguuucauguuaaaaaaaaaugguuaaaacuuuaccugcugaaucacucucaguuugcacaacugaggcgagaggcccuucccuuuagccaaaaucaagcacagcaggagagguccugcugaaaaacuuagaaucgacaaccucuuaguucuaaggcaaauaagcugauaguuguuuuuuccuaaaaaauucucugcaauuuugugauuauuguguuuagcaaaugacaaaguguguuuuuaucuuauaaguauagcuauaaaaaguaaaagucuuuaauugaucuaaauuuauaagauucgugaagccacuucauuugguuuuugauuggucuuaaagguauaaauaugaccuacauaucuuggucauagagaauuggcuuauaaguuauuuggguaugauuaaaaagguauaacacggguuacaaaguuagcuuaaguaauaacucaaggcuagagucauuuucaaacaaaagcaccuggcauaaaacagcccagaaaacuagucccguaaagauacuucuaaauugagauaauauuuuauguaauucuuauccuaaaaaauagacuuauagagauaagauuuuaaaacaaugucucuuuaauagaacauuaaaauuuacacugucaugcauucauaaauugguagccaaacuuuguaacgugauagugauguuucuaguauugauuuaaaaagaaaaaauauuguuuaaaauugggucuuacuuuucaaaaguuauagauauauucuaauauuacaacggaaacuuaaaaauuaggguuaaaauugccaguguuccauugacugcagcuugcaguuugauuacaaauuuaagaucuuuaauucaccuguauauuguaauugagauaauuauaagaguaaucauccuuaagaaagaguaucaaaaauuagaggcauagacagguaaauuguuccucaaaaaccgguucuuauuacaggagggccaagaugcucagauuaaaaaauauccuacaacccagagaagcuuauagccuucuuuuauuuugcaaacagugccuaaagaaguuuuucccuguguucaagaaaaguucuuuuuagcuuuguuacagaucuauucaaauguuuaaaauaaugcuuaaauucaaagaguuuuacuuuuaguaaacuggugaucacuaguaauuuugccuguagguauggcuaacauagcuuuacaauauguauaaaauuuuuauugucugcuucaauacaagaaacaaaguuuaaaucuuucaguguauauuguuuccuaaguaaaaaaaaaguauucuauuagcuaaugccuccaaagaaaaguuuaaaguucugaaaaguaauuguugcuccauaagauuuagaggcaacauauuuuuaauauuuaagauuuuaguuacagaaaaucuaaaaaagaaaaauuuauuugcuucaaaauuuuuauuuucaaaaccuccuaaagauguuuugucaacaauuuaauguuacacauguuacugaaauauuuuauaauucucaaagacgagguauuguaaaacuuuaaaaacuauaccuucuuuaaaaacaaagaaggggggagagaaauuauauccccgugcacauuauuuggaucacauuuuuguuuuuuaaaaaacuggauauaauagugucuagggcagauaaaaaggauccacuuauugacacaugccaugauccuguucagauacuuaauauggggaaaaggggaaauguuucuguuuuuuccacagaaugcuacaagagcaugcuagcuuccaaugugacaggcugaccugugaccugugagugcccugacaguggugaccaaaaagcugugcugagugcacaaaagaggagaaaucggagagcauccacuuacaaacagauaaagaaacuucguaucuccaccaugggcugcaacaaggaguaccaaccuggugc

SEQ ID NO: 1778 - RNA, 2387 nt, Mus musculus
uaaguuuauuauaaaauaggcuuuguuuuggauuaucuuguuccaccgcggaugaguguaaauuaaaggagggccaggcuuagcuacugugauuucugaaugaggaaugucucaugagcuuucaacccuuggucuccacuuggugacauuguuuggggagguuuaggagguguagucuugcugaaggauguacaucauggaggugguccuugggaguucaaagccuccagaaacuucaacuucugucucuguuuuggcacgcuuuuccucuggaaccauaaucccgaauaaaucaagucuuucuuuacaaagugccucgguaguggaccuuuuaucacagccacauaaaugauagccagaagaguucuggugaucaguagcucacauacaugaaugugacuuuggcugaggcguuuucaucuuaccuuggggaucugggauagccugugauggcggugcacaccugcaaucccaccauuugggaagcaggggcuuccaaggaucaccuugcaguggaggccagucugguggacugagugcguuccaggacagccagggcuacaaagagaaagccugccuugaaaauaaaauacgacaaacaaaaacagaaaacaaaacccaugggguucugggauagcacccaccguaagucagugcuuagaucugagaaauaucagauaguaauuagcuuuuccuauuguuguuguuuguguuagacccaacaacuaacugaucuggggucagguaacucucuguauucuggcccaagaaucaggauaccugagugucagcacugagcacugauaucagucaugaagcggugcaauguagcuugaucaggcuugguaguugcugcccccauccccauugcuucucuguauauuuccuugucagaguuucagaaggcuaauaagccauuuauuagccacuaauaaaaaaugcuagcccuggguaguaacacacuccuuuaauuccagcauucuggggacagaguggaucucuuuugaguuuuaggccaaccaggucuacccuacccugaguucaaggcuauccuggcguauacaguaaaacccuguccaaagugccaacuauucguauuguaaacuuggucaaaagccuauggccgagagagcauauauccagagaggaagcuacugcuguuguuugcuaaccagauacaauguaccugucaaaacuccuucuaaauaauuguuuuuagccccaaagauuaguagugcuguugacucuggucagagucacuaguguugcuucuuuucacaaggcuggcaguugcaguaacugcagagacucauaacuugccaagguguugaggauaagugacuacugagugcucgucuauaauaaugggacguguaucaccucuucuaaaacuuggggaacauggcagaaagggguggggaaagucugcacgaggauaggguggaguguuguggaaaacucuuccaggaaugacauggccauagcacucuuggcuucuaacagcuaugguuaucagaagcuaugguuagcagaagacugggucuauagacacccugccauggaggggcaagggguucaugccccaguccaggaucuuaugaaguuacuaguuccuggggaaaagagaaaauucuucuucagaaguguagccucgagcuggagagauggcucagugguuaagagcagugacugcuuuuccagaggucuuggucaaaucccagcauccacaugguggcucacaaccaucuguacugaaaucugaugcccucuucuggagugucugaagacagcuacaguguacuuacaauaaauaaauaaauaaauaaauaaauaaaucuuuacaaaaggggagaaagaaagaaagaaagaaagaaagaaagaaagaaagaaagaaagaaagaaggaaagaaagaaagaaagaaagaugucagaaugccuaggcuaaaggaguucccugguccucaaaaucuacugccuagaaaaguguuuucuuggggucaguagcagaaguugaugccacacuagccuuugugguccaggcuacaucuucaucugacgacagaaccgggugaugccauaaauauuguccaugugauuuugaaggcaugaaagaugcaagaaagaguacaguuaaggacagacauuauguggcuuggcucaaacuccuauggagaggccuacagucggagaaagaagaauauuggagaucuuaggacucagacaucguacaaggaaagcagcaauuuggaguggaguuggcuuaggccuaagagagaaauuguguguacuuuagcuagcagagauagaguuggaacugccuuuuguccaagccuuuuggaacucagcuaacuauauccugugccccagaugcuggacaugguauucug

SEQ ID NO: 1779 - RNA, 221278 nt, Mus musculus
ccugccggcuuccacguuugccacguuccagaggauccaggcagacuagaaagccacaagccgcuggggcuuugcagucacugcgcagcaaaagacaagcuuuggccugaggagggcaggcgcgcguagccugccccgcccccugccagcgguccucgggauuggcucguguuggcgucuuucagaucuggugggugggcagaggcuggcgugggcggggccgaggccggggggagcugagcgcucuuggcagccuaaggagucgcaggcugggcgcacgcgaggcuaaccgcgcggcugcacgcuggugcaagucguccgaggcgcagcgagcgcaguggacgcuaaggcgcugcuacaggagucucgaagccccggugucccuagugcacucagcaaggccccgguucucugcaguccccggagcagcucgcgauggccccgcgcaagaacgccaagggcggcggcggcaacagcagcagcagcggcagcggcagcggcucgggcagcgguagcccgagcacggguagcagcgguagcagcaguagccccggggcucggagaggucagaguccccgcaggccaggcccuggcugcgggcgggagccgggugggcgcugcaggucuggucugauccuacguccgccgcuccucuccauccuuagcgaggcuccugugugcgcggggcgaggccgcgcucaccgggcggggaggcggaggagcagagucggccggagggggaccccuagcaccagccugcccgagcauuggccggcccuuucuugccuuuccugauggaagcuggguguagagggcccuuuaucuuuuugcaguuuucggggcgcuugacccugagccaaagucagagaaaguaaguuucagccuggccagcagcguugaggagcggcuuggaggaguguauucaagggccgggaugagacuugaugcuucguucuugcaaauuauuuuaaggaguuuuguuuaguuuucuuaauauguauugcguuugccuuuuaaaauacaaagggacaucauaaaguacuauagggauuuucucugugccuccuuuuucuuuucucaauaaaauaaaauaaaaucauaacccccccccccccaaaaaaaaaacccaaccaaacaaaaaacccaaaacccacaaacaaaaaacccuacugguuauucaccuuucuucuccaugugcuuagccagcagaguggagaacagauguuuuaaaucuguuucgugucagauuucaccgguucucgguuucucuuauauuuccuuugacucauauuuagaauauuggaacuggaacacacauguguauugaaugugagcucucaauaucacuggaaaugauuuagauucuaugcuuuggucuaugggcagcucauuauuauaugucauauauagauuggaugauuaugguuuuauuaguauaugucaggacgauagaugagccaacuaugguuuuucuucauagcacuugcugucuucauguauauucugucuucauguauugucuuuguuucacucucuucuauuccccauuaucaacuagaauaguucguuuccuuaauagcugugcaauaaauauuugauuagaaaaugaaugaauaaauguaaauggggaaaguuaggcaguuaaauccauuguacacauuaacauucugagagcuguuuguauucuuaauggaaaggacucuauguacacaguuugagguccaaggccacuguaguaauuaauucaccucaauaccgguaaaaaugacauucaggcucucuggcuccuaagucagcuaaucugacaucggcagcgccauugcuuugugguuggagcauagauuugaaguaugugaaugagaagagccuacugaauguugaggagaaagcuaaugagcaagauuuuaauguguucuguagcgauugccuggugaaaugcgucugcugcuguccugggagcuuugugugugcuggggaagugcuuuagccgcugagcuacauccuagacuuucaucucuauccuuuacacccugauugcauccagggaagucucuuaugaggccugccaguacagagagugugcaccguccccugauaaguaccaguguuacagucagcugguagggcugggaaaccccaggauguauaguaccuuauucuuaggauguauauauagucccuuauucuaucauuaggauguauagucccuuagucuaucauuugcccacacuuuagagugacauaacuauaaugaagcacaauuucauucauaaugaaugaaacaccuguguucuaaccccuccccccaaacucgagccuaaauuacacagagcgcaugauucuuccuaggccauuauuuuaaauaacuauuucaguaacuacugaguucugauugggugaaagagaaggcaccccagguggaaacuaaaacucuucuucccuuugugcuaaacaguuaccauuauaaugggaaagcgugguucuguuuauugcuuucuuacagcaggguacaccugaaagauaaacaggguacugaaaacaaaguuaacuuuauguggucacugagguagggacauggacaugcaaaccaacucuaacugcuggggaguccguagcugcaguuacauugcuguggcauuuagugucuucuaguuaaauaaggugagaaaauuaaugcuuaaaggucuugcucagccugugaaaacccagguaggacagaagagcaucaacuaaaagccagguuuucuguugcucaucauuacacugcacuguuugaauuguugguucuuaaauagaauacgucagaucuuauagggguugggaguugaaguaguuuaucaaguuuucuucuggcaugucccagguagaguuacagucauugcagaaauuugugcuuuuguuuaacuaauaagccuuugauuaaaauaugguuaaaguagcacguuuaaaaaucauaguuugaaaagugcacacacuaaguuuuuaacauugagaaucugauaucaguggugacauuggucucauaacucaucucauuaguacuaagguuauuauauaaaaguauuaugggggaugggagaccuauaaagcacaucuauagagaaaauauuuuaaagcaugugucugcuuuccacuuucuucagcucaguugagaaaugauaaaguagaauuucauuuuaaauuuuucaauuugcuccuuagaauacagaagaaaggaguuggacauuuuacguuuaacaugcaucuaaaaggugauuuaccuagccgggguuuugaacgcagguauuucauucauagagugugcuucacuauuacuuggccagugaaaagucuuucucacauuuacugauugggaaaguguuugaggaagagggacaugguugucuuuggguuuaugauacaguacagaggggucugugcaauguaucaccauuguggccagugucuugacauacuuaccacuggcugccucuuuuggcuguggcuugcuuuuauucugucacuuaccagcaggugucgcuguagaacauguuuccccucccaauuugaagcuucaaguuauauaauggcaauuagaucuuaaaacuauuuuaaucagucuguacuuacccaggaacucuuaucaacugguguucaauucucucaagauaucuaauagaucaagaaauuuaagaauaagccuuuguguggaacaaucuuaagacuuauggagaaugaaauauguccguauacuuuugguaauauaaauucacacaaucauuugaugcauuuuggucauugggaaacacacuuccaaauuuauucuuccccagccuccauaaacuuucugugucucuuagguugcuaauggauacagugugcugcugaguguguccuggcuuucuugaaagaagggggcccagucgcaguuuuuuucuacuuaaccaaggggauaagucagggccagugacuuaauacucuaccagccaauuaaggauggaaaacuagaaagcccauaauuugcucacuacaagaauuguauguguuuguuguguugguagcacuguuuuucuagcuuggccagaucauaggaaaacaaguucuauaaaauacucggagggaauucuuugcaaccauaccaugggcugggagauuauucgaaaauaaauagauaaaguuuacauuuucuucuaguuaauaguaguaccgugguuaugugggcuaacuuagauauuuuguucaugugcacugaucccaaaagggaacaacaaauaccauuuuucucaugaaaggcagugcaguuuggaacaaggaaucugauagcccaggccucuauuuguuuuagaaacauguggcaagucucucugacaucgcuaaucuuaauccauuuacucucuguuuugcuuccugguucccgauagccuaagacaauaugauaugccuugaugcauaucaaauuguacacguguccaugcugauggugagagugaaaaaccugagagaauacaaaguacccaucuugcuugacaagcugcacuacuguuacucuguaacauguuuguuucaaauauaggauuccuuuugcaguagacucuauuguaacuuucugaagcacuagauacaguuuuguaaguguuucauuuguacagccgccuuccuguugcuauuugccagcugaucucuuagcgauuuguaacauucuguaucuuaguaaagcucagauacaaugugcucuuuugaugcucuuccagcuacugauuuaauguccugagaaggacuuggccuggaucuucaauaugcugcuucugcauccccagcaaguacagaguccaaaaggcuguuagagaaaucccauuuaguaaaaacuguaugcauagcuagauaaggccaagauagucuagugugauuuagcauaauagggcaucuagaguugauaguaauauauaguguguuucaagauaagauuauuuucaaaaauugcauuauaaaaaucauauuugaagauagaauauuuuaccugauuuacauauuguacauggugaaacauuguaaguuacuccauuaauauguauaauuuuucucugucaguuaaaaacuuacuuaaagccauuuauaauuucccaggauaauuugaggaaagcuucaacugucugucccuaaaccuguggugccuggcuggcuccaucugcugccccaguggcuagcuguucaacacuguacucauggguagauuuuugccauucggaaacagaaacagaaggcuagagaugagauggucacucucugagucccacugcagccguguauucugggaucuaguucaugagcucugcugguacuucggggagccugguggugguuuaucagacauuauaaguaauuuuaccuuuauuuucuguuccuccuguguuaggguguuggaucaugugugugcauuuggcauuugcauuucaggaaugugauaugguuccuuucggcugcuguuccugucuuuucacaguaagccauugaauggaacuaauucuaaucaaauucaugauggcugaagacaagcaaguucgaacucauucgacugagagauuuuuaagcucccauggcccacgagcucuuaaagggaagaguuacaggaaagcugcugaagguugcagggcguccuuugcccuugagauucccuuggcucaucuuacaagugccaccaccugauguagguaguuucuaugcuucaaagcagagauuaguaugaaaggggaaggggauguagguguugaccacuuacagaggagaaccguaacaauagacagagcucuuguugaauuuggagaaauguugacucuuuuccuauguguauguucacagaucuaacccagugacucauucauuauggaaggcagccaggguugccuuguuuuuaaaguggaagaauauuguuugauaaaauaaauuuaauccauaaccagccuuguuaucauugcuuuuaccccuguuugccauaggcuugacaacuguugcugcccugccaggcagucauuguuaauauguuacagcuauuguaucucucaggccauguaugcccauauacagaguguuaacuuccaguaucuguuugaauucuaguuauucuaaaacggcauauugcaagccucuuaaacuuuagguucacaugcaaaucuuaucugggaguaguucauuucuuuuacuugaacaaaaguuaguguuaaaguuuagucuuugagucgaaaugaguuuuuuucuuucuuucuuucuuucuuuuuuuuuuuuucuuuucuuuuuuuuuuuuuuucgagacaggguuucucuguauagccccaacuguccuggaacucacucuguagaccagacuggccucgaacucagaaauuuuccugccucugccucccaaaugcugggauuaaaggcaugugccaccaccacccggcuucaaagugaauuuuaauaagauguuucuggcuuaauuuuuaaaauugugucaagcacuuguguuuuugaaucuaccacuuuucaccucaucaauaaaacacauguguacuuuuagaucuggaucuauuggaaugcuacuuuaauaguacccacucuacauguagaggaauaaagcauucccaccuuguggauuuucuucugugggaucacuuccuagccauucuuauacacuuuugcuaaucagucucauacaugcuaauaugaucuauauauguaaccuauaaaauguuauguugcacaauacaugcuaaauacccauguaccauauuuauauauguauauaugauuaaaauauauuuacuauuaaagauauguuuuuagaucaauguaaaauuuaaauauauuuuauguguacgagugcuugcuugcauguaugucugggcaccauauucaucccuggugccuguagaggccaguagagggcaucaaaucacuugggacuaggauuacaaacaguuguaagccaccauguggaugcugagaauugauccuggcuuuuagaagaacaaccagugcucuuaaccauugagccaccuaccugucuguccagcccaagaguuauuuucccuuuaauuaucuguauguguuguguuuguguguaugugcacaugagugcaugugcccuuagaggccagaagagggcaucagcuccgugggagcuggacuuacaggagcuggugagcagccuggaauugguguugggaaccaaacucaagucccauggaagagcaggaagagcucuuccaugggacuugagcaccaaaugugaaauauuuuauugcuagcauuauggauaaaaacugcuugagaaaccugccuuuagaggcuuuacaugugcuuguuuaacaugcaguaaacauguuugugacuuaguucuugcucagguuacucuugcucuucauuuccguguccucagccccucacuguguaugugugucucuuucugccgagcaggcuggcugagauugcugguccuuugcauucugccuuccaaacugaaaccuguuugcuccuuucuacaugugucugaauauuuuccugugcuaugaaauuagauuggaauuguuucagucauagcaugaauuaaccuuuuuggguauugaguguuuuauuaaacccaaaguguucguaugaauuaauauccuaccugcaaugaauuacaguaguuaccuuucuaguugcuacucuugguaaaguugaauguuuguaagcuuccugcccuccuacauggauaacauuugcauuuuccuggguacuaguaagaugaauguuuuuguuucuucugugacuuucuuguucauacauagccccugguguuuuuacuuuuaguguguguguguauugacuguagagugugugucacagcccaagccuuucguuugcuugaguggcaggucgagaaccucucuaucccauuguugguuguuuagacugccauuuccugugcuauguuuuacucaacagaauuugaugcuuuuucuauagcaaugauagaauuuuacucuuuucuacuuuaugguuugggcguuuguguuuuaugacauuguuuguggcagagaggguaacauuccuuuuaaguaagaucauaaaauaucugaaauuuuguucuuuuguguuuggaucucaagagcaguauguacugacuuaucgaguaugcacuguucaagggcgggguggggaggggccauuuuaaauauguuuuuuucacaaaggagauaaggacguauucuguaguuaguauuuauacagacuuuguagagucggucuuaccuuuuuauaagccuggagccauguuccaggagggaagggccaugucacugaguacucucuagcuguggaggauggcuccgugucugaaaggaccggucacacugccuuucacugcuguucuuaccauguuccaccuuuuucuacacuagagaacauccuucucaagguuuuauaaauauuauuuguuuuuggaacuuugggcagaauauauugaauuuauagaacaauuugggacaaauuauaucuuuauaauacugagucuugauucugagauuaauauaaauauuguuuuuaauuuuuuuaguuuuauccaaaaguuacaaauaucuuuuguuagagaugguuuuauguguguguguguguguguguguguguguguguguguuucuuuuuuucgagacaggguuuuucuuuguaguccugacuguccuguccuggaacuugcuuugaacaccuaacucagaggucuaccuuccucugccuccugaguguugggauuaaagguauguaucaccacugccuggcugguuugaaauuauuauuauuauuaauuacuauuauuuuuauuaucacaguuucacugcucauauugcccugaaacuugcuggacauguagcccaugcucccugcccgugaucauuggccuuugucuccagaauuuucaagauuauaggcagguaccuccauuucuggagaugcuuuauaauuuucaaaguauuuuaaaauucuuauuuagauuuauuguaucuguaugaauauuuugcauacauguaugugugugcauuguauguaugguguauggcacccagaggugagaagaggguagaguuacaguaauuacaguagguacuguagguuacagcugauacugcuaccuagacucugcagugguauuuaauauaugagcuucaugucauguacuugucaaagacaucaguacacuaaccucagacaucugugcuuccaugccauuaucaagaacuuagucuguauuuauagucuuauuucccuuugugguaaaacuaaaauuuucauacaaugaauuauacaauuuuuaguguacaauuuaaggaauuuugauaaauacauuaccuaccuauguaauuugccaaccuguucaacuacucugaaaaguucucuuuaaucucccuacuaucaggugaagcuacagauuuguauuaaucccgucuauuuuggaaucugucuuguaaauacuuugugugaaauggcuucuuugacuuagcgggauauuuuugggauucacgugcauuuuugcacacaauacuaccccacugcugcuccuuuucuucuuguugcuccuuuccugcuaguuuuuguugugugagcagagcacaauuuguugaucucucuuccugauagaugccugagcaauuucuaguuguguagaauguuuugaagaacaaucuauaaacauaagaucuguaagaaguauguauuuauguuuuugaggaaaaccaagaguaguugcuguauuaaaguguauuuccuucccaucaccaccaugaugagggacucuaaucauauuauuuacauauugucuuagucaauguuccuuuguggugaagacauacauuguccacagcaacucuuauaacggaaagcauuuaauuggggcugacuuaguuucagagguuuaguccacagugaucauggugggggacuugauggaauacaggcacacauagugcuggagaaggagcugagagcucuacaucugcaucuucaggcaacagggcaagggcgagggcgaggguuugacuugggauucucaagcuucaaagcccacccccuaugacagaguucuucuaacaaagccacgccucccaacccuuuaaguggugccacucccugaggacuacacauccaacuauaugagcauacgggggucauucuuaugcgaacccacacacaugugugggucuaaggcggccucucaggagguuugcgucgccuuucccuguucacugugaguguuacacuuuucuugugaguuaaaauccuuucuagcuuuuaaacaguuuuggaaaacacuucaugugugguugcuuuaguuagcguucuauugcuaugauaauauauccugagcagaggcagguuagggagggaaggauuuauucagauuacugugaggagaugacaguccaucaaugaaggacaucagggcaggaacucaagcaaggacagggaccuggaggcaggagcucggaggaaugcugcuuacugucuugccucuaaagcccagcucagccugcuuucuccuagaacccaggaguggccacuugugcaucacccacaguaaacugggcccucccacaucaaucaucacucaagaaaauggacgauaggauggggugaaugaauuugguggacgacuuucucaaucgagguuccuucuuccuaaaugacuguaacuugugccuaguugacauaaagcuagccagcacagugacuuuaauuguacgucuuguaaaugaaauguaacuauucuauaccuagcacucaacaauaaaauaguuagucaguaaguauuaagguuuaagauuuguuaagcuuauuauuuucaaacccuaggaaugcuuuuugagguuauugugugaacuguauuuuccucuguaggacuccgacuacuugcaggugccugugagaagcuaggcuauuuacuaccagacaugcacuuuggaugacuccauguggucaccuguccuuccuauucaugagacgugacuugaacuaggaaaauuauuuuguccaaguugaacuuauuucuucaugagugaaacaaaauuuauuuucuugaacuuuuaagauuucuuuuggcguuuggcugccuagucuguuuguaacuaguacccagagaggccuagaauaccugguguggauccaagacaugauugaaguuucuucucugauuucuuuucagcucuucucaaucuaaaaccaugcguagugccuggaucauccccaaaccugaacaaacaaaucccaaaaccaaaaccgaaaccaaacccugaaacuuggggaccucagccauaguuuuauucuuauuuagaauacugcagaggcuagggguuguuguacuguagauaacguguuuuuguugucuuuguaucugcuguuauagcagcugccugacuaacuaggucaguguguguguguguguguguguguguguguguguguguguguguuccuaaguucucagagaugaccucuuucaugggauuucuuagguuugugcuaagaagacagaaauccuauugauaagugauagagcugagaagaauucucagaacauuuguacuucuuggcuauagaguauuguucagauagaucaagcccaucugguguuagauacaguagguagaugcuacaguuccuccucauccucuugggucacaccagucaguuccuuuguucucucucggucucucugucucccucccccuccuacucccccucugugugugugugugugugugugcgcgcgcgugcucauguacacgugccguauuuagagacgcuucacuuauuugcaagguuucaauuuuccuuuuuauuuuuaaacaugacucaaaagaaugggcuaaaauuacuccguguaaauacugaaguauggagucaucuacugaacuuuucuucuccuuuuuggguuucauaguuugaaauucccuuguaagaauuaugaguguuuccucuuuaaaacuaagauuugccaauuuucauuaaacaguaccagauuauaaaguagaccaguuauuuauagaguguuuugcaacaguuagcaccugaguuagcacauuugaaauucaacagucuaauuuuuccaaaugacucuauccuguuacccuguccagcuuuuaugugggugguaugaauuuuacugcccuuucuagcuucucuucacuggguuguaaguuaaguugccuuucugauucacugauguggaauagggcagagauuuagcauauuugcugaauaaaugaaugaauuuaucugaugaaaaaaaaaucuagggaaaccauuuaaaauuugccauccuaagaguuaugguuacguccuacaauccaugcuaacuuacagagcuaaucuguauugccaaucugaauuugcuggugacccaaaacuuuucguguaaaacaguauuuuaagccagaguugucguguugucauauuuaagcuccaugacugugcuuggcuuucugccugagcauuagcaugugugaauuuuguagaaagccuaaagaauugcagcagaucaaacauuuuagggucccaugcuccuacagcgaagguuagagccaagcaaguuagugagguaagaauugugggacaucucugagcaugguagugguguuggucauaacucugugugaccuggauacacugugacgggaacacacagagacauaugugugagauaaacagucacaacugugugcaugguuucucuuucagagaacucugcgaaugucauuguauugggacaaaauuuauuuguauucuccuuuagguuuuuggaaauaaggugaacugugcagugagguuuaaggaaucaggcccagaaagggcuaaagccuuagcaggucauauuagauacucugcauaucagauucuuccauuaugacucauaacaaugacaacauuauagcuauaaagcagcagcaaaauuauuuuaugguuggggucuccacaaaaugaggaacuguuuuagagcacuaggacgguugagaaccaagggcuuuuuuuuaaagucucagaacugacugcaaccaacaauuccugagcauuucaucauugagaaucuagaagucagagaggcaggaagcuaaagggacacaauuuccacuuuugcuaaagguaaagagagguggauucggaacaacuguaaacugauuaauuucagaguaguccuccaugaguucugucuguaaacaguauucugaagugcccagaaaggcaucuguaaacaucuggagacacuuuguuuaucaaguccaggcugcugaagaugauuuuguuucauguuugguaggcauugcacauuguucugauucagucuuguuauugccaagcuuugcugagguucacagcauuuugggaaugcccugaggucaaaggugaucuccacuagucacauguacagugugaagaacaggugauuuguggaaccccgguaggaacuucaagaagacuguccagguaaugcuaauacaauccagacuuucccacuuuauccuaacaguauccuccagccugcccgcuguuuguccugugugauacuuucucagccuccggagaccugggaggauaggugccaccaugccuggcucauccuugaauuguugauagcucuuuuauaaagauuugauuuuuaaagguguuuuuauuacuaaaauagcccccucucucagaacacagguaggguuguucuuggagaaagugagaggacccaaguguugcuuggcuacuggagggcacagacaucagacuugguugcauugcuggaauggugaccuggguuuucauaacuuagcuagugaagaacugaaaacccucagaaccaucacucgugcuuuacuuucacucaugaugagagccacaaaucaauguuaauauucugaucccgguuucaagaccacgucaccagugcguagugucugcccauaacgaggauucugcuagucuagugucugcguuucugagagccugugauuugcaagauguggccugaaauagcugucacaucucacggugaagcaaggaacucuguaacucuucaccccugguguguugaugauguugaugaugaugguaucgggugauacugaagcauucugcaucaucaauacugcacacugcuggucugaagaggucauugaggaaggagcugagcaaacagaccaggggaacagguugugaacgaugauggacacaugucugggaaaucucuugaaagucuguucaaaucagaagcagauguguaaaagguuugagcaauugcuucaccaacugagggaaguaauagcuaccaguauuugaaaugugugcucugcaugauuaauucucaggagagcaaacgugaaacccacuguaagguccacgaugcacucguuagaaucgcuaaacguaaaaagacaaaauccuaacugacagagugguaagugguacuuaaugaguacauuaaauggugggauuacuuugugaaugaucugcccauuucucauaauacccaauguguuugucacuuggaacccagcaguuccauuuaucuaaagcaauaauauguagucauacauaauuaucccuccuuaucuggauugguucuaagaaccucauucucacacaggaacuguauguaaaucaguguuguaugugcaucuaaacugcauaucuccccauauucuucaaaucaucuccagauuaauucuaguacuguccuaguuaggcucacuauuuuugucaggaaacaccaugaccaaagcaacuuaggaaaaagugcuuaauuggcuugcacuuuauugcuguucaggacaggaacucaauuagggcaggaacuuggaggcaggagcugaugcagaggccguggagggaugcugcuuacugucuuguuccucauggcuugcucagccugcuuuccuguaaaacccaggaagcuaucuagccuaaauaucuaauucaaugcuagggcuaugcagugguuuauacuacaugguucaggggauauuaacaaggaauaaaugucuguacacauuaaguacaaauguaagacucgugggccuagauauguuuuccauuugcuguugauugaauccauggauguagagccuucaaguauggaaagcugcuguaaucucaaacaguaaucucguuggagaguuuuuaguaauuuugguucacaguagugcauuguggggaaugccuaguucucuacuaguagcagaauggauagacucuauuuguucacucuuauauacuuauguaugcagacagugaaacuacuccuugguuagcuagauagagcaaacacaugaaagacacguuauauggugccauuuucauaggacucuuaagaacguagaccuaaaaugccguaagaaaauuaaacaggaaagcauccaacagagcagcagagccauuggcaagggggauaggaugagacaagcucgagaaccaccauuaguguaaugggaaggguucuuguucuagucuugauagggauuuagcaguagcagaguacacauucguuaaaacucaggagcuagcgacuuaggacuaaugcucuucauuucauguggacuuuacacuaagaacuaugugcgauacaaacugaugugauggguacugaugucaacaauuuacuugaaguguuuuguacaaaugagcuugauuaaaaggugaaaauagaugaaugaguucaguaaccucuucgcaauagaaucugugauauucauuauaaaauuauuucagauugaauugcguauuuuggaguuuaauuaaacauugagaacacacucacauuuaagcaguacccugguuguuuuuacuggcuaguuuucguuguguagacauuuaucuugggcaucucuguuugccagggcacuaguggaaguccuucaucuccccuagucauugugcuuaguugggcaggguuaaucccucauuuccucuagggagcacaggcugucuuccagcgugugacagauuccucaacaucccagucaccuucuguauuuaagucugacugguuuagcacugaucuccuccucagugccaaguucugucuguugcaggcagcagaaggaccugcagggggcaagggcugcugagugccucccugauguaucuuuuggcccuguccagaagugccuauucaaggauuuugcaucucaggaggucccaggcagggguugggggagacugaaaagccucuguccucacaggcuccuagcagugucuccucugccaguugguaagaugggcugugaggcugcucacaagagacaggugccaagugccaccucaguucuuuggaaggccagguggggaccuucaccagcaaacagaaugacaaggaguuguguggggagucagcccuuuuaggagugagcuacaagguggugcauacuugcuacuuccuuguugccccucucauccauggaaagcucaggcugcauugugugacccuuucccuguagccuuugcuucacauuucucccuguucugucacucaggggcagaguggucucuuucccccacugcuugaaugugugucccauuguggaaugagagucucuuccaggaagcuuuaucguuugccuguaauucucccagucccuugcucucauuuagcauuaaauggcgauuugggggguggggggaguucauguauguuauuaaguucuuugcuguguuuaucguaaugugguaagaauuuuugaaaacccaguuuaccauucuauagaagugugcuuuccaguacacuuuuuuuuuuuuuuuuuuuuuucuuuuuggcaaagcuguaaaauuuccuugaaccagaaguauguaagaaaauuugcacuucuuguggcuuaagagaagggcaccaggagugaggcaagcucugaagccugagggaaaaucucugcaagaucggucucacuucagacacuagccauggcuuggggccuccugagggcccugaguucagacuagcugaccacaagucugagggccucuacagccaccauguguucuguaauucacuagaaugaauggcaaagcucagcaaagugcuggauuuaucaacacuguguuauuacagugaaaaggugagacguagagucaguuaaucgagggcgcacacaaagcaacacauuccaugugauguauuauccugugggggcucauccagccuuugguguccaggguuuguagagguugcuuacaugcuucauuuaguugaguacuuccaagaugagaacugauaauuguacggccuaaagcuucccuuguaacucacgcugggaggcucucuagaguccuuagagcagugcuucucgaccuuccuaaugcugcgacccuuucauacaguuccucauguuguggugaccccugucuacuuaguuuuugcaggagacacuguggccauggcaacucuuauaaaggaaaacauuucaugugugacuggcuuacagcucagagguuuaguccauuauugucauggugggaagcauggcaguuuguaggcagacauggugcugacaaaggagcugagaguucugcaucuugaucugcagcaaaaggggaccguauguuacacaggcauaccuugagcguaggagaccucaaagcccacccccacagugacacacuuccuccaacaagagcauaacuucuaauggugucacccccuaugggucaagcauccaaacacauaagucuauggggccauaccuauucaaaccuccacaccccaaacuguaaaauuauuuuguugcuacuuuguaacuguaauuaugcuacuauuaugaauuguaauguaaauauuugauaugugacuccucaaagggguugugacccacaaguugaaaaccacuaccuuagaugugcuuccugucaaguagggcaucucuauauagaggcaguucuugguguauaauucuuacaguuguuuuaagugcauuuucauguggaugcaagucagugugucaguucuugugcuuuacaaccauagccaggcuuuuuuuuuuuuuuuuuuuuuacauggcugucagggauaaacucagguccccaugucuguguguccucauuucccugauaaaacugucucccuagccccgcucuauaauuucugguuauagccauucuugcuucacaguuaccuucuguacucguugguuuugugucagcuugacacaagcuggaguuaucaaagagaaaggaucccccgcuugaggaaaugcuuccgugagauccagcccuaaggcauuuucucaauuagugaucaagcggggagggcccagcccauuguggguggugccaucccugggcugguaauccuggguucuauaagaaagcaggcuaagcaagcccggagaagcaauccaguaagaggcacccuuccauggccucugcaucagcuccugucuccauguuccugcccugugugaguuccuguccugacuucauuuggugauguggaagugaaagcugaauaaaccccgacuugcuucuuugucaugaugcuuugugcaggaauacaaacccugacuaagacaccuucauugcuacuaauuuauaugguaaugugucuuggucacaauugcaucuaccauuuuuauuauauuuuuauuuuaauuuucaaauauuuugauucuaagacaugacaugcuuuauuauuucacaugauuuuuaagcuuuauguauuccuauguauucuuauuuuacauuuauguuaaauguaaauauugcacauuuauuuauuuauuuaauuuuccccuggaaagucauauaagggggggugggcuguggacauuuuugcuuucugaaugaauuaaaaucaagaaacuuucaagcauacaauugaagaucagcauuggcagucccuguuguccucacaaccacugugucugcauuaagaguuaaaugaguagccauguuuucaguuuguuuguuuguuuguuuguuuguuucuuucuuucuuucuuuccuuccuuuucuuucuuucuuucuuucuuucuuucuuucuuucuuucuuucuuucuuucuuucuuucuuucuuucuuucuuucuuucuuuaauuuuaugugcauuggugcuuuucuugcauguaugccugugucagaucuuggaguuacaaacaguugugagcugcuugguaggugcugggaauugaaacuggguccucuggaagagcaguccgugcucuuaacugcugagccaucucuccagccccuccuuccuucuuuuaucuguuaccaauuuuagugaaaauaaauaaaugggagaacuuaauucuaacaauuuuucuucuucuuuuuuuuucuuuuuguuuuuuuacugaacaucauaaucucauuucuccaaacuggaagauugacaguggauggaggggggcggggggcauggauuuccuacuauggaggugcaguggaaguauucaccaaugaagagaucuauucuucuguaccuggcuuagugaaacuuacauucuggaggcagaagauuaaauauccauugucuuaagcugucuaauccccagugacaugcugauugcugucagagcauuuauaagcugggaaggcuucuuugaggaggagguguauuagagugaacaggaaauagugaggcaggggucagagcagugacuguaugugguggugggagcauugagcauuggaacauuucugcuugcugggcagagagcauaaauagggguacagacaagaagagugugugugugggugugucugugugucuguguguagauuuuaaauagcucaggggaagugaaagaaagcugagguuugagcaaccagcuggagccaacccaacucuauuccccuuuccaucuugaagguuuucuguuuuaucuugagaguaauaugaagacauuaaggauuauuauuauuuuuaaaaucuuacucacaauguaaucugaucgaagcacuacugugaccguggaaagcagagaaguuauguugagguagaauaguggaagagaggaaacagauuucccuacccuuuccuuucauaacaaacacaaaucguaagaaaagucacugaaacaguuguucaggggccugugaaaugggucagugggugaagugcuugcgaacgaccagaaaccauacaagggugaaaggaaaaauaaaacagauucucugagguuauuuuuuggccucuauaggcaugcuggggcgcucugauuuuaauugucaaggauacccagguguggagggagcccacacccuugcauaauuagcccuugcccaguagccaguggggaaauagucugaagugaaagaaaagggguggggguaaaugccacguuuuuuggcuuacgcaacuggcuuugugacugcccuugcagggaggagugagggacgucagaaacgugugugcaggucaagcauccauacaggacaugcaggagacagguagcuggguuuguagccaaaggagagaugcauuugacugcugagaguggcucaagagagcaggaaauggcagaggaccaagcuuaggaauuugucagucuccaaagucacauagaggagauugacccaagaaggcagacugaaaaugagaaaggccagggagcugauggaaguaacagaggagucugugguacggaagggagggggaaaggaacacuucauugcaucuccgucuaggaaacccacggccccuccaugacuacuuuugaaaacaccgaauggcuuccuucucccacgcuggauagaugauaguauaggguuaaugaaaccuuucuccuuucaagcuugaaagagggaacagccaugcccuugaagauuucaugaccuuacuucauucagaaggcaaaggagggaagaaacugaaugggagagaauccugaugagaggucaaagaagauggugcagacggcuuuccgugugacuuuaugauacuagacucaugagcgugaccuuggagauccugcucugggguguggggccaguguagaguucuaaguugugagugggaagguagcagugacguaagaacucugaagaguuguaccugugcagacucagcgcuuaggaacacugacugugcuucuagaggacccaggcucaaauugcuaguacucgcuacagaccguucacagcucucuguaacucgugucucaggggauccagugcccucucauucucugcuggcagcaggcaagcacaugacgcaccgcauagucauucacagaggcaaaacacuuacaugcaaauaaguaaauaaauaaauaaacaaauaaguaaagugcuuuugaaggauugcgccugugaggagaggagcgaaaguggugagccacagggagagcaggcagaaagcugggaggagugcagcaggcgugggugguguaggcucucaagacaguuccuugcucucacuuuuagguucucucugacucuaguaagguuaggggaaucuugaaccugguagaaugcauuucagggcagagaaguuugaagcaguguuuguggacacugggaagcuguaauggacauagcaccgcuguugagaggucggcuaugcucauugucagggaggagggccgaggaggccuucaugucagcccggugcugugaggugaccgaguagcaaauguggccagcguggcaggagaggacuuggaugacgagcuguguucuccagcuuggguguggagagauggggagacaggugaugggggugucuucaucaauucauguuaugaauaccuuagcuaacuaaaccuauaaagagguaacguuuguccuaaugguucuaggaagucugucacgagguugggcauuuacaucacccugagccucuggggagagcagccgaucauggaggcacaugguagagcaagcagcuggcuuccuuuaugagucaggaaaacugagagggaggugggugcccuuuuuugagaguuaccccacuaaccuaaggagcacuuccuggaggccccaccuccucucagcauuacccuggagucagggaucacuuaggagauauggcccacauuaaaaacagcaagcuuguggggguggggggagcggggagggagggggagggagaagggagggagaagggagaagggagggagaagggagagcugcaggaucuguagagaaaucaguaacuagacaagcugcaagaauagcuguguguucucauucaguucccuggggcagaggucauggcugggggaggagucagugggaauauguuuucuuggugucugcagcuuugccuugguuacuuuggugguguccuuggcugcuuauauuaaguuuagaaggauacugcuugcucauguguguugagguacugucaguguauggacggaagcuccuuuuugggguauguguguugguuuaaauaguggugugcccugcugucaucaaaauggagcugaaugagcagaacacuuucaacacuuucaguaggguuuuagauucugugaauggcugcccagagggcugcagaagaauuucggcaagaaugaggaugugccuaagacagugaauuaggccgaggucacagcacacuguuagguauauaaggagcaaggcuuccggggaugaagaacagagggagagaaucugucaucuugaccgggggcuggccguugaguccauuugguuacaguaagauugaggugcugggcaggccacagagcauguagcaggagcaggggcgugugauggcaugccaggaacacuggaggagugggguucuugcugcuaggcuuuuggggauggaggugcaagauacugauaauguugcaguugucaaaacagcugcuuuuuccucuugagacugagacuaugagggcuuauauaggaccgcuuauuuguucauauguaugcauuaucauacuaucguauauauucauggguucucuggaauguucuagaacuuggauauaguguguacucaucaaacccagccuucaaaccccugcuucccggcugcuguuggucacucuuccacauugaggcucuuagcagccgugcuggugugucccccugaccagcauccaaucaccagggaccccgcuguacagaccgucaggacugcaggcuucaggacugcaggccugggaggaagagauuaagaagccccaggcuaaguuagggaugcuguugcagauaaugaguggcuggggaccaaggaaaggaaaaggccagcacugguucgagagggugcauagauuuucaccuggcagguguuuggagacaggcgcagccgguggcucaguggauguaggucuuggcucuugaggucucgggucacaucaggcugauauuaauaguuugugaguucacauuacagguuuguucccugccuguacccagggcugguucuuagcuccagcagcugguacuuugauaguggcugucaguguuugccaugguguugauuuggcauauacaaaucuaguuuauuuuuuaaaaacuuuagaagaauucuuccuuauaaaaaaguuaucauuacagguguuuucuugaaauuuauaacuuacuuucccugcaaugaauacaugaaugauuuaaagugguaucucagccauuuucucucuuuaccccacugcacagguggucugccaccuuugcaaaauuaggcaaggaagacauuuuguaacaaugcguauuuaauuauuggagaauauagaagaaggaacagguuaacucucuuagaucuccuuuugcugcauugaaacacuaugacugaccaaaaagcaagcuggggagccaaggcuuauuuggcuugcacuuccagaucguaacgcaucauuggaggaagucaggacaggaacucacgcaggacagggaccuggaggcaggagcucacacagaagccauggaggagggcugcuuccgagcuucuuccgagcuugcuuagccuguuuuccuauagaacccaggaccaucagcccagggguggcuccaccaacaaugggccagguccuccuccaucagucacuaaucagccuugccuacagcuugaucuuauggagugauucucuuaacugaggcucccuccucucagaugacucuaguuuguaucaaguugacaugaugcucuccagcacauuaacuguaacguacauagggccauggcuaagacauacacaaggaauaaccagcccucuacugaagaagcccgaggcuugcauuggcccuaauuuaauggccacgauucuuaugucaaugaaauggcuacugucuuggaauuuuuuaaugaggcuggcccagcacaggcugggcaagagcucaggagcauguuggcacuggucguguuggggauagcugggaguauuaagauagguaaacugagagaguagaagcagaucuuucgcaguaguucugagugauuccagaaaaugcgggguguggauaguuucggcaaauaugugcaugccugguguguacguaagcaggaaauugauaccugggauguaugcugacugccugggaugauggagacacugauaaacauaucuccauuucaaauccauaccagggcacggccccagaaguguggccacucugugagucagcugugguaugugguuccauggugugcuccuugccauccuagcacccucaagaagagcuuccaaaauauuuauuauaauaauucacuauuauugagcauuguaugauacugucauauuauauucacaauauuuuauuaguuaccagaaggucaucuuuaacuccuuccuuggaaaccaagacacagauuuuucaguugccucugguacuuucuucacucugucuuguaucuggaccgucauauuuuaaguuacugacuucucuucagaguguuuaaauauuucauuugcuuaugaauacuuaaguuggacugaagaaaucgaaagaugaagaacaagcagcuuugaaagguugcugcuugcucuagauuccccuugcucuaaauuaauuucauguauuaauuagagcuagaaugaauucuguaaacugcuaaucuuagaacagugaaaaaaaugauauuaaaauugggccaauuucauuucccagaagggaacccuuggguguuggauugcguaaucucuguccaggaccaguuuuggggaccuuuuccucccuucuuaaccuuccugucauucccuccucuuuguuucuuuccuucaguggccgcaguccucucuuguuuucuagugaaauguuuucauacccuggcuuuaauuuugccauuccugggaugauaguguuguggaucaggauucuagggcauucacauuucuucucauuuaucauuugucuuccuuuaagcacacuggcuaacuaguccugcagacuuuugauugaaauucuggaggguugaaucuugcugccucuggucuuggggccacaugugggcuccuuuaauuacacagugauuugguguuaaagcugaggcucuggaagccuguuuggaagaaacacaaacuggugggacaguuuguuuccuuguguguucuguccagcugcgucuucauuuggagccuggaguuggaagagguagggacaagccaagcagggcauccauacugagugggaagggcgcagauugucaggagugcagucugucugccugagcgauuagcagcauguggccacagggaaguggucucuaaaaauagcuggugagcaguuugcagucagguccaguuucagcacuggagcccuuguccuggcaguacugguagccacaguucuugcagggaaggaccacugggugcccauaccucccgggggcaccuuaguuuuuucccuucuguguauuuugugcauggauugaagaaaucaaaauggcugaagauaaagguauauuucuguuguuuggcaugaauggggccuggaccuagcugccagcuuguugcuucauuucagcugugcucccuucagaggcuuuuggcugagugcuuuuagccuuccacauuuucuguccuaaauuucuggagagaucgaguauucacaguggcuggguuuucauggaaugaucugucuuuagucugaauaggcauugcuguccuaauaaacugucuuuuauuauauucuacuauuguaaaccucauuguauaaacuuccauagucugauaugacuguuccaaugaaccuagagaauucuguguucagaguucauauaaaaggacagggaacuuaagggcugugcaaguccagucuuguaucagugagugugcuugguucgagcaggcuugccuaauauggaaauugaccuacuucaugugcagcagaggguaaaugaaaaacaaaauaggagacacuagaauuuuguuucuuaaauggauacuuucauucccuuaauguguugaauuuauuuuuuuuguuuauaucuuuuauuuuuuuuuauaagcaaagauugucuuuuuauuaaaaaaaaaaaguuaaaaucaugugcauugguuagguauacugaaacuccguguaaggaauugccguuugaauguguuagaugcucuguuuagauucgcugugaaauggcaggcaccaagcccacuaacaguuguccgugaauggugugcaguuugcuuaauggcaaaugagugacuugacccuucuguuuacccuuuccucagccagugugcaguggcccuuugucccuagcccaggcuucacuuuggagucuuuucuccugauuguuggaacucucacucuccauaguaauguucuguccaguacuaugggcaaacauuuucuaauguggacaucauuuugaugagccagcuuggaugaaaaugaaucccauuucauuuucauuucagaaaaugaauugcgauauucuuaacucuacaaaacccuggugaccauggugucccuaggacuguaguuuggauggagagccagagaacaagaugagggcucacuccagauuuauuuuaaucugagaaaauagcaucaacugcugguguucuuccagaauauuuuugugacaacauccugguuuugaguuuguucguggaguuugaaacucaaguauuugcuuuaccacaguucucuugagucagaaaccagaucuucugcccuuggggacuaggcacagcacauucacaaagggaccgcccccgcacaugcuuagcuuagcguuccucaugagcauguuuaaagggaagacuuugaagugcugauagaaagauuuuccuaugauguaaugcucuuagccuuuauggaacuaacaaguauuaauaguaauaagguuaaugaugcuggaguaacacacugauugacuuuguaaagggauaaaguauuuuuaacaauuugcuauuuuaguuaaugaggaacaguaggaaaagguggugucuggcagaauauccaagaacagauaagacaagaacccaguuuauuguaguuuuaucauugauuuuaacugaauguauuucauuuuaaagaaagauuuaguuuuguuuuuuaguuaugggugugcauacaugaguucagcuucacacagaggcuggcgaccuugcaguccuuugaagcugaguuacaggcuggugugagccacugcuguggguccugggaagugaacaugagagcggugcacacucggucacugggccaucucuccaucauggacuucucuggauguuauauaagauuaagaagggccuuuucuuauggcuuaggaagaugucuuccuguuuauaaaaguguaguaaacuaaacccugaacacugcuauugauggugcccuccugcuccgaggacuuagucauuucuucccucauuuugaaacauuccagagauagcuuauuuuguauuauuuuaaugauuuauuaaauuuuauaaugugauuauuuaugacuuuuaaaaauauuagaaaccauguucuccaacaauaaaagaucuucuuuagccauaauuuuauaaauguaguuacaggaauauacuuaaguauacacauguguuugaguguguacacacacuaagacugaguuagucuuuugaucucuugagguugugaucuacuaauggauuuaaaacgugaauauucuugggauuggaauacuggcucaguuggugagaacauagguugcucuugcagaagaccugggcacacccacguaguagcuuacaaccugccauagcuccaguuccggaugaccucuucugaccuuuauaggcaccaagcacucauauggugcacaaaacacucauaacgcauaaaauaaaucuaagaaaagaauauccuuuuaacaaacaguuucaguucucuuucugaguaaugcauuggaauuauuuaauugccugaagcugcuaguucuuuuaguagcauguguggagguagaagguggguucugaguaaaagcugauggagaugcgagucaugcaggucagcccucuuuagacgcugaggacuuaggaccgcagaggucauuuccugagcuuugcagugccgaugagggugaggauuccuguccuugagaauucagggguuucuaggcaggaaaugccccaugcaagggaugcuuagggauacuggugaauaaucccgggaccccucugccuuugggcuggggaaacucagcauguuggauguuguggcacgugagaaacaguugcacagaaugaacaauguccugcuuaagccucuagaaauaccuuuagcagaaaugugggcaaguugccaugagggccacauguauguagcagugcucgggccagugcugugggaagagcccacagugccacucauaccuggcauuguccuucuguaagauggagcaagguuuccuuuucccagaugcccuuuggggauaugauauaaccuucuaaguauauuuguuuauaauuguggaauauaacauucuuuuaaaagugaauaugaugcuaauuuauaaaaaaguauugacuuuuuuuuauuaguaaugaccagugacuucuguuuauuugaccauuagaagaauauuucuggaggauuauaaggcacauaaaacauagcaaacgugauaaacgacacuuggugaacagcaguuuacagagcuguuuccugcauugaguccaguuggcaaggccugcuuccugccuucccacgcccuacugggucuccuggaggagggagauggaacugggcuggauugcuucuuuuugucugugauuucuguuuuuguaccuccucucucucaccuuucccaauauugcauaauuuuagagggaauugucuccuucuguggcgguuaugacucaggacuguguacaauguaaauaggauauggaaaaagguccauaggcaccucuugauuucauuuaauuuauacucacugaacuucaaggguucuaggguggguuucugauugcguguaggcaagagauaucgcuccauaagaaaauagcaacucaccagcaccaggaaaagccagcuuccaguaaaggagccagcagagccguaaggcaccaggaagaucagcacagccauucagggauuagagagccauguaggacggagagccacagaaggggaaggcaaaacagauugccuguccccauguccaugccaccugcuaaagacuuggaugcuguagcaaaaugaaaacugaacagcuuuggcuaguugaaaacuuacauuuuuugauaauacaagauaacagugagaaauaucaaaacgggaccaguauuuuccuugguacaggaaggcaagaaccugaaguuucaggaaggcagaugacauaccagugucugcuaauuagcacgagaggcaggacauguggccgugcagacucuuuugacaaaggacuugggaggaauucuauuuaaaagcaaaaccaaaguguaacccaaucaggaguuugcuuguguucaaaauuaagauuauuuaagcauggugauugaguaagcagaagcuucucguguucagagucauuaauuuauggagugcacuuugagaauuuaguuaaaacguguuucugaaaugauuuaucaaauuacugucaaaaugguguucagccaaguaucuucuuccgcugugaugacacaugccauuuuucucucuccacacagaggcaaagcacggaggacacaagaaugggagaagaggagggauuucaggaggguccuuuuucacaugguucauggucauugcauugcucggcgucuggacaucuguggcugucgugugguuugacuuggucgauuaugaagaaguucuagguaagaacuaggguaugauuucucuagugagcuuguaagagugaaaauccaaggauuguuauuucuucucuuguauuaugacagguuguagcuucccaccaacucuugaaaaagcaaagggcugccccagaguagugaccugaaucuugaagauuucuguguaggcucucuauuuauugugguauauggaugcuuccaucaaaacaaauuuuguuaaauucauuuucgcuauuuucugcacucuuuauuuucuguucagguuuauuaugaauuuuaaaaaauucuagaucaugaacugauuccuuuaguggguauagaucugaaguagcaucuuauuguauagcccagguuggccuggaaccuacaaugauccuccugccuuggcuuccaaguguuaggguuacagaugugagcugccgugguugguugauggcaaaaccuuucucuagagagaguuuucaaggaacaccuaccugcccaugucugaugagauaagagugugugugcacggcugggugaguucuggguggaccacgugguuagguagggggcaucuccauccucauuugaggaaguuccuggggguacuuccuguucucuucauauaaucaccuaugugaguguaugcaugugugugggucagaauagggcgaugggucccuuggagcuggaguuuuaaaccaucaugagccgccugauauggguucugggaacugaaguuaguucuggaagagcgggaagcacucuccaugcugagucauuucuccagccacacuaauguuuuuuaaaaugauuugguuuucuuucaauuauuuuaaaaauggagagaagucacauaauuuaaauacuguaaacauuugaaaaucuaaaacucacugauuuuuaauauauucccauuuugcgcaaucgucaucuaauuuagagcgugucuauugugcacuguuucccuccagugagauuuugacuuucugugauuguuuuguguguucugagcacagcauguacgugcgugucacauuuugaguugccugcuuacauuuagcaccauuauacauguaaggucuagaguaauacuuuauccuaugacaauacucuguuuauccugaaauccgugaugacagucauuuguuuucacuguuggcaauuaugcagaauggccauccccuuuacuaauccaguuaaugacagagagaugucaguaagaaaacuacgcaguugcuaauguuguguugaagaccugcccucuuacaguagaccucucuugcagucauagagaaaaacaaaggauaacacaagaugcuuaucuaaaucugucacucauugauguuucucccucuuacugccucaagggaaguggcuccaaauagguagauuaaaaaaugguuuacuuuaucauaaagaaaaaaguaugcuuucauuaacauacagucuugcuagguaauuuguauacuuuuaaugauaaauaacaauuuucauguuuuuauauacaugcagccaaagcaaaggacuuccguuauaacuuaucagagguacuucaagguaggcacuggagaugcagcuuaagugguuuugcaucugucucuaagaccuagucaucuacagcaagaauguaauggcagacgcagucuccccuuguaagauucuuacaagguccccuuguaaugucacuugcugucuuuaaaauggcacuauacuauugauagccuugaauuacaggcuauuacuuugguuuucuuagcgguaaggauaccaucuucaucccugcuuucuuaccaguuuucuccuggguuuacuaaguuagacuuuuguauaguaaaacuagaucugggaauucuguucugcaccaaaauuccugcugcaauuguacuuugaauuaaagaucuggaaauaguauuuuuugccaucuauuuuucguaagaaugguauacuuuugcucuuuaaaauagugcugugcaguaugauuuuuccccauagcucuuguucagucaugaauuauaaacaauguugauuuuagaauaauugcuaggguauggacuuauaagacuuauuuguuaaaguuugguuugguucuucugccuagccccaugcuccuagaaauaagacucaacucaaaauauacuuacaaauaccuuggccauuuagcuaggcucuucucugacuagcucauaauuuaaaauaacccauuuauucuaaucugugucuugccacauggcugguuaccuguguuuagguaccaugcauuuuucacaucuucccaggaaaaucuucugugccuggcauuuucccagaauccuuucugccucccagaugucccaccucuuuuuuucaugccuaagcuauaggccauccauuuuauuauugacaggugccacauccauacagacacagauauuuucucucacucauuugaaaugcuaagccccguguacagcaauuguugagugagggccgagugaaccuggagccuggcuucucacuguuccuuuuuaagccuuccuuuuuuuucuccuuaaguaauggauaucuggugccaaggacauuuuuaagugggugaguuuucccucaccauuucaggaagccuccaguuucaccaacuuuacuucuggaacugaccaccccaccucaaguugaugcaugcuuuuuaaaaaauaauguauuguuagaugucaaacuauucauccuucccuuaucaaguaauuaugcucuaguugguuuauuuauauuugaucuuuauuugaagcuuggguugcauagauuguugauaguuuagugaaguuuuauaccuuagaaaccucaaauuauaugcaauuguuagaccguuagagaugggcugauauuuuucuuauauaugucccaauacuuauguaaaauauuuuggagagaauaguaaaauuacugugaagugauaggaucagaguauuccugaaucguuagggcaagccuuucacuccucucuuaggaaguacgcagcuagacaguucuaagucuguaggugucugcccgugagcuuugauaguguagucuuauaguuuugauugugagccgagccuuuaagggcugagccaucucuccagccuuugauaguauauucuuacaguuuggcuuugcagcaguaaguggagaggaaucaguaauauauauggugucuaaaaacugcagcaagagacgauguauuauuaaauuuguuuucuuucuauuccugugucuaucaugucucuccuguuguaggaaaacuaggagucuaugaugcggauggcgauggagacuuugauguggaugaugccaaaguuuuauuaggcaaguacucuucuuucucucuuuuuguuagaaggggucagauacugaagucagaagaauacuuuugcuauaauaauuaucuguagcaacuguaaacauuucuauuuauugacuuguucauuuauuuacuuauuuacaucccaacugcugcccucccucccgguucccccuucacagggucccuccucccuccccccaccacuucacuucugagaggguaggaccccucuggguaccccccccacccuggcacaucaagucucuauaggauuaggcacauccucucgcacugaggcagaacaaggcaaccuguggccuccauccagcccaugcaugcucuuggguugguggcucagucucugggagcucccaggaguccagcuuaguugucccuguuggucuuccugugugguugccaucuccuuaagggccuucaauuuuucuccuaacucuuccguagggguccccagccuccauccaauauuuagcucuaaguaucugcaucugugucagucagcugcugguagagccucucaaaaaacaguugugcuagguuccucuuuguaagcauaacagaguaucauuaacauggucagagauugguaucugcaguuguuggcuggccauuccuucagucucugcuccaucuuugucccugcaucucuuucugaaagggcaaaguuuggaucgaaaguuuugugaguguguugguguucacugggggucaugccugucuacaagagguggccucuuuagguuuaguguccccacuggugcuaggcaucucagcuaaggucaccugcauugaguccugggaaccacccccacccccuaccucccuccccacccaugccuggcagcugcgauuuccauucauucuccuggccuuucaggugugggaaauguaaacauuuuauggaagauauuuugcaacuuaauauuucauuuuuauugauauacuaaaugagcacucuuccauugugacuuuuuaaauugcucuuauaagagcauguagcucuuaauacaucaaauuuuaauaauuauagcuucauuuguguuuccagauuuaagcauuucauauucugaacuuaauguucagagauauagguaauguccucauguguuuucaaaugaggaacagauuuuuuuaaaguacuauuuuucauaauccugacuauaagauguaaauuucucccauuaaaaugcugauuagggccagcucugcuuagcauacauaaugagaccaaaugaaggccaaauguucaguaugauaugaccauggaugaagcuguacauuucucaaguuuuacauaaguuaguuuugaaauaaaaccauggcagaaaguaucuuuaauguccuauuuguauuuaaguuuacaugaaaacauacacuagugguuauugaucacauuuuccuguuuugacagucauggauuccucucuguguuuguaacuacguuaacagcuagguuuuucuugaacuaaauaaagauugguauuuccucauuguuuuaaaauacugucuuaauaggaaggcuaguggugacuugaaugugcagauuuuguguacucuggccaguuuuggcugguuugaagcagcuuacuuccuguuccuuaguaugaagcaauauauauuaaagcuucagauggaauuacuuagcaaggcaauagcuguggccugguauuauauaugcccuaaguuuaguagcaugcuaaauaaaccaucuugugaauuuaugauugugaagcaauagaaagguauuguagcagguuagcagcuuugcauaguuagauuuuacguccuuuuaaaacaaacucuaagaaugaagcaguuuuauuuauguccagcuguaacagagcuccugacuuagcccuaccuugguguaugcuuuucccguaugcgcagugggagguagcguuuccuauuuacaguuggaaguccacugugcagcuuucaugaucuaucuugacuuaaugguaauugcuuucuggcuauaauuucaucauuaucaaucuaaaucagaguuuuaguaccuacauuaaaucuucaggugacguuaguuuaggcaagugaaagaaaugaagucaugaacaacaaucguuagguugguagcuacgaugguagcaugccccacuugacagcagccuuuguuuucugucuuguugagaugagaccucggcccuuagggcgcaguuuuagguaaaggcaggaagcaaggugacggagaggagaggugacggagaggagagguaacggagaggagaggagaggagaggagaggagaggagaggagaggagaggagaggugacggagaggagaggugacagagaggagaggacagagauuacugagaagcacaguaauuaauguagcguuaaauggccacagaccuggcacgcaggccacacuuuuuuccccuggcguuugaagccuagcucuaauacuaauuuguggaaagucuauaugcugcuuuucuuuuuagauuuuccucaagacccauagcuccuacugauccuacuaauucuaaguauccugaugcacuuugaaaaugcccugcccuuggacauagaauuuccuauuguuuaggccaagucgucugaaaugcaagugauuuggguuucaguguguuaaugaaaccuauagacacgugcauaugcaaccacaauuagagagaggcagugaacuggagagacagcaagcacuggcuggagcugcaauaggaggguuuggaggaaagaccaacugggaaggggaaagugaugcaauugauucauaaucuaaauaaaagaaaagaaaagaaaaaagaaaaaaaaauguuccccacauacugucagcaggaaugcccaggacucaguucuaggacuaaugucuuauaauaaccucgccggaagaugcaagccugccccucuguuguacagcuagcacguggcugaccccugucagguauggcugaccccugucagucagguguggcugcagcaccaagcagaggcacucagccuaagcaaagacuggaaaggaccgugaggccauaugaggagcauggagcucgcccagcguuuagugcuguucauuugaggcagacucagcucagaggaggucugugcccaggaucauuuuucuugucagccuggcauuccugcuuuaagaacuacagauacagcuuuggagauggagugguuggugaaacccuuguuucccaagccugaggacccaaaccuggauucucacagugcaacaguucauuucuccucaggcaguggggacaggagaaucccucaggacuugcuacucagugaucuccuuuagggagauacccugugcugcuucacucggcaccuaccugggcucccacauucaaggcaaacucacugugaaccucaaggccucccaggcucagugcugggucaugaagaagaugcuugacagaaacuucugacaccacauaugcacacacacaaguaugugauguucacaaauauauacaggacacacacacaaauauauacauccauauacaggacacacacaacucuaggccguguagguaggucauuguccaaauguuugcugcucagugccacuugccaugcugaagcucggaaguuucuuauuuuauauguaguaauaggaagcacuuagagcacagaggauaaugaaacacagcaaggguuuucucuaaauacacggugguaguauuuaggguggggagaaguaucguucucacaggucuuggguggaaaugcagaucucuguucauagcauugggagacucaaguuaaaugaaaaagcccgggacuugucaaaaacugauuaaauacugacugcaguuugugucuuuccucucuccucacauguggaaacugauagggccuguucuucaguugacaauagcagagaaguucacuguaagcuugacagguagccaggauucuguuaucucuuguaugucgguauugcugguaguugugguacauggagaaguuguguuguaaaugaccugaaaugacccggcuuugguuacgaaggcgcuggagauucugaugcacauauuucuuccugucauaacuaccaccugcuuuucuuccucaaauucuggggccuuucaguguauagggaacugacuuuacaucucaagggucuuucccuacuucgggucauuucccacuggagacggucauaauaauuuaccucuuuauuucuucuauucagaggguccuguuugggagcagugcuuagaaaacagcagagaacaagaaucuuugcaguaagaaugccuucuuucaugggcaagaggaagaggggucaggguuguccccuaucccuacccccccugccaguggcugcuagagccuucucagccuuccucgggguucuucuagguaggcagagaggacucuuaucagcucauucuaacuuacaaggccuugaacaaguuguaagaguguauagcacuaacugaguuaggcguuugauaugaaugaccauauuugagcgucuggauaccagaugagaugcugcaggcuguaauccgcuggcuuauguacuccggagcaccugcaguuuacuccagggcguaugaucaggucuggcucaucagugugcagauugggaggcugucggaaguguuugcuuugcccucuguaucacuuucuccuaucacugucugcagagugugcugauacucugcaggguuuccugcccaagacuguaguaggaaaaagaugaucugcucaugagcugggaggagcgugagguuugcuggguggacugaagccugacuuggaggugugcuucguaccggucucuguauucuccgcauuaccuuucuguaaaccugggaccaugauacgccccccuuuugagaucacucugccuaagcuuaacuuuuuccaccuaacugcucuucuuguuuucucuuucucucuuccuuuauucuuauguaggccugaccaaagauggcaguaaugaaaauauugauucucuugaggaaguccuuacuauuuuagcggaggagaguucagauugguuuuaugguuuccucucauuucucuaugauauaaugacuccuuuugaaaugcuagaagaagaggaagaagaaagcgaaacugcagaugguguugaugguacgucacagaaugaagggguucagggaaagaccugugucauuuuggauuugcauaaucaguaacuucaacucagggacugaaaagcaguggguuggaaaacggagcugccuccucuuccuuugcuuacgcagggcucaacgugcaguggggcaguugugacuucagauaaugccacccauaugauccugaucauccugcccagcacagccacuuagcuagccccucgcuuggcucccuccacacccagaaaggaagugguauuccucauuccuauagcuguucacaaagugcauuggaaaugauguucuugguaguauaauugguuucuguaucauuuuaucucaacuuauguauucacugaacuaaguuggaaauuguguuguacuuaacccuugaugcuugucuuucucauacuuuuaaugauaguucuaaugggagugauucuaacaauauuucuggcaugacuaaucagcgaaugcuccuuuguugaccuuuaacuugccugcuguguagugaagcugguacuuuuuaaucuguaauuucuuuagguuaauugacuagucauauaaguuccuacaaacuuguuaaaguucuguauuaauggugcuuuugacauaauuuaaaaauccuauguuuuugccuuagggcagugaaguuucugaauucagacacuaauagguuugaauauguccauuucugaaaucagaauuuguuuucaauuuuauuuucaaauauaaaucuagagaagguaauuuguaacuuuuuuuggggucacccuauuauaaaagagggagagugugaaugugcgucuugcagaauguuguacauauuaaaacuaucuuuccugaauuaggcuuuuccauuuuuuacuaacuuauuaccuguugauuugugaguuauguauaauauaauguguagaauuguaaauuaaauuuauugaacugguccuucauuuuuaggagaaaaaauucuuucccaaacuaugaacacggcaguagcuuugucuuagcuuuuugaaacugaguucgccucaguaauacaaaaucaguuauuaaaaaaaucaguuauuagcucuauaugcauccaucucugaaaggacguguuagugacuacccuugugacugagccgugcgccaccugacagguuuacugcugcccuuccaaugacucucaaagugucuagcucccguugagagccucuaaaauucugcucagcuuugggucuucauguguuuuaaaccagaguacacuggaguuucagacaguuuuauuuaaguaucauucccagauauucucuguuuuuacauaguuaccuucaucagccauuugcucugggaugacgaaaugccagcugaaguagaguuccugaaaucagaacacagcaguucucucucuaaugucacuacucuuguacaugguuccaugugccacucaugggccagggcuuccccaagcuucaaugguuguuaggaguuuuucucguucuuguguccagcgaguguuuuacugucagugaggacuuggucagaagcugcuuacacuccagggugcaagcacuucagcucaggccuuagcagcguagugacugaggagucuuuagucaucuucucagagucauuguaguucuccagcucaggacuaaacucauuuugaauuugaaugcugugaaauaaucaaugguuguuuguuuuaaauucacaaccuuagguccuaaacacaauaaaagucacuuacccaaauggcugagaaacgguuuucaaagcaguuuuguuugugugccaugacuacuaacuguggaugguuuuagucaggaaugaauaauuaaauuucuguguuaaaaacguuuguaauuaauuucucaucagguuuuguaucgucaugauacuaaugcacauuauauguacagaaauuaauuaugcccaucuucccaacuguaaagcaagcgugguaacuugccaacaauuuuauaccaccuccgaucagugcaucuaaaaaacccuaagugaugauaaaauacaggcagcugaagaaccccugacuucucugacuuccuucaacuuguaucugaggcuuauuuguguguguaugagaaagaauaaaguuauuggcaaaaauguggucuaaagcaaauguaacuuuucuuaaguguuauugauuacauauacugaaguugugaauuuauuuuguaauuuuguuucauagguauuuucuuacuucaugucuuacauuuaugggcugacuuugaaaggccacuuuguaugcuguguauaugaguguucaauuaguuacagaguuguaaaucacuguguuaacuuugccuuuucaguuuucaucaucuaaaaaacugaccagugcugugccgucuauguagcauuggcucccaaaguggcuguccugccugcucauguacugggccacuuuucuggucucaaguucaguuaaauugggaaggggagcuggagguugugugugguucuuuggcuacuuuccgcuguucuuucacuuggaauguugaaugaugguauguaagcuggaggguuuuccaggagcugaccuuacuaacucagaagccuggccgucagugugcugccuguggauccugcagaagccacacacgggagggagugcuggcuaguccugcuugcucaccucacacuugagucuuuuucuguacaaguuuccucugccuuccguagcccuguccagacauuguaagaaaagccuuuucuguauuugauccugggcugagauguauuuacccuuaguuauucuaauuacagugguuuuugggggguuuuguuuguuuguuuuuagcucucuuaauauuggcaacuuuaaaggacuguggaagcagagaguucacugcucugcugccuaucuuacugcugggcagugucucacagagauugguacuaacaacccuuucuuaagacucuggcuuagcucuguaaugugacacaaacuuucuauggugugggcugugggauuuucauuaaucaugaugcauauuggaacacugaacaaggaauucagugacucuauguucauauguuaguugauagggcaggcauggcauaguuuccuuauauuugcugagguaaacccgccguaccauuuggacacuuuacacuuggguuuuguguaguccacauugggauuggguuuaguguuccaguguaggaaagaggaaggugaggaucuuggacucagugcgcagucucuuuaggaagcaugggaguggcgaggugaccucggugggaaagauaggaaucuguccccugaaggagcuacucggaugccggaugccauaagagagcccuucuaaagccauguguucugcauguggcaaaaccauggacccagcuuggcuuagucaugcacacauucuagucauagcggauauuacauuuugggaugggucuguaguaaugacccuguggccauugccaaaagagcauccauuaggcguucucucuaagugaagaacaugacuaccuuuucacauuucuguuaaagaauuuguagccaugacauguguacacaguaauuaccacacacacuagcagagcacagugacugcugcuggcuuccuuuuguuguuguugcguuuucuuuuacauucacuuacuguuuccaucaagacugccuuaaacggggacagccucaucaguacuuacaucccaguggacuacagguggccagagguucccuuccccacuggauagaacuucucucaacagugcuuggggacucuuuacaguuguaaauagcagaguaguaucuuuuauuguuuaaugggauuccuuuugucccuggggcaccaguaaagacagaaaagaaggaagugaagguguguuuguugaugugucugucacugugaauccacagcagccagaggcagcauaaagguaguaacuuaacucugcugaucaguggcuuucaugaccaccucuauuuccuguagugcuguaaacacuagccaagcucucccgccauccaccaucuuugcauucuucaggagaggugauuguuugaugcuuuguuguuguuggacccuggcuugcuugcuuucccucacagaauuucuuccgagccauugcuucuugucuuucaggccuuuuauaguaugcugguucuaaacccagucucccccagucuccccagccugucucccauccuuccucucccaguaccucggcucccccuccccugcagccauuccuguugcaugcucugcgccucaaauccugcggcuuuggauaggcacuucacccgugcucuguucccagucugcuucauccugaggacugccugcuguaucucucuuccugccacuccugagcaagcugcgucucaggauucgccuuucucagugccauugucccuucugcugggaaaaccaacggaggaagcucaggcgacaagaaacaacacuucuuagcagcaugcaggcuucccuccugcccuguugugacuuuuagaacccaauuuuccugguccugcucuuccucuguuuuggggugcucggguguuuauuucuuaucucccaagggcugggaucuuuccuguccauucucuccccuuagaaacuaaguaggauaguugucaguuaaugggcugcccugaucuucucauugaaaacauuccuccaaagucacuguugguagauuuuuagauuuuuuuuaauuaauuauuuuuuuccccagagaaaaaaguagguuaaggggaugccugugaccucuggauguuugcugcacuuggauaauuuguuucacuuugaugccuuucaccaaaucuaaaguuuuaagugcaacauucuuucuuaauguuuuaccacccuggcgguagugcagcucguuuggguucuagugaguuaguguggggaguagauugauuuuuuuuucccccuaccuuucauuuuagugggagucuaggcugccauggaaacaauauagcaaugcaaguggacauccaagguccuaaaguauagaugcuauagucucauuccuuuuauacuuuaaagguuaguguuacagaaguaggauugguauuucauucugaauuaauuaaacuuguuuggcagugcugacaguauuuguugcacagugauacacuguuuuugccuuagaaaguacugguucuucugaugcuguuguuaggucucccacagagagccagcagcuaaucacuacuacccuuuccuuuucccuuuccccucccccuucucuugauggccuggcauucucagacuuuccaucuccagaaagaugaucauaagacuucaacugacuaauaaaugaccaucucagaugcgcuaucucguuugauggacacaguugacuacaguagagguuaaagauggaggaugugagcaagaaaacuaacaggagcacaugaacaccucauuccagaaaugggguugugacuggaguguggggaaacaauggccauuguaguuuguaguaugguaaaccucagguuuggggcuccugucugauacuccccaaacuuagcuguugguuaaccauuuguaaauucuuauucucccaugguaagaacucagucuccuaccugauauagccaagaauuggauuggcagcuuagaacaccacuugagaaagccuaacaguauaugaauauauaaaauaacauuuaugagagugggaaauagaaaaagaaagccaauugacugagauguaaguacaacccuguuggaaaagaguauguugaaagaagauaguguugauguuuguuaucuuacaggguuaaaaacuaaaacaacaaacaaaaucccaaacccuuuaucaugacuuugauuuucuaagagugaaaguacaaagcaauuacaaaguuuuuacaguaacaagcaugacugauguaauaaugcauuguuugcuuauggaacuuuaaaacauugaauuugaaaugauagagaaaagccaugugugcucaaagaugaagauucuaugggaauaugugugguuagcagugugaagcagaagggaaacaagggucccaguccccugcaaaucgccuguggcuugagaagucuacugccugagagaaaggccauggcaguugcaaagccguggaggucuaaugcaaauuacgcacaaacaucuugaaagucuaaugugaauuauggugcugacugguucucagguuaguuauaauguguuccucuuaagacuauaguuacugaaguccuaaggcuguauuucugauugauguuuacuggccuuuaaaugguaagccuaagcacuuuaauucguuucauagaauuaucaguuuaaauuauuuauagguacugaauuuuaauuuccucaacaugucuucguaaccucuuuuuaucuuguaaauaccaacagaaggaccugguggguuagccaagaggaaaacuaaggcuaaagguauuauuuucuguguugucaagcagccucuagugagugaaguucaugcuugauggcgcauguuguuucugauggagaugcagccacaguuaacaguacugcuuuuugauuugggcgcucuguguuaugaaaagcuuuuaaaagacuaaauuauagacuuuugcuucuucuagcuagucuguaauuuuaauuaauuucccuuccuuguuaccagaccuuucuaacagccuguacauuaagaguuuaucaacauagcugucuauguuuauuggacugugcuuguuaaauuacauaugcacauuuucucaugcuuccuaaaaccuuuuauggucugauuuuuacaacggugaguccaucagcgauugacuuuauuucucccaaggcuguggggacgcuuuccuaaagcagaauaagagccagugugcucuuacacugaagguuagcuuuauaaccuagagcucugaauuguugauauagggucugcugaguuugauauucuaaugcauuacaauugcuguaccugugugauaguauauguacacuaacauuguauuauuacagccuguauaucuuuacauguaagcacuggugcucuucagggggaugcauggaagacaugcaugccuuucuuucaaaaucuuaggacaguuuuguguguguaaguacuuggcguauugguaauuucuuguguguuaaaaucauuaauauacaaggcuuuuacucugggauaugcgggaguuuuaguuuucauuuucaguuguagguugcgaaaacuuaaauuucuaacuaguaucucaccaaaauaauucccaagaagaaaaucauuuuuuaaucauuuuauuuuuauauaagcaguuuugaacuaaauugccaguaaauuauaauccugccucauguucuguugauacaauuuaagcauuaaggauauaauuuuaaaaauacagaacagaauaaggccugacagcagugagcaagugucuuacaguuugcuuugccauuuucuguugcucugugggcagcccugagggggaugcagccuugcagaugguccugucugaguuugaaucaguauuuuuagaaguuuaaugaguuuuuugcuaaucgacuuucaguagaccacguagaaagguacugucuuuugugaguaccacauguccagaguucacccugaagguccuaguguuacguggaucuuagacacacuuuguuagggcagacaucuuucacauuuuguuagaucuuucguuuuguuuguggcuguuuaaucgcugucuuaugcagugagaaucuuuuauaauguccuggugagagcagaaagugaaaagugaaacuuuugcuaacugcccaguuaaacuuuauagaauguaaugugaaaacaguguuuuaucugagauuggaaguaccuggacuucccacuuaacugcuuucucgcauccuaagagauguggaggaugugagcauuggcuuguguggccuuccaaaaauuaccagggaaauguacuuaaagaaaagaguacugauuuuaugaaguugacauaagcauaaaaaaauucauaaaauugcuauuaaaauguuacagaaaacaaaauuaaaaauuuuuauauggauuuuuuguguguguguguguguugugaagaauuaagugguauuuaacuuaccuguauaccuuuguucugaaguccuauaaacauaacgguuaagggcaugacagaauguugaagcugaaaguuuuaaguuauuguuuaaaaacaaguuaaaguuuguuuucauagugccuguguuccuuuacuuaugacauuauaguuaggaguuaacucuucacugcccuaacggaugggcuuaccuuguuaauguugaaugccagccuguguuaacacaagucaagccauauuuuaagcuggaaaauaggaugaaauagucuuagaauuuauuucauagcuaauacuuuauagagguuuguaucucuuuuuacucaacguuugaacuaguaggcuaaugccugaaggagggaguuccaugcccgggugggugggaacagggcagugcaucuaacaagggcaucuaacaugccgugccaugauuuaagagauguggucaguaaacauuuuuuccuuugauuggaaaaccugaaagcuaaagaacccaucaaagaagagcugaagaaggagagagggaaagcugugccuagcaagaaugaagagcgaaggcaggggaagaaggagcaggaggauagagggaaggggaggaagaagccugacucagacacaucccagaaagcauccgcugcagggaagagagacagagacaaggagaaagccagcucugacaagaguuccaagucuaaggaaagcuggaagaaggccguagagacaaaggcuguuucuaguaaaguggcugccagagacaaagacaggcgaggaagaagcuccucugggcaugcucacgucgccaaggaaaauggccagaagagaaagaacugaaggccugucagaaaugacucaccuuccucacuccaguucgcugcuaaagggcagaggaaaucugggauugcuccgacugggaaaaugauccauauuagccacuggauguguuuauuggugcucaauaaguaaauucugugaaucaaguauacuuugucaucuucucaguuucaaaaaaaaaaaaugaaaguuuguguuauacaauguaaugaccuguuuuuauugcuaugugcguagugugaauuguaaugguuuuaauccuuuauuaaauccuguauugagguaaguaagaaagagucuggagagcaugagaaguauuaaugugcagcgagggacucagccaggcagggucuucccugccuccucccuuccugcucccagcuugcccauggcagccccaggcuacugucugucaccucccuccucauuuguuaggccuuugcccuuuaggcuccaucuguccagguugagcucgugccucacaccuuaucuccuaccuuccuguccccuuagcggccuuaguugcccuuccucuucuuacccagcuuccuguuuucacaccuuccuuucauuacauaaacaauaaggauaaaccgagagccuguucagcccacuccggacacaucuuucugaauucuauguauugucaagaauuaaagaguuuuaucuaggagaacauuuccaaaugcuuuuauuuauguuagcuguauggacugugaaucauccaaagacguuggcuucacugcgguacuugugugguucacuguuuuucaguggugguuagcuggcuuccauucuuauguuucaguuggugugguuagcuggcuuauauucuuauguuucaggugugguuagcuggcauauauucuuauguuuguaucaugauuauuuaucauuuccagacgaccgcaaauuugagaucaaacuucuuagcccaucacaaacaauuaauaaaagaaauaucauugagggagacauuucuacaaaugugugcuggucugugcaugaugcucuaacuuaucuuuagguuacauguuaauuaaaaagucugaccaggguacggugggugccucgggccuguaaucccagcacugagagauggagguaggaggaccacgaguuugagcuccuccuuggcuacagaucuccuuggcuauagccugucugggcuaugucaagauccugucuugggcgccagcgcgcgcacacacacacacacacacacacacacacacacacacacucuuucucucucucucacacucucuuucucucucucuuucacaaacacacacacacucucucucucucucucuuucacacacacacacacacacacacacacacacacacacacacacacacacaccaauaguaaaaguaacuugauaauagaauaaaacauuuuaucaagaagacuuuaaauuuuaaaaauaacuuuuuagcuuuucuaugaagagauuugaaauagaaauuuuuuuggccuaguuaaaaggcacuaaaaccagauauaaguaaacuuaaauguagaacaaacaucucucucucucucucuuucuuucuuucuuucuuucuuucuuucuuucuuucuuucuuucuucccucccucccucccucccucccucccucccucccucucucucuuucuuucuuucuuucuuuucucuuaaaagccagcagcuuuuucugcuuauaaacaacuaaaucccagcucacuuaaaggaaucaccaaaggaggcuuuuuguacauauaccaagaucucuauuauauuccuggcccaaagaaauuacacuaugucaugacuugauucucuguugguuagugaggauauuuuguuuuguaauuuuuuucaugaaauaccagaccacauacacuaaaaccaggggucugugacuguagcuucagacugauggcuuccgcauuucaggucugugaugagaaguuccuccuaguucaauuuccaaaauccuggucaugcuaauuuggucuguuuuauuccuugcaagauacaaccaugugguacgaaaggagacuucggcaggccucagagacauugccuuauuuuucuggaggguucugguggagcaaacucccuaggagaaucuguugaacauucuuuuuagauuauugguuuuugaaacagggauuuggggguggagcaugaaugagugccaaaguguuuuggcauuuuccauucauaaauggacgucugggacaucagagaccuucaaggauaacugaaaaacagcaaaccugcaggacaguuucagugucuucaaaauguauucugauuuuacugcgagauacaggauuuaauuaaaaaacauuacuugcaagaaauuuaaugauguuucuccuacaggcaauccccccccccccaccuccccgccauagaaggacacaacuuuaguggaggcauuuuuauuacguuuaccuugguuugaaguucaguggccagggaguuuaaagucuagaagugcucaguucuaggcaaugagagggccuuaggaucagcaccagcauaagaaggugagcaucgcuuggacuuugggaagaugcuguaagcuucuuuggaucuagagguacuuuuuccucugaacagcagcacucaggaauugaaagagaacucgggguccacaggcagucacagaaguggcucauagcacccagcagaaauacugaccuguuacuaggcacuucacauuuuggggaaugucugugaguggggacuggauuuauucucccuuucucuccuuuccccagccagucucuccuuucucucuaugcuacagaugguuauacucggucuuuuggcauugucucacgauccaguaucuuagcauccagauuucaguuaaagagcacaggugagccgaaagagggagauaaaccugcguggugacugagguugcccaugcugugccauucccagacauacucaggaucauucaugugguaguucuaauucauuguaacugcuagcugaggauaauucucagcuaaacacaaucugugauucuuuguagcuagcaaacaagacuuccaggauacauuugaaaaggaacaguaaauuugcaaguuuuugucacaucuguaacauuuuuauuuucugagguaaugcuguaaaauuuguaaauaaugacauugcauuaaauuuauuuagaccuuggagauccauuacauuuaaggagcagauauccuuaaagauugcuuucucaaaauguuuucuagccugucagcguuucuaagaaucucucuuuucucaucgucugaccuucagaugacacugccucaaagcacuguauuaucagcaucugcucucucccguuggcauuucccugccugaucauguuccuugugaauuucaguauguuuaaugucaccucauguauggucagugucuggagucugacuucaugcuugguauacauggucucaugagacacacauuaguagguguagcugcuuguaccacucugcagagcugagugaauucucgaaguucacagggaacaugcuaugggcgaaccgcuuugcuccccagguguucagccucuguagcuccugugggggauaaggaucccccuuagguguuuccauugacggaaugaaagggaauaaacaauaaugauuuauuaucuuaugcuaucuguaauccuuuuuccauaugcuggguguguugccucuccucaucugcuaaugccauuuggaaauguucucaaaauugaugccgugaguuauugcaacacaacauauccauguuggcacuuguaguuuuucucauuuguugauagguugugacaccugugucagaguggcuucgagagcccauguaggcuacacaugugugagccgucaacauucuuggcuccucagguuccuuuacuccugaagaacacugaugguaauggacccguggaaucccaucgaggggcuaaagagagaggcaugggagccgagcaaugguucauucuuacuccuggggacauggugugagccaagcgccuaaguucucaguccuuuguaccgugcaugcacaugucuucaugaaggguucagcugaaauccuauguuuuccugagcuaagggcuagagaaaacacuagcgaauaccacaccugugaggccuaagaauguucuggucucugcaucugugacuaacacagaaacaggauuugaaagaguugaccuucagggagcugcauguaagaaagaaaaucuaaguuuuauacucagaacauuccaccaagcagcuacaugcuuuguaggggcugucaaugaaaacauacucagucacaagagccugcuucagcaugacaguuacugcguuaccaugaaauaguguucuucagcaaguuuggguauuugccauuacguagggcuagucuccuggauucucuugguuacguggggaaguccauuucaguuagauuacauagauagcucugauauuucauaccauugugagggccaggagaaugagguuaggugguuauucuagaucucaguacuaaaccuugagccucuuugcucaucucugggcccuuccucaauguugucuugcuucucagacagucaugcacuccuggucaggugaaacuauaugcaugggucuaggauugcugcagucgaugagacaugagcugugaacaguguccacugucacagugugggugaaggaacacugcuucccuagaagaaguuccucucccucagggagacagguaaggagcagccaggcagggaugccacaugguccacugcgcuccaggcuggcaggcucuguguugguuuccaauucuuuucuccuccucuccuuuuaucugccccaguauagagaguugaacaugacuggucagaauggauauuuuacuguaagaagccaugggacagagaucccauccugacccuugaccugcaggaauucuagacaaugagagaacaugguggaaugacaauguaauaauaaguacagccaggcuugcuuuauugugaguuuucaguuucuuccugguguaucugaagagaacauuucuaucauuaggaagcugaaggguaaguauuauuuggcaguuauaguuucacacaaacuuuuuuuuuucaggguauuggggauugaaugcagacccuaccgaugcuuaaacaaaggcuauuccuuaauuccuuuuguucuuauuuugagacagacucucacuaaguuguccugcuggcugucaccuguaccucaggcuggccuugaucuugcaucuuccugaucuaacuuuaaccuucugagauuauagccaugcaccacuacacaagguuucaugaaaaauuggagaaaaaaaaaauccucuguaguaaacugcauucccauauccugcuugcccaaggauauaaccacaaaaaccagauuuuuguuuuuuauuuggcuugguuuucuuuucacagacaucaauuucugcaagagguuuuacauuuguagggucuauuuaaagcuuuugcaauuugugauagugguguuuucuaaaugcugcagcaguauuucucacuugcugacucacucucacuugccccuuccccccacgccccuggggaaucugcagugugucacugacuugauggggacugagagaugggcugucagguagacagucccuccagugaaaugcugugugguaacaaaggacugagguagaaagacaaaguacaggccaugcuccuguggcaguucccucugccgagaauacccucgugugggacccagcccccuggcacauuggcaccuaugguguggcauguaacuuaucugggaggcugggcucggugccacagccgcagugcccagcuccuguucacccuugcucucagucugugauuugcacaguaccuggccaguaaccaacagucuauagccaguguuugcuugcugaguggggaauauacacaguagauaagcugaaagguucugggucuuuuaagaccuuuggaagagaaacguuagcuuucuaaaagacaagcaaagaaaaacuugaguaacugcaauuuuuaacugugccuauugcugugugcaaggggugcagcagauuugauuuuugaauaaaugaaaaauaaauuggggcaaaaaccccacaauuuuacugggucuaaaugaucugucuuuacugaagggaugcagguuuuuccccuuuuguucuugguggaaaucaaagguguauugagugccaguuacagaugcacccugcuuacuuaggccacagagcucauccauccugggcacucagaacucccuuaguccuguucccaugaugguaaggagaggacacuguccaguccucguggagucuccuuucugguccugaauucaggcuguuagagaggagccuuauugucagagucuguacaguggcaugcauuuccucuuucugaauuuuugucuuuccuggauccaguaaaggucccuugaaugaagagcacaccuauuuuuaucaagggggcaguauuugguccuggugaucucagacucuugcuuaguucugagauuauugguguacuaauaagauauguacuuaccgacuguacagggcaggaacgagaagaaacuucagcaugaucgaucagcaucuaugucauuuugguguauugagcucucggaauaucugucagguuucaugugcuuguuagcccuuuucucaggauguauuaauuuguauuguuaggccauaugcauguggaacagcugcuugucuuggcauccauucugcaaaagugacaauagcuggaggaaucuggaggggguaagaucaacuuucaccuggucucuacaccauaguauuaguacacugaaggcuaaauaauuuuuaaagaagucuuaaguuuuacauuuauguagcauuucuauuguguuggguaugguuagcaccuagagaugacaggaagugugcaggggacaugcauaggagauuauagacaguguccaguuucuaaaagggacuugaacaucuuuggcuuuuuuaucuuggaggcccucgaucuaauccucugugaaaacugaagaacaguguaauucuuaggaaaggcgauucauucuuucuggacgggagagaccuaguauccuagggcauuucuguguuuaaacccugucugccuuuccugccccauugacucaggcuucuaaguuugcuauuccguugccugcggauuguagugcggcucagggcccugcccuucugcccuuuagaagucuauugagauccaguugcuaagcccuuuuguuuagguuguccucuugacgcagcuucuccguaacaucugugccaccuagugaguaagcuguguggcuucugcuccugggcuuuauuuagcuugcuccuucuggaaggcuuguaccgcacaugcucagccaccauggaagaguuccuuacauuagcagcugauggauacuuguuugaugaacugcuugauguaaaugaauauguaaauaaauaacacauuuaugaagugugaagcuguuauguuuauggagguagauuauaccauuuuguucucauucugguggguauggcuggauagccuugaauccuguaaagcuuaucauucaugggcccaagagaauugugcucagugucaaggauacugugaauggcuuaaauccuggcuucauuuauauuugguaguuucuugcauuuuuaauuaaaaugaaagaaacagauauuuauaaauguaaauuuuaaaaagccuucuaacuucuguaaugaaucuacagaacaaaaaccaagauguuguaagaaaaaguuuuacauuugaucccacuauugucauugccugaugacauuugaaccucagcagugucaguaagcagcugcaguggagugcaacauggcaggaagagucccucagaagucuggggcagccaggcaguggccccuuugcuucugaauagcucaucuggaagaggcuugccuuugccucugggagcugagucguugucugaggcuguaggggcugagagcaagccagcuugcaacugcucuaccaauuaaguuagaugguagaaagagagacaaagacagagagacagagacagacagagagagagacagacagacagagacacacacacacacacacacacacacacacacacacacacacacacagagagagagacagagagagagacagagagagagagaaaaaaaaaaacucaagcuagugugaaucuggauauagccuggacguagcgcugagcagcugucuguaagugugucauuugacugauaguuuggguggaaaugaagcugugcaguauugucuuuugugauauuuuccauguuuuuuauucuuuggauuauaaugauaaaugauucccaguuguguuacagaaagcugccucuuuguguauugugucugaaaacuuaaacugguacccuuugauuucauuguaugcauccacagggacuagaccacaaauggauuacauuuuauaauguaacuuuaaauauucauuucaaguuccagcccuaacccuuugucauguguacuucucaauaaaugaaucaagcuuuaacacaaacaaacaacaaaaaaccucuuuccucuuagucugaauuggucacauguguuauuuaugucgguuuuguauaacaggaguuacuacuguacagggauggccagggcuucuccgaggguuauuaaagcuauuucaguguggcuuccuuuguuaaaaguuuguaggggcccaguaaaggagaugcauaaauaugguuuucacugcuuugaaauuuauaauaaaauuuauuugugcaaauguccccucuggauauagcacugaauagcuguuugaaaguaugucauuugacugaugguuuggguggaaaugaagcugguuagcauuuucuuuucauacauuuuuccauucuuuuuauccuuuggauuguaaagguaaaugacucccaguugaguuacagaaagcuagcucuuuguguauugugucugaagacuuagacugguaccuuuuaaauacaucauuucuuccuuuuucaaaugaaauggacuuuucuagguuugguaagaauggaguuucuggcacuugcaucugccauuggaugggacuauuguugaaaacacuuuaaaugcagaccaguuugaaagccaguugaguguauguuagugaagggugauguuguagccuuccauucacacugagacacuucugagaauauaguuacuguugcuugacaucaggcacauacugauaccaccuggggaaaacuagacacauuauagagaaaucguggauacagucaaaucucuugaaaacaguagcagcaggauuguugcauucuucuuaggaaucccuuguaaacuguaagagcaagauuguugcaguccuuguuucuccacugacaucccugugccaaccaggcauaucuaaggcucuuugacccugcagugagccucuuuguaguggacuggcagagugggccccacugcaugcccucgcccugaaguaggcauuucuguagcaauugcuuuggccaacugucgacugacauacugaaugcagagacaaagcacaugaguccauggaauccuaagccucuccugauugacugagcacaacucaccuacugccagucaagagguaaaagggcgggcuacaucagugagaaagagcuuugucguuuucaugcuguauuucaaguagaugugaggcacuguaaggauuuccaacccuacucacacucugagcaagugaacuaguuugaaaucucuuuuauaguuagauuacacugauguguagaacaaagcggugugugguggugguguguacagggaguguugaaauugaggaaauagaagauugccaagccagccuguugcuuuugcagucucuguaagaguacagaaguaaccucuggcagaaacaagaauaagagaccagacaaagaauaaaguaaaaugcuugaguugacauaaggggagugugggcauuaacuguacagugguaccuacagucuacagaaugugagagcuggcuugaccuuuucuccaagggccacugugcccaucuucccagaugccacccucguccagcucucagugagggcaaagaagcucagacucagcaaacagaauuggacucuuaguccugccuugguuuccugaacagcuguauuaaggauuuaucuaauguucccuuccacaugcaacacaucacagcacuaccuuaguguuuauguggcucauguuaacuugcuuccugccuuauuuuuuauuaccguuuguuuuguuuuguuuuugaggcgggcuucucuguguagcccuuccuguccagggauugcucuguagcccaggcuagccuuaaacucauagaaauccaccugccucugccucccucgugcugggauuucagguaugccccucccccagcucagcuuuccuuacuuuuaaacagauuuuuuuggauaccuuuuagcucuagaaaaauaauaugguugcuuacaggugguacuuugugaaacuuguacugcguuacauaugauuuauugaaaacucugguauucccuaaucaaacauuacacaugaaaagugaacucaggucuggagugugcacagcccagcuuaugagugucauauggucccuucugcugggcacugagcucuggcuuacaagguccuuaaacaagacaggagucuggacucccacgcaucuucuuuuggcaaggcuagacaugguuagucuauguugugaauauuuaucaaucccuuuuaaaaaguuuuaaguacacggaagacccucaugagaugaaagacccuuuccucggucuuaaacacaguacugggaagcccgagcguccugucccaccaaucacauguuugaaaguuacuuuuucugauuuaaaguauaaaggugauuuuuaaagaagucuuaguuaacacugugaauaaaaaaugcaggccuuaaagaaagaucuccuucugagaggacauuuccaccggaggaggaggcagagacucacgcugagcuggaggagcaggccccugagggggcagguaagugucacugaacacucugcagggcugcuuggucugcagguaucuuuucaguuaccacucaugucucaccccauuguucacaucauuuauaaaacgagcugccguuuguucucuucugggauuauaauaaauacucuuguagugaagaugugucuaggguuauuuuaauaaaaauuccaaggcacagguuauuguuguccguugcccaugaccaugcaguugggaacgacagaagccaaaugcguccugacuuuaacuccagcacucuugccuuauuauauccaaaguaggaacaggcgcagacuguacacagccuguuugcugucugccccaugcacgauuccaccaggaaugaagagcuaagcauccccuguccucuucccaucugugcccaaagcaauagccucuguugacguccuuguuuuagguaagcacuuccugccagaagacaccagagacagaaagaaaugcuuccguagaucaguucauauucuuuccacaaagggacuuugacucauagauuggguaugcugacguauuuuaacaaauuggcacauaaaaauauaaucuaucaccauuauuuucugauuguggcauaguaauuuauagaauauuagcuucuguacuuugucgcaauaauuaagaaaauugguuucacugcgccaccuauuggaagugcuggauaugacacuuuauuggaaacaauacauggccccaaguugugcuggugaauacuauuugauuuucuuugcuucauuccuuuaaggaauaguauauuagucugaguuuuauuauguguuuauuucugaauuucaggagaacuuacuguaucccuccuaugacuguggaauuaguguaagccuccagaauccacaauacuuuuuaaaaaguuuuuuuuaaauauuugaauuuaacacauaauauuuuacuuuuuagcaaauaaauuuguaguuaaaaaaucaguucuugagcaaguauugggucuuagaugugccacaugccauauucuucccuuugguuauuagaaucauucauauucuuugcaaaugaucgcuuacuccagugaacuguuagccuccauucuuuuuaaccucuuggcaaugucccuuccagguuacauucugcucucucagcuguucucuuguugacacgucaguucuucuuuuccuucucugccuuccuucguuuguuugacuaucacagcuacuuauuaucucucauaaaaugcaguaaaaugaagcccucggugcccuccuaacaccaccucccccgacuucgccucuucacugucgugaccacacuugacagaacgcacugugcagcguugccuuuuuuuacuuuauuuucuguucauucuuuaacauguuguagcccagcuucuggcucugucccaucuucgagggagaaaaaagucauggauagagucagaaaugaaguggcagggagugcuuaccuaguucaaaacaggcacugguaacagaugagucuggaaaaguguggaggaccucauuuguaguucucaauccaugguggcaucagagucaguaaggagccaaguguaggagcagagcauccccacgacuuggcuagagaccuucauguaucucauaggagcagagcauccccaugcuuuggcuagagaccuuccuguaucccauaggagcagagcauccccaggccuuagcuagaaaccuuccaaugaugcccuggaugcuuucucagcauuagugaaauggcccggugaggaggcuggcacaaacacugggagacugaaggaagagcagagauuacggaccuguauauaauuacaucagggcaucaacaugaaugacuagcgaagcagauauagaaaaucuuuaugcuuucggaagguuuuaguaagugacuagcauagaguguuaaacccucccccugucucaacuuugaauuuguucggucugucacgggagagcugugcuuuguagcuaccaccauuggcauuauccuguacgagccacuggugcugccaggauuaaguccagcacugucacccaccagccugcaaguguuguuguagaaacagcuugcuguguaauguugggguguaucuuauaaucagguaagugcuacggugcuguggcaaugucaucauuaguggccacuuuauaagucauuauugugugagucuggggaucuggcuuucagacacauuguugagagcugcaaaugagguccuccacacuucuccagacuuguucugaagcugguacagaguucguuaucaucacguaagcuucauuuuuguguggcccggcccuacucacuaggauucucgcgcuuccaagagugaccuauuccagucaggaggucagagguggucacauuguuuaguguguauuaaauuuggucuuuuucaguaccccuguuuaugaaaaguuugcuucuaacaugaauggaaauuuuauuaguuaaaaguugacagcauuuucucuaugacuauuucuuuuuuuaaaaaaagauuuauuuauuuuauguaugugaguacacuguaguugucuuuagacacaccagaagaggacgucagaccucauuacagaugguugugagcuaccaugugguugcugggaauuaaacucaggaccucuggaagagcagccagugcucuuaaccucugagccaucucuccagccccucuaugacuauuucuuaaaggaaaaccuuacgccuaaauuaguuucuuuaaaagucuuuuggaaaguuucuuaauguuuaaaccuacugaacaaauaaggcgaauuuuaaguauuacguuuccugauguaggggagugaauagcaugugaacaggaaaauacagagccucucagacaaauguagucauugcaguauguguguccaugccauauuuaaguguuggaauuuccuauuaacacuucagcauuguuuguuuguuuguuuguuuguuuauuuaugauuuguaauuauuuuagacauccagaauguugaagaugaaguaaaggaacaaauucagucccuucuucaggaaucaguacacacagaccaugguaugaauucaguucuguuuuacacaaguuucuaaaauagcuggguuucuauaacuacauuccaagcaacuauagccuauuacuucuagggggaacacuggguauacuuuucaaaauccccccucacugugacggaguuuuauggacacuuuuaauuuaaauaucauauaaauaaauguacauaaaaaaguccuggauuuuaucaggaauaaauggagagucagaguggagugaccaacacaggccagcggcuucuggcugcuugucuuagagugguccucuaucuuugggagccaucauguaugccugugugcaucagagagaccgaauuuaaagucagcauggcucaugaaagucaguucuacaaggaugggggugcagaagaguggaaaguccagcagguucuugucgcacuggcucaggggcuaaggcacacgugaugaacagcuaaccagaggaaagaauccauccucaagccaaguucccugccucacugucuugguucuguguuauguccuuagagagauuuucugcauagaugguuacacagguggccuguggcuucagacaucauuuaaguguuguuacuccuguacaugucaccagugacucuuuagaaguuuuaauauacccaguuacagcuccauuuggggaugcugugggugacucggacugcagcugugccuagcacaggcuuuccuucccaugcugucucucagcuccucguuagcccugccccaugccaguugcucucacuugagcuuuuuauacgcucgcucguuaaugacuuugccaggucuguaguggcucaagguuaaacuccaugcgcuuucuaugguuucuuugcucuucuagcugcaaguccuguccaaguugcucuuacauucugacucuuguuuccaaacugugucuguuacugcuugucauggcccugcaguggcauuugucuagguguguuucucuuuucucuucucuaugcugugucggcuguggcuuuauugguuaggcguuuucacacagucucucauaauaauuucaucuuaucugaccaggggccuuugcaucugcugugucaucugcuuggguguuucucauuccuaccucaucuucacaccucaucagcugagcuuggccuccuugggcuccuugucacacagcuuauugcuguacugcaucugccauguaguagcaguguggcuugagcacagucgcuccuguuuuagaguuguguagcagcacuggggaaaugcaguagcacagagggcuggcagugccuaguggagugaguccaggaugugauuucuuuuccucacacguggcugacacugucaacaguaggcucaaagccacuggacagugcuuucaugguuucucuccagggaacagugacacgucuauugaacagcagugcugacagguagugaugagcuuuucuagauggggugaggggagaagggaagagcgcugcacucaguagagucccaccguucccagcaguugcacuuggugggcaguuugcugagcagcagaucugaaaggaggagagacuccagagcagcuggugaugagagaugggaagcagacccugugccuccuccugcagcucucugagaacccuugcaaucugcaaaaacaaaaacacuacugaacccugcccuaucgcugaaccccgcccucaucucuaucauauacugcggcuguaauguguucuguuagaaguacaauaacaaaaugagcaccauuuuccucaacaugaagauuuuauagcuaucucaaaucaaccucucucgcucucucgcucucucgcucucuuuccuucccuucuucccucccucacuuucugucuuccuuccuuuuuucuuuuuaaaaaaaaaaucaauuauaaaaacccaguauggauauuuuuuuugguauagucaauaucacuguucuugugcuuucgugccauuauuaaguagagguucuuguaccauaaauacgguaagugccauuaaaucugaugacacauggcugcuagauaucaaauaggcaggcuguugauacagugcugaugagccuggaccagagggugacucacaucccuagugugauggagugagaugaagagggauuucauaaguaggaguugaaaacauauuucaaaacuuaugaccuguuuauuccugguauuuuaaggucucauauuaugguuagcuucagagaagugaaacugcaaaaagcagaacucgagauaaggggcaacuucuaugaaaguaucuacaaaaaucagucaguaugacucagugaaaccgagcacuaccaugcuauucuauacagaauaacuagaggacuucuugugaucaugggggugauucaauagcaguagaaagaauccuauuauuccuauaguaauuguagugguaaugaccacagggagauacuucucaugggccaggcauauuucuaacuauuuucauccuuuuaucgauggcuaugaauagaucauuauuauuccaauuuuauggaagggaaucucaagcauggcauagguaauuugucuacacucagacagcugguguaaaaagccuaaauaaaucugccagaagccaugucauugugagguaauuuuagggcaagauuucaguccaagguauauuaaaauggaaugaaguaacagacucacucaguauauccuaaaaaauaaaaaauaaaaaaaucagcaauuaacuuuacauaucugcugacuaaaaugcuaagccuagguuggcuugaauguacaaugugagguguagcaaugugacugagaacacagccaguugcucuccacauuaaagcacuuguaguugcuacuuggaauuugauaguucucaauaaaaguucucgauauaaccugauguguguauuaauaaucauaaaugacuuaucuguucaucauauuuaggagaccucuauuggcucgucaggcuccucccugcucaguauucagugugagcagcacggugagaugccuguccuccaggaggucacauuguaauaagaagugacuuucaggcagacuggcacuggccagagugagaaaaauagcuuuagaggggacaguggcaggggcucauggguggcugcggaugagucugucuagguaggaugccaacguggcgccuuggucacuguauuucuccuuguugaagaccuugaagcagaugggcuggcaggagaaccacagccggagguugaggacuuccucacagugaccgacagugaugacagauuugaggaccuggaacccgggacaguucaugaagguagaacacauuuguuuuagacuaguuggucauuuauaguguaauuauuaaaaaaauuccuaaaauuccuuuaagagcgauauuuaaucuuaucuaaauauuuugaagaugaagcucuaaagcaaacugauaucugauuuguuucauuaauaaguggguuucugauacuaguaagggcagacuuuuuucuuguauuccuccaccucggugcuguguguuauaugaagucaugaugaacugcacuugaacucuggcccuggcuuuuguuccagcagcgcugucuccccuacugcacaaucuguagcuuccauagcauguccccagacugucuucuuacauaguuagggaucaaguguucucaucgaaaggagaacuuacuagcuucuagaacccuuagcuacuauugcaaugcaaagacagucaucaacugucauuaacugaguauagacauggcuguguuuccaugaaccucuaucuacaaacccagcuaauacauaguuguaaaaauugcaagucacagagcaugcaagcauguggacgucugacauaauaugcugggaaaugucuuaaguaguagauagguccucauuugugagugugaguuuuuagaagcuauuauucaagucuacuuagagcaggaaaggcauccuucauggaaagcaugguagcauugcuggguaguggugucccagcaaucagcgguaucaguaauccauguaguaugcccucaucuuaucauuucuacacggacauauuucuaauuucugaguaaagauguucaagcgucagugucucuguuuucagguaccaugcuuaucccuuugccuuuggcuaagauggcucagcaugguguacaguggcucaaaguuuuuacugaggugcuguuuauccagcaaauugcaauccacaugaagcagggaggacuuaaaaucaaugagguuaggagauucagcucugggcaggaagaaacacuucuaagaagucuguaaguuguaaaacaccuuauugucuaauauaaucuuugauaaaacagauuaaauauggaccaaaaaguuuuaucauuaaaagucuuuagagauuaaaacauuuuaaccuucuauaucuguuaaauaaaauauacaaauguuaaaucaugaaaaacagugaggaaguauggaguagacguguuggaaggaagagguccagagggacuucagggaacagagaacgggugacagagggcgaacgugaucagaacacauuauguacaugcacaaaauugucaacgggaaacuaaguacucaaaggucacaugggugaggagugaaugguggcauuuuuauugucugcguaugugaccucagugaccugggcauuuccaugcaggcguguggcacaugcuuuuaguuccagcacucaggaggcagaggcaggaggcucucuaugacuucuaagccauccuggucucuauagagaguuccacaccagcaguagccaucuagugagaccuuguuugaaaauaaaguaacaaaaccaaccagcagccaauuaaaaacaaaaacaaaaagauauccuuuguuuuuuucugcagagguaccuccccccaccccauucuugucuauguuuucauuaguagucaugcaguuuucacuuuagagaguugugggacugaacuagugaauagaauaccacagaggcaugggaaauggauuagccaugagcagcuccuggguucagcccuugucccugugggccacugcaugaagugccgucucccucugucgcagagguuuuggugugucaacauuuuaguguugaguggauacagcaagggaaucucgugguguaaagugcagcaauaaacugauagacauauuggcauuuccaucuuuauuuuaaaaguuucauauuaaaaucaaugaaaagcauugggcuuaccugaauuaucguucaaaauauacauauagacacauuaccuauccauauacuauauauuagaguaguaauaucaaccaaugcuuuuuuuuuucuucagaaaucgaggauacuuaccauguggaagacacaggugagauuuuuauuaaucuuuaauaauuagagugaaccuucuaacagcaucaugagauaaaauacuguuuauuaauuuuuaaaaauacuuaauaugcauauauaucauaugacauauagcuaauaauguuauuuguguuuuguauauauuaauuuccuaaauaaaaaucccaaguaguggaaauaugucaaaauaugcaagggaaauguauuggcuuuuuuuuuguuuuguuuuuuguuuuuuguuuguuuuuuguuuguuuuguuugcuuuuuucgagacaggguuucucuguagcccuggcuguccuggaacucacucuguagaccaggcuggccucgaauucagaaaucugccugccucugccucccgagugcugggauuaaaggcgugcaccaccaaugcuuggcuguauuggguuuugaugguauauaccuuuaauuucagacuuacauaguucaaaacuccccucgguuauauagugaggccuugucaaaacacacacacacacacacacacacacacacacacacacacacacacacacacacacccugcuacuagcaccauaccaacagcaacaacaagaaaagcaaggugggcacuguaccccacaccuauaaucgcaguagucccagcaacuggcaggcagaggcaagagaauugccaugcauuugaggcuagccugggcuauaaacuaagaccugucucaaacaaacaaaagaaagagaaagaaaaauaagcaaaaccaagccgugcacaugcaugcuuuauagccguagguuaugaagccagugacucuccuuaucauguguugcuguauggccuaaaccccagaaagcuuugcgcuagccagugccagccgaucugugcuguucauugugcucugcccucguggguuugaauggcugacugguugaauuugccacaugagaccuggcuuugcuccuuugugccuagauucuauaugcagcuaugcuagaagcuacacuaucuuuccacuggggauuaaguacagcucaugcauggguggacgugguggaucuuagauaugauacauaagcugauuaagagacauuuaaaaggucccuuuuccuaacuuauagcaucgcagaaccauccaaaugacauggaagagaugacgaaugagcaggaaaauucagguauguaaauaauaaaauuaucauuguauauuucuguuggaggcugugacuaagucaggguaaaugguuuacucugauucccacggaggucgcuucauaauucuuacaguuucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucugaauauaugcccaggagagguauugcuggauccucugguaguacuauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaauaauucuuacaguuguuuauauucccuagaccacagaguuuuaugcauaucauuuuacaugacaagguaaaugagaaaaggaugucugucuuaaaccaugacuggcauuaccuguuugucauaaggaguacuagaagcagaaucgagugugaugugcuacagucaggaagguacaagccuuuagcccugcuccguaccaucugccacccagaccauagcaugugggcccuucccaugguacauuuuauuaaaagaaagugguguuaauguguguuaguuuuuauugcugugaaaaaguaacaguuuuugagggaugagagguuuucaguuuuggaguguugacagcuuucuuuguaaugcuuucauacauuugcagaguacguuuuguauucacuccaccaucuuuuuccagcuuccccaccauugcugcuuccuuuccuuuuuuccaaguaguccucuucuacguuuguguuuugucuuuucucuuuucuuuuccuuucuuucccucgccuucuccuccccuuccucccuuuuaaaauagaguuuccguaugcgaggaucaugguuggcuuuuccaacucuagcuuacuuccccugaugaucuucacuucaauccaucucaaaugacauaguuuuguucuguauggcuaaguaaagcauccguuuuuauuuauaccacauuguuggcaucugaucauuugugggaggacacccaggcugauuccauggcuuagcuuuuguaaagcagguaacagcauacauaagcaugcgggugucucuguuguauacagacuuagauccccuaagguguauauccuggagugggauagcaggauccagccgaggacaggagacuucucuuagcgcauagaauacgauuuuuauuguuguuguuauuuuuaguggugaugcugggguuugaacugcaaacacucuaccaugauacuacuuccuagcccagaaccauauauguaucuggguuugcuagugccgcugcuuugaacccaaggcagagcgguauauuauguggcaggaucugaaggcagagugaggcugcuuacaucaugguagccaggaagcaacaagcucaggaggggagagcaagguguauucagagacuuacgccgcagugauacaaugacacauuuccuccaagaagucccaaacaccaaacaccauucagcuaugaaugcacugauggauuaauucauugauggguuaacacuuuaugaucaauccaauuaacagucaauugugccacugacuggggccaaagcuuucaaugcaggagccuuugcggacauuugagauagaaaccacagcaggauuucucuuagaauucauuccugauuuuagaguggugucugugaugcgcaugcugugugcgguuugccaagucccucuuccuuuccuuuuagaucccagugaagcagugacagaugcaggugugcugcugccccaugcagguauuaaacacgcaugucagucacugcuaaaucaugggcgcucugaggucacugucuuuauuuggugaccuuuuucuuucauagaugcagcguuaguguuuggguuuuuuguguauuauaagaguguuaugagcuucugucucaucuccuacuggaagccccacgaacagagcaagccacuaacuccuaacgcuaacacuuuauagauuaauaggaggaauuuuaugaaaaucauuuuccuucuuuuauauucauccuuuuggaacaaagacacauauuugcaacuguaauguuaauuagaguucuguauuuaagaaaagguuuuuuuuuuuuuuuuuaguauuuguuucuuuuuucuuuaguuacauagcuuuaauguuuuguuuaauauuuauuuuguuuuaaauuucuauuuucuuuuuuuuuuucagaggaaguaagacaccaagacuaugaugaaccagguuuguaaauauuuccuagcccuaggccaaucauuuguuuaaaaauguauccauacuuuuaaauauaaaauauggagaauuguauuuuaagccguaauuaucaugcaucauccagaagaccaaccaucuuaaaggaacuuacuuguggaucuggccauugucuaaauaauaccuucuuuuauuuucugcaaguugcaauugcaagcuauuuaaagcauugauaucauuuuguagcuauuccuuuuggcuaaaauauaaaugaccagcaucuucugucaggguuccuuucuacaaaucacuccucucacgacuugccauggcauuuuguucuguuggggaagaccuagagcugguuucuuuuuucagcaggcagcagaaaugugcccucagacucaggaccuauccccaaccugcaagucauguugcaggcuggguagggauggagcaggcuggccuuuagugacuauacugcucuuggcuccaggcauuuccagcauggguucuuaaauuccaaucuagauuauguuuucccuguuuucugggcaaaagaaguaagguugggcaagguagguaaguugcucgagauuuuaugaguaagaagcagagucugugauguguugucuuggaacaacuucaggaccacugugugaagacagaagucagcugacaguaaccugaccuaauccugaccuacaucaggaucugguaggaagcuucugucaccuugcuguauagaagugaagcucuagcagguagaaaccuugggagaacaugaugcacauuuuccaucaaacuccagagucuggugaacacguggucuggcagaacaagagccgccuuuuuaccucccagagguccucaaagcaucaagccuacagggcacaccccaggaagugauggcacagcuuuguuaucccacugagguguuuauguuaucuaucuguguccaggacaaauggcugcuguagcugcaaugaagggccauguguuuggcguccuuauggacucuauaauauagcaggaagaggaagucaggcaaucauuccagugcagccuucugcuacuuugacaggugcuugugagagccaguucauugcguggcaagucuuuaauaauugaugcaugcuggcguguggauuaaaugccuggagaugagggugcuugguaacaucuguuuauggauucucuggggagaaagaggaaugaaguuaagaagacccuuugauccauguguaggcgaagucaaggacauuaucuccaucuuggggugccacacagggcaaugugaagucaagucugcauucuucauaguuuaaugaguguuucaguggacggauuggauggcaaugguggcaguuuaugccaggaaaccaggguauugccagcaaagguggaggguggcgaaggugucugagaaaugucuagagggucaaauuguuaggguuugcugcauuuauguggaaagcgagugggagaacaagaugcuggcaacucugacuccugcaggcuuaauggauauuagauuuuuuuccucuaagaaaagagaaacugggaggcagagagaccuuggacccaguuucuuacaaacugguagugggggugcuuugagccacccaagaggugagaccagagaagccauuugcugguguucagcuugcaguggaguccagggcuccaugggacuccugggcacuagcagguaauuggagccagacugugaaucuuguaaggagaggacggugaggucaggggucaggggucagggguuggggauagguccugagucugagggcacauuucuguugccuacugaaaaaagaacuggccaauggggaaggcugaggacgaggaaagggagcccugcacacccagggcggggguggagagagaccugcugcugagacccggaaggcugagcuuaggaguacccuggguaaggcuugucccugcccuucuccugggcuccuuuucaggcagauguguggguugaggagaggaaaggagugacaguuugcuucugggaucugccaagggagguugauuuguacguguuuaaugcuaacggcucacugacaugauuguacucuaauaucaagaauaaugucuaaaagaauaugucuaacaucaauauucaaaaacaguucuuuguuaauguaucauugcauuauaauacauuuugguaagauguauuaccacggaggcgggccagaagguuugguucugguguaccaaauacuggaagcuuuuucgaaggucaguugacuaaggagauuuccugccgcucuguguggggcugugggggugugggagcgagccaugggacaccagccuuugcaucagagcacagaaacuccaguccccugggcccugguuaccaugguaaauuaaagguucugucagccaguuccugcugagaggguaccagcagggguguuugucuccaacccaaucacugugcaaacuaaagacugccuggcaaaacugggauccugggauaauuagcaggggagagcgcacacagacuggaaaaccaggaaaggagacucccuguuaagucaucagcagaucucgcuaacagugauuaugggaggaacuuauacuugccccuguaagggaaggagaacaugaaacuuccaucucccauggcuacccacuagcuaaaaugugagcccagauggcuuguuuuauagcauuuagccaaauacuccugucccugcccuguaaucuacauuguuagugaguaagccugaggcuuaaaauguuuauaaaugaaauaaggcaagccuguaggacacugucuguccuuauuuuuacucagugcugcaugauuucuguuuucuauuuacuucauaguauaugaacccucagagcaugaaggggucgcgauuucaggugaguuuuuccuauaguaacugcguagcuguggaacagagaguaggaauaaguauuuaggaguugucaaacaugguuucugccaggaauuugcugcuaggauggccaacagauaucaaaauccaaagauacucuaggcccuugcauaaaacagcacagcacuugcaaccaguaaugaacuauacauuuuauauuuauucaauauuuauuuuaugucagcaggagugagauuaaacuuuugaauacaauuuagcauuaaaguggauuuuguggaauaaguaaagacucuuuaugggagugucccauaaggagauccagccuagauaacacuuucugaguggauauuagccacuuuagguaucuaagucauugguucucaaccugcaguuugugacucccuugugugucaaguaacccuuucacaggggucauugagguuugugacucccuugugugucaaaugacccuuucacaggggucauugaaaaccaucagaaauaauucauucuaguagcaaaauuacaguugagaaguagcaaugaaaauacuuccgugguugggggucauggcaacaugggcuauauuaaagggucauagcauuggggaggcugagagucacugaucuaaguggagcaagaguuaauguaaugugauuggcuuauucauuuauuuuccuagauaacaccauagaugauuccagcauaaucucagaagguaagguuuuuugucuuguuuucuuuuguuauuguuuauguuuguuuguuaguuuguuuuugagguagaguuucucuguguaaaccugacuguccuggaacuugcuucgaagagcaggcuggucucacucacagauauccuccugucucugccuccugagugaugggauuaaaggugugcgccaccaugccuggcugguagguuauauuuuagaaauaaucuuauauucuacauugaaguagaucaguuuauucaaauucuguguccugaucuguauguuuacccagggcucgggcaggcagugcugggguggauaaagcuaacagggcucuuucuaugaggcugccauucaguggccagacauaauaauggaagaguucaaagauggugguggaaacaggcugcugugagagacauaggugugggugcaaggccacccuuguuuaugaguaagcuaccacuucagagaaggcaaccugaugagaaaggguuacucuggguggagaugggcuggaaguugcaugguuugugauguuacugagaugcugagaagaaaaagaaugcauuauugcuuguuugguagauuuuguuggacaggaaagauuauuuucugaaaaguaaaaguagauuuugugaaguagcaguuuuucaguagaacagaucugauaguuucagaauuauguuagaagaauuucacuuggguuguuucuguugguucucacagugcacacugaggaggcgacagggcaaagguguucguacauuuuuuuuuuuuaaacaaauggugugcuaaaacugaaaggaguuuaguucugcaugauccugguuccgcagacauaaacggcucacugcccuucucuccaggguccuuacguuuccugugugggcaugcuuguguucucaucagaggccuaccauagcagaugucuccuugcacaauuccucuuagaguuuuuaauucacauuaucugucaggcuggaaauagagcccccggcauggguaagcauauuacggcugagaugcacuguguucauugucuaaugcuuauugacuccgagauauucaagauacugaagggaagagaagaauucucaauguaacccucacugguaccagacgacaacuccaaucugaguacagaaggcacacagggccugugcaggcaucuccacauuguauccgcacaggaaaguaaaccccgucaccagcccggcacacacauuuccucagauuacacuuccacacauucugccaaaucaagcucauuuaauccugccugcguuaaucacaccauagccuugccacuuaguucaucccacaucaaucaugaguaaccgucguagucaccauacaugaucugaccacacaguuccaagcuuggagacaugguucauuucuaagaaguuucagacauuuugagaauaugcuaagcuacuaauucuuuccgguagucagcggggcugagagccuugucuguggcucuugcuggacuguaacagcaaaguaggaguuuuauauuuaaaaucacaaacccaaacacaugauauuuugaugaaauuuucugaugaguuuguuggaugcacuuuuacuguuuuuccaaaauauaauuagcugaaaguuuaagcuagcuaggaauagugacacugugauggugugaugacagugaucaggugacaaggagacaugagugcguugauuguacuggaugggagggugcuugauuuuaguuguuaucuucucuuuaucuuuagauuuuuacauuuaauuuuauuuguaugggagugucccugcaugcauauaugugcagugcacauguaccugcugcuguggaagccaaaggaggaugccggacauccuagcacuagaguuaaaaacaguugugagccucuauuuggguguugagaacuaaagacguuuccucugggaggaacaccaaggauucuuuuuuuuuuuuuuuuuuuuuuuuccauuuuuuauuagguauuuagcucauuuacauuuccaaugcuauaccaaaagucccccauauucacccacccccacuccccuucccacccacucccccuuuuuggcccugguguuccccuguacuggggcauauaaaguuugcaaguccaaugggccucucuuuccaaugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauucuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuauaaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaagugauucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugauggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaguuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagaucuuucacuuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugccgaauugcucuggcuaauacuucaaguacuauguugaaaagguagggagaaagugggcagccuugucuagucccugauuuuagugggauugcuuccaguuucucuccauuuacuuugauguuggcuacugguuugcuguagauugcuuuuaucauguuuagguaugggccuugaauucccgaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaaccuaucugguccugggcuuuuuuugguugggagacuauuaauaacugcuucuauuucuuuaggugauaugggacuguuuagauggucaacuugauccugauucaacuuugguaccugguaucuguccagaaauuuguccauuucauccagguuuuccaguuuuguugaguauagccuuuuguagaaggaucugaugguguuuuggauuucuucaugaucuguuguuaugucucccuuuucaguucugauuuuguuaauuaggauuuugucucugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuguucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggguaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaguguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaauuuguuuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggauguguuuuccuguuuuucuuuaaugauuucuaccuguuuggcuguguuuuccugcuuuucuuuaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucaaugagcagaccuugaggguagcacucuccuuaguuucagugggcagauuauucucugcaggcaagcucucuucuugcaaggcagguacccagauaucugguguucgaaccagacuccuggcagaaguuguguuccacucaccagaggucuuagggucccguggggagucccgugugggcccuugcggguauugggcaagacucugcuggcaagguagcccggggcucgagucucgagucgagcggaagggacuugugccccagaucaggcccggguagccugcuucccuauguaccgcagucucauguuccgugcgaucggauuggggcaggcgcuguguuccacucaccagaggucuuaggggcccguggggagucccgugugggcccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcgcuguguuccacucaccagaggucuuagggucccguggggaguuccgugugggcccuugcggguguugggcaagacucugcuggcaaggaagcccggggcucgagucucgagucgagcggaagggacuugugccccagaucaggcccggguagccugcuuuccuauguaccgcagucucagguuccgcgcaauuggauuggggcaggcgcuguguuccacucaccagaggucuuaggggcccguggggagucccgugugggcccuugcggguguugggcaagacucugcuggcaagguagcccggggcucgagucucgagucgagcggaagggacuugugccccagaucaggcccggguagccugcuucccuauguaccgcagucucaaguuccgcgcgaucggauuggggcaggcgcuguguuccacucaccagaggucuuaggguccuguggggagucccgugugggcccuugcggguguugggcaagacucugcuggcaaggaagcccggggcucgagucgaguggaagggacuugugccccagaucaggcccggguagccugcuucccuauguaccgcagucucagguuccgugcgauuggauuggggcaggcgcuguguuccacucaccagaggucuuagggucccguggggagucccgugugggcccuugcggguguugggcaagacucugcuggcaagguagcccggggcucgaguugagcggaagggacuugugccccagaucaggcccggguagccugcuucccuauguaccgcagucucaaguuccgcgcgauuggauuggggcaggcgcuguguuccacucaccagaggacucaggggcccguggggagucccgcgugggcccuugcggguguugggcaagacucugcuggcaagguagcccggggcucgagucucgagucgagcggaagggcaacaccaaggauucuuaacugaugacccaucucuccacugcugaauucucucuccagcccauguguccuuagaggcguggagcgaguuagacuugcuuauuuacuuuuaaacauggauuuuucucuguagcccaggcuggccuggaacuuguggcgagcuuccugcaggaaggaagagucugggguuugggaucacauccagccuucuguuuccuuuuauguaaaauagauuuaauuauuuugagcaugauuuauauaauuaaaaauaaguuacaccaagcacaaaaaugaauaaaaaaggcauaucaauauuuugaacauuaguuagaaaaauguaaaaaauuaaucucccccuauuauuauuauuauuauuauuauuaucacuuauuuuguuuguuuuuggaaacauggucucucuauauaacccuugcuguucuggaacuugccauauaaacuaggcuggccucaagucacagagauccuccugccucugccuucccaguacuacugugugccauucacaucugucuucuuacaauuccuaaggaauagaacuaacaaucucauguaagguaguguuaaguggguugcuggguuugaugaaacuaguauuucagguaauuuauagagugauucugauuggcuggugauggcugcagccucucuagcucucgagaaggaaagaaagccagcuaaaguucacauccacagcuucaagucagaguaggacaucugagaauucagcgcuagcucaugcuggagugcaggguuccgauucaguguguggcuguuauagcucacagggcaagggcuucucuaauggaagugguucagagcucuuggggaagggaggcagucaggacccacggaauaccacaagucgcauuucacaaccaaccucucgaaagagagugaugaguuuuccugcccagggacugguacaauuuuagcucagggacugguagauuuuggggcccauggauuggaagguuuuguugaguuuucaaacccagaaguggccuuggaccuuuuacucuauacagcacauagcaccuaaaacauaaaaauaaaaugcagauucaucuuaaagauuauuuuuuuccaaaagagcuuuuccgagcaugguguuugauuucaacauucauuuacaacuuaauuuuguaaaaauguuauuuaguguuacaacuaugagacaagaagaguuuuuaagcagaaccagguagagugccauucagcagugguagggagaguccacgcacacacucaagguccugauuguguccacugcuccaaagagaggaauggcagaguuuuaguggcggaugcucuauaaaagaaacaaggugcccagcuggucuucccuccacuugcuuauugagucugaugcaacacuguggggaaaagcaaagucauggugcccaucucugacugaagccuguguuguacauggcugagaaguaugcagccuugaucaacuguagcuaauucuuuuguugucauguuaucaaaaccuaauauacuuaugacaaucauaggugaauucucuacaaaugauuagcucagcccauaaucugccacauauaaugauuauuccuuuguuuaauuuuagaaauaaaugucgccucuguugaagaacagcaagacacaccaccagguaugacauuucccuagaucuagugcguuuugcuuuuuuuguuuaaauuuaaaauacuguugguguuaaacuggccuugagaaacaaaacuacagugacuaagacauuugcagacgauuucuguacuuaaaaaaaagacauuuguguuuuaauggcauggcagagucauggaaaacacacccuguguucagugugagcuucccauugcagauggugguggaaacauaaguuagggacauguggcuuuuccuuuuucccucuuugauugucaggguguuugaugguggauauagaaaugguugucuugggugaaagugaaauaguguguauguuaugauauuaucccuggucuuccuucugcccagccuucuugagagugacagcagugucucgacagccuguucagggcugcucaggaccccauuuuuccuuagccacugcauggagcccccugcccacauucuucuuuguucccauaguccccugucaacagugaauuaggagagugggaguggcccuugagccaagacugcugcugucaggggcuuuucagaggugacagaaacuaugguggucagacuggcauaggcagggggaaaauguuuuuaccagauuuucccuuacaucucuucuccauucacauuucuaauaaagucuggauuuuauuguuuuucuauuugugucuucuugguuccguuuuacuccuuuucagauugagugugguauagaucuuuccagugauguggauaauagucauagauuuuguuggaaguaauugaaccugccaaaaagaauucaauacugacuuucagaauaaggaauagcuagugaaugucuuuguaugguggaugggauguuuuagguuuuggcaguguucacacccuguucaugauguuaauuaacaugcagaaacauuuccuuuaaagaucugccucgugggcaucacggcaugaucacaguaugaugggaggagcugacaugaugagugcagagcggcguagauucuguuuuucagaacaacaggcuuggcaaaugaagcuggaacuuuuguuguugguuuucugcuucuuguugaaugcugcuugacacuggcagacggagcagacuauaaaaucagcacuuugaugauuauagacaaauacuuuaaagaaaaguauuugggaaauaaucuuagaaaugaauuuucaaagaguauuuuucuaguugucaucuauaccuuuuaauuucuuauugaccuaaccacugugagaggaauugggccuauaaaugucuguacuuuuauuucaguguccuacaaacugaugcccuaauuauuuuggcacauaaacauaaaauacccagggguuaccaggguaguggaguaaggugacuuguaaagauauuuauccaucucaguaaagcacauagaacuaaagaugcgauccaugacagaguucccagaaggaugugacgucuccguuaaugguggauguagcaguuucuguuccgggauuaaucagcuugaugugugagguggagcaagaggagcuggagcacugaaugaacuaaucaaguucuguacguggguuuccuaaaagcucccuagacccucugcauggcugugaucagacucugcuacgagaaaguguaaggcucagagucaacagugaccaugcugagccuuuacacugggcuuucucaucuccuguaccugguacuuaguauuacuuccuauuacaguuuguauuguguaacuguacagggaaauaaucaaccuauauuaaugauaucuugguucugucaguugauugcuuuugccaaaguguugcuugucugauggaaggaacuguggcaacguagccagccaucaggccugaccccacacuagaaucugucucgggaaaacugaguuggaggccuucugcagaauguuguguuuuccuuccuuggucauuccaagacuagguuacgcaguccugcuuacuaacguucauggugacgcaucguguuaaucccaugagacuuuacugcuauagaaacagucacgagguaggaaaccacucaucaugcauuagauugguggauuuuuaggacauuucauggacuaacauaauagcuaacaacacugaagaagcuagauuugcugguguguccauuucacaugggaggaugccgggguauggcaaggcaguggccuuccccaggcuguggaggugacuaguagacgugcaauugaccaucacacggugauucuagaaccuacaguccccaugucuucuagcacauuucaaauaaaugaaggucauggagcugauggcagugucucgagcuuuuugagugugauaaacuagacgaacuuuguuucuacaugccuuucucagucuuccuuugucauuuagacuggggaugugaaagacuggcucaugauuguggcauaaagcaaaguugucuuaauaacguuaacuuucucuuccuuuguaaauguguuggugcuuuguaguguaugaaaaucggucuuaagaaauuaucccucugauaguagauuuugagugccagauauuuuuaauugauuuauuaaaauauuuacuuuuuuccacaacuuuuaaccuuucucguuaaacucguauuuuuauuugaagucauccggcauauuccuagucacuucagaacguggacccacauauccaccuagcaccaaaagaauggcuugugaaggggucauuuauaaaguuccuuaggguaacauuuuugccaaacaauacuuaagguuuugugaauuaagugacccauaaaguuucugucucaaagugcgcacgaaagaguaaaagcacaucccguauauucugagaaucacugcacucagaagagagcuaugggggcgcuguguuuucugagggauucuucuacucuugguugccuacaacuggggauuaugcucuugucucagcccacuguggaauaguccagcaguagacagaguucuucucaguuacauccagccagccuucccagcacauuaaacucuggcagcuguagaagaguuugauuucauguucauaguaggcaguguuuaaaaaaaucacuucauaguuuuuguuaucauuguuauuggucauucauucacaaaucauauguugaauaauuacuaugacacagcugugcacuggucagucauccuuggccuggccggggcuagaaucuaauaggaguauggugugaucaaacaaacgugauagcauuaacuucugaguggugugaaagauggcucucaguggggguggguaauuuucuuaacuuccaaaggacuauacacagagaggguucgcccccaacuggucauugugcauuggcaggugguguggagguagaggcaagugcugccugacaaaggcuaagacaguguguccccaggauaucagaagacacgguggaaagcagaaaagcagacaggcaccugacagugucuuuuauauggucuuugaaaauuuauacuuggagcccagaauagccaaaaggccacuacauuuuuuuuuuuucagauagacaauuuaugggaucaaguucagaguugaaaagggucgugccgaagaaaguggagauguguuagggaaaagugaguccaacucagugugaaauggugaggccaggccggugcagugacugcaaggaaggcaucaacguuacagaagcuagagguagcaauaaccaagaguucaacucagucugaaauggugaggccgggccagugcagugacugcaaggaaggcgucaacguuacagaagcuagcgguagcaauaaacgagccauugggaugguacagggugguucuggggugaaggacucgauggaugcauaggacggggggaugaaggcagcagggacagaaaguagcuuugugugcuugugugcgagggagcauaugugcaccuuagugaagcacaugugaguggcagcuuugagucugugcaagcucauacuuaaguuguggagauugcauuggcaguuuuaggguguuuuaaaagauuuauuuuauuuuuaauuguuuguaugucugugugcauaaguaggagagugugcaaguauguguggaugccagggaggucacaagagagcagcagaucuccuagagucagaguuccgggccuuugugagccagcgucacugcuggaaaccaagcuuggcuccucugcaggaacaacaagcacuuguaacugcuaagccuucucugaagaccccuuacuauuacuuaaugaguauauucuguaaacucugaucaacuuccuauugucucaguauaauucaaauauaauuuucucaaagucuagcuaguuguuaaauucuaaauuauagcaugcagucaaguugauguuuuuaaauguuccuauugaaguauaaugugcauacugagaagugcuaaaauguugagauuuuacaaguaaacagaccguauuccagaaaaccucuuguaccuccaaacucuauuucuugucagcaaucuugaaaacugguguucugaccuacaacaucuagacugguuuugucuucuuuugaauuuaauauaaucucucacacacacacacacacacacacacacacaaauggggagggaggggagaagagagagagagagagagagagauguuuuuugugauugguuucuguuuaguauaacaucugugagcuucaauuacuucguuuuaaagucuaguaauuuaaucuuuuuuucuugauauuuaguuuuguuuauucuuuaaaauuuuuuuauuagauauuuucuuuauuuacauuucaaauguuauccucuuuccuaguuuccccuccaaaaauccccuauccuauuaccccuucccccccuugcucacgaacccacccacuccugcuucuugguccuggcauucccuguacuggggcauagaaccuucacaggaccaaggaccucuccucccauugauaacugacuaggucauccucugcuacauaugcagcuagagccaugagucccaccauguguuuucuuugguguuuucuaugagcauauaauguuuuuaucauuuugaguuugacagauauaauaaucauuucuacuuuuuuggcuacuauagaggaggcagcucuauucuuguauguguuuuucaguguuuauuaaacacugaguuuuguuggauauauaaagguacacauauacuuuuuaggugcucuaaaugaauaauaagaguucuugcuuacagugguuuggguuuuguuuuggcuaaauagagauagauaauucauggauuaauagauaguuagauggguggauggugaguaguagcacuucuggugcugugauaaaccauucugaccaaaagcaacuuggagaggaaacggguuuauuucacuuuacccauuacaguccaucaucaagggaagacaagaugggaacuagagacagaagcagauaaugagugcugccugcuggcuugauucccauggcuugcucuguccguuuucuucuucacugcaggcccacaugcccagggauggcacuggccaccguaggcugggccuucccacuuucaagacguaugugccuacaggccaagcuuuuggacggauuuuucaauuaagauuccuucucccaaucuauuucuagguuccugucaaguugacaaaacccaaccagcacagauaauggcauagucauaaaauaucuuacuaauuuuuuaaagagcaugcauuuagcucacaguccugcagaauguccaugcacaugguaucagcaugugcauggccucuggugaugacucuuucacuacuuccugucagaguggaagagaucauguguaagucuaggaaagccuuagaguguggcucucucuccuuguuuucaaaugacaccaauucugucagaggucccugaccugcugaccucuucuacaguggccugucucugaaaaccacagcauacaugacuuuauauuaaauuucggacacauggguuuauaggaagcauccccaagcaucaacggcacucugucuuuagaagcuguaucagcauuugccugggccauuagaaguagccacccucuuucuuacccaguguuguauauggacccagcauuauuuaaugaaacaaaccacacacuaaaauauggagcaaagauauguaucuaaaguuggauacuaauggauuuugcaugcuuuaaaauacauuacacuugucaacaguacugaagauuaacauaaaguuacucucucuuuuguuuuuuuaaugauuaaaaaauauuucuguguauaugugcagaugccuggggaggccagaagagggcagcagauccccuggagcuggaauugcaggagguugugcgcugcccuacaugggugcugggaacuaaacacgugugucccuggaggaaaagcaaggacucuuaaacccugagccaacucucuagccugcauauuagauaccacauaaauaucuuugaaaauucuucauguucuuguuuuucaaauaccaacucugcuuuguaugucuuuaaagucauugguaggagaaagcacuuuaaugcucauguuucccuucccugagauuccuccauuugguguuaugagauagucgcaagagucccagaccucagacaacagcuuugucaagcaagggccagagguuucuggguuguuaaacuauucucuuuccacauuagccuuaaaaagagacacaaacauuuccuucagcuggugugugugguuuguuuuguuuguguguguaugugugugugugguuuguuuuguuuguguguguuuaguaguaugaaaaugaagcaguuuccugggcugucugacugguccuuuaauuuagauuuccccuuauuuuuacagauacuuaaagcuucaaaaagacugcccccacuaccacaggaggaccagacuaauacgcuccaaaagauggcugugauagaucuugugauguaguuacuggcaaaucaagaucuuugggaaugaacacuaaagauguuuagagugaauuacaguggcauuuuagugaaucuuuuuuuuuuuuucuuuugaaaucacauguuacuuugcauuccuguuuguccuuauuugagagcaucuguggcucaguuggguuucuuuuuuacuugugguacaguuuuaguuuuucuauguuuauguguauuuuucagagaagacuugguaauuacauugauaauguagcaaaaacugaccugacaggauuuuaauauguuauuaguaauuggaauuaacuguguugaacugauguuuaugggcacuguuaauggggacuugaagccauugugggcaccuuguauuaauuagcacugugacuucuguaagcgaggcccugguaugcugagaggguagggguugugcauaucuguacugauauucuuaucaagauuguucacauuagcuucauguggacauguuauagcacuggcuuugauuuuuuuuuuuuugguaguguuuagauguuuuauuugaaaacuuaauauuuugguucaugauacaaaugaucaguaauaugcuuuucaaaguaaggagaaaauuaaacuccuuguggggacacaggguaaacaguagucugcaauacauacacgaccucaugcuucagcuaaaucaauuauauaacaacuauagucuggucaguaucuauuuacauccugacagcgcuguagauuacuguccuauagcuuaagggcugcccugcauuggucuaaaugaguaccacucgcuuagcccuguugucugcucagggcucucacuagggggaaguccaugauccccucagguugagggaauucaggguguaugagaaacagucacuaagcccagaguuugcugcuggguccaagggaugagccucuuccuuuauacacugguguuuuuauuauauuauuagugugguuuguggcuaagaaauaguguugugaugaaaauuugauuuguuagcaaagaagacagcuagcugacaugugguuugaggagagccaccggccauuuaaacaacgucauaaggcuauuucuuuugugggccaggggcagcucuugauuaugguaacacuguuuuaagguaaagugauuuuuuuccccuuucucaaggauaaaaucagaguaaguuuuaugauugaacauugugaccacagugcacugauguccaccugcuggcaccucaguuaagucaauaagcaauaauuuuuaaagcugugauauguaugcuauagggccuaaacugaauuauauuaaagcucuucauauugcaaguuguagaacacuacuuuuuauaaagccauauuuuuuuagugugacuuagaagugacauauuacugguaaauggcugaaaucaguuucucugaacuucuguauguaaucuguuucaaaacucugggaagugaggguucauuguggccaacuucagauacuuugauaaaaaauaauaugugaauuaauuaaugagccuugucucuacaaauaugugccaugcuaugcaacagggguggguugucugaaaauaugucuuuugugcaauguugcuuaagagcaauaaaauggagaugaauucuucucuagauugucauuauuuugaacuauuuuaaaacuuuacaugauauaauuagcauauguuauuuaaaauuaccacaaacuuauuguccaaaaucauaaagaaaugcacaccuucauccucuuuucuuaaccuaugaauuuuuugccugcaguacuaagagucaagaccaggacccugcaacuguucuacuucauagcacacacacacacacacacacacacacacacacacacacacacacacacacauucauuucaaguccuuuaguuacuugagacaaggacucuuuuagguuguguaggcuagucucaaaauuucuguauagcccaggcuaguuuugaacuuguaacuuccuguguuagccuugcaaguaucugggacuacaagggggaacaaugucacacucuguuuuuaaucuagguuccaugaaguggggcaaguuuguuuguacacguccuacugugcuacauugccagaaaacagaguucaaguaccauggcuguucuugcuuuuguccuggauaggcguuugcccugcacugggaggcuguguacucuuaacucuggugaccaccaggccaugaucuuacaaaccucacuagggaacacuugucagggucguauggcuggaucuuuguucuucccauuuccagucuuuguuucccaacagguaauucuuuaccaugucagauaaguaaggaccguacuccuugggcuugagaaaggugguuuucccuuguaauguucacaagaaaccauaaaguagaucugccuuuuaagcgacagagcaucucuaagugagccuaacccauucugcuccugcuuugcauagcuuaggaagucaagcuuuucuauguggcuggauauuaucccugcuucuauauaauaaacuuagaaccagagggcugggaaugccuccuagccuguggcuugguuccagaguaagcaugcagguagcagguggaagguagacauggugaggggaagccauugcgugaacaggagaccagguagggaacugucaaggcaaagguguuggugcuguguuucagcuugaucugaggcagugugaguaaagacagaagccaugaugaagggugggacuuacagaugggcagccuaggagcucaggaagagacagacuugguccaguguuucagaaugaacaagugccugcggugaggcucuugagugagcgggugggccuggagcaaguucaguuuugacugcuggguuuaacagaucuccuugauagggacauuauucacacacacacacacacacacacacacacacacacacacacacacgaaauauggcaggauauagaauauuccaguccaugaguggcucccugucaugauugcagaaaaaaacuguaaagaucaagauuucauuccauuuaauauuucuucauggugaugaaauaauguaacagaggaaacaagaaaauuaucaggacagaugaggauugcaugacaccauuguuggacaagagaauguaaacacuuaagugucaggguuaucagcuuucagggggacccaagguuaucauccuuacuacuggaauguucauuauuauaugaauaaagucauaaugugagaauauggacucugaaguugaucauucucguuuuuuacccugaaugggauuccuuaccuacuuuaugccucagcacccuguccucagagcugauaagggaguuaauggggguaacccgcacagugcugagaguaguguccagcgaacaguaagugcucaccaagcucuuuucuuuuugggauagaaagguccauauaggguccuuagcgaugcacaggacagagaauacgauagcagacggcuauaaggugaguuggaucuccuaggaaacucauuaagcacuaaaaugaauauagcugaaauauucuuacauuucccccacuccuaacuggagccucagaacucagcuuguugagaaagggacuuucacucuggggccugguagauuuggguagaaauuaggccucuuaccauuccauccuaggugcugcuugagaaagaugguguccuaguuucuggcauuaguccagucauacuugccuuccgagugccugaggaaccuaaggggaccugauauuguggcccacggcaugcccauaugggauuagcaccuucuacuuguauugaggauguaaaauccuguguauaguuuuucucuagggguggagagaccccuucauaaccaguacccaccugauugauauguguguguucuuuguguguggcuuuucaagucacuuuaacccagugcgauggcucuaggauuuaguguuguggguccauuggaguacuauggaucccauguaagagaguaauguggggauagaaauuguuauguuuuucuucuuugucguauccuuauuaucuacaaggauaucaggcagcuauucugcccaguugguguguacuguugggccuggggagauggcagcaucaguaaaggaccugaguuuggaucccuagcaccaguguaaaagccugacacaaugacauguguuaaugccucuggcacuagugcagguagagauguauggaucucuggcucugguauacucaagucagugugcuguagguucauugcgagacugccucaaaaacuaaggugaagacagacuguggaauacacccaguucugaccucaagcuuucacaugcaugugcacaugugcauuugcaugugucuauauauagaaaccacacauauacugcaaaaaaaaaauguucuagcuacugagugaauugucugugcagcugccuaguuuuaaggauguuauuggucaauuagcuuccgaaguucugggacacucaacaggaaucuaagaaacacuguaccccuucuucucauuuaucuugacugcaucuuguagauuuaccgagaguaauaugcagcgagucagcuuuauuauagcuacucuuagcaagagugaagacccgugccccucuguccuuucauaucucuuucagugaaaggugcaaaggagcagaauggccugggauucuguacugucggucgcuauggcugggaaaacugugauugcucacucucuacuuguuuugcacgcagacaccuuugugaucggguaucaggaggcaagauuauggaagccaugauuuguagauagugcccaacuugucacccuacauuucaaagucagguuuuuuuuuuuuuuuccuguacuucaggucucaaagacgaagaaccaauauuaccuuuccauauuggaagguauucugugacugaaucuuagauaugcagaacucgcaagucgagugauccaugugacuguacucuggauuacagcauuaguucuaccuauacacucucugaugucugccguagggagaggauggcaucucagacuucguaucuauugcccacuccgccucauuacuaggucaacacauguguauacacacacgauuccagagauaaccaaaaugaguguccauaguaaucaaccucaucuaccuagagaacuagcugcuucagguuuuuauuagauaaauaugccugcucucaggcuguauguacauaagcaacauuacaguaggugguucuuguuguccgugggagggguggauuugacuaguauuccaggcaccugguggguuuauacuccucauuucugggaguugcugcuugugagacugacacagaaagacuuuggguucaucuuaaaccucuuaguaguugcaaauauacaucugggauccaacguaggcaccuccaaggagucaucggcauaugcuucaaguucuuggaggaaggagaaucauauccaagaagugugccaugcaacauucuguucgaacaugcuauggcucucaucaaaguaguugggguuuucugagacaaugcaaauagugaaugagcuuugguaguuguaucucaccaccuuaguuucuccuuggaguggaugucugucacccacaggcauaguuaguguugaucaguauugccuacacuacuaucuccauccauaagggaugcuuagccugacauacugauacaaugacuauuguucagugacaucaaaaugauucauaggaacccaaaucuugguauucuguaaugagguuugaaugugaagaauucagcacuuaggaaaauugaaucaugugacuggaaauaauuuucuuaaauuacacucacuggacuuuauugaaauacauagucaaguguuuugggauauagaauagugacuugcucaugcuucauuuguucugucuuuaaugaaacaaauagaaaggcaaaugugauacagaguaaagagaacauaugaaauugucuaauaagcagccuuuaaaaauauauagagaaaaaagucauaucuuaauucaagaauaacagaaaauuuuauuuugugccauaaauugaaagaaaauggcacugggucuuuuguuuugucguuuuaaucauuuuaucaacaaauacuuauuuauauucuacauaaacauuuaagagcuaaggcuccaaugacaaguuaaguguaugcuuggaacgucaugguuggcuagggccagggcuugguuuugccuauucacugauggcuguuggacauugauaguugguaguuaagcaguagauguuagguacuaguuaguuaagcuugaauguugguugaccaguggcuguuguuuuuggcaauggggcaaucucaaugcaguauagguaauugagcuuuagcaagaugugugacccagggagacgacgaggcugcccuuugcuagaguauuggacugcaccccuuuggccagugucaagauauccauggcaaagauaauagguuagcaugaaccuauggucugugaugcgcaaugagaaacagauguuuguauuagaagugccuuugguucaugaacugcagcauccaaaccguuguccauuaucaugaugagccuauugauccauacauacaacccugugcauuuuaauggaauauugugaaggaaagcuagagucauuacagagggggaacaauuuggacaauacauaagugaagaauuuguccuuuggguggcaccuuaguugaugcugucacagaucaaguacugguuguuauauggugcugcuucaggaucugaagggagccaguguuuuccuggauggcaaucaaaaugcuacacuugaagacuuugaacuagcuagaauaucaaaucauuauggaaacguuguuggcacaccugaaaaaaguaaacagaauggccgguauugagaaauuagguauauggucacuaggcugcuuguuaugaguuguguguguuaaucccuaucucaaccuacugcacccgggcacucaaacacccgugugugugugugugugugugugugugugugugugugugugugugugcaaguacauagugaacauacaugcauuaugcuacaaagucuggcauuuuugugguucuggggaugggaacucgugcccucauccuuguauagcaaguacauuaccuguugaucugucucuaaccuucauuuagagcuuguaacuuaaaauaaugcuucuggaaaaaaugagagaaggcagacuccauaucauuacucugaggaauagcacccuugcagggauguuaaaggauugccuuugacuuucugagaauucuaacagcagacccgcauagagaacuccugcaugcuggaacccagcauugugccgaauaaacgaaagcugcgggacauacaggugagaaugagagcucguucucacagcuggagaacagacuggagcagaaggaacaugaacucugcguguaggaccaggggaucauggacuggucagagagaaagucugucaaagagcuaaagggagugaauugcuaaugcaaaagaaguccagaauuucuugauccuucauccucagaaguuaaaaggaugcucauuucagugggggaaacguggagaaacaugaugaagagcacauuucaagucaacaaacaaacaaacaaacgaauaaacacaucuguaguuagcucacuucccagugcaaggaccugaagaugcuuuguggaacaacuacaaccaugaacuaaagagaaaaccauccuauggaucacaaggccagcagagagacgcagcuggcuaucauguuugcuguggccauuggcuuuaagguagcuuuauguacuuggugugcaugacgcuaggauugccuuugauggauuuucuucaacuuuugugcaagauggccacagcuuuaaucuccacuccuacaaaggcguuaugggaagaauggcacuuuccugacugauuggucuuuuaauccuguaugugauuacuacuauuacaugacaugggacauuuccaucuugggaaaaaaauaaugcaaggaacagacuacuaaccaggaaggagugcuugcugagacgucucaguguggcaccugccaccaucacaccaacuuucaaacuggaaguugaggguaagaggaggaagcuugugcccuggcaccugguggccauggccgugguguccaccugccucuuuaaaugcauccucacuggagaugcuguucuuuuaaaauccugcuuauugcuacagagguuuuagcugcucuugaggucugugcuucaauaauaacaguuggugggaaacaugagacuccaggugugggaagcagugggcagagcagggaugcuuuuguuguuuaaagaucacucugcagauguaccacaggccuuuacuagcguacggucuauaacuaguggcccauucaaccucaugaccauaugauaucugccaguaucccaauuccgauauccuaauuauacuucuuggggguaggagaauuuuauuucaauguugaggaauagagaaagaaaagagauuuagaaucugagagagaaaugcaaucaggaagcaaaccuuuuguacaagaauagggacuaauauccaggaaagcaucuuugaagacuguguccaauggaagagaugcuaagaagccaaagaaacuugcugaagauucaaggacucuaugaccuuaauaaggaggcaaacauuaaaauuagcucuuagcauggugcaacuccugcaggaaaccagagagacuacagguuggaggcgagcuggaaaguggauuggggugagacuacuguugagucuguuguuaaagucuagcuacccagugcagccacccaucugccacccuccucaugaacagcugagacaugagacuaucugaacuggcauuaugucacaggagaccuuaguccuuuggauuccuguauaauguugaugguugauguucuccccaaaagacagguuuugaagauuguauucauaucuguuagcauuugauuucucaggcaauugaugcaauuuuuguggaauguugucuugagcccuuaacuauuaaaucaguuuguauaguuagguuuuccaagugugguuaccuaauguuuaguauuacuggauaguccucaggaaguguguuaguuuucaaggcuauggggaaaaacagaaagacuuuucccucuccccacaauucccuuaccaccuuuuucagaagaggauauguuuaccauuucuuugaaucauggcuacuccuguucucccuccuaacggguaagcuuuacuuacaagcauuguuugguuggcagugaccucagcuacgauuuuacuuaauuuugauuuuuuuuuuuugagauaggguuuuuauagaucaggcuggucuugaacuucugauccuugccucucccacucuccccaagcagcuguggauguggagcccagacugggccucugcugccaaugaaauugaaggugcuaaaauaggcaccaaaagcugcugcauuguccugucugcagcuccagagacgccaggucccacacucccugagaugaccccuuuaggacuuacagcccuugagagauggacuugugcaguacacacaggacuguauggauggaaggcaaggguaaaacuagagcuagggugugugggacagcaaggcucaccccaguguugagcuauggauuuccagauauuuuucuauaucuacaaggagcuaccaccaccacacucucaccucucauguucuuccucuguauaagaacaaugggggacuuccuaaaagcacacacucguguggaggagagagggcuggggcaggaauagcaucucacucauggacuaaaguguucuugcuaccaugcucuggccuuggacuuucucuagcugcccaucucuaacucucggguugcucagaguucucaguuucaggggcuuucuuuugcuucucgggaccagugcaggcugcuccucagcgaaaaaauggcccuggaaggcuucaccaaccuuagggaccugccucucucauaucugacagcccacuccugccaugucuucagagaacugguuucagcucuccuaugaacugcuugugggaggcaauuccuagacagcaccucgcugcuguccgcucucaguagcauccucuucauagaaauggcacacagauauuuaggaagacaaagcaugccaagugggugucuucauaagaacagacacuucaguggccuaccuacugugaugcuagggacgacugucaacuuggcagaaucugaaaucauguaggggacaaacuucuaugcacaguuaugagggguuacuuagagcaaguuaacaugugggcauguccguggggcguacauugauuaaguuaacugaagugggaagguccaccuuaaagcagugugggaccagucucugggcuucgguccuagacagcauaaggaagaaacuggcugagcacagacccuucagugcucuccuucuccaggcugaaaggccaacauggcugguugggucaagcucccacugccuugacuuuucugccaugauggucuguacccuugaacguugagccuuuucuuaccuaaacugccuuugucagacuguucucuuacagcagcaggaaagauaacuaauacacccagugaacugcuucuccuccagucuuagccauggucuuaacggauggauguugagugucaacuggagacaaaaugaguaagauacugcccacagcugcuaacugccacuuauucucaauauuuaaguuccuucuccuccuccuucugaacagcaucccuuuaacaaauuuugucaguuaaaugcagcacuucuaagaaagccguuuuuuuucccaagccucuuucuccuuacauaggugugguuucaauggcugaaaaaugauggcugaauaguaaaaaagacacuaagucccuaggagaugcuagaauggucacgugcauaacguaaacauuuacgucauuggaauuugaaguuuuuaaauuacccauaacuggaucuaacugcuauagggauguugugauacccaggaugggucugauugugauauauaacccaguucauagagaugugggaugacacagcuuagggaacuacuaaaaaaaaaaaaagugaaaacaggauugcuccagaccuuuauccuaaggauggagguuugcaaacuggagauaagggauaaagacaagggcguuuucuguuccccacucuccagguccucuugagcagggcggcuuggcugacucaguauugacagugaccggcaucuaccucugcccucggucucuuaaagaccuggccaauccugaucaauguggaucacaugagacacucucucauaaagcucaacuuauucaauuuuuaagauuuccuuuauucugacauauauguuuuauauugggggcuaaaacaccuuugugucucugugauagauauggaucuuuaaaagacccccuuagcuacauuagcacgcuaagcagcuaaguuagaccuccaugccaaguaaauugugauugaaguaacccauaguccaggucucuggauaacaauaguugacuggauucagacaguaacagcaguaguuacacuuuuuacaggcacuucuacucugccaugcgugacgugagauacaggaaucauuagagagugucacugaugaaaacaaaacucaaaauccaaaaagucuucaccguuaauaaaagccaacagcauuaaaaugacuuugucucagaaugauuuaucagguucacugguuuucugugcacuuuaucccacacuggaagauuaaugacgaucaacugugggucauaccuguaauuccagcacccaggugacuguggcagagcuaucaugagguugaggcagccuagguagcauaguaagaucuugucucccaaaugaacaaacaaacaaacaaaauagacaaaugacaaaaaaaguacuaauaggaacaggaaaaggacuguuuuacuuggaacuuguaauucugugaccguguuagaaaaucaaaucuuauuuuuaguugugagugcaugcuuugcuugugugugcucacacuugccuguucuguguguagaggccagugguugaugucagaugucuucuaucgcuuuuuaccuuauuuuuuuuucaaaguaaaauguuauaggaugaugaugauacugacuucuacuuugauuacuuucuuuuuuuuuuaauuagauauuuucuuuauuuacauuucaaauguuauccccuuuccugguuuccccgccgaaaauccccuauccccuccccacugccccucucaccaacccaccuacaccugcuuccuggcccugacauuccccuacacugaggcaaagagccuuuacaagaccaagggccucuccucccacugauaacccaguaggccauccucugcuacauaugcagcuggaaucaugaguccuaccauauguacucuuugguuggugguuuaguccuugggagcucugggagugcugauuaguucauauuguuguuccuccuauggggcugcaaccuccuucagcuccuuguguccuucucuaacuccuccauuggggacccugugcucaguccaauggauggcuguaagcauccacuuuuguauuugucaggcacuggcagagccucucaggagacagcuauaucaggcuccugucagcaagcacuuguuagcauccacaauagugucuggguuuggugauuguauaugggauggaucccuagguggggcagugucuggauggucguuccuucagucucugcucugaauuuugucucuguuaauuccuucuauggguauuuuguucccccuucuaagaaggaucgaaguauccacacuuuggucuccucugaaaucugggggucacaaaaugguuagucuggcugaccagcaagucccuggaaucugccugucuguccacagcacugggguugcaggcaugggcugcuuuuguaugacugcuagguaucuaaccccaugucuguagucugccaaccaagcacuuuacccucaggcugucuucccaacccugagaugcccaaauuuaaaauggaaucaaauuaugugucugcuuuagauagaauugcuauaucagucucucuccacuggaugucaucuuucuccacauauucauauuccagagccuaaaucaagugagagcuacaaaccaaagcagugcagacaguugacuggauaucacucaaaugacuuuuuauuccuccauucguucaacacuuauucagaaucugcugccaagcucuccucugugcaaaacagcagauauaugcauucacacacaaacacgaggggaagguauauaacaggaaaaaaaacauuguuuuuucuugcuccuuacugaccagucaguagagauuagaagacuucagagagggaguuuuguuccuucauguuggaggaaagucugaggcucacagagaauacucugaggccgaaaggcauaggugcucaaugcccuugaguauugguuauugauauuuacggcugaagaaugugaggaggggggcaguguuggaguggguagaucagagcgguugagaguccacagagagcuuugaaggucacagcuaggacuucugucuggucuccaguaagaagggaacccaagggauuugcuguguuuucagagccucguucuggccaagggagugaagacagaagcugggaaagcaauuaggagacuacugcagacauccaagugaccaacaacgaccaggauuagcaaggaaguuaaagggccagggagggagugagaguguguguuguuaaauaaaaugguguuuucaucgugggcauuucuguaauuuccuuugauuuaaaccaauacucaauuauguauauguauauguauauguauauauauauauauauguauauauauaauauauauauguauauauaaccauacucauuauauaguaugcacaauuagugauguguuuuaacaauauauauugugaaggcuucuaaaaaggcauuuagaaguuuucucuuuauaguauuuuaagaauaaacagcacuccagcaaaacaccagauggcaguagaaaauaagucauauuuuugcuaccaaaauaaaaaaaucacauuuguagugcagcuuaacgaaaaggccgaggcaggcagcuaaguuguggcaguuuggcacaaccggagccuuuuguggagaguuucugcucuuuuggauaaagggaaggaaaaauaaaacugacaggaagaagaaccaagccucgcgcugcuggcuuaugcuucugagauuguguguguguguguguguguguguguguguguguguauguguguguguauguguguguguguguguguguguguguguguguguguguaugugugugcgcaugugcgugugugugguuaagggugcauguguuuguguuugugugugugaguguguguguggugugugugugcaugugugugugugguguguguguguguguguguguguguguguguguguguguguaugugugugcgcaugugcauguguguggccaggggugcaugugugugugagugcauguguguguguguguguguggcggggggauuuuauggguaacuauguuacauguaugcuagacuuuggguuaauaucucacuagucuccgaguuuuaguucuugcuaccuuuuucuuugcccuuuagccugcuguuucuacaguaucuuuaauuaaguucacugggcuuuccacugcggcaugcauggcuggaacacuccaccuuggagcagaaacagucuucuaagaacagcaccugucagucucugccugcccuugcuccuucccuguugacuucaaaagccguuuaaaaauauuuugaugacauuccaucaguuuaaugaagugcuuaucccaauacguuuaguauuuggccggcugagcaucucaaugugagcuucccuggcugagccccucacccguguguuuuuacucacuuuuccuugaaccacuggacuaccuuuucuuguugauuuuagugauguugauaauagcuccucacugcguuuugacagugucuuucccugauuuuuuucuuuacauaucaccuucauguaugaugccgcaaagaugaaguguuuguauaaggucggcacacagaugcauguguacaagaagcaauugcauucucuacugcacuagagaauuuagacugggugugaugcuaucgcauacgucucuauuccauagcaacagaguauacacaaagacacuaacaggcuugaugaacuaggaagcaugggagugagaagugugguacuucccuuuauaaucaccuauggagacaagaacgcacacuuggcuaugaagauaccagucacgaaggggcgaucagcccaccuauguggauccuucaccucguaugcaugagcucagucaaggcuucucugcccugaagggacacacugucacucuaugugguuuagcugcucacgacaugcuuucgcucacugucucuagcaguccaaaacuacaagguacucuucguuauuagugccugcauccgaucugggauuccuugugcugccuggugcuucaguucagaccacaucccuuggucugagugaucugcccauauuacagaagagugagguagaaguagcgcguuuaaagcaacucagucugaaagcuuugaaaaguaaucucaauacuagccugcagcugcgacaagagggucugagaugacugccgugcaagauuuauuaucgucauuacacucaacagccacgguagugucagugccuccuaaaauacaucggcgguuauugucugauuacuucuaccgauaaguuaauuauaggagauuucugacucuuacauaacugauuuagagagaaguuuaauuacagcaauuucugugauuuaaauaagcucagcauauauuaccagucucagcgagcauaguagagguucuucagcuguguugaaauacgcauuugcuuuguuuuuaguuuucaucgcaggauuuuagcacuacuguaggucacgugacaaaccaggacaccuguuuccaccagagugcugccucugucaagcacucugcaggaccguaauagcaacuuccuccuuaucauuaaaaucccauuccaguguuucccagugagcucucuacauuugccaagacuaauuuguguaaugauugugacaaugugggcaggaaaggaaaacaggcuucucaaggggagaaaaagaaaacguugggguauuuuaaauggucuguuagcaucuugauuuuuuuuuuaaaucgaugagaauugugacaugcuaaaccagaguaacucacaugacuuuaucaccauucuaucaguauauuuagucaauuaaagguuaacauauuaguuauggaugccuagacuaacuuaaaauuaaacuuguaagaaaaugugcuauaaauagaaugauggguaguuuauuuaaaucagauguagaauuagcagcguuaacguuaguucaaaagggacagugagaauuacuuuauucagcaugccauaggcuuuuucccguaguguuuucuauuuuaugguucuacagguagcuucugauggcauuuauaguaacuaacucuuaccauauaauuuuauauuucccuuaaacauaaacauuuuauuuacacuagacagugcacagucugcuuuuaucugugguuuugcauacucacggucaaugaugcccacaugcauuaaucacugccgucugaaggucacugugcaccaaggucuaaaagagucaccucacuucagcucaucaccuggguaccggcucagcgcacaucaucccgagaacaguguaguacgcuaagauauuuugguaaagagagaaagagaaaaagcccauugccauaagaucuauuauaauacauggcuauacuuguucuguuucauuaguccucuuuguuagcccauuagugugacuguuugugaguuacacucaaaaauggaaguucacauacagacaaaacauucucuauggggugagcugugucugcagcuucaggcaucugcugggauguauccccuguugguaaggucaugcuagucacuccaaucauugacaaaacacacaugaugcuggcuguucugcucugggcauucuauuucauucuuccugggaagaaaucugucugccaccuucuguagcaccgugaaaugucgagcacacauccuuuuauuagaacaacacuucuuuccgcaccucuuuggcccuucaucugucucaccuacagaucucacccuuucucuuccuuuccugugccucucaaaacuguaccagaagaaagggagaaugguuugagaaauucccagcugccguccucauguccucuaaccucagacgguaguagcuucaacuggaugcuaggauagaccagcuuuguguuuccagagaagacuuugguuuguuuguuaacauacugaaauagcaagaaaacacaaccaaggagcuggcacaguggcacacaccuguaaucucagcucuaucagggcaggggcaggggcaggggcaagggcaagggcaauugucgcaaguuugacaccagccugauuuguauagcaaguuccaggacagguugguaucaaaagaacaaaaauuaauaaauaaaaauaaccaagaugguuaaaguaucuuucaugguucucuucuauucacuaauagguauauugaccauuuaaggcaaauguguacacagguucaguuauguuaugaguuugugcauuuguccauuuggcuaugauugaagccgagaauauaggauuuauuuauuuacuuaguugcuuacuuuugaguuaaucucucugucucucucugugucugugucucugucucucugucucugucugucugucugucucuuccucagaagacaucuguacgugcagggaaaggaauuaagagaauaauuuucguguauucuaacauuuuccuuucacugugucuugggaccacagccauucuugcacggcauugccuugagggcugcuccucaaguauccaacagggguuauauucauguaaacguucugugcauucugauaaccucuuauuuuuaauggccagguaguagguugauacaggaaggaacuguaggaguucuugcacacagcaaacccaucucuauugcaaagaacaucacuaccgcaaugugagggauagugcucucugcaaagcaguuucuccaggauacagucccucagcccugguggccuuacuccuaggaaggcaggcaccacaucuuucuuccaguguacagcgugcuacauacuuucucugcucugaguccccugcacugaugggacugccaucuucuguccuguucuggguuuuguuagcauucccccucuuuaagacuaaguauuuaaugucuggagccuaguuaacuagguuacuaccauccuaacccuguucacaugugcagagcacucugaaaacuggacucagauuaaauguuuauccagcauggcuccuucaguuguuacccuuuauguaaaagccaguguuugauaaaguugugcuucugguaauaaaccuuaauuuuuaugcuuccuagaaauuuggcuccucucccccuaaagaucacuggcuuccaguguguguaccgacguaucggcgauguuauuacuaguguuauucagcgagccagagacuggacauagcauuaauugcaaauuauagccugaaaauaaaaccaaugaacuugggugagcauuuaauuucugugcccugucacuuugauucauacuacaucuugcuuuuuaacugcugccaugaaccccgcaugcauuucucugcaguauauuuuuuucauggcauuugcagacaguugcgagagucaagcaguauaggacccagcaggguauguguuguugugccauuaauugcauaccucugugccuccagaggaaggaggccagaggcagacugucuuuuacccccugagaaguaugauaauagcuugacagugugcuuccuucaguauuucucagugauuauaaaauacaagugaagaaacuuguuggaaagcaaaaaagagagagagaagcagcuuuaaaucacaucucagauuaacagcaucgagcaagguuagugcaucgcagugggcggguacucauuuccgcuuucucaggcaccaggacuaaguccuguugaguuuuuaggaucaggggugagccugaaagugacuuuggauguugcaagugucacugagagcgcagaaaauuugagagcauuaaccuguucagccuuuaccguaguccaugcccccccccccaucaugaucauguucuuuccugcuauuugugugaaaucacuuauuuuaaacuagagaaucgauuuccugaaacacaaaggauccuugaguggagccagagucucuggucuaccacuuccuguuuguccuuugacucuggacacaucccuugggcccagggaacuuuucuuucuucacuuguaaaaugaugcauauucucacauuccugcaguuucugccuacugagcgugauugcguggcuuugcuccuggugccuugcagggcagauaugacuaacucucacggucccucucccugugauggauuaaagacaaacaaaaugaaacaaaacaaaagacaagaagccuagugaccuggcacaguggugaauaucuugaaucccagaacccuaaagauagauagagagaggagugucccgaguucaagaucacucuuuggcucuauauagaguuucagaccaccagggcuaugacagauccagccucauaagagaauaaacccaaaauguaguuuaagucaaauuuacaugaucuccaaauuuaaguauuuuagaaaagaggucuaauaaucuguauuuguuccugcugcacaaggcucuggaugaacacgauaaauuacugacaugacagccuaguguucuuaaugucuuaauuacaagagaaggacgccaauucuccagggcugguucucugugaaguguguauuuauggaaagugagcaucaacaagcugaaugaggugcaggcauguuggggagccauuagugggaugcuugugauggcaucucauuaaauaaacagcaagugaaguuuucuucccaccuuggguguuaacguggaguuugaaaacagccaacagaaaaagcuaaaugcuugagggauuuaugguaagacucaauagugccauuaauuuccauguaugcuuuaaauugcuggaguaaaauaauguauucagcaaagaagcaaguucuugcuuccucccaugagucuccuugauugugcaauugguaucucauucuuuaauuaaacuuguccaaagauaggaucagcuaaaguguuuacuguauaaauaguuuucauucccagugugcaagcuuaaaaccgggguauaaagaguuugccaucuguuaaaaaccaaaacauguggcgugcuguugcauaaaaauaaaccacacauuauucauauaaaggauuacaguauaguauaucuugggggaugacaauaauuugugauacuuuggaaugccaccacauucucucuaaguggugguauguucagaaaugcauuaugaaaagcaacaugaccauguauaagcauaggaaaucaaguuuuauuuucaauacuuuuugccucucuuaacaucuggucauucauuuaugacagaaauuuaaauaauuccucucccuuugcugcauccucuuggcccugugguuauuguaucucaaaggaucugcccacuacuacguuauuucugcuuaugcaugugcccaaaaagcuucaagcugauccgccaucuucaccauuaaagccauagcaacacuacagcgucugcagagcagagucuuccuucagagaaacaggucgucgggcuucaggccaccguguaguccuggcccucacccuggaacccccuccauggucucucugaauccuggaaguuacuuccuuucuauuucuguguucacacuucccuucuacuuuggaaucaacuuuccucccucacgcaccccaaauuagaucuguguuuuaaaggcuccaaacauuggauuugucuaaauuuccuuucucacuggcacaaguagaagcagcuguuuaugugaucauacuauaauuccuauuaugacugguuguuucagcuuguucuacucauuauggacuucuccauuaucuaaggcauuuggguuuguauuuauauuuggccugguuuugagucuguuacccuaccuggccugaggagaggccucaguaagcaugggagcugcccuuaccauggcucaggaauacugccauauccuguauuggaguuucccaccacaccgcaauggcuacaguuguuuaaagugauuuggagauucagucaugucugacgggauugugugaggaaucaugacacuucagacagaaccagcauacggucuuuggacuuuuuagauuccacuucagaacaacaaauaaauuauaaacacuauccagaaaaaguguucaacugugauaaucagaauuauucuuucuuaacuuuaaagauuuauuuuuaauucuggacucuguguguguguguguguguguguguguguguguguguguguguguguguacaugagagcaggcucccaugaagggaagaagagaguguucuauaccccggagcuaugggucuaagagccgaaugugcucuuaacuguugagccaugucuccucgcccucagaauuauucugaguuuuaaaaaauagaaucuauuguaauuauguuguacauguuuauuauaauacuuuuauuggauaaaggcaggauaaacuucgaucaacacaaucugaggguuugacgugugucccagcaaagaaguuaucaccaugaagacaauacucacacccagggacuuagaaguucccuguacucucugcaucucaucuucugucccuggcacacacuauaucgucaccaauaaacccagguuccugggcauucacauuccucucccaggacucugaguuaguggaauuauucaauguacaauauuugaagguagaggguuuuuuuguuguuguuguaguuaaagagugauuuauuuauuuauuuauuuauuuauuuauuuauuuauuuauucuaugugugugaguauacuguuggugucuucagacacaccagaagagggcauuggaccccauuacugaugguuuugagccaccaugugguugcugggaauugaacucaggaccuuuggaagagcagucagugcucuuaacugcugagccaucucuccagccugaagguagaguuuuauucugagauuuauguaacaguaugaaguaauaucuuauuuuaauugacaaguacuaugaauuuuauuguuacaccaaaauuuguucaucaauccacuuacagacauucagcuuaguuccagcuuugggccauggcaaagcuauuaagaauauccauguacaagucgaugugaaggcgcaugcauucacuucccuugagauguauaggaguagaaaggguauauuauacgguguaucuucaacuucugaagaaauuccuagccuauuuuuaauggauguauaaauuacuuucauacucucgaucacacggaguucuucgccaucuuugccaacauuuguuacaccacagcaacugcuggccauugcagccacuuugaaggucuguguuuacuucccauuugguuuuaacuuucauuuuucuuaugacaaaugguuuugaacaucuuuuguugagcuuucuuauguuaucucuucuuggaagaaguguuucuucaaaucuugccuuuuucuuucuuuuuuuuuuuuuuuauugguaugccuguuuuuuaaucuugaguuuggagacuaugucauuguauuuuuaaaacguagaauacaggucuugcaaauguuuucucccauuuuucauauaucuuguauuaguaugauaaguauagcauugauugauuuucaaauguuagacucacaauguacagcucagaguuaagccuuacuguaugguuuccuuguuggauugaucuuguuggauuggcccugccagauauuucuuguguuaauaaagcacaccaguuuuuaguguuguuuuuauauaaugucuuugucugcucuuggucucaggaguaaugcuggcucauggcauaaguugagaaacaaucuguuuucuucaaggguuucuauguccccucucccucaaauacuuaggaaauuucuccaguugagguuaucgggccuagaauuuucucugugggaagauuuugaaccacaaguucaauuucuuaaauugacauauauauuuaguuucauucuuuuugacuuacuuuuuuaaguuugugacuuccaagacuugguucauuuguucugguuuccuuaauucauucacauaacauugucugucccuaucuuaugauccauucaccucuccuuccauuuucuucugguugaaaugugcucuucaucauuauuuuuguuuccuugaauaggaucuggccauucugcuguuaggauugagaagcuugacuuguguccccucacagucacugccuucuguugucauauguacaguuuccagggaaccauuguuucaugagcuauagaaaauauuuaagacgucaucauauuugaccauaacuuuaguauuugaaggaaguaucaccuucugcuguaugcucuucuugucaccucugucuagaguggcacuagcuugcuucuacauuauaucaacuuauagauuuaagucuuguauuagucucauucuaguauaaaguaaaaucauguauguguauaaugagaaauguaccaguuaaacacauaacuuucccccuauuuguugaccuaucagaaauaguuuuaucccuuuucuguugccugacuaaggguaagcauuucucauucuauggagaccgauagucacaguuggguugcuugccagaagucugugguuggucaucuucuaucaaccaucgcuccuaaaagcuaagauacauaauaacuucuguaacaucaguuguucauuuuuguuucagggacaaaucugaaaggcuccauugagaugucucuuauucugaucauauuuguuuuagagcuugauaguguuacauauauauauauauauucccauacaccuaaugucuuaaaauacauaauaauugaagaaagucacuacuauguguuaaacacuuaucaaaccuacagaaccuuuugagagcuaggaaauucagugaaaauuaagcaccaagaacucucuugcaaaucccuaggacauuaccgugacauacacuccucucuguguguagcuguaucaagaaaugccguaccucacagucacuugcugcuuacccaucauaggguuugggagucccuaaucauuuuagguucucucagagaugcuggugccaagccaggcuuggagauuauaugaagggcauuguuuugacauuaaugggaaaucacuuucacagaaacaaagcuuuuaaaggaagaauucaaguaccuuuaagcacuauuuaaacaaaauuaauaguuuggaagauaauuuucugacauaugucuuugaaagugaggguuuuacagaauuuccuggcugguaauuagagacuacaaaucucauuuuaaugaacaccaguuaguuauuguauugagcaguaaugcuuuggggguuguuaauaugggcagccccaugcauuuucgccaccugugaugcuuuuugagcucaugcuuguucggcuggcuuuucugccuucccuacauugacuauguugguuuguguuugcugcugagugugucccuguccagccaccuuuacccuuacccauuuacuuguugaggauggcacccacaccuugccugugcugagcaugugaucugcccuggggcugcacuuccagcuccuggcuuguguugcuuagauacucaguuaaugguuagggaaccagaggaugaagauugucagaacggacucuggaguuaagccagaguugagcucuucccuccugaaaggugcccacggagauagcauucauaaugacuguguaagaguauggacugcuuuggcacugaugggguuucucuuacaucuuaaaaacugcauuacuuagugucuaaaauuucuaauuuaacauauggggucacaucuguuaaaggauuauuacucuagaaggggaaugauguauaauuuauuaaaauaacccuauggggagacagccaacuccauuuaaugaacugaaauacuugccgccuccauggaaggcucccagcugcaucucacaguauuuccaucaagggggcagaggaaaacaauugcccuuuauagaauguuuacuguguuggauuaguuagugucucuuagcuaaagaaauauuuauguucccuguucaguguaagcuuugaauauuggacuccugcugguuuguaguugauauuuaauucugaggagaacaaagguccauuuuuccucagcuguaggaggccaggaaggaggcacugucuacccuucccagcucacugcuccccgaaggcuggcagcuuagacagagcaucuccccagagugguccaaauguaccccuucucccacuccuuaugaaguguguagucuuggagagugaaucccugcaagggguuacuuuuggaucaaguacauuaauuuucuuuucucacauagcaauaauacagagaaaggcuccugccggaaacacuuccaugucuggcugcugauuggguuucucagcagcagagaacgugucugucacucaauuuacuagcaaacugauugcagaaccagugggaugcuuagcaguagggaagaccuugcacaauucccaccuuuaaaugaaagagaaaauggcugugggcuccagcccacauucccugcugcucuccuaggaacacuccaguguaggcacaagcgugcucaucccgugcucggcagagagauuuccaucagaaaucugaauguaggacucuguacgggcguacucgguuguuuacucuuucuucugacuugucuucauguuuaccuuuugcugaaauuuaucagugauuuuguuuuacaucaaauguaacuucugauuuuaagucaggaagauuaauauguauauuagaauuugucuuaauugauauuuaccaagauuacuguaguaaaauugcuuuauaugacuguuagcuucauccugcaucuuaggugggaagcacauuuuccuuagguaccauaauauaaucucauauuucuuuccucuaaauuaauuacuuuaacuuguugcauuuguauuuuucauauuucugaggcauagcuguagaaguugaguauccuuuacuugaaauauuuggaauuagaaauguuuuugauuucuacccuucccagcucacugcuccccgaaggcuggcagcuuagacagagcaucuccccagaguuuuggaauauuugcauaugcauagugagaugccuugaggaugagacacaagucuugacauacaacacuuauauuucauauauacuugauucauauagacugaaguuauuuuuuuauauucugaugguuaaucuuaauugucaccacuaugagauauaaaaucaccugagauauaagccucaggggcuuuaucuugauuacuuuaauuaauauuggaagacucacccauagguggcaccauucccuaagccaauuuccuagacuauauaagaagggggaagugaucugagcacagcgauucuucacucuuugcuuccuugaggugggugcaguuauagccucaaccucuaacacccugccaugguccuucccugccaugaugaaagcugaaacugugacucaagaugaaccucuucaucuuugauuuugucaggauaucuuaucauacuaacagaaaagguaagacauacauauuuaauuuuuugcaugaaacaaaguuuguaugcauugaaguaucagauuuguaacauguguuacucugggcaccagauuucugggcauguuacuaaaauuccuuuacuugaggaagauagaacaaccaguauccuucuuuuuuuuuuuuuuuuuuuuuuuuccaagacaggauuucucuguauagcccuggcuguccuggaacucaccuuguagaccaggcuggccucgaugucagaauuccgccugccucugccucccaagugcagggauuaaaggcaugcaccaccacaccuggcuaguauauccuuguaagguccuaacauaaaccaaguugggauuucacuugaguucaccugagggagcuaaugagauauuuagguuuucuuagagcaguggguggggcauuacauucauucaagagcauggaugacccuagagaauccacacuggaagguauauacacaacaggaaugauggcugccuguguagauggaauccauuccauucauccuuccugucuuaguuuggguuuuacugcugugaacagacaccaugacccaagcaacucuuauaaggacaacauuuaauuggggcugacuuacagguucagagguucaguccauuaucaucaaggugggagcauggcagaguccaggcagauguggggcuggaggaacugagaguucuacaucuucauccagaggaagccaggagcagacuggcucccacauggcuagcaggagggucucaaaguccacccccacaaugacacacuuccuccaacaaggccacaccuccuaauagugucacucccuagcccaaacauauucaaaccaccauacuuccccaccuauauccucuuguuccugccaaagauccuauggccacgugcaacgaauguagaauugcauacaauuuguuguguugaugggugugugggggugaauggaugcucaggugaggguucuaugacccagccugcccugucccuuccuuccaagaggaaaggucaacaaacucagcugugaugaucuuugucgaggaagccuaccuggacuguagaaaauugcagcaguuuggcuaggaggauagcccuguacaacagagcauuucagaguugcgguuuguugguucucucucucucucucucucucucucucucucucucucuccuuuuuucuuuccuccuucccucccucccuccuccucuuccuuucuuuuuuuucuuuuaauuaggggaagguaucaugcacacauagagaagacaguuugcaggagccauuucucuucucccaucaugugaauucuaugccucaagcucagaucaucaguccaaguagcaagagcccucacucagggggccaucuuauaugcucagaccaggaguuuggauuagagauucccaagguguaauaaaguuuugggagcaagaggagugcaguguggauccauaggaauagugugaaaaaaaaaaaagagucacucacaccucuaccaaggaaguguuuaaccauagagcaacugucaaaguaaaacaaaaaagaagaaaguacacauuuacuaauaagauggcucauacagauuucccauggaguuaaaucagcagacuucuagagcacauuaagaagccauauggaagaaguguaacaaguguuguggugcuugaugcccaugacuguccuucauggcuggcagucagagucagauaccuucaucgcacugaugguaacagcagcuuagccaaguguuucaaaccaccuagaacugacaucccugaaacucacauccucaucuuucuacuaagcuagggugugcuugugcaguguagcugggugcuuaagacacaaaauaaaggaaaauuacuauggcuuuauaaaacuaccuuuaucuuuagagacaguaauacaaaguugguaguuccuuuguacaauguaauacuuacacuaauacuuaauuccacucugccaucaggaucaaagcuaugaacaacccacuuucucaaugucugggccagaugccagagauaggaagcaguuguaaaggcuguuggcauugcagucuucuuggggcaaccugagacccagucuuggguucugcuguuuuugaaauauguguccuagguagcagacagauauuugacuuuuuaagcauucaguaaaaugacaacuauauagcaacaaugaauuucccuggugguaacugauacccauaaacccagggacuugggaugcugagguaggaaaaucaccugagauaguggguucaaggccagucuaaguaacacaguaugaccuuuguuucauaaacaaaacaaaaagaauuuugagaagcccagaauauagcucaguugguagagugcuugccuaaaacauucagaaaauccuggguucagucuugaucccugcacgucuuaaaaucuggcauggugacucaugucuauaaucaugccuguaauggaggcgggagaaucagauguucaaggucauuuucagauucauggugaagucaaggccauccugggcuacaggagagacaguguccauacagagggagagggagggagggaaagagagaggaaggaaaggauggagggugagagggagggagggagggagggagggagggagggugagagggagggaggcaaggaggggagggaggaagggaggggaggggaggggaggggaggggaggggagaggggaggggaggggaggggaggggaggggaggggaggggaggggaggggaggggaggggaggggaggggaggggaggggaggggaggggaggggaggggaggggaggggaggggaggggagaggagaggagaggagaggagaggagaggggaggagaggagaggagaggagaggagaggagaggagaggagaggagaggagaggagaggagagaagaggagagaagagagaaaagcuagcaagccagcuguguuauggaguuuugauaucccacuaaaaauagcugaacuuuucaaagcuagaagcuccugguuagcugugccuauauucugucuuaucuguacaggucuacuaaauucacuaaaaacuugaaguaagacaugggaaauacagugcucuccuugggauguucuauaggaaaucauuugagcuugcuucuuuuucuugucuuccucuuccguccuuccgguuauggucgacuggacauuuuguagcauauuuugaaggcuucauacaggaaauguaaacuucacaaguaaguguugggggaugaaaauagagcuaggccaucuuggaaaaggcaggacugcugguuccaggaagcacaacagcggagaagcucaagguaaauacuauucccuagaauaaguccaguguuucagguggguuugugggagacagucacacaguuaaaucaaugucuauguuuaauuaguaaucaaaaugugucaaaguggcagccccagacagaagcagauucugugucucuguguggcuucuauuuaccuguagaauccuuugucaggguggcaaugccuaggucuuaucauugcgcuggucuuuugugcuauaguuuguguucuuccuuugcaaaccuuaugaucauugagcgcaugugccggacucuguuggcucuuguagcaagcuuggcaucaguagguuccaucuuugcacaggcagauggcaggucagagccugugagcccugagcagcaucaccccuucagcccaccagaagucuagaaaauucagguuuuacuaauaacaagaauugguaaguuguggcaccagaccuuagaauaugucuguccuuucacuuacaauauaaacagcuaacaacagagguaccacuuacugacugcuuuaauuuccugucuuguaguagggauaaaauguuuugacaaaagcagucuaagggggaaaugggguuguuucagcucacaguucaagguagaaguacaucauuguggggcuagucacagcaauaggagcaagguacacgccaucuacaguaaauaaagcacaugugccaucagcccccuucccaacagcugggcccgaguuacagagcaauggcuucuuccacugccuagauggcuacccuugucuggggauagcuaugguucccauuauuccaggaccauuccacuucuucccagauauuauuccuauccuaccauguacaauuauaggcugaguaucacuaaucugcugacaccauugcauacacuagcaagauuuugcugaaaggacccagguauagcugucucuugugagacuacgccggggccuagcaaacacagaaguggaugcucacagucagcuauuggauggaucacagggcucccaauggaggagcuagagaaaguacccaaggagcuaaagggaucugcaacccuauagguggaacaacaauaugaacuaaccaguacccccuggagcucuugacucuagcugcauauguaucagaagauggccuagucggccaucacugcaaagagaggcccauuggacuugcaaacuuuauaugccccaguauaggggaacgccagggccagaagugggagugggugggggaggguaugggggacuuuugggauagcauuggaaauguaaaugaggaaaauaccuaauaaaaaaauuuaaaaaaaaagaaaugcuguagaauccaaaacauuuuuguauauugauagaauuucauaagcagaaaaucugaugucugaugugaugcguaucauucaaagcacaggacuuuugaaggaauuugggcuuugauuuggauauucugggaucaacaagauuacuuugaauaaugcaguagcgugaaccacccguguuucagaaagauccucagaacaguguggcacuguaggcauagaaaauggguagaaaacuuaaguuuuuaauuuguguuuguuggagaaauuguuuugcuugcugucuugggugaagcaguucauguaaaaugggaagauucuagguguucugcagguggccagcuucugccaugaagcacacucugaaacauugucuaggaccuaaagggacauggggggaaaucaugagaucagacugcucaugugucaguccugauuguccuguggcucagcuguggagaccaggcugaguuucagacaggguuucucugugaaacuguuuccgggcuguccugaaacucauucuguagaccugaaacucaagccaaacucaaaccaagccaaacucaccucaaacucagagaucuaccugccuccuccauugcuaggccaugauuaauuuuuaugcagacugaguauuuaauguuagugcuuuucccacgccuucugcuguucuuuuucaucauauuugucuugauaccccaacuauagcauaguaaaggaagcaaagauuugaagugcgacagucucauuuccuuuguacuucuggaaagagaccugugcuggcagcaauaggaaaauagacgucucugcuauaaaaucgacagucuucccaaaccaucuuaagugauccaaauucaacaaaaauaaccaucccucucccuagucccuuaugcaacuacuuugaaaggcucgguggcugggcguggggugcaggucuauaaucugagguauucagacagcugaggaaggaggacuacaacuucaagacuugccugggauguagaaugaguucaaaucugucuuuaaugacaucgaaacaagaagaaaggaauacaggucagugaaagagcgcauuucuagcauguguuagacgugggguccaaucccuaggccaugggggguggggaagaacuugaguaacacgauuaaauugaagaaaaucagacagacccagcagaagcucucauuuguagaugagacucuugagguacagagagcaagagguuugcugcgucuugucccgacaggaaccaaaauccucaucccugcaucuuguucauuugccuccauaauaagcauaggugaacuuuacaacugagaaaacuuccccgugcuuauaaauauuuaaaaauaaaacuaaccaugauaggcuaaaacuugaauuucaguaugaaaucuggggcagaggauauucuucgugguaggugccaugagguuuuaauauuuucuccauguuugugcuguuaugacuaggguacuuacaugugacucuuuagugggcauuuuaccuaucuguagacuguucugggugccccagacuauuaauaauuuauuuuuuucuaaauaaaucucauauuaaccugagcuucaugccuggugacaccgagaacacaguggggaaaucugcagagccagccaugaaggccuguguuuacccaugugguaggcgaggaagccagaggacugagaggguaacuggugaagugcuaucaugaggggacuggaaagaggagggugagcggaaacggaugggcuugguuuggaugguuggucugucugcuguaaagugacagggaguuuagcauccuuaaaugcggauggagcccaagagaagcuggcaagugauccacaguggagauugauuucccaggcagaggaggggggaugugaguguauacacgggcccuuggggacagggucucccuucuuugucccagaauaaggugaagguuaacagguuuguaaguuuaauguaaaaggaauguccaucuuuggguuguucucuuuuauccuagcguguagcauuuccagugcgagccccuucucuaucuggaaguuucugcuuuauccuucaagccuuuggcaagcugggcucucagggaauucccugugccugaguuuuccaggggugcaggcaagugugcaccagcagccugcccucaugcuuguagagugcaaugcccuuaggagaagggcuuucuuugguuuacacagcagcccaagcaauguaguaagaaaaugauaaaccucagcuuugguuuaagacguacugagucccugcaggagucuaugauuugggcuuaguaaguacagggaugacuaggauacuagaaguuauaugggggagagaucaucaaagacaugugcaugguggaggagagaaggggcagggacgaacacaggagccucagcaagaaggaagagaugggagagagcucccaagcugagcaguauggaauccuuuaucggucacauggcuuggaaucaaggcauagcaguauuuucagcugaggaacauaagaaaagacguuuuauguagaaauuggcauaagaaauagugcuaagaauaagaagaacgaagccugcgguauucucauuuagcagaaacagaaucugcgggguaguuguggcuuucugugauagauuuuucugucaaguaugaguauggcucuugucaucccaaggcaaggacaacagaaggacagagaucgcugccuacaaaucaccagaacgugucugacaauguuaagauuuuaaucagccagugaguacacacucuuagaaagguucaccuacugacuuggucaaaaugguggccacauucugcuuguacaaagggaauuucugugccauguaguacaggauagccugcaagauggcgucaucuuccuagggguuacccacucugugcugacugguugaaggugaauugguagacucuuguucccgcacauacaugcuggacaccaaaaccuggcuucucggccuuauucuaaguaacugcauugacaaaaagcaaauuaaauggaaauccccccccucucucucuccuuucaguuaagaagaagaagccuaaacuucugaacaaauuugauaagacaauuaaggcugagcuggaugcugcagaaaagcuccggaaaaggguagguugcuauuuuugauuugcacaagaguguacgaugguuuucuuguuacaaacaugggaacugcaggacugugagaaguauaauaacgauggcaacaacaacaauaguaaaugugaaagaaaccaucaguggcucucccggcaccucaacacaguucuaugugaaccaggucauguggaacagaacugcacccaggggccacagaggaagagaaccacaggaccucuggccuggugucagcccaccccccaucgagugcuaauuacauggauuccauaaccacuuggccacugugggcuucaguuuccuccucguuuauacaaaugagaugaugggaguaguccuaaaucccucuugcuuuuuguaaagcucaaauuagaagaaauuuguguuguguuguauuccgacaagcagcuaauucuguagcaugccagugcaaacacaaagagccuucuccagcaccugaggcugugaaaugucacagguuuaguguccuccucacuuagguaaauagcgcucaugacuacucugcucugucaucaaguaauugcaauguucugguuucuugccagauggucuggcuuuugaaaacaaugaauugacauagccauauaauauguuauaauaaugaccacaauauauuuauuauauuguaguuaggaucuuuaauuaucugcuugcuuuucuuagaaauuucuuuugauuuuauuucaguuuagaguauguacuggucuuuaguuuuccugcccugugcgcuucuauugaacagccauuagcuacaaagagguggucagaaaguaagcaauccaggaaauggcgauaagaggaauacacaagucagggacagaagugggauaaguuuucacuucuuaccuguuuacuagaaguagcaggagcaaaaggccucuguaaccagcauuggacaggacuucacaaaugagcuuuggccaacccuggucaccagcacauagaaacaccaacucaagaggaugcugucgacagugaggauccacuguaccuagauuauugucaguagaaugauuucugcauuuauuuuguuuuacuucauaaagcaaagccaucuauggcuuuuguuguuguuuguuuugggucugugugugcgcauguguguguguuuggcggaggugacuuggggguguggauucacacuucucuugguguguuuccuucaccuucucugcuccagacagauuacacaugcaaacgugcaggaggcuggugguacagguaucuugggagcuaaaacaucaguaaaggacuuuaaagaaggaguuuucugugguuauaaugagugaaaaacgugggcugaguuacuaaggagcucaugaaucaaagggauuuaaaguaauggccugguccacaggguguccuccagucuugcucauuuggagaaaggaugguguuuuccuguaggagcucugugagccuguagcauuaaagaggcaggaacagcagccacaugugaccuucucuccagauguguugugacaaaaccaucagaauaauuaaaucuuguuuacgauuguuuuuauagcuagucuuuucuuuucuuuuuuuucuuuuuuuuuuuuuuuuuuucgaaacaggguuucucuguguagcccuggcuguacuggaacucacuuuguagaccaggcuguccuggaacucagaaauccaccugccucugccucccaaguacugggauuaaaggcaugccccaccacugccuggcuauagcuagcauuuucaaaggcuacaauucaguacacaagaaucguugagggcugagcaaaggugucccaaacaguuaguacagccucauuuaugucauacauccacauuccucccuaggggaagcauaugcuugcuuuuuauguuucauccaaaaauguauaaaaaucacaucacauuugaauaaucaaauuuacagccuuaaaggcacauuuauuuauucauugauugugugcauauacauuugugugagugcacauauguacaugggucuacccugaaggcacaaacuaugaagaucugaggacaacuugcuagcaucaaauuuggauugucaggccuaguagcaagugccuuagcuuacugaaucaucuuguugucccugaaucaucaaauuguuaagaauaauguguuauuuaagacuuuccuuuauccccaccccuaacacacacagggguugauauaaccuaaugaaauaaauuuauuuuuuggaauuauuuuuuauaaugguauuuuauuauaaugaaauuauuauuauagugguuauaauuauaaaugaagguuuuuaagggaggagguaggucauuuccgcuccuuuguuuuuguuguuguuguuaguggugguguuuguuuguuuguuuguuuuauaggaguuggggguaguaagaaaauauaacaaaaccauacuaaaaugaaaacaggaaaggucacccacaccacaaacuuugaaucaugccacagacaaagacaccuccacuucuuuucaggcagaaugagagaaacagaagcgacuagaauauauguucaaaguaauggccaucuucaccaagcccauaaugcaaugcucuguuguacgucuggaugcauaguaacuggucuucaucccacacuucccacaucucuccaguggauucugccauccaucuggcuucaugccaaaacagcauggcucauguaugcaucacuccagagaacugucucuguauaaguaagcuacauuaagggacagaucauuuuuaggcaauucauuauaaauaaugugugcucuuaaaaucagaauauguauuuaguagcaguguuaguagcuagaaaagaucuugaaggagaagaagcugacugaaaacagacacaucaacauuacagccaaugcacgugugagcagcuauggugauucucaauggcagccacacagcccguggcuugcgaugauccaaaggaugccuaggagagccaaaaugggaugcuacuuuugccaaagaagaacaauaugcuguaaaaucuguuauggaucugguaugucugguuuggggucuguuaguaacacaauggccaugaaaguggcuuggcaauuaaugcuggaugugauaagcugaagaggguccaccaaaagauggccaaacuggacucuguacagguuucauuauucggagaaaagguccuucaaaugugauugacuuaaagaucuaaaggucaagauuauacugcagucucuauuuagucccuaaguauagucauguuugcuuaagagaggaaaaccuguuauagaaugaagcacacagagagaauuugauggcaguaggaauguuggggccaaugaacacuggucuggacuuccccuggggccucuggagaaaacauuuugacauccauuugcccugaauugugaaaaaacaaaguuuucuuguuuuaaggcaccagauuuaugcugguccugcaugcguggguaacuaagcccacacugcuagacuuaaaaaugaucuccucaaaagauaauccuguuuuccugggaccuguaaauguuaccuuggaaacaucuuaaaaaugggucuuucuaggugugauuuuucaugggcuaucugguaagggcccuaauguaucauuuccugaaagguaaacagagauuugguccagacagaaguaaagauagucagauacaaaggaagcccuuguggagacagaagaagagauuagagcaauguagccaugggccaaggaaugcugacagcuuugggagcuugcuuggcaugaguagagucuccccuggagccuuucuuucugacaccuugcuuccaacaucacaaacccauuuucagccuucauuucuccagucaggaaauuagcaguaauguguuacauccccccauaggacauugaugguauuuaucuuuaaagaaccuuagagaaggcacuuaagagcucaugcaugucacagaggcagccaugugucccacucagccggacgagccaaaucgaccccgacuuccaccagcgcucagugccauggccaaguggcccucacagacuccuuguuuauucuuccugcuuuccagauacuucaaaccuaaggugaugccuuguucccucugacaggcccaagggauccuccugcuaguaguguuugcccccacauauaguguaaacaucuucauuaaagaaauguggggacuagauagauuaagaaaaacguggucaucuucaacaaaauucauuuuucaucauuaucagcacacauuauuuuaaaaauuaagguuauaacacuuauuacaguuuuauguuugcuacuuaacauugcuugggguuuuuguuucuuucuuuuuaagugugcuacucuguuugguacucaaaaagaacgcuaaacaauucuuuggugacuuauuaaauaaaaaaucuaaauaucguuauucagaggcauuauacuuaugcaguuguaccucccuaacaggguaaaauugaggaagcagugaacgcauuugaagaacugguucgaaaguacccucagagcccacgagcaagauauggcaaagcgcagguacccuaggcccaucucaccagaacacuguucuggcauucacauguuuuauauaaucagauuuuucacucuuuuguauuugcuuuuuucaucugcucuucuuauaauuucuuuauaaucaguuuccuaguuauauacauacacccccagaauugggagugccauuuuauuuaaggcuguuuucaauacugugugcuaaugaguccuguaacacccaggugacuuauuuugccauugguccugugucaguguaucucccuucuauuugaauuuccuugugguuuugauuucaggcuccuuggagcuuuuagauaccauugugugacuaaagaguguaaaucugccuuggagagaccuuuugaaaugugacauggacagcacauuguuucuugacaguuucuugggugugacucaugucuuaccagccaccuccuuucuuuccccaucaccuccucggcuguguuuugucaucuuccaacucuugucacaaggcuugccacacuuaccugcaacuucacgaacccaccuguguggcaaugucuaguuugcauuugugugauagucagauauggccacaaaagaggauauagaaauggcucaacauaaaauggcuuauuuuugucuugaccuaaagauaggaaguggguucccuggacacugccacaggaaagauggcaggaaggaagacaaaccuggaaggaagguuucacgugauccuuuggggcuggccgugagaaaaguaauggaaggugcagugcccagcgugggauugccugguuugaacaacacuggcaagccugggccacaggaauggcuucuaguuguugagcaucugacccuggcaugaggaaggcaaaggguguggccuccuaugcugugggccagagugagaaggccagacucugggcugcagggauuguauuauaagggcuuguuugcuguuuugcccucucucagacagcaagcccuagaaauguucugaggugcugaguguuauaaaacagucaauuuuaaaaaguucccaauauagcagaaggaacaccugaggacgacuuacacugaggaaauguagugagagcccacugugugucaggcucugcuggguauuggaguuauguuccucagcaaaaauguacucacacaguuccauugugaaggaaagagguuggcuaagguaagaaguaccaugcauacacuugcaaguggugacugucaggagacagggaacagccaguagauaugugaggggauuaccagaaagggccaucagaaagguaauauuuaaguaaagccuuggaaaauuuuauaaaugaauauauuguugaaucuuacaaaguauuaaaaaugaauaaauauuauaccuaacaacgcauucuguaggcaaaagaaaaaggcagcaaggggucuaagagcacacuuauuaagaccuuugguggcaggugauaugugugacaguaacaagagauaguagcugagaugugucaggguuguggaaggaacuguccagguagagggagccgauagacaacugucuuggcaucagaaaguggaacagaaagaggugcaugcugggaauguggggcagccggggacacaggaggcaccucucagcucuuguucucugugccugaggaagccuuugcaggcuauugcaugugcaggugacugacugccuggagggcuuuuguaaagauugcuuugauugccaguuggaaauggauugugagagcagaauuggaugcucaggaaguaggaggcaggucgcaauguugugugcaugggagcugguagacugugguguggacugugggcugggcauggaguaggcaagggcagagauagauuaaaaggacucuagauggaagggucacgggagaagaguugaccagugacuguuguugggaacagcugagaagaugaugccagcuaacugaccaaguggaacaguggguuugaagagaggcugaaaucggcagucugcguuugaucugaaguuugcaguugcagugguuuuuagauaucagugugacugcaucaaggagaccacuggguuugugaaauuugggauucaagaguaaagccagagcuggugcaucaaucugucaagguguauagcuccugcagucacccuuggggaagaaggagaugaccagucacagggcagcagugggagagagcuacagaaguuaguggagcaaggagaagcaggugguauucccuugugugugacccucacagguaguaaaacaucugcagggaggcagugggccuuguucugagcugaaggaagaugcucagauucucuuuaucccauuggagacuaauucauuaaauuuucauuaauuaaauauacauaaauuaaauuuguaggacaauugauacaaauaaauuucccuuguccuugauaccuacuggguuuauugcuuagcaacugugugguuuugguaaacgaauugggccauccuccucuaaccuuuggaaaccacacagcuaagauccagaaugugcagacaagugauggacuuucucacugauaucaaguccuuugcuuacggaaagcccucuaacaggagagaaugguugugcagauguuaauuauggcaaaaauguuuuguacuuuccaaguuuucucuguacgagauuguaaucaucguuccaggagccucuggagugugguggucacuguaugugcgccuucuuucacaggaguaauuugagaugugggccucaggcaguauuuuuuuuuuaaucucuaagcuauuaugcuacagauguuauugauauuagcacuaauguggcauaaaacaaaaguuaagcaugauaaauuaaauuuuaauggaguaauuuaaaggaaacuaaauuugucagaguuuuaaaaaauaaacguaggcagauuuucuuagggaagacuacauucugacuuuccccauucucaguuaggaaauuaaccaauuucuuugcaguuucucaacagauacuaaguagucagcaugaaaucaaauaaaacuauaauauguauauccuucaaguaccacugauuauaucauuaauguaucuuucuaaaaaucagguuugugcaaguucccuaaacagugaacacagaagucuuaaauuauaaacugaauucauuuuauuaucuuucacaagccauucguggcucugaaguacaaagugacauguccccuaggaaguuugagugaauuaguccauccacaaaaguuugugugacagagcuguccuggacacauggauugcaugccucucucuuuccaaucugacuuuaagagauuggaugccugucucuaaggauuaaugagaccagcauuguccuuccacuaaucuugcagagucuucaggucuguuggguagcucugcagaccccaagcggcaaggguucaccuaguggugucuguauaacucccuagcucagggacauuguuucuguucagucaucuaucaauauuugugaucuuggaaguuaauucacuauagccaaaacgaagcagaaaagcuggcuacaaauagcugcuggacaauguguagcuaggauagauuauugacaugggauuuccuguucugggagcugaaucugcucagugagcuuacuguggacuccaaaagguaguugaauggucugaugugucuuuccauuaaggaaggaugaacuugugucauuaauuuuuucucccuaaugaucccaccuuuacucacugguuccacugagcccuugucauccugggagccuuauccuaaugaauguguguuaacacguuacauuauagaugugcuguuuucugagaaguuucucacaaaugacuuuaucaacagguguuggcuuuuacaaaguauuugucacuuaagggaagagcuaugaggauuuuuuucuuaccaaaguccucagauuuuauacauuagcccagcauacaguuuauguuaaauugagauuacguuuacauauccugauuaaaauuucauagaauauguucagcauggaaaugcuacuaguuuucuuuaaaugaaagucuauaaacucugaugagcuacuguggaccaucuuacacauccccccuacuuuucugucucuggucuuuccuucccaauucuuaguuucaaguuaugaauuuggggguauuuuguuaggaaaauaaaagcauccagagacucugcccucucacacaguugccaugauaccuugcagucguccauuggcaggugugaacuguucuaucccccugucuucucaccuacuggaccacaucuuguguuugcaugcucucuuuugucuuuggauauccccuuuucugguggguauuuugcauccacugagaaaccugaugugcuaucucauccuuaugaugcugggcucucauaccccucgaccugcucacacgugcucuggcuccuguuaaagcuagccccuccacauccuucccauguucucuugacagugcuccaguuuguucaacaaucccauggaaacagugauggcagggccaucgaggcuccacaaggccauuaccuucucuucuccauccuccucuugucugacuugguggccacucagagcauacuucucuuccucuuacagccuuuguaucuagacuugccucuggggcauugcuguguuguuguuuucuucccauguaacucauuccauaucccauuuuccugugggaaaaaauaugucuuccuaaccucuaaugagcuugaaacauuggauaauuuuaagauuuaguucuuggaacucuccugagucuacacucaugacucuucuagcuugccaacuuuaaauaccacuuccauucuugacagauccuauguguguguccuuagcaaccaacuuucccccaacuccacccccagaagugcacguucugaguguuuaccuccccuuggcauuugguuuagcauaccaaagacugaaguccugauccccugcuuuaccagaccugucucuguucuuccuuugcauucccaggggaggacagcucagucagcuaggcacucacaccacacccugaagucaucuucucucuuucugucuuauacuaaacaugcccuggccccucuucuaaaguuccccaauugucuugacuagacugcuaauuuccccauucugcacccgccaugcaucaaccugcuguuucuaugcacaacacuuuuguuuguauuugucaaaugagaaaagaucucacccugagcuauugaacuagggugacacauagguagaauggucuugcccucugaaaagagcuguuaaaugaauuaauuaaugggugaagugaaugagucgcuggacacacaaauugaagaacagaccauagaucagaguccuguaugucuaauguucccaaauguuauuaugucuguccccaucagcccuauuguugugauuguauaguccucuuccucgucuguaacuuagcagcagacuuuucuuccuguuauugaaacaacaguuguccugcuuucuuuuguuuguaucauuugauaaagaaaaggucaauugucuuuuuaaaaagcaugucuaaaagaucacugucauuggaucucugggggaaaugacaggcauugagguaauggcauauugauccaucugggggccaccucuagugugaagaugacuuggcagagaagcagagaagcaaugagguucugcgcagggccaucgagaccuaccaggaggcagccgaccugccugaugccccuacagaccuggugaagcugagcuugaagcgaaggucggaacggcagcaguuucuaggugagaagcugagcuuggugaugggggaacaugccugccuucaguggcagccacauggugccuucucaaagucaaggugccugagaagaagccugccuuuugccuugucugacuuaaacacaacuucucuuuauuuaaccaaucuuagccucaguaauugugugcacccucauguguguguauguguucgguuguguaugggugugucugucuguucacacacaagugcacucauacguguacagaagcaaacaucuaugaaugucuaggccagaggaaaaccuagaugccauuucuccuuauuuuuaaagacaggaucuucacuggccuggagcacuucacauagccuacaccggcugacuuucuagucccaaagcuccgagucgcugccucgcaagcacugggauuacaugccugcgccagcauauguggccuuuaugcuugguuucuggguaucacaugucuucaugcucacaaggcuggccugccuuccagucauugagcuuuucucaggcaagcauauaagcucacagcuccugaggaagacacucaguguugucuucuagucucuguucacacacccacacaugcauauaaacgcauacaaagucacuguggauuuuuacauuaauuuugggaggguuuuuuuuuuuugagaauuuguuaaaauaauuauucaacuuagaguuaaacggauugucuuugguucccucuuaauuuuuauaccaaaagauucucuugccucccagcccgagaucaaggucucuugaucuugugaagaugucucaccuuccacagaaauccuuuaguuuucaguauagucucuuccgcugaggugagaaugagacaggguaacgugagaaggcucugaggcaacuggacagggauccugaaauugcagaguuauggaguuuccucacaguauaacaggggauccagacaagguguggaggaacagcagcaggugucugcaggagguaccugcaccauuggcaccauugcugucugcaccagagagggaagcacugccugggaaaaccacucggaguccugacuggaauagcauuacccagcaaugcgacacagacccuggagugaacgggccagauuugcuuauguuagcuaagcaguagcuguguucccuggcugaacugcaccugccuccucauaguccccuuuguaggcauuaaucccugcacgguagguuuuucucuuauuuauuuauuuauuuauuuauuuauuuauuuauuuauugcaaaugcuagucuucuuagcacagccccgcccccauuugcaguuuguguuuccaauuugcaauugugacaaugagcagugacagugggcccagacucuuucugucuaagccuccaagugaacagcagcugggcuuuccugagccauguagugcaccauagccuguuguccaccagaggcucccauaguacuggaaaaugucuccucugcucggucucugccuccucuguuagagaaggcaugcacaaugaagcuggugccauggcccucggugcccauacugacagcucgacccaaacucaggcuuucuauuaucuauacuccaucuaaaauuucaaagcuaauaaaacaaaauuguuucaccugaauugguaacauacauuuauauucucaagaacauaagauaaaaaaaauguaaaugugaauugacucagaaaauacuaugucuuuacaauuuaugauugaucucguauuuaguaucuacauagaacaauuacagauagcauuauagcuaugcuacucaggacuuacugaucuguucauagaggaugucagauguaaguuguucuucaggaucugcuaaauccucucuuguggucuguauucauaauacuuuuaauccuauuuuccaacacuaggucacaugagagguucucuacuuacccuccagagacuaguucaacuguucccuagugauacuaccuuaaaaaacgaccuuggcguaggauaccucuuguugggagacaacgacagugccaagaagguuuacgaagagguaagcacugguguauuuugagccgcacugaguuaucuguagacaacucuuaagugcugauugaaaaugacauguaacauacacuguguucuguccucuuuaucuugaaugaaacagcauguacgugauuauggcuaacaaucuggauuuaacucucccguuacuuucucugcccuucacucccuguuggagcccgaaagucacaucuagcacaggcuggcuucaaacucaugguaaucuuucaccuucagccuuucaacugccaccaugaccaauuuuccuuacuuuguuuuucuuuaguggcaugccucuauuguacagagcaaugggucccauaaagacuauuaaguauauugaccauauucaccccuauaucuugauuggaacgauuuaaauuuuaauuaauuucuauuugagcuucauuuuuaucagucuguauugacaacuuuuuaaggguuuuuguugugauaggaaaaagaaugaagucaauaaauguaaauaauauacuauuuucaaguguugcaguaugagacucucaggcaaaaguaguagauuauaccauugauauucccauauucuggcugagauggcuuucaaaggauuucugcuuuauaguggacauuuuaauagauaagcucuaagucacaaagccuagaaacugguuccuuuaggcaacaagggaguuuauuuggcguaaagcaaacaauaugucgaaugcacuuugaagcaggaaaaagcuaaccccucuguaaaacaaagacagacgaggguccucguucuuugacuugagccucuggaucaguggcuuccaagcugccgacuuuacauuaaaugcuacuucagugagcuaggaugugucacagaagggucucuucuguguuggaaacaucgucaacaguagcagcuucccccucagccugcucacaaagaggcacuugacucuguugcucuuggugcuuaacuguaaugucauugaauuuugaagcuauugucuuucuaccuuugucauaacuuugauuguuuuugggagaucagaaguuuggccuuggcuuuuuaugacaucauuaauacaugcaugguggacugagacuacagcauugcaaauguguauuguauagaaaagaccugcacuaggcuauaacguagucccugugggacagggugucagcuaacauacccaguggcuccuguccugcaggguuugguuaaaagaaacauuaugugucauagugauuuaggaucaggugaauguaaaaaugaacaaaccauuggagacacaagauggaggucuagagauccuuccuacguguaugucuccuccuucccacacugucuucuuucuucuccuuguaaaauucacucuuguuuuccaacucuuucuuuuccuuccuuccaguauccuucucucaucccccauuucagucuaaagagcgcagugaaguucauccugggagccaagcacaagcgaggucucaggucucagcaggcuucgagcucauuuugaccagcaucuaacugcauuucccucuccuaccuucuaaaagucuuccucgaguacacucgucccaucucagaaacauggaauguuuuucuucaccuugaaaaccaauauuauguuguuguuuauucacccaggacugcauucucacuugggugagcauacuaggaugcacagagcuuuagauauugcccuaucacacaacugauugguuuucuuuuaaaaggagccuucauacauugagaguaauguguggcacuccucuguuuuugccucuuacuuauaaacuaaugagcuguguuucccuaaccaaaguuuggccuguuguguuuaucucuuuucccaaggucauuucagaaacuaauaccaaggcuucacaaugauuuuugaguacauaugugaaaaucaguucaugauccuacuuuuaguuuuagggcuuuguuuguuuguuuucuguucuguuuucagcccagagacuagcuuuacagagguuagguagaagcugcucacaucuguaguuuuuaaaggcuccuccuacaucuccuucucaaagcucugccaccaguuugggaucccagcucagcaucaccuuugcagccccacacaccuuaugcagauacaucacucagucagugcacauuuauuaaaugcacgcacagcaaaaaccucagcaccugagcuuauugaagugacaccgaauuuaccuuucugucuucacggagcuuacggucuggggccaagucaccaguucauuuuguuuuccaaguagauccaucuucccgaugcuuucacaagacacugaucaccuuuggcuugaacugacccagaucccucuauaggauugcugcccucugaccuccauguaccccaaagcaccaugugaccauggcucccgacucuuagcgucaagccugccaggcuuccugccgccauguucuuuaaauacccuuucugcuguacccuuccagucaaaagugugcgaucugauguuuguaguuguuuuuagauuuaaguguugucuauuuauauaugcgucauaguguggcacauacuugauuaaaaagagaaaguacaugcccuccaaauaggauuuucagcucaaaugaaacauuuagagugcuucucaaauuuuacugaacugacaaaaauucuuucacucuuaguaaaauguugcuauuucagucugaucacugugaagugcuacucaugguuugguaguacccuugcauucaugaugguuacauucuaagacccauauagaugccuaaagaugaagauagcacugaacacugcagguguguuacaccucagugagccggggauauuggaacgugagcucuguaguccuuggagcagucaguuggcuaauagagacaaauacugacagcaaagucagguagcauuuacaguaugaacaggcugaaaagucaguggcucacaucccaggccagggagagcacaauuuaacauuccuucaugcuacucacagugauaacacuuuaaaccauggauucuuucauuguuguuauuuguugauugguuguuuguuuuacaaaacaagccaaaauuauuugaaacugggagccagggaaagauuuucuuuuuuugacacaggguuucucuguggugcccugguaacuuuuccuguccuggaacucacagagcucugccugccucugccucccaagugcugggauuaaagguuugcacuacuaagccuggcuuaucuucuaugcuuguauccagcucuuauuauccccuguaaucaugcagguaaaagauccccuacaggaagaacacuugauuucuuuuuccuggucugaaaauagguauaugaucuuacacagucaugugaccuguuuuggacagaggacucuuggaauaucugccuacuauuagaacuuuagauuuuguccuuuugagguguuuccuuuuucuuucccucugagaaguucacuuaugaaucguacucagaauauucuaauuuaguugccugugguuuagccucuccuguaauaaugaucuuuccugucagcauauauguucuuguccauagugaaguacuuaaacuuuuucuuugaaagaaugagucacaucagggggcugaaaaaaaugugucuuuuuuuuuucuuuucuuuucuuuuuuuuuuuuuuuuuuuuuuuuuuguagcuagggccucuagcucaggcuagcuucaaacuugccucgucucugaggcugaccuugaacuugugcccguacuguacccaccuuccccagagagcugggauuauaggauugucccacuauaccuggcuucaggaugauuuccuuaagaaauucuuugaaauauucacacaauguauugugaccguauuugcucccagcuccucccauauccaccuaucccccaacuucuucucaucuuuuucuagaauauaguuuacuuuugaucacacagcauuuuuugcuccacaacaguaauguguuuaucuuggcucaccccaagagugacucuucuagagcccugcucccacuguuaggaaucccacaaaaacaccaagcuauacagccauaacauauaugcaaaugaccuaccuuagucagacccauccaggcucccugaucucugugagcccguuugagucccagucaguugauccugugugccuuguucuugugguauuauuuguggccccucgggcuccugcaauccuuccuaaccuccuccacaggacucccugaauucugccuaauauuugccuguuggauucugcaccuguccccaucaguugcuagaugcagucucucugaucucucugaugauuaugcuaggcuucugucucagcacaguaugcagaaaugacaagcuguaggucagagguuuuaugguggguaggugucccaauaccuccacuugaggccuuuccugguuacagaggauggccagcucagacauuuugucccccauuacuaggacucuuuguuaaugucaccccuguagauuucauggaguuuucauuguaccagguuucuaccuagcuuccaaaaugccccccaaguccagucgucucucccaguacucccucccuucaugcccacacucacaccugguucuuccuguucccaucuccaucagucccaagucuacucaaggaaacaauuguauuuccccuucccuggaagaucuuugcauuacaccuuaagcucuccuuauuauuuaaccucucugugucuguagauuguagcaugauuauucuuuacagcuaauacccacuuacaugcuguguuuaccuuucugagucuggauuaccucacucaggauuucuucugguuccauucauuuagcugcaaauaucauggugucauuguuuuaacaacuuaguaauacuccauuguguaaaugcaccacuuuuuuuuuuuuuuaaauccauucaucaaugugggacauauaguuuguuuccaguuucuggcuauuaugacuaaagcuucuaugaauagaauugagcaaguguccuuauaguggauggauuacccucuggauauauacccaagaaugguuuggcugagucugaaggcagauuaauuuccaaguuuuugagacauugccauauugauuuccaauuggcuguacaagcuugcacucccaccaacaauggcggaguguuccccuuguucaacauccuugccagcaugaucuguuaauuguguuuuucaucuuuguuguuuugaaguuauuugauuuguacuuaaaacguuuggguaugauguggauucauuuucauugaauucuaggaaguguuuaauauccuucauuucugccuugacacaguagucauucuguguagaguuguuuaguuuccaugaguuuagauucuuucugcuguuuuugucauuguugaaauccagauuuaauccauugugguuugauaggauacaggaugcuaguucaauuuucuuguauguguugagacuugcuuugugauggaguauguugucaauuuuggagaauguuucaugaggugaugaggagaagauacacgcuuuuguguuugggugaaauguuuuguagguuggguccauuugguuccuaacaucugugagcuccacuauuucucuguuuagcuuagaccuggaugaccuaucuguugcugagaguaggauguugaagucucucacuaucaauguaugaagguugauguguaauuuaagcuuuaguaauguucuuuuacagaugugggugccuuugcauuuggguguagauguugagaauugagauguaaucuugauggauuuuuuucuuuaaugcguguggaguguucuuccccaucucuuuugauuaauugugguuugaagucuauuuugcuagauaugagaauaacuacaggagcuuuccucuuggguccauuugcuuguaaauuuuucuuccaacuuuuuacucugagguagugucuaucuuugauauuaagauguguuuguuuguuuguuuguuuguuuuuguaugcagcagaaggaugaaucuuguuucauauccauucuguuagccuauguguuuuuaauccauugauauugagagauaucaaugaccaaugucuguuaauaccuguuauuuugucguaguuauuaggaggaggaggaggaggaggaguaguaguaguaguaguaguaguaguaguaguaguaguaguauguguguguguguguguguguguguguguguguguguguuucuguguuucuuucuuuggguuauacuuguuuuuaugcaguuaacugccuuguauuggaguuuuccuucuaguacauucuguagagcugaauuauuuaaauuugacuuuaucauguaauaucuuguuuucuacaccuauggugauuauaacuuuuauuggguguacuggcuggcaucaguggucucuuaaagacugcaagacaucugcccaggcccuucugacuuuuagugucagagaugaaaaacuggguguaauucuaacugucugccuuuauauguuacuuaaccuuuuucucuugcagcuuuuaauagucuuucuuuguucuguauguuauuaguguuuugauuauuauguggcugggggcuuucucuucugguccaaucuauuugguguucuguaagcuucuuguaccuuuauagauguguccuuccuuaggguuggaaguuuuuucuuguaugauuuuguuaaaaauacugucugggccucuauuucuauuauucuuaaauuuugucuuuucauagugucccagauuuccuguauguuuuauguuagagaauuuuuaaaguuaacacuuucuuugacugaccuauuucuucuucuuuuuuuuuuuuuuuuuuuuuuuuuuuuuuuuuuuuugguuuuuugagacaggguuucucugugcaguccuggcuguccuggaacucacuuuguagauuuguagaccaggcuggccucgaacucagaaauccaccugccucugccucccaaguacugggauuacaggcaugcgccaccacugcccggccuuauuucuucuauuguaucuacaacagagagagucuuucuuccauaucucauauucuguuagugaugccugugucuauaguuuuuuguucauuuaccuagauuuuccauuuccagaauucccucaguuuguguuuucuuuguugcuucuauuucuauuuucaaguccugaaaaguucuauucauuuucuucaacuguuuguauuuuucuuggcuuucuugauauucucuaagggauuuauugauuuccuccaauuuuuuauugucuuuuucucaauuucuuuugaagauuuauuaauuuccucuuuaaggaacucuaucaucuucauaaaguuaguuuuaaccuuuucuugugcuuuagcucuguugaaauauucagggcuugcucuagugggaugggugggcucuguuuggugacauauugcccgguuuguuguugguuguguucuuguacugauguuaagacauuuguauuuggggucaucauaggucuaggugccauuuucuggguuugucucuuuuagauagguguuuucuucauugguuucuguuucuucucugaucucacuggaauggccuguaguugaguagaaggcuucugcucacauuaagagcuagacuucuaauuguaucaauguccuuguuccaacagggaguugccucccaaguuggaggccguaguucuggugauguguggccucugaucugguugaagguccucuggguuucaggauguuggccuggcuucugguaguguaggaggcuuaugucagagauguggccagagauagagugacagucuggaacaguuagaguuaugcugggcaggugcuagcagggugcaggggcagucuuaccugggguucaggaugcuggccuaaccucugaugggguaggauaguuccacaggacauguggguugggacauggugacuauaaaacauugauucuuuauuucuggaauuuuccauuuaauauauuugcaucauaacuuacuguagaaaaugaaguuuugauaaaggaaauaggugguguuuuaaaauucuuaaaauguaccuugaaagaguuuuuacuguggguaaaaauguauauauaauaacuagauagauaauuagaaagauagauugauagauagcuagauagcuagauagauaaugguaauaauagguaaauacaaaacuuuuuaauaucauuuuacucucaguccugguuucuuguaaaccaaccuguaucuucauguguggguuuauuaauccuguaaauuugcugcacauguaucaaaaaauuucaaaaguguggugccuaaauuuaaagaaaccaguggggacagcacugucagccacucuggugccugagcccugcccauccuccuaauccuauguaccagacaugauuccugacuguccaccugcaaaugagcaugguaguaugaaccucuucuuaguauauuucagagcagaagugguugcaauuucuucucccuaggggauuauuuuucuuguguccuuaaacagaauuguuuugugauaacgccuguccucuucuccaauuucguuaccuauugucuuguuuguauuucacagcauucccuuuuccuauguguguguguguacauguguguuuguaugaauagggaggguucaggggguugccuguguuguggaggccagaagaagauauuguaucccucagggcuggaguuagcuauagacauuuuagagauuuccaguguauuuguuauuuuuuucuuggcugugauaaaauaccacaauaaaagcaacuuaaguaacacguuggcuacggugggaugaaugagagagccccaaaguucauguaguuuggcuugcaguuccagauggagaguccgucaugaccugauagcaugcuaugguccgagaaagcaccguggcaagaagcuggcuugucaugaacgagaaucggaagugagacaaggcuggaaacccucaaacccucuccucagaaauauacuuccucuauaggcuugacaucuugcugaaggauugauagccacaacggcaugaauuaugcaaacaagugagccuuugugggcauuucuuauucagagcacccuacccagcuuguuacauggacauuaggaccugaacucuggcugucaugauuaaucagcaaguguucuuaaccacugagguaucuuugcaucccucgccccacaugccuuuuuauguuuucuuauucucuuuugccuugagugucuuugccccguuggucccugcuuuuccuuucacuggugaucuccacacucccagaugucucuaggaccuuucuucuaaucacacucaucaugagcauguuggguguuccuccccugggacgaacaugccucugcuuguuucugggagcucuugugacaucaguaucuacugaacaugcauuucuuguacuggauugagagcccuuugagagagaagaauaucuuauuccuguuucauaucugggaccuagaggaauuugauggguuuugaaauccuagaaaaugcuuccauuugauagcuacuugagaugaugucugugugacugcaguaggcaggggugucaucagugaagugcaguaauuauaacgacuuguuuguagcaguucaggcagaaccaugaucaacacugauucuccucaguccuggagguccguucucagcccaaggucugguuuagggccugucagcugaagaaacagagcccaagcuuacagagauucuucuaggaaggagagcccagcaugcaccaguccaugccuuuaucacaauuuacugagaguuccccaucaccaggcucaagggaugagacaugagugaagcaaagucccuguagcgcuuaccuguuagaaaaggaacaaagcauccaaacgggucagauggugauagguccugugaaacacagucuggauagauaacuuggagagggcaccuagcacggggguggcuauugcccaagcuuuuguccccgccggcaagaacacacucaggacaaccagaaucuucugcagcaaagcuuuuacugcuugcuuaucaggagggaagaccccaaaccgggaaaauggcgcugcuuauauagcccgcagugugacguuucagcaccugauguggcgugacagcuccugauucguugcucacccaucaccccauuacuacgcggcgagaugggcagugacuaggcgugagcucacucuugcacuugcacauaaggcuuguuuacuaguuaggcgcaguggaagccagagccaucuuauaauggcgauugcucgcggcacggcucuccacagguggcguugguuuucagacugggagauagacaggggaggaaugcccuggaauagugugcacaccauccuucucccacaaguaaagagaugaccuacuuggaugcccuaggaaagagugagccaaaggaguauugugaggaugacauuuuguagaaaaggugccuuuggcuugcuauaaauagccaggaguccaacgugccucaaagggaugacugggaggggcaagagcagagcuggauagguggaggcugcagaagugguuccuggaauguaaucguuaaugcugaguaaaaacaaacuugaggaaggaucaggucugacccccaauuuaaaugguuugccugggagucccauauggagaaugaauagcaggggugcaaaguaucagccacugagggguucugcaagagggugugaaagaggagguuugguccagugcaguagcggguagcaugcugagugguacccuucuaaauaggccuuaaauaggcacugaguccaaugcggucaugguagcuucuugcuagauagcuugcucuuccucuguaaagcgcccuugguagcugugacuucaccuucccuaauuggcucagggauagagaggagaggcacucaggcaucuucucccugaaaguaccacucgcaccuucuccaucuucuucuuuguucaagaaauacauuuccuaagcagcuucacuagucuaaugcuuuuguguggauuucucacuguucauguuuaauuuagggcugauuuugcauaauucaucuuuaauucauaauaaaugcauguagugaugaacaauggaccagcuuauaugaaguagccaccuggguuuuuaucacccacuuuuuuauuaggauuauuuucaccaaauuuauauucagcacuuaaaaaucauugcacucccaggaacuuacuuucauucauaauuuuuuaaagcuuguuauuuugaaauaaucucagacuuccaaaaaguuacucaaguaggacacggguuauauucucgggucccuagccauucugcauucaaccccagcacagaauuacagaauuagcaccugguagcucacuaggccaauacucagguucugaucauuuaccaguccccaggguugcucuucaacacccacaaggcugcugugucaagccuguaacaguuccucugguaguucccacuuaaauacccaugggaaaugcaggccacuguuugcuuagcugccaugccaggcagucauuuaucauucaguaugguagccucgggagcaaugcuguguccucugcagugauagcugaauagggucuguacuaugacagauguccuuuccacggugauggcaauggcccuguaaugcucuuauaguuaucuuuauggucaccaugcaucuguaacaguuaggaauguuuucaugucccacucugccacuaacuuuagugaccauggacgaauguuuuagugcaugaggacauccuaauauguugaagcauguccguaaagcaaugugagacaacccuucagggucgucuugaagcacaaagaaauucagagggauuuucucuaaugccucaacaaccuugacgucuaucaguggucaguauguggucacagccaugguccagcaguaacuacauucucauucacagcuguagucaguaagcacgugugaagggcaucuugaguugguuggccauggguuuguuucguuuaaugguagcggugagacaagacgcucccacaguguuugaagcuguaacauccugauccaccccgaguauggcagaacuaacuaggauuuguugugacagucacuucuacagucucuucucuagcacagucacucuuugcuuucuuugaauucaggugcuaaaugugacaccaaaugauggcuucgcuaaagugcauuacggcuucauccugaaggcacagaacaagauaucugagagcauucccuacuuaaagguagcugccauggucuccuucccauauacucucuucccggaguccucugagguccccuuugguuguggcuuccaguuauggcgucuaacugauuggcaugacucacugagucuuccuagccucagagugcauguaucucaggcaguucauacaccugacugaaugucagggagagaccccaacugcaugagcuacuuugguaucaugguugccaaaauucucaacagaaaccauguaaggaaagguugauuuggguucuuaguuucugggaggugcuguguuucauuguggggauggcacagcagagcucgaaguggcaggaacaugugacaguagauuguucaguuuuggucuaugagcacuaaugaaagaccaagaguggaggguagagcagaguaaccgucaaggcccaccccuggugagagaguucugcaagcaauguucuacaaacucccaaacaguaccucaugcuggagacggaagcacagaggcaugcaggagacacuucagccuacaacaauaacagcuugagcagacacuauuugaaaaacaccuuagggcuaaugacucaaaaucuuaaaauauauuauugcguuuucuaccauauuaaacugcaguguggauaguucaugagagagagagagagagagagagagagagagagagagagagagaaagaaagagaggaaggaaggaaggaaggaaagaaaaaagaaagaucacuuauauuuauuguucacacacugaauaucuaaaccauggcuacuguaacugaggaagggaauuaaaguuuaaguuuaguuugcuuuuguuugaguaggaacaauaugauggcuaaaaguuugacccacuguaaaggagagcugcuguauacauagcucauguaugcaugagaguuuugaacccccuuuaugauagcaguauggcuggcuucugugacuucuucaaacaaugcuuauuguugcaauugcugccugucuuaagaaugcccacacuguguguggucaggcacacuucuagcuuccuaucuggcccacaacccuggggcauagugcugagcaugaugccccucuagauggcuuauauucccaucugcccugccugucaucagacacugcagaccuuuccauuuuaccagggcugugugggcaugugcauuggucuggcuuaaagugcgcucacauugucuucaauucuggaggccugauaguauucuucuagguacaacagugggcaagcaagcaagagcuagggcagacauuuaacaaauaaggauacucuacaccagucagucuguuuuuuguuuguuuugguuguuuguuuuuuguuuuuggcuuuugguuuuuugguuuuucgagacaugguuucucuguauagcccuggcuguccuggaacucacuuuguagaccaagcuggccucgaacucagaaauccgccugacucugccucccaagugcugggauuaaaggcgugagccaccacgcccggcugucagucuguuauguuagaggcuauuuuccaagacuguacaaauagcaguucuucugagagaagauaaugaucauauauguuuucuauucuuucauauauauacauauauaugaacaugauauauuauauauugcauuuuauacauauaacacuauauuauuaaucuuaauauuauaauauguauacauaauacaauaugguuuuauuaauacuaauaauaugacaauauuaauaauauuaauuaauguuacuuaaauauacaauuuuaaugauauauuauauauaauaucauaaaguacaacauuauacuauuaauauuaaugcuacugcaauauuaaugauuuuauugauauuauauuaauuaaauaauuaauaguaaugauauaauauuauauaugaaauauauuauguaauguucucagauauguauauauaugaaagaauagaaaacauauauggucauuaucuuuucucagaagaaaugucauuugugagauaaaauagauauauauacacacacacauauauguauauauacacauauacguauauauauaaccauggguauguacucauguguaugugcauccacaucauguacuuagaggucagaggaugacuuacaggaccuggcucucuccuugcaauauuugggaccuggagaugaaaaucaggucaucaagcuuggcagcaagugcccucacccacugagccaucuugcuagccuuuccuggggcagccucaaagaugucguuuaugaaaagaauaccugccauuaaacuauuucacauuuuuguuuuuuuuuucuuuuccauauucagucucaguauuuucucuucccguuuuacaauaagaaucucauuuccagugcuuuuauggagagagggaagagcagagcaauucauaauagaagcuguucaguaaaaauuaccugugucaagauuccaguugguguuggcuugaauccuguaaauguuaguaagaaguuucauuagcugcuuguggcacauuuguuuaggguagaaaggacugucacguacacucacacugucaucccuugaaacacaagcaaaacaguguuuggguucaggaauaaaagacuguagguggcauauggucagacuuggagagcaaagucaauguggaaaaacccagccagggaaaccaucugcagcccuggaauaugauagcuccccuguggcaguacagcgugcuugcuaauuccugggcuaguccacuagcgguuaaugauaaccuugucguuaaguuuagauuaucucauuuuauguuuacauguaaaauguggaccaaacucaucaucuacuuuuaauaaugagacaaaauuuucaaggucuuauguuuuccuaugagauguuuuuguucauaaauaaggaaaaucuacagaggucaagggaugagacccccaaaugucacccuucacagaugguaacacuguccuuuuccaggaaggaaucgaaucuggggacccuggcacggaugauggccgguuuuacuuccacuugggggaugccaugcagagggucgggaacaaagagguacgauuaacuggguuugugacuuuauuccaauagaugauaaacuaguggguggggacuuuuacugcugggaaucaguuagaacuuuacaaacguucuuagcguaacuuaugaagccaauguucuuacaagaucuuugggauuuggauuuuacaguuuauuuuuuccaguugguguuuucagauguguaaucugaaaagcgccucuuuuuuggggggggguguguuuguguguguaucugugauuguuugugugucugugugugugugugucugugugugcaucugagcgaguguaucuauguguguagcaaaagauaauugccuuugaaaaguauaguugaaauuaagaaauacagaguucucuaaaauugauuuaauuuuuaaaaccauuuacauauuuaauguuuuacuuuggaauuucugcaguagucauuuuuagaaccaacuauuugacuaauccuuagcauaguggucuuaacguuuaaccauguacuuuucauuuucaauuuaagcugaacauuuauagccagggcaguggcagguaccaacgcaaacaugcauggaugcaguaacugaaacaagugaauuuucuuccugaucauuaccuuucuccugcguacaauugucagccuguguaaacaugacaucagucgugaggucauguaccacagauuucuagcccuuuuaugacccccaugauuugccugccaauaaacaaggccuaccucuuccgcccuauaccacuguagaaauucuacuucagcugucuucagagucugaagauaaaaacaccaacacaacagugacccuuuguaaccacugcccuucauaugugacaccuaaggacaaugcagcuucaaauuucuagauuucauaagaauauaagacccucugggcagcuaggggcucagagaagcagugugacugcgcagucuccugcaagaaacaggaguuauuccgaguaguagcacuuugaugauugacacuguuuucuuucuaccuuucuauucauguguaccuuccuccuuuaaccuaccaaucaucugacuaaaauagaacgacgcuagaagugaagaggaggggaggcguugcugacggcagucauuauucuguaccuuccugcuguaaaaagaacccuccuuuggaugaggagggcaagaaaaugucugccacaguagccaacacucgggaaaagucuguauucaauuucuguaaauauaauugucacuaauuaauuugucuuugaacauuccgugguacagggcaaagacagauaaaagaaaucuacuuuaucucauaucuuagaugaaaacagcucuuacuucaaggacaaugaauucacuacugaacacuuguuaugagccugguguuuaagccuaggggcuguuauaccagcauaauuaucauuaauaugcaaagaaccgcacaguuccugaauuuggaaaguucauaaggauucaugcuuacacagaacagaaucaagcccauagacaccccauguuagcauaacccaauacuaaguguggagucugcgucagagcuuacccacugggaagcagccgcccucugcguuugccucuguggagcucacugcuggucugagagaggacgcacacaacugggaggcaaacgcacagccucugccacaaagacugcugagacaauggaucucugugacuauuucugguaguauggaggagaaagaggaagacaacccacggcagcccuggagcagccaagcuucagaggcuucauaucgaguccacauugucuucagcucuggucucacucuccacaugcaugcucacacaucuccagccaguccgagggcacugcauacugcucgcacagcaagcucccuucuccucuccgccauuuuucuuuuagauggucucagguuccuuuauugccaacuccugaaucaaaauugggaucaaccuuagcuccucccucuuucucucccuuccugagggcaaguuccaaggaucagaauuccugggcucaucaguagccccccuuucuucagggcauguuaauuccaguuucucaucagccaccucaguaacucguaagcaccccacuguuguuucuuacguuaguuacacuuucuguccagccaccuaauucucaaaacauuugugauucaaaauaaaacaaagccccauuucuaugcaaugucauuuauaguucaacacagguaaauuguaaccgagugcuauacccaaaauguaccaacacuucagacaggccagcccaagcugagccucucaggacagaucuaucacacagauuucagaauuagaagcuuucaguguguguguauguguguguguguaugugugugugugugugugugugucugugucugugugugugucagugccugugugucugugugugugucagugucugucggugucuguguguaucugcauaaagaacacauagcaauaauuugacaaaaauagaaauggcauugauguaaaauacauuuaaggagacugggauguagcacaguuccucgauugccugccuaguguuucuguccccaguuccacaugaugugggugugguagaacaucccauaguacuauugcucugaaaggaaaggcaggaggaucagaaguucaaggucaucuucagcuacacagcaagucugagacccaccugggcuucauggcccugucucaaaaggaaaaaaauaaaaaauaaaaaagaguacacaucacauucacaaguuucuuauuugacagaauuuuuuuuuagaaauuuuuguugucauuuuaugugugugguuuuuaaaaauaaucuagccuaauuuguugaaucuauucuauauuguaugaauagaagcgauuuucauguuucuaaucuaucauugugaggauuuuauuucugauuaacaugacgaggugagugccaauucaaggcuguuguuaagugcauggugcuuacugcgccucaguacgcacagaacggugagcaggcugcacagacagugugaccagguucccuaagaacccaccucgccccagcacgcagcacagcgcagcccagauguaagacccugaaggcugcagcaggagccacacugccugcaauuggguuguccuauaacuacuguuuuacacacuauuccgucaauauggcuagucuuuccaaugaauuacuaaugauucaaaaauuaaugaacuaccagacuuugaaaaggcaaaaagaaucauauguuauaauuaaugguguucagcugaauagcagaagguucaggaaauaaagucuugaauucaaauuggcugacaccauaaugaucaaauuauuucaaagaugagucauuuuuucuuuucuuuuucuuuuuucuuuuuuucccccugacaucaguuggccauuuuaacuuucugcgcuuuaaaaaaacucuggacccaacuuacauguuuuucaagggaaauauauaagaaguauuaguauguaugcuguuugagauuuuaaugagaaagauaauuaagaauuuuuuaaugguuucaagaaauauuacaaaaggagaaagaguguguagcugguuuugaggggccuugaauucuaguuccaagaauggaggcauuauaacucucaguuucagcaguuacagaagggagagauccgggcugcuagaaagcucuggugaggucauuuaugucaaaggccaauuguggagugauguggaaaauaagagggcuaucuacacacccuuuacuguccugagcaagaaaaauuugcaacaugauuguuaaauacuuucaaagguuaauaauuucguacauuaaacuaugaguuuauuuacugccaaguuuuuuuauaauaaaauuuaaagaagcugguauuuucuauguuuaaauuauuauaucuggaguuuuacaaagaagguauuuaaguuaacaugaaauucuuuuuauugaucaagacauauucauucaaucagguaugauagcacaugccuauaaucuccccaaacaggaagccaaggcagguggauugcacauuggagguuacccugaccuauagaaggagacacuguauaugacauggggagggcugcacauuuuuuucaaaaucaguucucaaaagagcaauugguagauuagaacuagcaguggaagagauggcacucagugugcuacuaaaaaacucuccucuccaaagacaaugggcauguagggcaggcaacaugagagcagggccaccuaugggcauauaguguauccucauuuggaccagccauauggaagaaguacugcagccagauagccccccauccccccaaaaagcuagucuuaaugccauucguauuaugggagccaacaugaagccaugaguguugucccuuauugcagaaaauguacacacuccaugaacaaaaguuuucuguuaaaaagccugauauaucguacaauguauaucauagcuauaccugccaugcuauuuauugccagcucagaguaauauuuccuuuuuaucuguucugucaucgugggaaaucaaagaaaguuacuaggaaaauaaauuuacucuugguugguuuuuaacagccuguuucaguaaauagugaauguauuugaaauuguuuaaaucauaauccacuccuuuuagagaaaauauaaaaauggaacucacaaaaugaaagcuaaguacaagcaugaccuccuuuggugucuaacacugaguguauacacaacaaauuauguuuuaaacuggcuuagauguguggaaaccaaacuaggugaggcaugaguccagugaaagaccuccguggggauaaccccacccgagucacgagauagcuagcgugcauccaaagaaucacgagagaccgucuugaugcaaacacacgagguaguuuaaugacggagcuccgggcugacuuguaauacacacaggagacagaggugucgaccacaaggcucaaaaguuagggguuuauauaggaaaagaguggggguaggagaagaauuggcacagcuucacacaauuguacaguuuaaacaucagcaaacuauacgugcagaucgagguaacagcagaacaucugguuaacauuuaacccaugucagaagggugggagauagggaggcgcugggccagucuggacauucuuguaugucuucccuaucuuuauggcuaguuggcuccugggaugacuuuacagccuuuguucuuugcucuaggcccaaaaagcccuccuaacuagcaagccgcaugaguuaugggccuugaauuuuaauuuucuuucaccagaaccacagagcugauggccugagagugaagauaaaugcuagcguguucacucaucccaacagcuuacagaagcucaguuaaaaaacagaaguuucaccagcuaucaucagggaagaucuugauuuaauuaucucaagguacaguuagucgcugaauuaacaaaggucauaguuguuugaggcuuuucaucucuguagggugugaacucagucugcauucaauagaaaugacacuucagauuuuggcuuuugagcucuucucagcagagcaccauacucugugcugcugggcagugaugcugaucuguggcccugccagacauacaucacaggggaaaccagggggcccucugcaagagcgcugaugcugaagacagauguucugugccuuacgaggaaauagauuuucacuguagaauauuuacagugggucugcaugguggccagacuacaucucaagaaacaucuguacuagcuuaugugauguccuucaauuuugaaacaaaaauguuuucuggaaaagaacaauaugaagcagccuuucuauucuuuuaggcauauaagugguaugaacuugggcacaagagaggacauuuugccucugucuggcagcguucccucuacaaugugaauggucugaaggcucagccgugguggacacccagggagacuggcuacacagagcuagugaaggugaguguuaacuuccacagcaacccauccaaccuacugaaaccacaggugaggaaggaauguuagagaaaagguauuuuauuucuaguaagaaaaucuucuaacugaagccuucugacccaugcuaccaucaucuguccauuucugucuuuccaaugcuagcucauuaugcucugagcacucacagaccuuuccuaaccucaaacugcaaaauccugccacaguccuucccaauacaacacagucaucuucaucacagcaauagccugcuucugguaccaauuucuggccuauuuugccuuuguuggcugugauaaaacacugaccaaaaacaacuuggggaggaaagaguuauuucaacuuauagguuguaguccaucaucaagggaugccagggcaggagcucaagacgggaaccuggaggcagaaacugaagcagagaccacagagcaguucugcuggcugcaccacuccucauucucagacugccugucccggguggcacuguccauagucagcuagauccccuucauaaaucauuaaucaaaaauaauaauaauaaaaaaggcacccaucaaucugcucaugggccaaucugaagaaggcaaaucuucaauuauggauuccucuuuccaagugacucuaacucaaaguauugacaaaaaaauagcccuugggauauuagaugacaaggaaggaaauuuguguggaauaacaguucucagucuugcuacccuuuguguucuuaaaaauuguugagcuuuguggggcuuuuucuuugggugggagguggugcuauuccuuucuauagaauaaucacaaagcaaaauugaaauauuucaguucuauguauuaauucuuuaaaaauaaccucauuauauugcaauacaaaugauuauauuuucauauggaaugaucuucuuuuagauguaggaucauuuucauauagaaucaaaauagaaaauguaaugagauugaaaugaugacauuuuuauaagucucguugguuguagagugguguuguuagauaucacacaacccuuggaaauuccucucugugccugagcccaagugaacaugcaaaaagcuacauguuccucuguauuaucuagaaaaucguuuaggccuuucaaauuccugacggguucagcaucucagguauugcuggacugaauuuugagaacuuuuagauuugaggccacagaacaagaaagcaguuauaaauauuuuauaaaagauaacuggaaaacagaagcaaaguucuucuaacaacuuaagagcuauaaaacacgggaauguuuuacaucaggagauaaaaucuaaacgcaaauucugugugauuuuguuagcaauuggugagcuuauguuugcuuaaaguaaauguguucuuaggcucauuaguaaaaugggacuggguuguugauuuacuaacaauuuguuuuacauuucaaaugagaaaaaugugugucauuggucagauggccuucaucaauuuguagaugaugguacauucugguuucccaauaacuauggagcuuuuguaggaggagacagacaagggugacaaacgcugcuaauucuagaaucuggaugaugggcguggagaagcuccaugccccuucccuuuuacuguugcauguauguuuuaaauuacucacugguuugguuuuguuuugcuuugcuuuguuuuuuuguuguuguuuuuucgagacaggguuucucugucuaucccuggagcuugcucuguagaccaugaacucagagaucugacugcuagucacauguuuguaugaaaaaacaccuggaacaaaaugucuuuaagaucugcuagacuugauugaugacucuggucugccuaggaggaagagcuacgauacuuuuccaauguacuuaggagacgggccuuauuugaugguuuguucuuauuucauauaacugcauagcuuauaaucauguacuccaguguuaaagccagcuucccuuccucaugcuuucaacacuuggucagucaggaaaaagucuggccaugccaccccugagcaggaagagcacaggaacaucucugugaauccucagcucuuggugcugucccucauuuguuuccucaucaaacuccaucuucccuccaaccacucacugagcucugcagaucuccuguaucauucacacgucccagacucugaaaguugggggaccugcugcagauuucaagugacagaaauaaaacucaaagauugcuuuaacaacagggagccugguugauugccauagcugaaggcuuggcauuaggacagaugucaggggagagcaguuaggaagaugguuucuuggcccuuacccuuccuccuugcucagcucuguccucagugugggauaguugucagcagcacucagacuggagcugagaagaguaaaagcaccauggggccaccacacaaacacuagagacuucugggaagagccguuccuguugguaacaacauggcagaugggcacuccccguacaaggcagcaugagacacagaguagcuagcuuccuggcuuccaggagaagcuuuacccagagcacuggucuguccuuccagucugacugagcuacuuugaagggcaaagacaugugaaguugucccaaaaccccaauaaauacauccagaggacuucuucugaaaugaguggcuuaucugggggagaugggcacccuaacagagccaggguauauuuaggaaggucgccuacaguguuggauacccuugucuguuggcacacacuugcacccaaauauuuuucucaguucuuuucuuucaauuuugccauuaauuuuuaaagcuauuuucacuuuuuugguuuaucuucuaugaaagcauugacuagagcuauacuaccaaaaacacuuaccccucugaauguuaucauuuccuaugaagacuugcguaccauguaaaccccuauuuccuauaccuuucuaacaugaugguuuuagccagggucuugguucauuucugauguuauaacaaaaucccacaaacagaaugucuuggaggcaacacagaccuaguuuucaagauucuguaucugagagaucuaaaaugagcauaacaauacuuggugucugggaagagcuugcuuccugguucacugaugacaucuucucacugggucuucauauagaggaagagaaaggcaacauugugucuauacauuacuaaaacuaguauuaaacuguauuaauuaaauuaguuuuaaaauuguauuaagcuaaacuagauuacuuuaaauaaagugcuaauauccacuaagcuuuuuaaaaagaaaagacaggcauuaacaaguguugguauguagauggagaaacagaaaccuuugaacauuuggauguguacagggaaugcuguaaccacuuuggaaaauacuauuguugcuccucaaauaguugaauauagagugaggguauaaccuagcaguucuguucuaguaaaaucaggguccuucaaaaugaggaguauauagauaaauaucuccgacaauuagaagugaugaaguccugacaccuaguccaacacagaugaaccuuauaaaaucaugcuaaguaaacaggcuagucacaggaagaucacguuauaugacuguuucacaugaacuaucuucucuaggcaaaucaacugacaaaggaaauagguagguguauuugagaguccgaaugaauggaugggauaauggggaguggccucuaaugagaaagggcuuacauuuugaagugaaaucuuuaaaauuaaaauguuaaugagucuuccacucugagucuaguaagccccacugccugcuuggguuuccugucauuccacuagcuauaugcacagacacuggccauauugucuauguuucaguuucauuaucugcaagaugcaugggacguggcauucacucugccuguguacugaagauuucauaaguaggaaugcucaauacacauuaguuauuaguacuauggugguuguaaucauaauuacgugauucugagcaucucuaaaagcaacuauaaaguuauuuugaaguauccucuauuauuggaauaauaauguaauaauuaacauccauuaaaugcugccuaccaaccaucaaugugaugagcacuuuuauguaauauuucuaaucuaauuuuuauagcagcucuaaaagauuauuacugacacguauaugaaugacauaaggcugagagaagcuaagacacuugccuaaguucucaucucuaguggugucagaacugagauuugaauccacguggccuuaaguccauguccucccuugugcccucugauggccuucagaacuguugacauuugcucuuaggucacaugaucuucuuuugcuaguucaguacuuaauucaguacuuaguucaguacuuaguucaguacuuaauucaguacuuaucacacguaacugagcuucugaguuuuaucacuugaucuguuucacgcuuagcuuuuuuuuuaaagaaggaauguagagccuggguguuaguccagcagcauagaaucucagcgugggugacaucuugcagcucaguucgaugugaaacuauuucaccuugcuaccuuagcuugcagaaauauuaauaucguacauggagugaccuuuuaaaaugaaaacagcuuuaaaaugcugucaguaaugacuaaucuaagcaauaacaucacuauucaguugccaaacauacaucaagaugaucugccauuucaaaauuccagauuugacuaucccgagucacccagccauugauaucuugaaauagaaaucuucuagauaugguggcugucacauuugaccaaaaugcuuucaaaauaauuucuuagagugucucuaaguccuuugagugacuugcuuuuaacugcuugucuucagucaggcuccucagugcucagagacagaggaacauuuccuugcugguugagaugaagcgaagggaagugcagcccugaguuacagccccauuuuguugacucguugaccuuuacuguggagccuauaauucaggugcugugacacuggguuuauaaaucuagauggaagaagcaaagaaaguguuaacaacaguauuuucucuuugggauauauuuccauuaaaguuggcagguuguugcauaucguucagaaauaucagagugccaaauuccugagagacauuuagcuuaaaaauuuauauaaaaauggacuaauaaucccuuucguagguugaaaauagaaaacauuacuuguaccccacucucugagauuagcaacuuguugagauuagcaguuugaucauggccaguuuagauguaaacacccaugaauagaaguuauauuagcacauuccaaacccagcagcgaagagcagcugaagcuguagguuaaaauaacccucuggcaccccccccccacacacaccacacagacacacacacacacacacacacacacacacacacacacucaccuccuugcauucagcacuaggaaaaacaaaaacaaaaaaccucuugcauuccucucugaacuucagcaaacagcaagugggggacguuugccuuucuucccaguguggcuuuaucucagcuggagaaguuccugggaacacugugccguucccaggagcacugugccguucccaggagcacugugccauucccaggagcacugugccauuccugggagcacugugccauucccaggaacacugugccauucccgggugcacuguacuguuccugggagcacugugccguucccgggacacugugccauccccgggagcauugugccauccccgauugugcuauccccgggagcauugugccauuccugggagcacugugccguucccgggagcacugugccguucccgggagcacugugccguucccgggagcacugugccguucccgggagcacugugccguucccgggagcacugugccaguggugugacccugcgcacaggaaugauuauaguaaaaacucaguccuguuccauucgauguugcucuuuuaaaguacuccauagugaaugaaugaccucaccugggcggaacaaggaaucacccaguaauuauuauguuagggcucccacauuucucucuccgugauuaaauauuugaacggucucaaggagcuugcacuugcuuugaaaugaaauggauuuaggaaggaaaaaaagaaugucagauuuaguguggaauuaaggcacaaaugaagaggauuagcaguuuuacauauaagugaaggcugcaauguggaggaacaacaaaagcaauuccuuaagcuuugcauaauaguguaaucuuacuguuuuaaggcacacuucuaacuuuuuggaccauagugauaucuucacuaaaaauggcaguagaacaaagaugaggugaaugacugagagccaugugcuuaaaagugagccuuguaggaggaggcccccuguuagagacagagaaauguuuggucucuggcacuccagagaaguaacugcauucagcugagacugcuucaucucuaaauucaaaauaacuacuccuuucuugcaagguuuuguugagacucaaaacauaaaacaaggaaacccauggccuaggaugucccuggugcaguuuagaugucccucuguccuaagacuaacuggagcuguacaccaaaaaggccagccugcaaaagucacagagggcuaggcucaaccacagcuucuaacaccccaacuaaagagccaauuaagaaugagauacugagagauuucaucuacacgcauugggaagaagaacggaaaaagggucuggggucuccagguuuuauccuugggguccugacaugagcuuagguagacucuuauugagugacuuacauaccuauguguagauguaagcgguggguggcccaguguaaagcaaacucccugccuuuauccugccuucaguugccuucuaggccgacaugaggagucuuuucagcuaaagcugcuucuaauggccccuuuaagauauuuaaaccaagucuggcaaagaaaaagauauugauugcaucaccuuugaguuauuuuaaaccaaaaggcaacauuucuuucacaaaguaaagugaguuuucaauauuugucaacauggggaaaauagcuuuaugaggggggaaaaagugcuuuugaggaacacagugcagcauuugaugugucagaaugauugucuaugguucauauuucauuuuagguuuaaaaaugcuuaagccagaaguucaugcucuauggcuugauauacauauguaaagaucaacaucuugaauguacauaugcccaugcauauguucagaugucucauuuacccucgaagucccaauagcccucaaauggggguaauaugucaaauacaaaggcccaaagacuaaauuccagaccaguauagcugugauccugaggccuacaagagccugccuggcaagccagccucacuaaaguaaccagccaaugagagcagcucaguauaaauuagacuugcagaagaccacacuccuauguuuggcaacaaucuagaacacuuggcagugagugacaucuguaacauuagcccaaaucacagagaucugacucacaaauaacaccuuuccuggguuuugucuaucguucuaacaaccagaaaaagccaagaaggaacuucuaacucagccccagcagacacccuccuugucagauguuucauagucgucccuugacuccccaccccacccccaccuuaccuaaacacuuccggcuaagccugacucccuccaagcucagaauaaauggcuucuguuguucuuauuugacuggucuuguuuuauuuucacaauaagaaaugauagcuauuuuucuuucaucuuuauagucaagcuuagaaaaacagagcuggucagaaugcaucagggcuagcaagaaauuguuccuuugaucugcagagguuuuauuaaaauuacugcacaaagaauuugcucugagacucuacucgcuguggccugggcucugcucuacuugcucagcugugccccaccccacuaagagggggggcagugccuccauguuacugcuguuucuaaagccuagcacauuaccaugccaagguauaagacaacugauuuuaucucuaaaaagguagauaacuccugaaauaagauaaaaugaucacuauuuccaaaagaagauauguaauuccuaguauaaacccuagaauuauuccuaggacauuaacuaagauuggauauauguauucaugcacuaugggggucaguccauucuaauuccaugcuguugccuacacauuccuuugaccacaucccuucauuuaguuuacuaccaguucuuuuuuuauuuauuuuuuuuuaaauuagguauuuagcucauuuacauuuccaaugcuauaccaaaagucccccauacccacccacccccacuccccuacccgcccacucccccuuuuuggcacuggcauuccccuguucuggggcauauaaaguuugcguguccaaugggccucucuuuccagugauggccaacuaggccaucuuuugauacauaugcagcuagagucaagagcuccgggguacugguuaguucauaauguugauccaccuauaggguugcagaucccuuuagcuccuuggguacuuucucuagcuccuccauugggaguccugugauccauccauuagcugacugugagcauccacuucuguguuugcuaggccccggcauagucucacaagagacagcuacaucugggaccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccaaggguguuuuguucccacuucuaaggaggggcauaguguccacacuucagucuuaauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacggauuuccagagugguuguacaagccugcaaucccacgaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauuauuuguucaguucugagccccauuuuuaaugggguuauuugcuuuucugaaguccaccuucuugaguucuuuauauauguuggauauuaguccccuaucugauuuaggauagguaaagauccuuucccaaucuguuggugguuuuuuugucuuacugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuugagugucucugguuuuaugugaaguucuuugauccauuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggacuacuugucugucucuauaccaguaccaugcaguuuuuaccacaauugcucuguauguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugggaaggguguuguuucccuaauuucuuucucagccuguuuauucuuuguguagagaaaggccauugacuuguuugaguuaauuuuauauccagcuacuucaccgaagcuguuuaucaggcuuaggaguucucugguggaauuuuuagggucacuuauauauacuaucauaucaucugcaaaaagugauauuuugacuuccuccuuuccaauuuguauccccuuggucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucaauauucauaagagaaauuggucugaaguucucuaucuuuguuggaucuuucugugguuuagguaucagaguaauaguggcuucauaaaaugaguuggguagaguaccuucuacuucuaucuugugaaaaaguuugugcagaacuggaauuagaucuucuuugaaggucugauagaacucugcacuaaacccgucugguccucggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucuuggagguacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugauaagaguguuguucaguuuccacgugaguguuggcuuucuguuauuuuuuuuguuauugaagaucagccuuauugcauggugaucugauaggauacaugggacaauuucuauauuuuugaaucuguugaggccuguuuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugagaacgaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaagcagcaaaauguugggucuuguuuguguagccaguuuguuagucuaugucuuuuuauuggggaguugagaccauugauguuaagagauauuaaggaaaaguaauuauugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuaaccuuugaagggcuggauucguggagagauaaugugugaauuugguuuugucguggaauacuuugguuucuccaucuaugguaauugagaguuuggcuggguauaguagccugggcuggaauuuguguucucuuagugucuguauaacaucuguccaggcucuucuggcuuucauagucucuggugaaaaaucugguguaauucugauaggcuugccuuuguauguuacuugaccuuuuucccuuacugcuuuuaguauucuaucuuuauuuagugcauuuguuguucugauuauuaugugucgggaggaauuucuuuucugguccagucuauuuggaguucuguaggcuucuuguauguucauagguaucucuuucuuuauauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauugugucuacugcccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuuuuuuaagugaguucuuaaaguccuucuugauguccucuaccaucaucaugagauaugcuuuuaaaucuaggucuagguuuucggguguguuggggugcccuggacugggcgaagugggagugcuggguucugaugauggugaguggucuugguuccuguuaguaggauuccuacguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugcgcagauaucuuguuuuuggaccuccuccuggucgaagaagaaggcccaaaacagggccuuucucagaagcuguguugcuuuggcaguucccagaagcugucagcuucuguggugcagacucucaccugugcagacuaaauuccuaagcuccagggaguccuggaaccaagauggcgaccgcugcuccugaggcugaggccgucucccgagccaggcggacaccuguccucugguccggacaguggccggcugucugcagccugcaaaggguacugccucagcggcucugugcuuccgccugucccagaagcuguccgguucucuggcgcacccucuaaccuguucagacuaauuuccuaaguucugcugaguccuggaaccaagauggcgaccgcugcugcugaggcugaggccgccucccaagccaggcggacaccuguccucugguccggacgguggccggcugucugcggcccgccacgggugcugccucagcggcucugugcuuccgccugucccagaagcuguccgguucucuggcgcacccucuaaccuguucagacuaauuuccuaggucccgcggagucccggaacccagauggcgaccuacuaccaguucuuguugagguccuugguaucacuagaacuuucucaacugcuuauaugcaaucucaggguuuuauuucacacuacuagucagcaaucaucagagcaucucacuuagacuacucugagcccugaguucuuguauuauguuucucugcagauuaaaagcauaauucuuuuauugcuucuagacagggauuucguuaugugcaccaggcuggccuggaacucagaaaccuuccugcuuccaccucugcagucaugggacugaacgugugcauuggcacacacugcaaaauauaaucuuucucccccuucuccauugcuuuuauuuguaugaauuuacucaucuucuuguugauagagaauuauagaggaucuuccaucugcuauucccuuucuuagcuagagcauguucccuacuuggacaugcucuucugugauagcugaaucaucucucucuccccaauccuugccuugaagugccaaccaauagcaccucacagcgugaggauaacugaagauaggaccuuugcaaaggagaacccuuucccaggcuaccuggagcccuucucagagcaugggauuuaaacccauagaacccagagaugcacuccuucagaagacaggccaugugggccccaaugagaagauagaauagaagguuuccauguggcuuuucaaggggccuuuaguauuaauugccccucccuauacccuuuucagagacuuuugaaggaagcauuuaaaaugaggaaccuaggguaacuaauuaaguaacuuaaguaacuuacccagaaucacacggcugauagggggcggaaucauaugugcuaaguaagcagucuaucugagaaacagaaggagagggaggagaaggaagagaagaugauaggaggagggcaaagaaggggagaggaggggaaagaggaggggaaagaggaggggaaagaggagggggaggagguagaggucuaaaaggcaucagaugcccaaggguaacaguaaaacagcuuaaggcagggaugcuuuuaaaguuauaaaaagacauugaucuuagugacaauuucguggaaugacuuaaagaucacaaacccccaaaagcaaaaaauagaccaguggaguugauuuaacuucugcauguggacgcaaucuauaaagugaaaaggugaccuacagaauucgagaacauauuugcaaaguaaacauaaaauuaagauuucauaucuaaaauauaugaggacgugugcaccucaaaggcaaauauucugacuuaaaauggcuagggcguucuucugcagaauaugaacaaaugaccaauggauaugugaaaaauggccaaggaaauacaaguagaaaccauggugagaugucacaucacaccugauaaagaggagaacauaaguauuaauaaggauguggaggaaagaccucccaggcauggacagugggaauauaaauuauacauacauuaugcaaaauagugugagacuucuucacuaaacaauuagcagcacuauaauuugguccagcaaucacguuuuggggauauauauauauucuuuacaaagcagguaaaucaaaauauaaaauaucauauauaacauauaauauagauauauauaauucuauaauauagaauacauauaauauauaucuauggaaaaugauaucaaauugugagcccccccaaguccuaccccaauccauuuuaacauuauccauaaucuuccaauccaugacaaugcucuguguccccaccagcagguacauggauaaagaacauaguacacaugucaagaagaugcuacauggccuuuagaaaaggagccauuuucauuugcaacaacagcuggcucugaaggauauaagucagacauagaaagauaaauucagggugacauuacuuguaugugaaaucugacagagucaaaguuguaguagucaagaguagcacagugguugccaugaguuaaaguguggagagaaugggggauguuggcccggauggcgugaacucugaguuacaagaggagcaacuuagagcuguagccugcagcauggggaugauggauguaguuaugaaacugaguguggacaucauaaucuucacaaaauacacaaauaaaaacugucauauuuacacacugaucuaccuaggcuuugucgauugaguauugcaagauaaaggugagauucuaaucauguuggauaagaagaaaaucuguaggaagaagugguuaguugccuuuaaaaagugcuaaugcagcacuuacuguagauaggcuaagcuuugaucaaggguaagcacacccugaauguucuuagacauguaguuuuacugguguauguacucucaagagcacuagucugggaauaacggacugcucaauagugggcccaggucaagcaaggucacagagccuggacagcaguugguaugaaaagccccauacagguggcuuguguuauuauuaccuuggaaaaggagaaacaaauuauaugaggauuuuuuuuuuaugaaauguagaauucugcacccaaaaugccugaggauagaaauguuucagaguugccuuuuagggguuauuauaaagaugucuuggggauaugagcugauaggagcacaaaguucauuucuguuucagaugcacuuuuuagccauaggcuggaaguaacuuuuuacacuauuuugcauaauuuugcacaugaaauaagguuuugugguauguuauuuucuaacugucacugcucauaaaguuccuggauuugaagggucuggguuuucagguguuugguguaggcacauucaaccugugccaucaagggaucauauuguaacuuuuuucccaaagacaauaaagacuuguguuagaaaacuaagucuccaacagggagagaaugucuaccagcuaugcaagaaaugcagugugaucuuacaacucaaggaugagugauacuucauugucauaauauuauaaaaucugaaugugaauuuacucagaugugugauagauuugggaaguuaaugaucaccaagaugaaaaagagaaagccaucaaauuuuaaguugcuaaccaucccuccuaggugagugauagugucuauaguucauagucaagaauaguaauauacacaucuuauuuagauauaagcaggcaaagaaacauuuaaaagaaugagcugugaguaggguuaugguuagagaagaguagguagaggccacuguguucaucauaagaucugucgcagaagucagguuugaagggcuguaaggaaaaagacuuaaaaacaacuggauguuggaaaggccugucagguugguggaucaggcagaggggcggaugaggaagccaccgugacaggccagggcuucaguggagguaaagcuggcacacucuaucacaaguacuggauucgaagucuguuuguagauaaugagagagaugaauacagcugagcuuuacaggcaagugugggcagccauugaugggccauguagcucuggaauggcaguccucugggcucagaaauccauguagccaccagaagcaacaugcaucuaaaggcaccgacuuccuagaaacuggcccagauauacagauggcuuaaucucucuuucuggucuuuucaaauggaugcauuaaggaccaaagagauccuauuucaaauaaagguuugaaaaauguguaggcauugcucacucuguguccagguugcuguuaucauuuuuaaaagggcauucaaugcaucucagacaacuggagaacgugcauauuauuucuguuacccucuuacuuugcauuccuacccacccacccagacagacagacagacagacagacagacaaucagacagacacauucugcuggagucuggacgcugugucccugccauguccuuguguugagucccugacucccaugaugaaggaagucagaugugggacuuuugagaggagacuggcucauuaagcugggcgcuuacgacucucaugucuuccccaugcaacacuugugaguuguuaggggaaagcaccaaaguaaaacagcucuucgacagacaccagagcuuccaauuucuugaucugggucaugaguggcuagaaauuuguucauaagccacccagucagugccaugggccauacuagcuaagcauacacacacacacucacaguguaauuaaacuugaauuuuguaguuugaauuuuguauaauuuauuuauuuuuuaauaauuaaaaaauauucucaggcccuuccuguaguucuuccuaaugcucuauuauaucauucugagagaccucccugagucauuagugugguuaaaagauguuuccaucaaaacuuacaugguugugcuuaguguauaccugaguuuaccuuugucugcaccaggcuuaccugugucaucuuaugguucacucaguucugacacuugucauggaugggagcugaccugagcaugcuugugugaacuacuguaaaugggagccugugagaaccccaauuugugagaacucuggggggaaucacuguaaugcccaccucaguauauagucucugggccaaggugugacucucuuucuuuccauggguaccuuaggaaugguugaggaggggauagaagaguggcuuucuguuacuaaaucuucuggccacaggccugugggcugugggcuuaauaaccacuccaagagucauuuuguguuuucugaggagaaaugcuacccccuagagcaacaguagagauccuuccagccaucaauuucuaugacagagcauugaacucaaaggagaaaaauaacaaguugaugcuuuacuauggacauaaauagaaaucucuguagcucuugguuagucaugguagucuacaaaggaacacaaccaaaagaauaugcauaagcuuagaacaugauugauuagaagaccagagccugguuaguuucaaaguggcuggagggcugaggaaagcaauaggccugcucagugcuagaagcuggaaaaccagaaagaugcagcuguccugggagguuaugggucucuguccugugccagauugcuagggaaauaaagucaaaggcuggaguuggauguccucugacagugguggcagcagaaagucucagauacuaaacggggauuaguuuaagaaagaaaggaagaaagaaagaaagaaagagagagagagagagagagagagagggagagagagagagagagaaagagagagagagagagagagagagagagagggagagagagagagagauccaucauauaccagcuucucccugcacugcuucuaguuccauucaggcucccagaugaugagcugauaccacucauguucagagugcaucuucccugcucacuucuccagcccuccugccacacgucucuggaaucaucuacacagaugccccuaggacugugcuauucuaguuuucuaggcaucucgaagcccacuaagguugacaaccaagaucagccauggcaaguaagaugggaaccaugcauggcauuugagcccauguguuuagagucaggcacugggaccccucugcacugaugugugaugucuaggcuucagcugucacccagaucaacuagcacauacaggggagcaaaagacuuuaaaacaaaauccagguaggcuacguggcucagcacauaaaggagauugcugccaagccugcgacuugaauuugauuuccaaggccuacaugugaggagagaaauggcuccuucaaaucauuuucuaagcuucuaaugcauacugugacacauaugugccccuacaccagugaaagucauuaauuaaucacacacacacacaugcacacacacgcacacacacacacacauacacacgcacacacacacacucacacacacacaugcacacacacacacaugcacacacacucaugcacacacacacacaugcacacacacacaugcacacacacacacacaugcacacacacacacucacacacacacacaugcacacacacacacacacacacacacacacacacacacauacacacacacacacacacacucacacacacggguggggggcgggggaugauuacuaccauggaaaaguaccuuggcaacacuuccagaaaggcugagggugaagggagcaggacugacauuucauacaaaaagacagccuguucuuaaguagaaauuuaaauuauauugagugaugcaaucacuuuaacauuuucuccuaggacuuugugcccuauuuuaguaacaaaaagaucagcuguucccaacuaugcccuuaaaaucagcuuucaaaagaaauaaaagggauuucugaaaggcugggggugggggaaggcaaagcuugcccuuauaaggcuccgauaaccucauuuggaaaggaguuucacguguuagagagguaauucucuccuugucuguguggcagacucacaagaaucuaacagauuuaucuagcaacuugaccaagcuacaaugacacugaguacuguggcaauuuagaagcauuagugaggagcacacugcaagauugcggggugaaguuuuuccucuuccucauaaucuugaaaccuuaacgaaauccuccaguucucucacucccgggaugucacccagcaaggaccuuugagccucccuuuguugaccugagcucuugcucuuccuagcuauaaccugccagcuugggaugacugaagagggacugcaguuguuggacggcauggaacaaggaccagugguuggcaggccuccacacgggaggaggaggcacagggguugcaaggaaggcaaugaugggcuucauagggacagaauuaccaaagcauucucuaaucaaaacccugugcccugcaguagucuaagagcuccccuguuuucacauaauauaaaaauguccccugguuuuaaaagcgaggaugacaaauauaaccuucuaagaccuuaauuggucuuauaugugauuccagaauuggggagcagucugcaucuauugucucagguuucuguacccuaggagcggauuguauucauagccagagaaaaggaagggaauuuaaaacaacaacaacaaaauguuagcaaggcagaguugguugcugcuugggucuguccuauuugaccuugguuuaacaguuggcaucuggcaauuggcugagauucaccuacuugcucccagaguagguuacaaccuggauacauaucaaguuucagugcacacucuauggggcaaugcuugaggaaauuugaaauucuguaugagguagcagauucaugcugggucgguauaguccccacacaaaccuggaaaugucugacuuggggagucugcccucugugcaguccuucugauuuaaccagguuuucuuuucccacauuaaaucauaaguccauggaaaauagguuggucaaaacaaaaugacaccaaaaacgcuuucauucugucgcaugccucuuuuuaccccaagguuagaaugauguucacaaggcaucucacucucacaacguucucacuguuucuauacugugcauugaaaugcugcuauugcgcaguugcuuccagugucuauuaugccacccacagcagaugaaaagcuuucuugcuauaguuacuuguauuauaacaugcuuuccaucagcuguaccugaucccugauuuauguugaaauccagguagugcgguccugcucugaucccugacccucuguuauuccagacauuuugcuggagugugggaaaaacgggguuuccauuuccaaaccccgguuucacucuguaccuccuuagugcucuguagacucaccccugucugcuucuacccauugcucccaccagccuuccugcuccugagggacaccacagugcaaugggacaagaaccagcaucaucagucacuaaaucugcccacaugaagccccagcugaggcuagagcaaccuuauacagaauaagucaagggcauguuuauuugacugaacucuaaacauuuuuuccuuuuguuauuaacuuuauaauguauccugccccaguggcugauuucccaaaaccuuugaaaguuuaacuacugucuaucuuguuggaauggugucacuguaaggaauacuauugaaauuaaaucugugaucugaguuccaguguggaugcuggagucacguggaacguggucauugcaccuuuagcaaaacggguguucuuguuagauuggagggggaaagaggaucaagaggggagacagggagugagggagagagagggcaagagacagagagauagagggacagacagagagacagagacaaagaaaggaaggggugagaauaaagagagaaacuuuaagcauguuauaauacaaauaauuuuagcaagaaagcuuuucauaguuuaugaguuaauuuuuucauuuuuaucuuauguguacauauucccuaccugaaugcaugugcaccacauaucugccugaugcccacagagggcauggaaaauccuggaacuggaguuaaagagccaccuuauggguucacagaaccaaacccuguuccucugcaaaaguagcuagcaagaacucuuaaccaauaauaagcugccuucugaucugaauuuucucuuuacccccuucugcccuuccuccuuccuucucccuuccuucuuuccucccuccuucccucuuccuaucuuccuuccuuccauccuccccagccccuucucucaauauacuugaguuucuuuagauuccaaagaaacuaaaauaagcaucuauaugaaagcaagaauuuucuuucauucuuucuuacuuauuuuugcuuuuagucaagauguuuuuuguuugcuugcuuauugguucuuuuauuuacuuacauuucaaauguugucccccuuccugaucccuccacaaaaccuccauccuccucccccuuugucucuaagagggugcuccuccaccuacccacuccugccucacuucuccagcaucccccuacacugggguaucaaaccuccacagaaccaaggacuucuccucccauugaugccagauaaggccauccucugcuacauaugcagcuggagccauggacccauccauguguacucuuugguugguaguuuaguuuccuuucuuaaacaaagcaacugagucacuaugagauguuuugcacaaaauauuuuucaucucagugaaacuaaaauauucuuugaagucuuuagagagaaacuggaaguuaauccgugaugaaggccucauggugauggauaaagccaagggucucuuccugccugaggacgaaaaccuucgggagaagggcgacuggagccaguucacacuguggcagcaaggugagcucuugucuucuagauuaucuuccucaugcacaggccagaugauaagugaguagucuucuacugacagcuuccugugacauaugaucugcccgcaccgucuuuaaacaugugcaucugcuuguuuguauacauauguguauguggauaaauacgcaagugcuuucaauuaaagagugcucuauucucuguaccucugcagugcaugaguagcuggagagcccagcacgucugucacugucucagaagggaguaucucugaacuguguucacugcuguaaagugcauauuaggcuggggggacaaaauggcaacagcacggugggagccacugcagaggcugaagcugguggcagcagaaguggugguggcaguggugguggggguagugguggugguggcgguggcggaggcaguggugugcuuuguuauggcucuuuucuacuuccucauucauaagcuucuucuuguucuuucuguugauauucaguucuggaaaacauuuugguugaaaugccuuagcaaauuuguuacauucuuuauuaauauaagcauuuaaguuugaugaauauguggauucagaugcuuaaccuauacugaguuuuaaauuagagugaauuuaugucuugauuuccauuucaaaucaaaauaauuguguguguguuuuuguuagaaagagagaguauguguguugcaggauuuaaauggagaacuucacauguauuaggcaaaugaugaaauaccaaguucuaccccccagcucuuguauuccuuuuugaauaaucaacuuuuuucucuuuauuauauuuuuauuauuuaaaacaaaauuuaaguguaaaguauauuggugcuuucccacuccuacccacccaacuuuaaguucuuucucaaaaaccaagcauaaaccccaaagcaacaaaaccucccaaagagaacaaaauaaacuaacagcccuccuuugacaacaaauuguaaccacauaaaagcacgugagauuuuuccccugugcccauaucuucaaggcuuuuccccacuuucuccucuauaaguuucagugucucugguuuuaugugaaguucuuugauccauuuagauuugaccuuaguacaaggagauaaguauggaucaauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauuacauugaaucuguagauugcuuuuggcaagauagccauuuuuacaauguugauccugccaauccaugagcaugggagaucuuuccauccugaacagaacagcaauggcuugugcuguaagaucgagaauugacaaaugggaccuaaugaaacuccaaaguuucugcaaggcaaaagacaccgucaauaagacaaagagaccaccaacagauugggaaaggaucuuuaccuauccuaaaucagauaggggacuaauauccaacauacauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaauguaaaucaaaacaacccugagauucuaccucacacuagucagaauggcuaagaucaaaaauucaggugacagcagaugcuggcguggauguggagaaagaggaacacuccuccauuguuggugggauugcaggcuuguacaaccacucuggaaauccgucuggcgguuccucagaaaauuggacauaguacuacuggaggauccagcaauaccucuccugggcauauauccagaagaugccccaauugguaagaaggacacaugcuccacuauguucauagcagccuuauuuauaauagccagaagcuggaaagaacccagaugucccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaauuaagacugaaguguggacacuaugccccuccuuagaagugggaacaaaacacccuuggaaggaguuacagagacaaaguuuggagcugagaugaaaggauggaccauguagagacugccuuauccagggauccaccccauaaucagcauccaaacgcugacaccauugcauacacuagcaagauuuuaucgaaaggacccagauguagcugucucuugugagacuaugccggggccuagcaaacacagaaguggaugcccacagucagcuaauggauggaucacagggcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucacuggaaagagaggcccauuggacacacaaacuuuauaugccccaguacaggggaacgccagggccaaaaagggggagugggcggguaggggaguggggguggguggguaugggggacuuuugguauagcauuggaaauguaaaugagcuaaauaccuaauaaaaaauggaaagaaaaaaaaaagcacgugagagcaccauacacacacgugcacacacacacagacacacacaaacaaacaacaacaacaaaaacuacagagucuauuauggguuggucagcuacuccugaacaugagcccugcccuggacuggcugauauacccagugucauuuuauugggaaaaaccgaauuucccucuccccacagguauaaaugacaguucagguguuaaccuuuacccuaguggauagguuuuuauuuuuucauuuauucauuacauuuuuuaagaaauacaacaaauuaaauauaguaagacaaaacagaaacaaucacaucgaagcugaacaagacaaaccaacaggaauuuaaaaaaaaaaaaaagagcccaagagaaagcacaagaaucagagacucacucauuugcaccuucagaaaucuccuuuaaaaaaaucacuaaauuauggaaacuauaauauaaacacagaggaccuggugcaggccuaugcuggccccaugcaugcugcuucuguauaugugaguucguuaaguuuugcucauauugauuuagagggccuuguuuucuuuugaccauccacucugucucuuagauucucucugcuuccucuuucaugggguucccagaguucugagaaaagggauuugauggagacaucccauuuagugcugaguguuccaaggucucucacucugcagugucuaucuaugggucucuguguuuguuccuaucuggugcagaaugaagcuuaucugaugaugacugaacaaggcacugaucuaugagaauagcagaguaucauuaggaaucauuuuauugcuacauucuuuuuucuuuacaccaguguuacuuggcuucuacccuaggucccugggguaucuagucucagguucuuugucacccaggaaguauugaguguguauuuaaucuuguggagugggccuugugucaaaucagauauuuguugguuacucccauaugcuuugugccaccacugcacuagcaugucuugcaaguaguacauuguugcagauaaaggguucaugguucaugugguguuuacauuuuuauuucuguaauguggagaguaucauucugugccaaagauacuagcaaguaggggguaaaggcucuauauaggcaccaguucaaauguucaaugaauuguauagguguuguuucaggcauggggucuugcugucaguuuguggagagcaaucuauagucuugguaacugccugaguuguuugaagaguccuguggggacccuuuggccaguaacucuaauagauguaacaaauuaugguucauugguggcaagagaugaccaguugggacuugaucucuccauuauuuguauauauuuuaggaggcuuguacuguauuagauuuccauacuaccccucaaaugcccuucaguuuuagcaguugcuuuauguauucccucccauacaucccucauuauguauuuauuccuuuccccuuuccuuaucagaucuaucuguuccaucucgucccuuaugcuauuccuacccucuguuggucuauggcuuguaguuugguaaucuuugacuuaacacuagauaugcucuuauaauccaauuaucaaauaauauuuugucuuuccuagucugggauacuucacucgggaugcauuuguguauugguuugguuugguuuccaucaauuuaccugaaaauuucaugggaucuuuuuuuaacagcuguguaauucuccauucuguaaauguaccauauuuucuuuauccauucuucaguuguggggcauguagguuguuuccaguuucuggcuauuaugaauagaucaguaaugaacauaguugagcaauuuucucuguggcagauacuuuguguaugugccaaagagugguauagcuggaucuugagguagauugauucccaucuuccugugggacugccacacugauuuccauaguggcuaaagucccaucagcaauguaugaguguucccuuuauuccacauccucuccagcaagagcugucacuucuuuuguugaugguagccauucugacauuaguuauauggaaucucaaaguaguuuugauuugcauuucccugauggcuaaggaugcugaacauuucuucucagccauuugagauuucucuguugagaauucucuauuuagauauguaucccauuuuauaauuggguuguuuucuugauacuaauuguuugaguucuuuaaauauuuuggauauuagcccucuaccagaaauauaagaauaaucaauuuucuagcagugaagagugauagagcugacagauaucguauauuuucuuaaccaauaaguuuguaaauggauaccuacagugcuaggggccugagucaguguuagagcucuagccuggguuguacgagacccugggcuugcuugcuagaagucuaacaaauuacuaugugacuacuguuaaaugugugucuggcucacaaauuaaacaaauauugccaaccaugacuaaaguacaaaggaaacacauaccacacaucuuuauucuagagccuagagcaaaugguacuaacaauucucaccacuucaggaugacugaagcccuaaguccuccucugcagucugcuuguggcaaggauagaaugugauuggaaacuguauuuuaaugcacagggcuuggaaacagcaagcuuaguuuacacuguugugcugagcagccacuagcauugaucagaguugucauguaaaaugaaauuucucuucucugaauauuaagaagaauauacccaagucucuagcuccaugaauauaccugauaaagucauaugcauuauucuuuuauaucuuuuauaucuguauugacuguuagaucucuugccagagccauugucccaaaaaagccaaguuugcugcuuguuaagaauuaacuuuguagcauuggaaauguaauugaagaaaauacguaauaaaaaaaaggaaaaaaaaaaagaauuaacuuuggugacaaauaauaaaaaacacaagcaaauucacuguuagcaacacugggcauuccucaugcaaucgcagacuuaacaaugccuccugccuuguaaccugugauguaacaaaaugaggauguguucuuuaggaucuggaaaucaugguccuuguuuacaguuuugaauguauucucucuugaucuacaugugggcaugcccugaaucuccuugaaaagaguaaagaaaguaguugcauugaguauagagugguucccacugccagugaauacugggaagaagaguauugaguacaugccagugauucugcaggguugcaguguaaugggaacucauuaguaaagggcaacaaagaggcagggcugaggccuggauuagucaggguucucuagaauaaaagaacuuauaaaacgaauauauauauguagagagagagagagagaaaggauuuauuagaaugacuuauaggcuguaguccugcuaauccaacaauggcugccuaugaaaagaagaugcaagaaugcaagaguuguucaguccaugaggcuggauggcucagcuggucuucaguauaagcgggaauccugaagaaguaggcucuaaugccacugaagaaauggacuugcuagugagggcaagagccagaagauaaagagagaagcugccuucuuccaaguccuuuaaauaggcuuccagcagaaauguggcccagauuagagaugugucuuccuaccucaaaaaaaucuggauuaaagaggugacuccccaccucaacgauccagauuagaaguggaucuuucccauuucaaaugauuuaaguaaaaauucccucacagaugugcccaucacaaggccuaucuaaaagccuagauguuggaucuaugacaggugcacuguaauugcuaacucucugcucucccauuaagcgugguaccucucuguguguugguuuguccucugcauaacaagaccugagugacuuccuuccuggcuacagugaacaucauacaucacuaagugucugaccauagugagcaauaugggaauuuuguguugagugcgcccuuccaaacacauguggauacuuaaaacacuggguugcaagcuguggauguugaaccacuacugccaaccuucuccugaaagagacucuauaccuuaggacuacacaagauauacaagcugguugguucccugaugcuugagaucaacuaugucuggucagaaauaguucaggcuuccaagguuuucugaccugggaauaagggcaugaacuuugucacuugaguguuuaugaucaaagcauggucuagaccugaggucacuugaacacuauaccagaaagccagaaagcucaguuaguuucagcuuauggauauguaaauuagggauccucacuuuuuacaugccuagagguuaaaacucagaccucaccagaggaaguccuggugacaggauuaauuugguagucuuggcacaacugaccaaucagguguuacacaagcucaggcccuaccaauggguggggaagaacccaacugcucugguggcuucaagcuaccagacuucacccagcuucaacuugagcagccucguccccugcuagcccuccuaaaaccuuacuuauagaugcccuggaaaaccaggacuaaagaguccauuuugaugguuuauacauuuguuugcuacucuuucaagcuggcuuacauuguuuggcucaucagggcacacuauugcuaacuaaaaagagcacauagcaauguacuugauuuaaaagcaaaaaguucaucugcaaagagcuaauaaaacgguagaaaccauuuccuaaguuuagcgguccacuugacagaggcagaagacauggugcuuuaucucuuagaacucauuuuguucucagcauaagauuaucuuagugaacaugaacauuaaagucaaacucaucuuuagauguaauuucuuuuauaggaauuuugaauaggaaaacaaaauuuucuuucuuuaaaaaacaaaacaaaauccuguuguuuuccuccuccaugaaagcuagugguaauguauacauucugagcacaucuucucaggaagaauguggagaaaguuuacaugguccaagaugcugaagaugaagucuuagaaucuguucuugguauaauuacucauaaaaaauacuuuuuuuuaaaagauccugacguauguucuuuaaaugucacuuuagcaacauaugauucuuaauacauugaaaaauacacuaaauuccaaugaaaaauguuuugcuaucucuuagaaaugcauuucagguuaggcauagagcauaaaguauucuccuuucuuagagacuguauuaauuucuguguacuacaauaauuuggcacaaacuagugaugugaaggcauagcucagaggucuucaguggguuucacuugcuaaaaccaagucauuauccuucaacaggcuucagauucuaguauuugcccauggccuuugugucccuuauccaucucuauaacaagaaauggcuggucuguuuccuuauaaucugaauuauacacucauuucucucacuuuuacacauauaagggcccuacaaugacauugaccuuuaacugucuuucucuuggccuuccaauagcaaaggugaucauacaaguacacguggcucaaaugagaugagauaaaguuuuacugcaguuugguuguguguguuugugugucuuugugugucugugugugucuguguguguguguauguuucaguaguaucucauuaugugaucagguuggucuugaacuccuaggcucaagcaauccuaguuaacuugcagaauagcugagagcacagaugcacaaugacaacugggauuugcuucucaguaguuuuaucaucuuuuguucuaggaaggaagaaugagaaugccuguaaaggagcgccuaagaccugugcuuuacuagaaaaguuuuccgaaacaacaggaugcagaagaggacagguaccaaggguguuuucagagaugggaagaagacaguuuguugucaggaaagaggcagagcugaccuuuacaaaaaucacaguuauuucccuuggcacaauggaugucucuuuucccauucgcuuuuuaaugaaacauaauuucaugugguugaugucaaaauuugaaggucgaaaauguugaguauuaugucacuuugugggaaaugagacugcuuguuuuuuggcuccuucacaaagaaauaagauaagaauauaagucccaaggguuacaaagacucucguaugaauugaucuugauucugcugccucuccaugccuuguuuaauugaugauugggugucauacuuucgauacagaucaaauacuccaucaugcacccuggaacucauguguggccgcauacaggacccacaaacugcaggcuccgaaugcaucugggguuagugauccccaaggaaggcugcaagauccggugugccaaugagaccagguauguuuccuuugucaucccuuucuuuuguacccaucccucaacaguagauguccuuagagaaagucugugguccaugggaucaugucccuuucugcaguauacaggagugaagucauuuacauccagacuuuacuuugugaccugguuggugaggugucauucacagucagagcaggucugccauuuacccccagagcgcucaucugccugcccagcugccuugguucuucaagguggacagccuugcauucagagucaauucacuugccuuaagcuccccacauucugcauugugcuuuagguuccacagauugaguuauguauauguauaggaagucuuucuccuugaagauaucacccagugggcacuugcauuuugcucuagaggcaacaacaugguucugugagugacuaccacuauguaacuuugacuagucaguuaaucuccuuaaaucucagcuuccugcuuauaaaauguggcagcaauacugacucuucaggguuguaugaugguaaaguguacaauccuaagagacacuugauccucuuccugagaucagcaaggccaugguaaaugguaggacucaccucacaucgugcuuucuccucuucuaaucacagcagcugauucgcccucuugugaacaaggcacacuuggcucaagacacacugaacaagccucacaagcucuggucuuuuugaggaguuaucuagauaguuguuuuauguauucaaaguauaccaauuacuaggauccaauuucaguucauaaaaauaaggcccgcccuuugccaucuugagcuaugugcucagugcugugugucucaguggguguucuggccagccaucauugcuguuaaugucuguuagccugccgaucaugcugaaguggaagcuccuggacaugagaaaucaggaaguuaucuucuacagcccuuauugucuaugagaggggauagaauagagaggacgacaaauguuuugggacacucaguguuggaccacauggggccccccucgcuaagacauacaugaucaggaagauacaagagaacugguacuacaugagcccaaggggagcacaagucaaaguuacaaaugggucacuugccccugagguuugggaaucuaggguagcguuuuguuuuguugcuuauuuguuuuuauacaagaggguuauggguauugagaacugagaggaaaacacucugaaauaucuacaaaaauaaggaugcugaaucugagaaacacuuugugguucagcagccaagagugagagcacaugaggaggaggguaaggaagugaguacggccauggccaguuccugggaaggaagccucugacaccaaacuuauggcucagcuccucgucaggggcuguugucugaagggagagaugagagcauccucaguaacugacacagugaaauguuccaaagugaagcagguaaaaccugggugcuggaaagagauggagacuaaagaagcaggagauaugagagggugggcucaggggcaauccucagagugugguaacagaagaaguccaagauagcuuuccucguucagucuucagcaggaagaugcuggugccuggacacauugacaacuggaaauauaugaggcaaguuaauggaaaggaaaaugaauuuagugcuuauaccuauuuuauuuacauugcuauugaaacagagaggaacuaucaaagagcuggcuagaacuaggauaaggucgagucugaagacagagguuuucgaguggaacuuggcaggagaucugaggggcagcuugacggauaacugagaugacaguuacagagaggggguguuaugggaagcagagauggaugacagcacaagaaaguagauagaaucuuccaguucuccuuccugaauacaggauaguaucuagaacuuguuugguggcuuucaaccauuuccaugcauguuuugucucuuaacucccucuuuugucccucucucucccccucucuuccucuuuuccuuccuuuauuccccccuuccuucuuagauaauuauaaccaaauuacucaguuaagcaucccuuuaggcauagguaggaaaguguggaacugacuuugaggaugaagaagaugaccugaggaugaagaagcaagcucagcuagaaggauggucauggcaggcagacagacagacaggcgggcaggcaggcaggugugcaggcaggcaggagagugggugaguagagccagagguauagccacaaaggcucugagagcucagaauaguaggugacugucuuaguugggauuuuauugcugugaagagacaucaugaccacagcaacucuuauaauggaaaacauuucauuagggcuggcuuacagucucagguucagcccauuaucaucauggugggaagcaugguucuggaagagcugagaguucuacaucuugacccaaaggcauguaggaguagggucucuuccacaauggcuggagcuugggcacugggagacuucaaagcccacuuacacagugacacacuuccuugaacaaggccacaccuauuccaacaaggccacacuuccuauuaguaccacuuccuuugggccaagcacauucaaaccacuauugaucuuaccuggaacuggccauuuggauguaccuuugcaucagugugucucauggccacacuuggggaugcaagccacugcuauugccuccaugaauuuuaaaccacccacccuagauucucaccagaggucaaacagcucaccuagaggacucucauuggcuauuaacucgcagacuaucagugucugcugagcuaaaauacacucuaguucaugugacacuaaagagcuacuaacaacaguaauuugcaagccgucuauuuugcaaauucacagucauuuuaaaaacgugcucuccacccauuugccuauuaccaggcacugaguugauucugcagaggagcugggagcauggagaguauugcuccuccccauggcugccugucagcaguccuccuucaucccugcugucaggggugcauucucauccuuaauccuucacucagugguacuuagaauggguuuaguauuucauugacagaauagugcuuuucauaaaagaaauggguugaguuaccuaaguucuauauacugcguaaagugcauauaccagggaaacugaauagccuauagucuauaaagauuuagaauacaaaggcuuucaaaccaaauacggaagcuucauucugugauacauccugcaaggacugagugucaaaacaagcauaccaggaaagaagucaggcuuccuugugcugggugccaggcagcgaucuuuuuuucagagccugacaccuggccugcugaaagaguagguuacccacggcaguuuguuugcuguaguucucagaucucgauaaucagauuucugcuucccuggaaccaugggauuccugccagggugugaguccuguaaacauacccucacuacaacacaaaacacaacacuguuuuuucucugauauugagcuugcaagacauguagccuuacaccuuaagauaacaucucacauuuacaaauaccuucugauuguaagaugagauugugugucccuuggaaauaauuuauaagacacagagaaaacugauguaaaggacugucuuugauccugucacucagugguauuauccagaugcuucucggugcugucacgaguguguuauuaaugccagagacacagcugcggcgacgccacuucuaagcacauuagguacaacaucauucuuaacaguaauuccaggaaaucaggcuuauuaaaaucccuguguuacaacucagaagacuaagcuauaaaaacaaacugccuauuuguauuagcuucuuugggaauuuauaaauggccacaugcuagaugauauaagacagcagaaguucauccugucagagugugagauccagguguuugcagggcuggcuccuucagaggcucaaagaggccauuuguaccucuccuaucauucuggggcugcuucucaaccuugguguuccuuggcuaguagauacuuaauuccaggcucuuccucuaccuucaccuccugcuuccuguaucuucuauuuauucuuugacacugacacuguuggacuuagggacccuaauauuguuuagggcugauaccauuucaaaagcacacacuugacaucugcguagaucucuauucuaacuaauauuuuuuuuuuguauuaacauguagucagaaguaggcucaauccuaaguauuguggcuugaacuauauuccuaggcccaaccucacagccuugaugagaaggcuguuuguggggggggggggggaggaagagggggcauuucuuccugugccacuggguaaguaucaggcaccagcaaagcacuguuaaaaucuguuaaaguuacuaucaauauuaaugacgcauucacuaaguuguuacuguaaguacuccuaguauccacuuaccuauaaauaagcaaagaugguggggauggaucauaugacucccuacaugacauuuauuggacaguuguccugccacagcuaucuucagcaaaaggucuaucauauaaccagcagggagcacuuuuaccaauaccaucugugugcaacccuacuuauauaucuucgcaaagcuaagugcugaucauagcugauuaacucagccucugaaagcugaacuuuguacuagacuuugcuaucucaagcuuaaaugagcucuggaugucccugcagccauauguauucagaucacugaggggagcucuucccuggcuguguagcagcaagacagcacugacuggugcucagagacaagggugugauuggaccaaaccuaagcaaggcucuuugguucuccuguacuuaggcauauaaaguuugcaauaccaaggggccucucuugccaaauauggccaacuaggccaucuucugcuucauaugcagcuagagacaugaacucuggggguacuaguuaguucauauuguuguuccaccuauaggguugcagaccccuucagcuccuccuugggugcuuucucuagcuucuccauugggggcucuaaacuuugucucuauaacuccuuuuauggguauuuuguucccuauucuaaggaggaaugaaguauccaccccuuggucuucccucuucuugauugucuuguguuuugcacauuguaucuuggguguucuaugucucugggcuaauauccauguaucagggagugcauaucuaaugacuucuuuugugauuggguuaccucacuaaggaugauauccuccagacacauccauuuguccaagaauuucauaaauccauuguuuuuaauagcugaguaguacuccauuguguaaauguaccacauuuucuguauccauucuucuguugagggacaucuggguucuuucuagcuucuggcuauuauaaauaaggaugcuaugaacauaguagagcauguguucuuauuaccaguuggaacauauucuggguauaugcccaggagagguauugcuggaucuuccaguaguauuauguccacuuugcugaggaaccuccaaacugacuccaaagugguuguacaagcuugcaaucccaccagcaauggaggaguguucuucuuucuccacauccuuaccugcgucugcugucaccugaauuuuugaucuuagccauucugacuaguguuagauggaaucuuaagguuguuuugauuugcauuucccugaugauuaaggauguugaacauuuuuuuucaggugcuucucagccauuugguauuccucaguugagaauucuuuguuuagcucuguaccccauuuuuaaugggguuauuugaauuucuggaguccaacuucuugagcucuuuguauauguuggauauuaauccccuaucagauuuaggauugguaaaaauccuuucccaaucuguugguggccuuuuuccucuuauugaaagugucuuuugccuuacagaagcuuugcauuuucaugaggucccauuugucaauucuugaucuuacagcacaagccauugcuguucuguuuaggaauuuuuccccugugcccauaucuucgaggcuuuuccccacuuucuccucuauuaauuucaaugucucuggucuuauguggaggucuuugauccacuuagacuugagcuuuguacaaggagauaagaauggaucaauucgcauucuucuacaugauaacugccacuugugccagcaccauuuguugaaaaugcugucuuuuuuccacuggaugguuuuagcucccuugucaaagaucaagugaccauagguguguggguuuaucucugggucuucaauucuguuccauuggucuacuugucugucacuauaccaguaccaugcaguuuuuaucacaauugcucuguaguacaguuuuagguccggcauggugauuccaccagagguacuuuuauccuugagaagaguuuuugcuauccuacguuuuuuguuauuccagaugaaucugcugauugcccuuucuaauucguugaagaauugaguuggaauuuugauggggauugcauugaaucuguagauugcuuuuggcagaauagccauuuugacuauauuaauccugccaauccacaagcaugagagaucuuuccaucuugagaucuucuucaguuucuuucugcagagacuugaaguucuuaccacacagaucuuucacuuccuaaguuagagucauaccaagguauuuuauauuauuugugacuauugugaaggguguuguuccucuaauuucuuuuguagccuauuuuuccuuuguguagagaaaggccauugauuaauuugaguuaauuuuauauccaauuuuauauacugguuugcacuguacagguuuaggaguucucugguagaguuuuuggggucacauauauacuaucaucucaucugcaaauagugauauuuugacuucuuccuuuccaauuuguauccccuugaucaaauugcucuggcuaggacuucaaguacaauguugaauagguagggagagaguggacagccuugucuagucccugauuuuagugggauuacuuccagcuucucuccauuuacuuugauguuggcuacugguuugcuguagauugcuuuuacuauguuuagguaugggccuugaauuccuguucuuuccaagacuuuuaucaugaagggguauuggauuuugucaaaugcuugcucagcaucuaacaagaugaucaugggguuuuugucuuugaguuuguuuauauaguggauuacguuuagggauuuccguauauuaaaccaucccugcaucccuggaaugaagucuacuuggucaugguggaugaucguuuuuuauguguucuuggauucguuuugcaagaauuuuacugaguauuuuugcaucgauauucauaagggaaauuggucugaaauucucuuucuuuguuggaucuuuuugugcuuuagguauccgaguaauuguggcuucauagaaugaauuggguagaguaccuucuguuucuauuuugugaaauaguuugaaaagaguuggaauuaggucuucuuugaaggucugauagaacuccacacuaaaccuaucugguccugugcuuuuuuugguugggaaacuauugaugacugcuucuauuucuuuaggggaaaugggaaugcuuaccucauuaaucugauccugauuaauuuugguaccugguaucugucuaggaaguuguccauuucauccagguuuucuaguuuuguugaguauagccuuuuguaguaggaucuuaugauguuuuggauuuccucagguucuguuguuaugucuccuuuuucauuuuugauuuuguuaguuaggauacugucccugugcccucuagugagucuggcuaaggguuuaucaaucuuguugauuuucucaaagaaccagcuccuuguuugguugaaucuuugaauaguucuuuuuguuuccacuugguugauuucagccccaaguuugauuauuucuugccaucuacuccucuugggugaauuugcuuccuuuaguucuagagcuucuaggugugcugucaggcugcuaguguaugcucucucuagucucuuuuuggaggcacucagggcuaugaguuuucuucuuaggacugccuucauugugucccauaaguuuggguauguuguggcuucauuuucaguaaacucuaaaaagucuuuaauuucuuucuuuauuucuuccuugaucaaggaaucauugaguagaguguuguucaguuuccacgugaauguuggcuuuguauuauuuauguuguuauugaagaucaggcuuaguccguguugaucagaaaggaugcaugggauaauuucaauauuuuuguaucuauggagaccuguuuugugaacaauuauauggucaauuuuggaagaggucccgugaggugcugagaagaagguauagccuuuuguuuuaggauaaaauguucugcagauauuuauuaaauccauuuguuucauaacuucuguuaguauccaugugugucuguuuacuuucuguuuccaggauauguccauuguugagagugggguguugaagucuccuacuauuauugugugaggugcaaugugugcuuugagcuuaacuaaaguuucuuuaaugaauguggcugcccuuguauuuggagcauagauauucagaauugagaguucaucuugguguauuuuaccuuugaugaguaugaagugccccuucuugucuuuuuugauaacuuuggguuggaagucaauuuuauucaauauuagaauggguacuccaucuuguuucuugggaccauuuguuuggaaaauuguuuuccagucuuucacucugaaguaaugucuguccuuuucccugggguggguuuccuguuagcaacaaaauguugguccuguuuguguagccagucuauuagucuaugucuuuuuauuggggaauugaguucauugauguuaagagaaauuaaagaaaaguaauuauugcuuccuguuuguuguuguuguuguuguugcuguuguuaaaguugguauucuguucuugaggcugucuucuuuuagguuuguugaaggauuacuuucuugcuuuuucuaggguguaguuucuguccuuguguugauguuuucccuucacuauccuuugaagggcuggauaccuggaaagauauuuugugaauuugguuuuauccuggaauacuuugguuucuccaucuaugguaauugagaguugugauggguauaguagccugagcuggcauuuguguucucuuagggucugcguaauaucuguccaggaucuucuggcuuucauagucucuggugagaaaucugguguaauucuaauaggucugccuuuauaugucacuuuaccuuuuucccuuacuacuuuuaauauucuaucuuuauuuagugcauuuguuguucugauuauuaugugucgggaggaauuucuuuucugguccagucuauuuggaguucuguaggcuucuuguauguucacgggcaucucuuucuuuagguuugggaaguuuucuucuauaauuuuguugaagauauuugcuggcccuuuaaguugaaaaucuucauucucaucuacuccuauuauucguagguuuggucuucucauuguguccuggauuuccuggauguuuugaguuaggaucuuuucacauuuuccauuuucuuugauuguuguguccauguucucuauggaaucuucuucaccugagauucuuccaucucuuguauucuguugcugaugcucgcauaugguuccagauuucuuuccuaugauuucuaucuccagcauugucucacuuuggguuuucuuuauuguuucuacuucccuuuuuaggucuuggaugguuuuguucaauucuaucaccuguuugguugugucuucauguaauuuuuuaaggacuucuaccucuuuagcaguguucuccuguauuuuuuuaagugaguuauuaaagccauucuugauguccucuaccagcaucaugagauaugauuuuaaauccgaaucuugcuuuucggguguguugggguauccaggacuggcugaggugagagugcuggguucugaugauggugaguggucuugguuucuguuaguaagauucuuacauuugccuuucaccaucugguaaucucuggagucaguuguuauaguugucucugguuggagcuuguuccuccugugauucuguuagccucugucagcagaccugggagucuagcucucuccugagucucaguggucagaguacucucuacaggcaagcucuccucuugcagggaaggugcacagauaucuggcguucagaccugccuccuggcugaagaugaaugccugaaacagggccugucccagaagauguguugugucugcagucugcaugcucaccugcacaggcuggucuccaagggaaaggggacacaagaugguucccuuaccugcucugguggucagagcccucccgggcagacaccucuccucuggugaggaagaugcccggaugucuggagcucgaaauggguucugucccagaagcuguguagcuucuguauucugcacucucaccugugcagacuagacuuugagggaucugggacccaagauggcucccucaccugcucugaaagagcucuccugggugaacaugucuccucuggcggugaaggugccaaaugucuggagcccgaaacagggucugucccaaaagcuauguugcuuuugccugucccagaagcuguguugcuucugcagucugcucgcucacccuuugcagucugugagcugaccugugcagacuggucucugaggaacccgggacccaagauggcucccucaccugcuccaaaagcacaauuuuuuuucuugcuaacucauaacuguaauuuugcuaguguuaugaaccauaauucaaauauuuucugaucaccuuaggugaccccuaugaaagggucauucaaccuggcaaaugggucucuacccacaauuugaaaaguacuuucaagguaauaauuucaaaugacagaagcuagaaaaucugagaucaucuguggcaggcccuauuuuagggcuguaaguuagcucaauagcaacuuugguccaaagcugaauaaacuugaacugguagauaaacauacuaccagcaaguggaaaaugguucauuuguacagcacuucagggaguggcugcauuguaugggcuuuggggauuauuucacauuucuaagaaguuguuuuaaaccacacuggaacuaugcuaagagccugugaccucauaacucuugaagaccagcaucacugccugaaaccagaaacagcagugaccuuagucaggaaagcgcagucuggcauuagugaccagugagaggcgaacaggcaugcagccauucacuuugucaauauacugcuguacaaaugaacaguauguuuuauagcauguguccuucugaaucucccaaggcuccaagguuuauauagaaaaauuaauuaggagaaaauuaauuuuuaauucgccacaaguucauaguacuuuuuacuuugcuuuuuuuuuaaaaagcagguaucuuagaagguguaucaagucuuaagauuuuuacauuaggagagcugugaauuuuaaaucacuugcagcuaaauuuuuuacccacucucuuuucucuccaccagaaucauagaucugucucacaaaauuagucuguguuccauuugcauugcagugagacuauauucagauagccgccagagccuaugccucuagggccauauaagaacacuuuuaaccaguaggauguuuuuccugagcucugcuugcuguuaaauaauagcauuuugcaccuaaacaacuuggugaguugaaggcauuaguguacugugugugacccugucgguucagcacaggcuauaucuacaguucuuccuacacucagcuagauagaaugcacacauguguguagcuccucgccacaggagacugcaaugccuguggagaaaauggauuguauaagcauuugauuguugaaagaauuguugagaaguuagaaaucauuuuccuguaguaguaaaugauguggaagcugcuggggucagccuccaaaagcuucacaaaccacagucuuucuaauaggauuugagaaguaacugugggggggagauacauccuggggucuuuagauucuagcauuauguguuuucaugaaagcaggucucaaacacugaacuaacaugaccugaguucaaauucuugcuuucuuaguugguaugacuguagacaacuuggcacccuuagucacuguuaugcugcugugaaaagacaccaugaccaaggcaaaucuuauaagggaaaaguauuuaauugggguuuugcuuacagacucagagguuaguucacugucaucagaguggagaauauggcaacugcaggcagacacuggagcaguagcugagagcuacaucccgaucugcagggcaagaggguacaacaagaggaagagggagggugagggagagagacugagagacuaagagacugagacuaggcuaucaugagcuauugaaaccucagacuccacccccaguagcauaauuuuguaucaaggucacacccuacccuaacaaggccauaccuccuaauccuucucaaauagugcugcuucaugaugauuaaacaugcaaauaugugagccuaugggggccauucuuauucaagccaucacauucauuaaaccugacuuuccucaucuguaaaaugggaauaaugaaugccuauguguucauaaucugaguauuaaagccauccauaggaauaaaugcacucacaaugcacugagaguucaaugugguacauguacuccauauauuugaguuguuguuacccuugugucuagcugcugcagaagggguucaucuguucuguagauucgacagagugaucccggcacucccguaacauaagugaugguuauugucaucuagaguacaaacucaggggcuuuaaggaagcaggaaaugauggguaaaugucuggaagguguguuggcccacaugggaagugcgauuugagggaguagacaagaguaguuuucccaagguuugccuguugcagaauaguaacaguuuauaucuaaguaaaugcacaaguuaaagauaucaguauaguauguguggcccugcugcuuuagcacaacgcucuccccagcauguauuucucacccugauaccagagacuggguuugagucaucaucucauccagugucucuguucuauuucuauauguaguaaaacauugaucauaaucaaagcaggagcaaaggguuuauuucaucccacacuuugcagucuggagagucagagcaggaacugaagaagaggcuguggaggaacaccucuuacaugugucuuugcucuccauggcuugcucagcuugccuucauauacaacccagguauuagcucaggguuaacaccaccaacaaugggcugggccuuuccagaucaagcauuaaucaagaaaaugucccaaagaccugcccgcaggccgaacugauuggaacaggggcucagucggugcuccuucuuccuggguaacucuuguuugagccauugacauacacuaaccaacacaggcuggcuuacccucccauuccauuccuccucauacaguguucuuagcuauuuaucugugucauggccccuucugauauugauagccuagaaccauggaaaggaagguagaaauggcaagaagauuggcacagaggaggacacaggacuaauuugaugugaucaggugaggaauuccucugguaggccaacuggaggguucuccccacaagggaagaggcgacaaggcggagugugccagggggugcaugguuuaauccuacuuggaagagguucucugugaagucaagccauuuuuagugaacucaugguuaagcaaacuagaaaacaccacccaugucuuagauaaaagucugcuuacuggaccuugucauugaaauaauaaacucaccauaaucaaaaguuucacucaaagaauuaagagaccuuuugugcugagaggagaccgugaguccaucuuauccauuuucagacauuaugcaaauggauacgugaaacgcuucauuguagucaaagcugguuagcagccauuguaccaagaacacaaguacccuggcuggaggggaggagaggauuucugucaguguguauuuugaggaaacggggacagaggagcaugauaaugcgauuucacaucauugagagccugcaccagaaucuccaaacuaggagacugcaauagauaagaauauauaaggguugguuuggguuuuauuguuucugggaccuccuuuuccuguguuccacucagccagauuaaaugucuaauaggucccaucagcauggcauccucugauaccaagacuuugccucgggcaugaucuuaaguaauggcuguaacagcaaaccuaagggauuuauuuccacagcuucuccacaaucagcuugucuugagcaagcugaacuuguccucaugaaguuccuuuggauaaaaauuauaaccaugccaugccuuuucacggauuggaaaacauucucacaaagcucacugauauuuuuaucuguaguuuuagguagaagucuguaagcauguagagucaccacuggccuuauuaauauugguggcaauuguaugacaaaauuauagauauuaaguaugccuuuccaccauuauaccauuaucauuaguuauaauuauaauaauuugagaaguugagggauuaugcaauauugcuuuaucuuguuacuggauauucuuacaucuuuuggcauacgaggcauaaggucuuccucucucaauggucauauauucagaaaguaagcaacauauuuauccagccccuaccaccucuaacccuguaucaugagcccucacaggagggcuuugggacuagcuccaagaggcugucugccaaggcauccagaaagcuuugcugcucuucuagcugccuguaucauaauuugcucacaacuuagucacaauuguuggagcuuuucucgaaaagcaaguguucuggggacucuucuugugccacuaaugccuuguuuuucauucagauucagggacucucagcccuuugacaacugcaugccccaucucuucguaauggcaaacacuugaucuuucccaggcuggugauaucugucgagguuaacccugugucaguuuggguugagauguggcguggugcuauccuuugucucuuugggauaauugaaacugaaguuuuacuuuuccugucucugaauacaagugaaaagacagaggacuguguuuuuaaggaaaggaucuaaacuaaguaauuaaaacugcaguguucuguggaaacagaaaguucaagaacaugcucacuuauugauacagggucuaagcggauagcccaggcuggccucaugcucaccauauagauagcccaggcuggccucaugcucaccauauagaccauuugaacucaugaucauacuuccucaagcucugcauagucuuuuaaagacuuaguaaacucuaucaggugcugaugagauggauggaucagcgaguaaaggugccugccuccaaaucccauaaccucagcucagccccagaggugcacauaauggaagauaacuaucuccugcauauccaccgccccacaugcagcugagagaugcucacaagcaugugcacacauacacacacaugucauaugucaauaaaauauuuuaaaaugaauuuuguuaaagaaaaauucagugcauaauacaugaaaaugcccuugaacuuuuagguuuauuuuuuuaaaaaaugguugaggacugguugauucuagcauaucuagccuuuccacauugcaagaccauguuguuaccauguuguuaccuacagaguuuauguucaagaaccauguguuccaguuaucaaaaaaaaauccucaauguuuuaaguacguugaagauuuuguuuuaggcuauauucauaacuauccugggacauaugugacccacagguugcaagaaggacacacauuugacuuagaauuacuagaaaaucccuaaacagugguucugaaauccuauguagaagucaguaugcucccugggaaucacucuuccuaguucacaagaaauguaaguuaaugaauggaaugauuauguuuuuuaaauaugccaaaaucuuugguuucauuacaccaaucaaaauauccuggaaaaugucacuuugugcaauggagauuuuuguauuuaauuugaauuacauguagacuuuuaaauagcuuccagauucucuggugcucaaauaacugcaagagccuuuugucauugguauccaagauauauuuucagucuuugaaaaugaaaucagauuucauaaggagugacaucaaguauacucuugguaaucuauugucuuauccauacuucuuguuuucuucccaugucuguuucauaauuuucacuaugaaguugaaugucuaccauaucuucuuaucaagucugcagguggaaucaaguauaaaugugcuaaguucagacguaccccaaugcuuacuaugauaauagcucuaccugcaguaguucaaccuuaugguugugaagaaugaagcccguuuacuagaaacugaacuuguaauuguuacuuucuucuugggucagcaguauguguuaacaccuucuagugaugccagaacuuagcagcacagcuucugucagccacuccaucacuugaaccaccagccaaguugcuacugggugcuacgucacuagaauuuguuggauauugguuucugauaaguaauguuagcaauuccacacauuaguguucaguaugcuuugcauuagaugaucuugcccaacuauaggcuaaugucaacauucagaacauguaucccauaggcuggcuggcauauucagacuggauaguguauuguauacaucagcaaugccuggggcuuuugauucaugauggauuuaucagggcauaacucauccuuaauaaagaauuaucaguaacuugccccagaucacacaagugucaaaugccagaaugaaaugcuauguucggcucccuuuaaaggacuuaguguccugcuguguccugauacuuuuuuauacucuuuucucuccugugucccuguugacuuuccucuuuuuccuucuuuauuuaaucaugguuaaauacauaucauaaaguaaaauauguuaaccauuuuaaaacacauaguugguuagcauucacucacacuguuacagccauugccaccaccuagguccagaauaguccagucuggaugggugaguacuaagucuauacugcuuccccaucuaagccugacagcuuccacuucucuuuagucucugaucuugacuacuccaggaccuuacacaagcagaaccacagagagucuggucuuuagugacuaccuugauucacuuagcauaaugcccuuuagagacuuguugggcuggggagauggcucccuggauaaaaguccuuguggucacaucuuuuaggaggacaccugacgcagcaucuaaauaauuucacuuccagcucagucgauuuguugaagauccguuuuguggaaaaaaugagucuuacauccagugaccagaaaaccagacuagguguuuccuaaguuguauucuaucuuaggaaagcagacagauuggaaauuaaucuuguuuauauucuuagcuucaucugcuauguaaguggguuauacauggaauaucuuaaaucaguacugcaaaggacccuacagggccuccagcagaaccuuaggagagagcuguuugagaaccaagcucuagaaugguagucuaaaugaagcacuaggagagaaaccugcaggugguggcuguguagugcuuuuuuuaacccaccaaagguugugggcagaguuagugcuccugucuguauacagagauauuagcgagaagauacaucuuaagugauacuaaugugcuaaaugcuguuaacuuuuaaaagaaacuuuuacugggacuuuuuuuuuuuaauauuaaaauuccacaaaguuuuaaaauuuuauauuguaccuuagcaaagacuuacaguauagcaggagcgaugcuagcugguuaccauauuaucaccaggacuuguuucuugagaacaugauugaugccauuuuacauacuacacacugcaggcccuggcacuguggccaucuggcucacauggucuuugugcuuuaucuucagcugggucccuggccucuagccacuagagggcagugcuaugcuccacaccucuguaacaaugagaaauauuuuuaggaguuuccaaauguagggguguuagucuccuaucugauuuaggauugguaaaaauccuuucccaaucuguugguggucuuuuugucuuauugacagugucuuuugccuuacagaagcuuugcaauuuuaugaggucccauuugucgauucucgaucuuacagcacaagccauugcuguucuauucaggaauuuuuccccugugcccauaucuuugaggcuuuuccccacuuucuccucuauaaguuucagugucucugguuuuauguggaguuccuugauccacuuagauuugaccuuaguacaaggagauaggaauggaucaauuuacauucuucuacaugauaaccaccaguugugccagcaccauuuguugcaaaugcugucuuuuuccacuggaugguuuuagcucccuugucaaagaucaagugaccauagguguguggguucauuuuuggaucuucaauuccauuccauuugucuacuugucuaucgcuauaucagugccaugcaguuuuuaucacaauugcucuguaguacagcuuuaggucaggcauggugauuccuuuuaucuuugagaagaguuuuugcuaucuuagguuuuuuguuauuccagaugaauuugcagauuucucuuucuaauuuguugaagaauugaguuggaauuuugauggggauugcauugaaucuguagauugcuuuuggcaagauagcauuuuuacuauauugauccugcccauccaugagcaugggagaucuuuccaucuugagacuaugccggggccuagcaaacacagaaguggaugcucacagucagcuauugguuggaucacagggcccccaguggaggagcuagagaaaguacccaaggaccuaaaggggucugcaacccuauagguggaacaacaauaugaacuaaccaguaccccccagagcucaugucucuagcugcauauguaucagaagauggccuaguuggccaucaguggaaagagaggcccauuggucuugcaaacuuuauaugccucaauacaggggaacgccagggccaagaagugggaguggguggguaggggaguggguggguaggggagugggugggggaggguaugggggacuuuugggauagcauuggaaauguaaaugaagaaaauaccuaauuaaaauaaaacaaacaaacaaacaaaaaacaaauguaggguggauuuaggggaggcaaagucacuccagagaagaauaacuagcauacuggagagaucuaaccauaacauuucuaaauuaauaaacugauaaaacuaacuaauauuuuuuaaaaggucaaucucucuucucuauuaaccaccuacuggccccuucccucuacugcaugccucuaucuugcauucagcaaauguguugcuuagugguguuauacaguuccucugaauauagggaauagagugcccccuuuguugucaaagguuuacaaaggacagaaacuuagagugggcaccaaaugacagaauaggcauuuauuaccaugcaaaaucaaacaugaaaaggaaacuaagaaaagaacaaaccaaaaauaaagaaaaggggggaaccaacuaacuccccucuuuuuaaauaccuuaaacagagagagagucauuuucuugaucuuagaguuaucagagaaauugaacaaugucaguggcuguaaggaacaaacuacaggauagauaaaaggaaaagacagcaagugcccgaaaagagacaaugcccccacucagagcagcaaagucacaaggaacaaaaugugggaacaacucaaaugucuaggugaaugaggauacacuggacuggaggaagcagcacacagcagcacacagcagcacacagcagcacacagcagcacacagcagcacacagcagcacacaacagcacacagcagcacacagcagcacacagcagcacacagcagcacacagcagcacacagcagcacacagcagcacacagcagcacacagcagcacacagcagcacacagcagcacacucggccuggaaacaggaagaagcuguagugaugcuggaacucgccugccugccguuuuguuuuguguggggauggcaugcagauggggcaguaggaucgugcaugugcauguguacccacauuugugugaggguaaauguaggcacauugcguauaccacugcagauaugcgaaacucagagacagccacccguguguggcuccccacccucugccuuguuugaggcagggucuuacuugcucuucagcacugcguacaccaggccgggcagccaacaagcuuccagagauucuuuugucugucuuccagcuucccaucuccccauaggaacacuagaauuauaggugcucgugcuaucuaugcgucugccuuuugugugggaucugggggaggaagcuuuggcucucaccacccagaagccuaaaccagucucugaaaugacaaaugggacagcuguggcgcuguugccuuggaacuugucccaugcaugagcuaccagggcacacaucuaugucagcgguucucaacccugucaucggcaacccuuuuggggauccaacaaccucuucaugggggacaccuaucagauauccugcauaucauaaaugcauuaugauuccuaacaggagugaaauuacaguuauaaaguagcaauuaaauaauuuuaggguugggggucaccacaacacgagguauuaaagggccgggucgcagccuuaggaguucuagauacuuucuugacuaaacagccguuuuaaggcuggaggcagacuaaauggagagcaugaauacugucaguauguccucaucacaaguucauguccuuugcauaucuuuagugcagaaugagaaaauugcugucccuaauaagaaagaagccugaaguucuuaauuauuaauggaagacuauuuuaaggcuugguguuacagucauaucccaaaggaggucacaaaaggggccuccuguccauggacagaaacugguccucgagccuggcaacuccaaagcaguucugacaaaugcacgucuuucucuuccaggacgugggaagaaggcaaggugcucaucuuugaugacucuuuugagcacgagguuuggcaggaugccucgucuuuccggcugauauucaucguggauguguggcaccccgagcugaccccucagcagagacgcagccuucccgcaauuugaaaggcacugacgcagacuugguugcucuccagggaggcugccuuucugguuccuuuuggguguggagauagaaguccaaguaccaugacucuucauccccgugccaugcagcuggagaccucuaagguuccuucuggauuagaacucacuggagggaacauuugccuuccugcgauucauuuaggaggccucuugcuucaugucacccaugacagcacagaacuagugccugcauuuaaggggcagaaaacuugguuguguugucuacauggcuggccaaagauauuuuucuacauagaauagugucuacaucaaugcacauggaggauauacuauauagagaaacugugaaugaaucacuuuaguuuguaauuuuucuaugcaguuauauuuuucuaaguagcuaaacuguucugucaccaucuacccccauguuuucguugacuuuaaugacaagaaguauaaauucuuuacgucuguuaaauaguaauuuuccugguaaauucagacauuucuuuuuuuagaaagaaaaaaaucacgugugaaagaaaagaacuuuguuuuccuaacauaaauuggaagucaugcuaggaugcaugaacugugccaacacuugcccuugggucuaccuguguauccucauuuagacucagugucucccccuuucucugugcuaauaguacaaaguuguuauuucuaagagcaacauuucuuuuuaaauuacacugagcaaagccauagaaacauuuuaugugauaggaaaauaccacagauaauggagcuuggagagaaaauaucacauggaagugaaauuuccugcucagggucagggacccagguagccuggccucuuugccuucuauacccaaggccuggagucugcaguuccugccugcuguagauccacuuacgugucaaaaagaaggccucuuagucucugagagucucuucacuauuuuauccauguaggaauagcagcauagaaagugcccagggaugcuagcauccuagguggucaagcauccuugauuaugaauuugcagugcuuuuccaucuuccuccccucagaauaaugucagccaucucauuuuauacugaaccagcguugacaggcauguuugauuugagugcuauccauggcugagaaagagcaguagaaagccaucuugcuccucaagaugaucauuaguaaagcauugcugcauuuuauuuucuauuuuaaaauuaaagauaacucaagcccuagaauguaaugacauucaugcacugaucucuaagccagucgaacaacauugcugcagaaauggcugguauuccagccacacagagaugugugccuuucaagcagugcccaaaaaaagcagcuuucuguaccucauuuaaagagcaauucauugagcuugauccuuucccuuuuagcuuaaggacauuagcucuucguaggaaaguuuacaaaauauguguccauucuuaaaauagguacuugucccuuccuuugccaguguucaaaaauuccucuaaaacagauggcaaaggcaugaggggaaauaucaaauccuuaccaaauuccagaaaagaaaacaaacucucagacaacagaaaguuauuuguguucuucaguauuuauuaaacagaggaacuuacugacaaaggcaauacaauccaguguucauguaguaacccucgguuaccugcuggguuuaguucuccucuauacuacauauacauagcgaaaugcaaaccauguguucucauuguuaaacuaucaccuuacauccauggaauaaaauggaggaaaugagugaaaauuagcuguuaacuuaguaaauauaacauguuuuuuaaaauauggucauuacaguaggauucuaaaucuugccuugugaaaagccagcaguaccguuacuuuugcaaguguuggcaguggugcacuccaacagcauuuuaaguacuuggaucccacguugaucuuauaaacacaagcaauaaaagauuuucuaauucacuuuaauuuuuccucgcucuuacuugugucauaagaaaagaauuuccauccaugucuugguaaacauuuuucaagguuauuauuuuacaauucuaaaggucuauacaaaaugaauugguaggguuuuuuuuuuaauauacuaugaugcaauuguuugggaaauauuuuaaaauucuguuucaauuuugcuucuucaagguuggaacauaaaaauagcuucuguuacuauucucugccaguagaaaaaaauaauaaaacaguagaucaacugaggaguauacaucuaguuuguagcucagggcucagggguuaggcccuggguuugaucuucagcauuggagggagacagagaagagaggguaacagggagacagagaaagaaagacaaaggaaaaggagaggaguguaaggaggagagaagugggaaggaacagggaaagagagagauggagagagggaaguggccauagucaguaauguuuuguguuuauggcgggaaguaaguugaauugguuuccucuuuucuuuaggcuguucagcuaguaaaucacucuaccaagugcuuaaaauguaaaguauuuuaauaaguguuagcaauuaaaaauuuugacauuaucacucuggucauauuaguaagugucugugucguacagaugcuagagaauaagguaucuacacauacucagcuggucucaggaaacauggcacagauaaaauauccuccccuuugcuguucucugucugacuuccuaugcaugggggcugggauccauuucuaaggagaauggauaaggaaguaggcuggucuuuggcauuucaucuugcauucuugguccucuuuagcuugguacuuacaugcugauccauccuuaagggucuuucugugagauuugaaugccugcccccucagggccuuucuccacagguaauaggagcauggggacaaagggacuuauuugauagcaaguuuuugcuguaguaacccaagaauuaacuuaaaaggguaaucagucaccaguguguguguguguguguguguggugugugguguguguuccaaugaguugcccccucucuguaggcauucgccuacaggaaaucacuuugcuacaaugaagcagccucuuuuuuuuucaaacugccucuuugucuuaaaaagcaauucaugaaagucagcugauggucugacaagcaacacgauguccaaaucauucuuguaggagagagauuuaaaugaaaaacuuugcaaauagccagacgugggagaucacacucuuaggcugacuacuuagaugcuggugaugaggucaggaaauaagucaauaggacuggaaauuauuggagcuacugcugcugggguucagcacuacauuaaacuugcugaugugucugcacauuuuaacucuguuuuauuuauuucggaaugcauuucaucuuaauuugcaaaaccuggagaggguuccugugugagucuuuagagugauguauaugcaacuaauuuaggguuuuuuuccccuuuugaaguauauuugcugccaaaaauaugaggggagaauccuuuuuacauaaaugccuuucuucauccccgucaccauuccucacuaaaacauaaauuaauucguuaaauuuuuaaaagcgucucucagaucuuuguccggugugggcuacccagaccaaugguugcugacagucauggcugggacugggauggaggaccucaugucaagcagagcacacagagugucuguaggucaguugcacaggcuugcuggacgguugcuccacuggagaugucacaugaugcuggcuggcucaguccagagccagcaguggcuggguguucucauuuucuccuuucucuucauguuucaaggucccagcuucuaccacagacugagaucuaacaagagaggaaggagacacacacagucacagacaguccauacuggugaugcuugcuacucaccugaaucagagcaugugaaauagcuacuuagugcuuccuuucugccaucuguuuuccacacaccacuuuauuucuuuuuuuuuuuuuucuuuuuguuuuucugaagauugaaucuggucauucugagauucuuuuuuuuuucugcugaauuugauccauaucuuuuugcuguaauaaguccuaugaguguaacauuuuguucauguuccaaauaaaaauaaagguaauucgaaagaugcaaaaaacacugaauguuuuguguuuuguguaugcuuggugguugucuaaggguucuucacacauauaagcuuaccccauuugcaacucugagaaauggaucuacagucuccauuuuuaagugccaaaagcaaauuaaggguucaacagagaaauaacuugggacaaaagcaauaugacaggcagagagcaggaucuuuccaugagcagcuuuccccagaaggucuggggcugcagggccgccucgccaugcugauccuaacacuucacuaggagcauggcuugcagccuaagguucugagccucuuucauaauauguauguagcucagaaagcacaagacuuaagaaguaaguaaaucagugcugagcacggaggguauagucgaguaauaccagcucugcggagaaagaagcaugagagucaauggcgaggccugucugggcaguauagugagcuccagaccagccugcguugcauagugauccuauggggguggggggaaccacuacauuucugaaaaaucagaaaccucagaugauaacaagacaaacugguaaaaccagcguuccgggaagcugaggcuagaggcguguggguucaagccaggcugagcuauauuuugaggugcuauauaaaauuugaaagaaagcaaacagaccagaccacagcuguauggcuacccacacacagcgacucccuccagauucuuaaaccacugcauaauugcuuugcacuaagaauucuguggaaauaaaagagccugguagcaaucaacuauugaaaguuugaacugcacuucuuucugacagauaaaccaacuuuauuacacaaagcagccccuugcccgccuggagucugggugaggucuaggugcucaccggcauuguucaugcaccucuucuugaagacggccaacucgagaagcuugcuccucugugacccagaagaucaaccuuucaaggaucguuuuucacauugaacucaaaccugguuuugaagacacauguguccugucuu

SEQ ID NO: 1780 - RNA, 1503 nt, Mus musculus
uguuuucauuggcauggcacuugggugguugguuccaucauccauaugcagaucuuacaucucacauaauauugcaaugcacacuacagacacauauaauacauaaaauauccuguacaacauuuauguacaagauaugcaucauggacguacacacuggagccagguuaugauuaacugggaacucauuggccuaggcauguuuggugagggugcgcagggcagcaaugcagcaggcucacaggguaauggaauucugcacaguuggcagugugucucagagacagugggacugucacauuaaccagguuaccacuacacaaguaccacuuggcagcagggcagcgcuguggggagugagauguuucuccacaccaccucaacaccacuguacuaaccacagcucagacgagaaggguguggucugccuagaaucccugcugcagccuggacagugaagugcgaggacacggggaagacuuuagaacugcagcuccuucuggauuccccagagggugucugcacucuucuucaggcgggccucuuccucaagagucagugucaccuucacagcauccgagauuccauuuugucccaggauacaugggacacugaggaagacaucaucauugauuccauagagacccuuaaucaugguggaaaugggaugcacccaccuaagguccuucauuaugcucuuggccaaguuugccacagagaggcuaauggcuuucagcuugaucaccuuguaggcacuguccaccugcuugugaaccuccuuccacugcuccuugucugcaccagugcccaguucuggguucagagacuucagggagacaccagcaauguucacaucacuccacacaggcacacuggaaucgccaugcucucccaggacccagccgugacagcucagcgcgugaacccccagccuuucucccaucagguaauggaaccgagcugaauccagacuguaaccacuuccaauaacucggcuuuugggaaagccacugauuuuccaagccacguagguuaagauauccacuggauuugagacaaucagcagcuggcaguauggacuguacuugacaauguugggaacucucccccucuuguugacggccucccugugaugaccagcuuggaguucgcaguuacacaauagucuuugcuggagacaauuuuugguguuuuaaggaagaagcugcuaugcuggagauccaucaucucgcccuugaguuugucuuccaugacgucaacaagggcaagcucaucugccaaguccuucauuaagauacugauggcacaagccaugccaacagcaccaaccccaacaacuguaaucuuguucuggggagacuguucuuccuuaagaagauucacaaucagcugguccuugaggguugccaucuuggacuuugaaucuuuugagaccgcuagugcacgauggggggcgagcagaagcaguguggccugggcucggcaacaguggcuccagcaccu

SEQ ID NO: 1781 - RNA, 2024 nt, Mus musculus
guugccuugggggcacaaagucugagggcugaagaguagcagacguuuccacagccgcugacccgcagcuugagugucccgcaccgccuuucguggaagucugagccggcuguacagcuuuccuccuuguuccugcagccauguccacaaacgagaaugcuaacuuaccagcugcccgacuuaacagauucaagaacaaggggaaggacagcacagaaaugugucgcugcggaauagaaguuaguguggaacucaagaaagcuaaaaacgaugagcagaugcugaaaaggagaaaugucagcuccuuuccugaugaugcuacuucuccgcuacaggaaaaccggaacaaccaggggacuguaaauuggucuguugaggacauuguuaaaggcauaaacaguaacaauuuggaaagccagcuccaagcuacucaagcugcucggaaauugcuuucuagagagaaacagccuccuauagacaucaucaucugggcugguuugaucccaaaauuuguguccuucuuggacaaaacugauuguaguccuauucaguuugagucugcuugggcacucaccaacauugcuucuggaacaucugaacagaccaaagcugugguggauggaggugcuaucccagcguuuauuucucucuuggcaucuccccgugcccacaucagcgagcagcuguuuggguucuuggaaacauugcaggugaugguucagcuuucugagacuuaguuaucaaacacagugcgauugacccacuguuggcacuucuugcaguuccugaucugucaaccuuggcaugugguuacuuacauaaucuuaccuggacacuuucaaaccuuugucaaaacaagaacccugcaccucccuuagacgccguugagcagauucuuccuacguuaguucgacuccugcaccacaaugauccagaaguauuagcagauuccugcugggccauuuccuaccugacugaugguccaaaugagcgcauugagaugguugugaagaaaggaguuguuccccaacuugugaagcuucuaggagcuacugaacugcccauuaugacucccgcacuaagagccauagggaauauugucacuggaacagaugagcagacucagaaagugacagaugcaggagcacuugcagucuuucccagccugcaagucuaacaaaccccaaaacuaauauucauaaggaggccacguggacaaugucgaacauuauagcuggacgccaggaucagauacagcaaguugugaaucacggccuaguccccuuucuuguugguguccucucuaaggcagacuuuaagacacagaaggaggccgcgugggcuauaacuaacuguaccagcggugggacuguugagcagauuguguaucuuguucacugugggauaauagaaccuuugaugaaccucuugagugcaaaagauaccaagauuauucagguuauucuugaugccauuucaaauaucuuucaggcugcagagaaacuaggugagacagaaaagcucaguauaaugauugaagaguguggaggcuuggauaaaauugaagcccuacagagccaugaaaacgagucuguauacaaggccucauugaacuuaauggagaaguacuucucaguggaggaagaggaagaucaaaauguggugccagaaacaaccucugaaggcuucgccuuccaaguucaggagggagcucccgggaccuuuaacuucuaauguccagccaaggcacaaaguuguuagcuaugugcugugcuauucuguauucucauagauuugucuuacuguuucucuacuaagaacucuuuuuaaaugugguuuguuauuguagcacuuuuuacaaaagaaacuauacuugaacaguuauaaacuguacauacucuaugaagcuguccucugaauuuauuucuauguggaauuucguacccugucauguccuguaaauaaagauuaaaguuccauucuuuacucugaaaaaaaaaaaaaaaaaaaaagaguugccuugg

SEQ ID NO: 1782 - RNA, 548 nt, Mus musculus
uuuucuccggcggcugggaagauggcggacauucagacggagcgugcuuaccaaaagcagccuacgagcuuucaaaacaagaagcggguucugcugggagaacccgacaaggaaaaacucccucgguacuacaagaacauuggucuaggcuucaagacgcccaaagaggccaccaagggcaccuaccuagacaagaaaugccccuucacugguaaugucuccauccgagguccgauccugucuggugucgugaugaagaugaagaugcagaggaccaucgucauccgccgggacuaucuccauuacaucugaaaguacaaucgcuuugagaagugucacaagaacaugucugugcaccuguuucagggaucauugucacauugucacaguuggagaguguaggccccugagcaagacugugcaauucaaugugcucaaggucaccaaggaugcuggcaccaagaagcaguuucagaaguucuaaggggacucuggccaaugcccuagaacaaauaaaguuauuuuccaacguuaaaaacaaaacaaaa

SEQ ID NO: 1783 - RNA, 548 nt, Mus musculus
uuuuguuuuguuuuuaacguuggaaaauaacuuuauuuguucuagggcauuggccagaguccccuuagaacuucugaaacugcuucuuggugccagcauccuuggugaccuugagcacauugaauugcacagucuugcucaggggccuacacucuccaacugugacaaugugacaaugaucccugaaacaggugcacagacauguucuugugacacuucucaaagcgauuguacuuucagauguaauggagauagucccggcggaugacgaugguccucugcaucuucaucuucaucacgacaccagacaggaucggaccucggauggagacauuaccagugaaggggcauuucuugucuagguaggugcccuugguggccucuuugggcgucuugaagccuagaccaauguucuuguaguaccgagggaguuuuuccuugucggguucucccagcagaacccgcuucuuguuuugaaagcucguaggcugcuuuugguaagcacgcuccgucugaauguccgccaucuucccagccgccggagaaaa

SEQ ID NO: 1784 - RNA, 2988 nt, Mus musculus
uuuauuucccccugauguggaaaaucuaaaagcacagaaugaugggaacaagaguaugaugugcuugguaucuggcuuuuccccaagcagucgaugucaagguuacgacaccagugacagagcaugguuuggaaauccuuuauucucuuuucucaauaccaaguggugccuuacuguggcagcagugucacugucacugaaauaaacguaagcccuaccuucuuucuuguuugauugauuuagacacacuggugcucuuacagguggagaaugaguguuugauggauauagguaagcauauuuauuugacagcuaugaggaacuaaauuuagagguuucuccaaucuuauaugaauauuuuucauaaaauaguugugauuauauuuuuacaucuuuuaugcaccaaauuauaauggucacauauguuuagcccguugccacuguucgggauucgauuugaaacucaucacuaguauagaaguggcauaucccacuagcuucuacuuuccugauauauuuuuacaaauaacuuuauuugcuuuacauuauuucuaaaaggaaaaaucugaggaaacccuuauauuuuccaacaggguuccucuguguagcuuugcuuauccuggaacucgauuuguugaccaggcuggccuugaauucucaaaaauccaucugccucugccuuugccuccccaggcaccacuaccaccugacaaaaaugaaaagucuuaagaaaauccucccaggagaacauggagucuuagagaucuggaagagaucggaguuugacuagguuuccugucugcaagucaauuuuuuuugugaaauuaucuugauuuacaacgugguauuguauuuuacagaguucaugaagccccaaacaauuuuuauuuuuguaaaacaauuguauguuuaaucuguuucugaaaucauuuugcaauauauggaaauagaguagcaguugauauuucuaaauugugaccauuguccgagauugcuuugagaacugguaguuauucucuuuauguuuggaggcagccauuaggcuguaggccugcuuacugcauagcacuggacgugccaggcacauucuggccccuggcaugcuuaaguaacuagguuuucaaaugugggaaaccaagcugaaaggucuguuuuguuuuguuguuguuuuguuuugguuuguuuuuuuuuuuuuuucagaguucuuuucaaacccaguuucccuuuuucaaacuuuaaaaccugcauaauucugcagauguccuaggguuugagucaguaacuugugaaugaaagucauugguauuuggcuuugugguuacaguacuaauuuuacuuugcugcucaguuuugaaagugugugagcuacauaggucucccuguaggaaaugugaaaaaaagcacaauagaaccaggcuaggggcuuuguuccugcuuuuuguuuuguuugguuuuacuaucagauggauggauuuguguuugucucagagcagcauauacaugcagucaguaagcauguuugaaaggaccauaaaaaccagagaaaugcugaugggaacuuggaaguucagaaaccaaggggaaauguccugagauaacauuugcauugucgaccucaguugacuguuuuuacaauaaaaauauuuugcagcuuauuuccuguguuuuuauauuguaauugaauauuuucuuccuuuucuaacuaagauauuaugcauaauuccaccuuaguauauauuagauaugaaugcuuaggauguagacacuaaugaagaauaguuuuuuguuuuuagauagaccuauuuuggccucaaacggacuauguagcaaguaguagcucuaauugcgaagcugagaauucccuugaacugauccucgugccuccacauccagaggacuagaauagcaggcuggacugacccagaguacugagguccuucguucuucuaggcaagcacccaccagcugagccacacuccagcccuguccacucuuuaggaggugcugaugcaggauuggcagaauugcuuuuuuuuuuuuuuuuuuuuuuuuuuuuuuuuuuugacuugggaaacucuguuuauugauccucaaacccaauacaaaacucugcacaaguuuuacagguccuugaccuugaggcaacacagcugugcuugcuaaagucggcuugcuugucucucugggcucugauucugcuuucugagacaccaagaggauuucuccugcucuccuccucugcagucuccaaguuggugaucaucaucugauugugguggaggguggaggagaggagaggcagaaagacccagaaguuucucuguaggcuuagagaagugagccccacagccaauccaaagccggaucugguccagguugagggcaacaaaguuuucuccguuacuuuugggcaguggaucaucggagcccaauugcuccagaaguggccauuccuguaacacuugugagcaaccacaaugugguaaaaaggcugauuggugcagccacccgaagcaagguguaugcuuagguggacucucugauaggcuuugcagaaaaggcggugaggugaaccauggugcuucugcgagcugcucuuaggcugucccccucucggugacucuuaacaucuuaauuuuccaagaguagaaagaacagggagauugacugguauuacccccuuugcuauccaguuaauuguccuaguaaguaagccacauuaaaaugauaguugaaaagcuuuggagauacacguuuuuaucaggggcaauaaagaauuuaccacuugcauuguuugugcaugagccugcgaguuuguauggagaaaauguaauugugugccuuaacuuacaaauuuuagcagcuuuauuugaaacauccuccauuuuauuuaucuaccugcaguccaccuguuugagauguucaguucagugauucauguucauucaagcuaucacugagcuuuggauagcuuuauccugcccgccc

SEQ ID NO: 1785 - RNA, 13856 nt, Mus musculus
cguccugcucuccggccagguccccagagccucggcgcucgugcgugcggacggggagggcgcccgcuggagucccgagagguggucagcgcccggaacaggcgucugaggagaaaggcagcgcgcggcgccaauauuucccgcgcgggcucugggagggagccguaggcaagagcggaguggccgcucggcggcgcgcggggacaaggcucccacguaccucguccggccgcgcugaggcaccuuccugugcgccgccgcccgcucgucgcccggcggauggcuccggcuccgcacguggcgggcggcgcgcuccggcguguuuacauucugcggccgcuccacguugugcugccguccucuccugccauuggccggcuccucccggaggggugggcccuaggcucccgcuccccgugccucugaggagacuugggguuccccaccccagcccucccaaggccucugccaaaacgcggagccgaaccguagccugacacuccgagaucuaagagccaccgugagggggcccggcgcgaacuggaaggcgugcgggagccuguggugggcaaccagcaugggggaggagccucugagccgugcagccgcggcgcgcgcaggugaagcgccgagaggggcggaggagcacgguccaggagggcagccguacggccacucggcgcccgcccgcccgccagcccguccgcgcgcacugagggcagggcgcggcgcgcgcgggcgagcugggcgggcgcgggugggggaggggaaggcgccggccgaggugucagucugcggcgcaugcgugcggggcgguccgggcccggccuauauauugaguuggcgccggcgccagcugagccgagcuguggagggucuggcggugaggagguauuggggacaggggcaugcgggagcuaagggaaccacgucuggcgggagccaugggagaggaaaaauggggggcgggggugggacaagaaguaggagacuggaauucagggguucccgagguuggucccugucaggauucuugucaggaggccaagcagaggcaggggauggaguguguccccaaaugagaggccacggcaaagcuucucugggagcuucucuguccauccucacuuggggaaggucucccgcgcgagaggauuaaggugggaucacuucacggagagauucuuaagcacgguuuucuccuuuaauuccccccccccuuuccuucugcucuucuggaauuggggucccgucaccccugcaagcgacacugcccgccggguggggcugggaaggagggaaaggagccuggaggacgugacaccagaagguucccuccacccccugcuuccccgccacagccgcucuccaaauuggcgcggaaccggcuucuccacagcccgcucuuggaggcucguccaggcgccuggcggccgaggccaggacgugccuuucccacccugguuguccuggggagugcaugaauggcccagaugaucaucuaagggugcuaggggacuuugcaaauuccugaacgcacucgcguucccaguguacaguuaaggaaaugaaagcaugaauguaaaauuacugagauagcgaguguauuucagaaaauagugcaguguuuuauuuuuaaagguuuaggccaccuucuaguaacguuaguugguaacuucugaaucaguuuuaauuuggaacuugaagauuauggaugacuauguucuugauuuuguuuuucuucuccccuauuuagagguuucauaguccuugaagagaaugucaagacgcagguaacaguguuagucuuggagacauguuucaaaauuagcugcugcuuuugaaauauaugacguacuaauuaagcuuccuuucuacaauucaucacaguagccguuuacaagcuaagcaacaugcccagcccaaccagccagacucuccgcaagaaacccagauaauucaggccaagaagagaaaaacagcacaggugauuuaaggaaaaagagggagaaagggaaaaauauuccuugcugaaaccuuaguuuacauguucuuuucuauucuucaggaugucaaaaaaagaaaagaggagaucaccaagaagcaucaguaugagauuaggguaaugcagaacuggacagggugggcuggggaagaauaagaguggaaucauguguuauugccuuauagugggaagauucugauacuuuagaggugaacuugaaggagguucauauaagccugaguccuacagcugcaguguagauggcuuagaagcagcugguucccuuugguaaaucccucccuuuuggagcuggcugguauacuaggucugccuauauacugcucuuuguucauuuucagacuacaguggagggcccuaauagcuaaugaguggcauaaaaaggaugugagaucacugucaguuuggcaacccggcuuugggaucccuuccuauguguuuacuuggagaugguaauucuuucaaaaagauucucuaagugauuccacuugacuaaauuuuuugauguuuucacauucaaguauuagaaaacacguuaaaaagagcuauuuuuuaaaaaaguauccuugcuagaauuucuagauucagagaacuagucuuaaaauuauuucacuuuacauuaaaaugcauguuauuauuucaguacauuaaguauuguauuaccuuguauuaccaggcuucguuaucuaacuuaagaagacuaauaugaauuauauggcuuuaaaaauaaaauacagggcugggcgugguggcgcaugccuuuaaucccagcacuugggaggcagaggccagccuggucuacagagugaguuccaggacagccagggauacacagagaaacccugucucgaaaaaaacaaaacacaaaacaaaaauaaaauacgaacaucaaauuggcuaucauuugaaauuguagaacaaaagccaagguuucuuaaugcacuaacaaguuuuucucuuucuguuuugaaaugacagaauuguuggccaccuguacugucuggaggaaucagcccuugcauuaucauugaaacaccccauaaagaaauaggaacaagugacuucucuagauuuacaaauuacagauuuaaaaaucuuuuuauuaaucccucaccucugccagauuuaagguaaagaaaauuuuuuaguaacuuuaugcuaaacauuaaaagugguagaauuaaagcaaugccagguauuuucuuuugacuuuaauauaaaauauggaaacuugauuuugggggggggguuuguuugucuuuuagugcuucacuuacugaaaguaagcauguaucauucuacaugagauauuugcaaaugauagcaagugauauacuuaaaacccaaacuuggguuuuacuuaacuugcuugguaaauguuucuagacauagcagaacugaacuacuuuuuaaaauguagcuuaaauuugccuaguuaaaauuagaacauuuuuaaaugaacaguaguuucaauugacaacucuacuuacuccuuaccaaguuuacuaucaguugugauaugauuaagaaguagagcuuauagaaaauauucauauaguaauugacauuugacuugaauaagcaaauuaauggaggcagacaaacuaucucugugccugauacuuuguuccaccuuaaaaaucauuauaaaugaugcugcuauauuuucaaauguugaaacuuaauuaucacugugaucauauacuuauuuuuacauacacauauauuuauuuuuaucuuacugggugauaaugauacgugccuagcacucaggaggcagaaacaggcagaucucugaguucaagggcagcuuggucaacagaguuccaggauauccaggacuccuuguuucaaaaaaccaaaguuauuuuaaaccauaacuuuuacaaauuauaaaaaaaaaaaaaaaggauuauguagcauuccugagauuuaccaacaagguggaaauccaguaauugcaaguuggaguuggauauuugaaacuuguguuuaugcuacucuaaacaaaacuuguauaggucacaacuauaaauuauguguuuccucuccuuacccccuuccccaugcagcugggcauguucacaggagguuuggcaaaacauguuacaaaaggaaaacagauacgugcaugacaaacauuuucaaguucugcauucugaccuggaaccacagaugaggucaauacuuuuagacuggcuuuuagagguauguucuaaaagacagaaauuucuuuugcaucuaugacagaagaauauguauauggguauuugguauaugccuuccaugagacuucagagcauguugcccacaguguaguuuguaacaccuaaaguagaauaaugacuugauauuuuuucccuuguagugcuggggacugaaccaggaccuuauaugcuagauauaaucccagaccaacuaucuuuuuuaagaauaaaaucaggaguugggagcauagcucaauaguaguguguacucaguaccaaagcaaagaguaaaguccuaagaacacaucuucaauacaacccaaaccaaaaucagaaaucccuguuauguguuaggucuguuucuaguugagggggugcucaaggagaauguagaguugacuagauuuugaacauaggcauacaaaggaccagcuuuggaggcccccagacaucauuuuucugccaugaacguugguuaccccaagcccuuaagcccuuuacauccuauuuagcuuccauuguaaaaugugcuccuguuccuuuuagaaauacacuauacuccuggguauugaugguaguauaucccuguaacccacaaaggcugaggcaggaagauugggagguuaaggccaaucuggccuaauagccaguuccaggucagaucgguuacacaguaaaaccuugccucaaaacagaaauaaaugccaauaauuuaaaggaauaccaguaauucugaaaugccuauagaucuauacaaauuuuuuuucuuaucuguauuauuguaaauuacuugauguuauacugauuuucuuccaacucuggauuaucugcucuguagccugaugggagaugguagauuagauugaggaaagaggauuuacaaauuucaagcaaaucaggguagguuacagugauacuaccucaaaauaaggggcaggugggauguauacagcuuaguggugaaauguuugccuaacacauggggaagcccuggguuuaaucccuaauauuaggagaauguagauucauucugagggagaaagaaaggguggaccuuuuaguagauaaaaauauaguauagcucagaaauguuuccaagacuaaaaugagguuguucuaucaggucauuguccuuaaagaugauccauugauagcauggaaaggaaacaaaaauuguugaguuugucuauuuucauuugggggggauuucaaaauugaacaugagguccauuucuagugauaauggcaucaguguaauuaagaauuaugauaacuacaaguuuuuacuuuuuaugcuaacacaaauauuuucagucugagaauguaaaaaaaagauuguuugaaaaauccuaaagauuaucucuuugaaauacaacaucuauuccugauuuuaagacuuuauguguaaaugugagugcagguguccaaggagaucagaagacgggcaucagaucuagcacuaagauuauaaacaagggugagcuagcugccuagaaucuguacaaguucuuugcuacugggucauucuccaagcaucacauuccugauuuuaaaauaguauaagacaggaacagaauaguucuuuaaaaugcuucuucucauuuucaaaaagguagauaauggcaacccacuucauggaguaacaaugaaaauuaaacuuuccuuuacauaugaaauuggcacuguuuauuagcaacaauagugaaaugugagggcaauuccuacuaaaccaaagacaugggaagaucuuaaucaccaauguuacuaaaguagcuugcaguaaaauaggaaaaauaguaacauggaaaaacuguaaaacuaggagagcaaagauaacaagcucacucuaacaguacguguuauucccucccuuauguuaauaacagcauccugaaaaacaaaacuuagccucaaaguagcuuguaauuugguauaguaaauaugacguucuauuuuggauaaauucaggaaauaauauugaauauuugguucuuucagguuugugaaguauacacucuucauagggagacauuuuaccuugcccaagacuuuuuugacagauuuauguugacacaaaaggauguaaauaaaaauaugcuucaacucauugggauuaccucauuguucauugcuuccaaacuugaggugaguucuuaaauuucauccagauauauuuacuguaaauguaguuuuuagauaaauacauuaaucucaggauacugccauuuucugaacuaaaucuuuauggaaaauaauugucuuauucuuuauaguggggauauaagaaguuaucauaggucaguguuguuacauaauuauauagcaccugaguucacaagaauggucuuuagaugcuaaucagucaaaugcaagaacuauuaugcugaguaagaauaauggucucuccagccuaauauuuuccuaauguuggugugauguuaaaagaaaauuuaauugccuuaaacuugcaaaaauauguaauuaccaucuacuacuuuuuaauauacuguuggcuguuuccagugcucuuugcagcuguaucauuuugagggguugaacacauuaauaucccaaaauauguuuuuuuuucuuccaaguguaucuucugaguuuuauguucucuccaaauucuacaauguauggcagaucaguuuuuagagucagccuguacuauuguuuuggaucuuuauauauccaagucuauaguuuguagccacgggucagguuuuucuuuuaacccucugauaauuucuaauucucaagauuuuuaagacaaacuugccaucagccaaaacauaaucuuuuucuugauugaacccaagggcuugccuuuccuuggcaagcacuuuugagucagagugucaugauuuagccauggcuaccuggaacuuacuaccuaggccagguuggugucaaauucacagaucugccugccucuaccucuugagugcugggauuaaaaacaugauaccacaccuggccuucuuuuguuucugaaaguauagauucuacuacagcaagcauaagcccaguauuuucugauaaauauacuuuuguacuaggauaauguguuuaguuucuagaccuuauuuuuguuguuuugagaugugcugaguggcccaaguggcucaaacugucuucaaacucacucuccagcuggaagaugaccuugauguuccugccuccaccuaccaacugauaggauuacaggcuuauaugcaguguuuccuacauauuagacaagcaaucaacuaaaugagccacgucuccagcccaagacacuauuuguugagugucuuguuuuaguuugaccaccaaacuguacuaaaaaagguuacuauuucuuaacugaaauaacagauuaagauugaaauacaaggccaacuccagaaaaauaaaccuugaaaaugaguauaguagcagauaauuacauaccaaaaaaucuuaaugugguuuugauuucuaaucacuuugugaagcuguccuuaaaacugaagccuacauauauauauggcuauauauaauuuuguuuucauuuaaguugugcuuaauaaaaaaaauuucuuaauuaaaggaaaucuacgcuccuaaacuccaagaguuugcuuacgucacugauggugcuugcagugaaguagauaucuuaaagauggaacucaauauauuaaagguaaugauaaugucauuuuuuaauauaauugugagugauaauuuuuuaauauaauugugagugaaacuuggauauaagaaaaagccaaacuuaagggccaaugaaaugacucagcaagcuaaagggacuuacugccaggcaggaaugacaacauuuugacucaugggggacucacaugauguaaaaaguugucuuuuuaaccuccacauaguagucacaucaugugcccacccccaaauuaaauauaauuuugaacaaauuuuuaagaagaaccgaaauugagguuuuagucugagcauauaguucuaaaaguuugaaguauuaauauugguuaauuguugguaaggaaauuuauuuaaccucuaaacucuacuauguacauaauaugauaugugugugguauguguauauacacacaucacacacacauuauaugucauaauuaauggggauuuaaaauuuucauugacaggcuuuaaaaugggaacuuuguccaguaacagucaucuccugguugaaucuuuuucuucaaguugaugcuguuaaagauguuccuaagguucuucuaccucaauauucucaggagacguucauccagauagcucagguauuguauugacucuguuacuggaaaauauaagucaugaacuacacaacaaaauggcagagauaaaucgucaacaagaaaacguuugacccuuaaaauucgguuuucaaguauuuacauugcuuaauaauucuagaaaagaaaaucuaugcuuuaggauuugggauuaaaauaaaaaucuuuuugauauaaaauguggaaaaaauauguuuucaacuaguugucuuuaggcugcauagcccuggcugucccaaaacuuuguucuguagaccaggcugaccuugaccucagagauccacuugccucugccucccaaauuuugggauuagagguggcauauaccucaaugccuggccugcuguucuuuaauucaaauuaaacuuucuaggccagcauauucuaaaagaguaacuuuacaauaaguaacaucugaaggcuguacuucugugaaagcaacugaaaucuuauucuauguaggauguaaaauugacauuuaguguugaguauuaagucacuuaaauuagaauuuguauuuuaaaucuguaagucaacaaaguuguggaauacuucuaguauauaauuuuuaauaucccuauuaaaaaauuuugaaacuguuccaaaauuagaaacuuuuuaaaagauugauuuauuuuaugaguacacugucacucuuugcagacacaccagaagagggcaucagaugccuuuacagaugguugugagccaccauguggucgcugggaauugaacucguguccucuggaagagcagucagugcucuuaacugcugagccaucucuccagcccccaaauuggaaucuuugauugugaaaaauuccacacuugacuucagugauggucacaaagaaaacaggcacauuaaaaauauucuauaaaauugaggauauuuguuugugaauugaguucugacaugaguuucagcucccaagagaucucacauacuuguaaauacuuuaagauuccaaacauccagauuugaaaauacuggucucaaguauuacuuagauaauaaucugugguaguauuucacuugcaacuccuccaguuucuaccaccuucuuaccugaugugugaguacaaauacuaaguuuuauucaauggacaggaaaucagcuuaaccuucugaaaucuggcugugcaacuacuacucuuccugcauuaccaagauaauacaccacuuaccuagcuaguugcuaagaauguugcauucuaagccgggcgugguggcgcaugacuuuaaucccagcacucaggaggcagaggcagaggcagaggcagguggauuucugaguucgaggccagccuggucuacagagugaguuccaggacagcuagggcuacacagagaaacccugucucgaaaaaccaaaauaaaauaaaauaaaauguugcauccuagucugucuaguuuacugcguccuuuuaaaaaugaaacugcugauuuaaaaucccacagugggcuuaaguaguagugcuccaacuuguaaagguccuguaugauguaacaaagcuacuagauuuccuugcuuuccacugcccaccuuggauaaggaacaaagguuuuccuugcuuauuauuucaugagaauuauuaccuuuggcaacguucuguuucaaacauucucucucaccaauuuucuggccuagcccguuaccuaauucaaaagcccucacaagcuuuuuccaaucuagaugaagugcucacccuucuaacauuaucacugugcuccuagaacuuacucccuuuccugcaauucugagucuggaugguagcuuauuuacuuuauaguuauauauaaaauagggacucauuuauguuucucuuaaauuaccuuuuuuuuuuuccuuguuagcuuuuagaucugugcauucuagccaucgacucuuuagaauuucaauacagaauucuggcugcugccgccuuaugucauuuuaccuccauugaagugguuaagaaagcuucagguaagacuauuuuguugacuuuguaccuguucacaacuuuuuuuuuugguuuuugguuuuuugagacaggauuucucuguguagcccugcuguccuggaacucacucuguagaccaggcuggccucaaacucagaaauucaccugccucugccucccgagugcugggauuaaaggcgugcgccgccacacccggcuguucacaacuuuuaauggaacuacagauaccuuaauaccuuaccaaacacaaaauaaaacaauuuaguugauuuuuauuuugcuaaaaguacuuaacccuuaguguauuuccauagucauaaaagaaaauaaauucccagccaaguggaaaucaaauaccacaauuuuaauuuguaugaauagaaacugguuuaaaagcuuagaagugagccuggaaaaauggaucagugguuuaaagcacauacuguucuuggagaagacccagguuuguuuccuagcccucauaucuuguucuagcuccagaauaucuaacacucuucugaucucugggcacuuguguacauguauacacauucacauaaauauaaaucuuuaagcaaaaaacaagaacaaaaaacaccuacccucaagagagucagaugaguagcaaauccuauaaucccagcacugaggccaaaucaagagggaagccaaccugugcuacagaaugacccuugagaaaacuauuaauucuuuucagcuuuaacgucauguaaggaacaguuugauuaacauuguauuaacuuuuuaaaucuagguuuggaaugggaugacaucucggaauguguagacuggauggugccuuuuguuaguguuguaaaaagugugaguccagugaagcugaagacuuuuaagaagauacccauggaagauagacacaauauccagacacacacaaauuauuuggcuuugcugguaugguuuuuuguuuuauguguuuuaugggagguuguuuuuuuuuuuuuuuuuuuuuuuuuuugcugccuuaucuuucauuguuuuuaaaaaucgugcuauuuaguuaaguccugaaacuaaugggguagaaguuagcaaaguuuaucuaaggucugaaacuacugugcauuacuacuuaagacaguuauuuaagaugauaaaugggaaaguaaugaccauguugacuuaaaauauaagggagauaacuaaauuaaggcagacuugaugauaagggccuaggaugcacacuaacuaguacuagggaggcugaggcaggaggaucauaaguucccaggccacauaguaagacccuaucucaagaaaaauauuacuguuaagcagcuuaaaaucaagaccagcagcccagauaagaaauuagaaaguuuuguugaaauaaacaaggcugaucucuaacucggggaucccucugccucucaagugcuaagauuaaagguauguaccaccccccagcccccaacaaagauagagacucuaaaauuaaguuuggauagaaaaaauugguagaggucugguauuacuacauacuuaguuuaucuuaacuguuaauuacugaauaauuucuucacauguacagaaugaaguaaacuaugugaacaucuacagaaaaggagggcagcugucaccaguguguaauggaggcauuaugacaccaccaaagaguacugaaaaaccaccaggaaaacacugaaguuaacaaccuggaauugaacaaauaauggauaguuucauauaaaugaguuuuacagaaaaguagugcuguaacuauccuugucuaaggaguuacacugccauucuuuuacuuaaaaacuauaucaauuuggcacuaaaugccuaggaugcacaaaauccuggguucaauccccagcacuacaaaaggaaacaaaacaaaaacuucaaaaaauuggcacuaaagaaguauuuccuauaaaagagaacuuguuuacaaaggugacuucacucccaaggauaguggauggaagccaacaauuuaagcuauagcaguuguuucuguuuguuacuguguuucuuuaaaauucaguguuacuguauuucuuuugaugaacuaggaauuuuaucauuggaauauggacuaaacuagugcuaccuuaaaggauacauuagcugacacagaacuuugaaucuagauuuuauauucuuaaauuccuauacucuugaauggugcaauuuguuuuugaaaauaaauuuuaagcuuauuuacaaagguuguuuuguaauaaagugacuaauuuaucuaaagcaguuuguaacaaacgauaaaacuugaauuuuaugaaugguaaaguucaaucuguuuugaacuaguuugucugccuugccauauuucuuaaucaguaaggcacugaaccaaauguuuaaacugugcucuaaaugggagaaccaaagaaauuauaaacaagauauaaaugcuuuggcuucuucuacucggggguuuuacuugauagaaagguugcuuuauaaucuuuuuguguaucacaauuuggguaaaauuaaacacuuuuucaaacuauauaagaaagucacuuuauugcacacuaagauaucucuaaggcgcuuuauguuugcaaaacuggugguccauuuuuaagccccauauuaugagaugaggacugugucaacaugaaaaaacuuuaacauaugaccuaaacuauuuucuuauggcagaaaauauuaaauguauacuuacuccuagaaauuuauuuauuuaaacuugcuguauauagaauagcuacuuauacauuaaauauuuuaaguuagccuuugaaaaggaaauuugggccuaaaaaaguuaauuucauuagaaaaaaaaugguaccaggcaugaaccuugucucucuuugaagaaauuauaaacuauuguuaagauaugaaguuuuuguauaauuuguuuauaaacuaauuuguuucaguuuguuuuggucuaaaaagaaaacaccacuaaauuguacauauguauuauauaaacuuaaucuuuuaauacuguuuacuuuuagcccacuguuuaaaaaauaaaauugaaaaaaaauuaacuaacugcuuaaaaguaaaguuuugccauugcuuguagaaacuucuuuuuccuucucugugcugccagcuguaauacuucuucaggguugcuugcauucaauucuguuuggccaauggcuuugaucuuaaaacagaaaaguguuauuagaaguuugacugaaaaaaauugucacaguaguacacauaacucaaaguuaaaguuaacuaaaucaaauuaaaaacuacagaaaaaaauggcaucacauugauccacuuuuaguaugguuaccuggagggacauuuaguuacacuaaauaaauuucuguaugcuuaugugauugu

SEQ ID NO: 1786 - RNA, 3252 nt, Mus musculus
cuuaagcaacuucuguuuuauucccauuagauaggucugauaguuuuuuguuuuuuguuuguuuguuuguuuuuguuuuugauugucaccaaauaucguagagcagagaugaaauguaugcggguacauagauugucaaugguuacauugguuacaucacauuucuuaagaaacagaaccuuucugcuccuguaaacguuuucucccacuguaaagugagguuagugcugacauaguuauugcuacacucagagcuugagucuccaccacgucgagguacauugucuccauccacccucccaggccuuccuuacuugauuaagagccaacccagcucacagcccacacuguccaaugcuuucacuacugcuggaaugacaccaaguaacguuacaaaauaccagagaucagacugucuucucccuggagcacaagaguucaacuuauucuucaugacaugaauauacugcucuuuaauucuuccagagaggauuauugaagacagaaaugccuccccaaauccuuuuccagucuauuccuucacaucuccugaggcguugcuugucucguccauuuccuucggucaugaagaaucaccuuuccuucgguggugugucauaacgguuucuuaugcuuuuugucaacugcuugauaaauauuuuguacguuuuuccgcaguaugugugaacugucuucuguaguuccagcucuaaagguuuuaguaaggaacggacggaaucauccucaagagagcaauuucuuagugcuucauacacagcucugaaugcuggcugcuugucgucaugguaaacaccucuguuuccaugaagaaugaagacuccuucuucuucugcuucucggcaguugcucccauauauacagugaucuggucgguaauuccauugacauggaaaaacaaagaggcuuucuggguugugggaaaacacaauauuuaacagauccugaucaccccacgugauguucaguuuguacuuuuuaagcaguggcauaaguauguccccccaauuguagccgcgcaguugucauaucauucuugaaguacuugcuccucauccgggucauguucaucagcaucacuccagaguucacgcccguccucccauaguacgggugccaggcaaagcgauuauaccauccaauucugggcuccuuguguucuggugccaucgcagcaauuuguguggaauuaaauuucuuuaguaaugaccaaauaucaucaacaggucguaaaaaaaggauaucagugucgacauacaacagugagucaacuucuuucaguauuaauggcaagaacagccucugggacgcacagggcuuaaagagcuucuuccaguccgcggcgcugucgcaugggaaggugauaggguacaggcuguagucaaaucuccggaggaaggaccagcuggcaagucugucuuuaaagcuauugugcaguuggucuucagcaaagauguggacgugcaauggcuugaugcugaaaaucagagcugacuucaacauagucacaguuucuuccagucucucaccacaggcaacaacagcaaggugcauuuucucaucgggccuuguuuucauaucauaccugcccguccggcccgggcccgcgcugcccgugccucuccccgugccgcguccaccguccgccagccaggaaacuaccgcggccugcggccugcggccugcggccugcggccugcgcccccccccccccccccccccccccggcaucuccuuccucaaaggacaccgcgagcuggcugaaggccaggccaggcacagcccuacgacccgcagguagcgccgcaucccagcccgcgcugcugccaccacugucuguuuuuuuuuuuuguuuuucaauacaggguuucucuguguagcccuggauguccuggaacucacuuuguagaccaggcuggccuugaacucagaaauccgccugccucugccuccugagugcugggauuaaaggugugugccaccacgcccagcuuuguuuugcuuuuugagacaggguuucucuggguagcccuggcuguccuggaacaggacaggcagaucucugugagucugaggccagccuggucuacagagugaguucuaggacaaccagggcuacccagagaaacccugccucaaaaaacaaaaugaauaaauaaaauaaaaauauuucuuugugccaaguuacauguggucaauacuauaagccaaaacaaaaagcuacaguaagccuauuuacuauuguaguaauaucacaucuuaaauucuauaagauauaucauuuaucauggucaugaaucacgaagaacacuugagauacauuaaguugcauucuaggauuacaaaacuauguuaaaauaagcaguaaguaugucaucaaaccuuaaauuuugcauaauaggaauagucaagugucugccuuaucccagcgcccuuguuuugcaauaggccaaagaagcaaagugauuuauuugcucagccaagaugacacagcuaccuggcagcacugcuauaugcagugcucagcagucugggcuugcaggccagcgcucuuucccuguuggugucccucugaggauaugcuaaaucucaugacaagccuuugagacaucugcguagcggguuuugcugaaaauuaguuccagggacaaauaauagggcaugaaaguuacuaaaauucauuauaugaaugcaugaaacuggcaaacgauauacgacuauauacaaaagcaaacaucccaucugagugcugggauuaagggcagguaccaccacacacagcugagauuuguuuauucauugcuuugguucauucuuuaaacauguggucuugccaggauggccuuggguccugagcugaagauauccuccugccucgacuuucagacuagugagacuaguagcacugcugccgcaccugacuaggaaggcucuucugauccuuugguguccagcauggcuauuuauuguguggcuucacuucauuaccuccuccaacugguucuaccuacuuuaauuagucaguggggcugcacacuucaccccaaggcaugguuccugcugacugguagugugcuugcagaauuccuccuagagcuuggucacaggcuccaugcuuuugcguacagccuuuaagucagugacaauaacuaccugagagaaguacuuacugucuguugagcgaacucacuugucuugucgugacugccuguuuugccuucucuucuguacauu

SEQ ID NO: 1787 - RNA, 1740 nt, Mus musculus
aggcggccucgggggccguggccuccgagaucgcucggcccgcaggacccgccccccugcccccugcccagccagcgagggcgcucccgccgccucgcccagcuccccgggacccgcgccauccugcaccaggccccgcacgcgccuccccgggccuccgcugcagagaccuaccccgcaggcugaccgaaaucgcgagcgccccgcagcagguaccaacgccugccgccgaccagcucgagcuucccgccuuccuacagccaaccacgggccgggcgccgagcaugcgcaccacggcgugcagugcuggucccgcccccgacucugauuggacaaccguugcagguaccuuugcacuuccuuuuacgugggucuagguuugguuccgguugacugcuagaucuaaaacgaaccgauuugguuucagucuucagguccuagcugaggcgauaagccucacaacuuaaaucaauaaauuaggauucggaucauagaagugugugcaccacugagguacacgaaauccuguuacucaagugacacugagcuacaguaguugcagccccuguuuuacaagcccuuuuaaggucuaggaguauaaaaacagaugcgugauuauuggacucucgugaaaaggagaagagcuccuuuaaacuuaaaaaaaaaaagacacuaucuuaaaguauuguagacaaggucuugauagacaaagucuugcugauccuucugcucuaagaauucuggagauagauccuuugaaaagagagagugguuaaaggucauucacuagauuuuauacacguuugacaauuaaaaugcauccuguucuggugucucuggacacugcacacaugaaguacaccaacuuaagugccugcaaaacacccauagacauaaaacuuaaguagacccuuccuccgaaaacaagguuuuuuagaaaccuuugaccagucuaacuucagaagccaccaguguuguauaugaccguuguaagauauuuagugauuuuuuucucuuaagaugcacacacucacacacacucacucacacaauuagcgaugcaguuucuauuaaagccuugcuuaaaucuacauuaacaucucuuaacucaaauuuggcuucccacugacuucugaaauuauuuucuuuggcaaaguuaagaagcacagccucaucugagcagaggucucuggugagaccccuccggccgcugcagguggaaagcuguuguuugcugcuacuauggugccucucuuuccacggggugaagucagguaugcuggcacacacuuauaaucccaacacucaggagguuaaggcagaaggaucaccauaagagagcagccugggcuacauagcaagacugucucaaaaagcaaacaggcagacacauaaauaaguaaauagucuuguuaaaaugacauagacacaaaaauucuacgcauuaaugggcaccaugagacgcuuuuacuuguguauguauuguaaucaagguaaacacaccuaccgcuuuaaauucuuauuuuuuuuuuagggugaaaacuuuggaaacccuuccuucuggcuuuuugagauauacuguacaacucucucugcagucacccugcuaugcaaccucgugcuaaaauucuucuagcuuucugagugugaacuaaaguuucuucuucauaguuagcauuucacuucaucugaaaagcuacagguacaaagauuaaauauggacauuuuucuauggcuuau

SEQ ID NO: 1788 - RNA, 4109 nt, Mus musculus
cauuaauuucguuaggaaacuuuguggagaagaccaggguuuuucaguguacagacuacucuuauguuuucuuaagguuuuaacagauagauuucuaccucaguuggcauuucauuaagggaucccgagacagccauggaguuugugacuuacuaggccuccgagaacggaggaaagcaccugugcucauucaauguuuuacacggacacuaaaaucagcaaacacauaaggcagggaucaggagggacgaggcacgaacuccauccccucuccacucagagcuuuauaaacaguaguuaauucucagcaccagugagggacagugccagcuaaaggacuucacccaagguuugguguccagagcuucugcugcgagcugguucuguaacauuagugccuccacgacagccugaugaguccuucgaucgucuucccuccagaggucagagucacaccacaugaagcugggugugauggucagccugaggagagaugaaggaugaugguagacauacaacugcacugagugugggcgggcggacacaaagaccuacguuucaguaggacagaggaguugggggaggggaguaaccugaccucaggauccccggcugccugcgggcagagcagagacaggccuuuaaugauucuuaggugguuuugggaggggcacucuuuaaaauuuuuaucucauaaguucggggauuuucuucugugagcuuuagaucaguggguaguuugugugauagaaauugauggccaagagugcuggcauuauucugugccuggugggguuuuccauuuugguaagguagggauaagggaaagcuacaugcacacauugucaguaagagggggagguaguaacaggcuucacggauuaagggcauuggaagcagccguucugggagagugggcaagguauaaauaccaacccugugcugcccaggaucacuuuaauccuuaaacuagagggagccuacagugauugcagacagcguaagggauuuucaagggugaacuauuggcugcugggaccuugcaugcccaggcugugcuuugcuucuuggcugucuaaauuugccuucauguuuuaucaagauacccaucucacuguugcauggcacugcugcgcuccuucacaugccucuaugagugcuagucucccucucugaacccagggcaaggauguaaagaggguacauuguguguguguguguguauacgccacugugugccauggcaugucuguggaggucagaggaccuccuguaggaccuauguaggagcuggcucucuuacaacguagguucuaggccucagacuggccugccaggcugcugcucuuaccucucagcaucgugcuggcagugaaauccagaauucccaaugguacaguauauuccugcagauugcugauguggcaagggccauuguuuucuauuguauucauaacucuucuuuugucuaggccaugucuagaguauggagagauggucagaagcauccuguacauauuuacagacuccugacuacagguaaaaaaaccuucaccugacaaaaauguagcuccuuaaaauuguuuuguuguuaguuugugcuucaacaucugaacaucuggaauguauucuuuuaucagauaauaaguaauaaacauguuuuaccaaacacaaauaauagacacaagaagaaaaucuaauggguguuuucucccuagguacaauagaggaaaagaucuaucaaaggcagaucaguaagcaaggccuuucuggggcagugguagaccuaaccagaucaucugaacauauccaguuuucaguggaagagcuuaaaaacuuguucacacuacaugaaaguucacauugugucacucaugaccugcuugacugugagugcacaggggaaaaaggucacaccggugaguugucugcugauccuauuaccacaguauacucaacuugucccugaaaacauucaaagaguaacguaaaaaugucugccauuugcacguguuaguucucuuuguuccucggguuguagggcaaguacuagguauacaguugagaaaauauuccguagaaccuuaagcucaguuuaguuucuuauuucuaaaucuguuguagaaaaauuaacuauguaggcaaaucucucaaagccugauagaaugacuucagaguaagaaagauguaaaguuuuauuggaauuucguaaaaauccuauacuuagcagaauuauguauuguugcuuaaaucauguaaaauuuauucauaauaggacaagccuuugagagugcuuagaauaaucaacugugcugcucagugcuuggacacgaguguuguuuaagcaagccugagacuaucugucuuuaaaguuagacacuauucacggggagcuagggaacaacaggaagugaguaagcccuguccaggaugggaggucauuaguagaugauguugggggcuggagggaugacucugcauugacagugcuugcugcauggucaugaggacuggacuuuggauccuagcaccauguaacagucuguguacauggcacauaaagugcaaaugcacugccccucacaugcacguguauucacccggcacacagacacuuaacagaaauuacaaaauaaaucuuugugaugcuuaaguuauucuuuuucaacuucuuaaagggaggaguuugaaauuguauaugaugcaaguacaguacuuauauauuaaauucucaaaacaaaacauguauaaacauauuaaauugauguacauguacauacauauacacauacccauacauuauacaauuuuugugguuuuagagauugaaucuagagcucugaacaugcuaaaugaauacucuacaagcucaacccacagcuaauguuuucuauagcauauaaucuaguuuauauaaauuuacauauucuaaaauuuuauugcacauacuagaauaacagauaugauuaugcauaaucauaauuauauuuuaguuauauugauauacuuuuauuuauuaggguggauuuuauuuuacuuguuuaguuuuugagacagggucuuacuauguagcucuggcuggucuggaacauguauauagacaggcaagccuucaucucauagguagugaccuuacuguccuaggaguagauuucaaacuucagauaaauauguucauuuuucucuuuauggacauuuggucuuacuaugcuuuauuuuguaaaacuuuuccuuuuuauuuuuauuuuuaaccuuuuuuuuuuuuuaaagucaaguucuuguuagguacccugagauagcuucaaauucccuuuguagcccaggcuggacuugcacucuugccucugcugagauuaaaggcccgcaccaccgccucccagaaugacuuaaugauuuucaaacuuauuuucuaaaauguuuuuuaaccauuuaaauuuucuuuuauguagaguuucauaaauuugauauucuuauuguucauuuuuaaacauuucauauuuucuauuauuauuuauucuuuacucaugguuuauuuaaaaauauucaguccuaaacgcauauacacagcaauacuauguaaauucagccugugugcauguguguggguagcaaugguuauuauaaaagaggccauacauuucaaagugaguggaaugggagaguagugggagguauguacguuauguaaauaggauacauuugcucuaagguuuuugcaauaucaauaugcagagcagagugaguuccuaacccacucugccauguuaucuaucauuguauggauauauaaucauuuauuuacccaccacgcuaccauguguaauuaguuauauucuuauuuauacaccuuuuugaugcaguuaaguauauauuugucagauaacuuguuaguguuacugaguggcucacaagugucuauaauuccagcugcagagguggggauugcuguggccuccuugggcaccugcauucacauugcacacacccacaugcagacacauaaaccacauaguuagaaaauaacaacaaaucuuuaaagaaauccuaccuaacucgaugagugcaguaguuuuuaugacucauuucauagggagccaguucagagucug

SEQ ID NO: 1789 - RNA, 2729 nt, Mus musculus
uaagauuuuauuuccuuuauuugagaaacuuaagucuuggguacaucaaaaccaauuucugcgaugagggaaaaaaaaaaaaacagaacccacaauaggaaaaaaaagaaagaaaaguuaucaucugggucacaacagaagccagagaauauauucuuauaauuucaaaauuauaggugcuucauaauugaccuucugauacaaaaugaccuauugaauuugcaccuugguucuugguguggagguccggagacaaacuaguacgucuacagaccuuagcuggauaacaugagcgguuauuuggcuuuugacucuuauucuugucuaagagguagagcagcaacgguguccaccuucugggcagcuucuuucuuggcaugaugaaccugccugcaggacugccacagcuucaucuaccuuggagcagagggacuggggggacuccagcacgugcagcagcucagaguugucaauuuccagcaccaucccggugauuuucccagccagguuugaaugcauuguucggauaagcaggaacagaugcucccccagcaucugcuucugcuccugguuggggcgcugcagcaagcauggaggaagucaggggcuccugacccuggacauggacuacaggcuggggggccugcagcggcuggauggcagggugugggcuguggccacuggaggcauacuuguauggagccacagcccugggagcagaggcagcaacuguggcuguagggaugcuuccagaguggcagcugucagacagcccuugcugggcggcaccagccccaccaaaguccauagccaagccguccgggcacucagacccgacucucugagcaguaguaggaaggccacgagaggccggagcauuaccaguuggagccagaugucgaagagcuggacgaggcccagacaugccccgcagggcacuuggcaauccuuggaagccuugaggucucccgccuugcugccagcguggauuaggccucaucugugcuaacugguuaggcguguaauaugggggucuucccugagccugcgcaccugcgggcacaaaguagccaccagcugcaggcuggaacugauuuaagauggcaccggcagggaguacucucauccccgccacacgcugcguguacugcuuagucaggugagccuuccguucuuccuuccucugggccaaggcgacauacagaggcuuggagcccacaaugcguccauucaucucggugacagcuuuggucgccucuucaggagaggggaaacagacaaagccaaacccuuugcuucucccaucuuccagcaucaccuucgcacuggugauuguuccaaagggagaaaacgcuuuccuuaauuucucaucaucaauggugucauccaaguucuuaauguagagauucauccccugguaccggcuaauccucuccugcuucagcugcucaaacuuccgcuucagcucagccugccuuucuaccuuuuucugugcacggccuacaaauauggcuuucccgcucaucucguuuccauucauuucuuccacagccuucuuggcauccgcguguuucucguaacuuacaaagccaaagccuuuggacuucccacuggagucucucaucaccuugacacuuagggucuuaccaaacuggcugaagagcucuuucagauucccaucauccaccccuucuccgaaguuuuugauauaaacauuggugaauuccuuggccuuggcuccaagcuccgcuucccgcucuuugcgagacuugaaucuacccacaaacacuugcuggucauugagaagcaugccauucaucuucucgaugaccuugucggcggccucuugggucucgaagugaacaaaagcauagcccuuagagccguucucaucacagaccaccuuacaggacaagauguuuccaaaggcagagaaagugucauacagugccuuguugucuauggauuuguccagguucuugaugaagacauuucccaccccagacuuucucaaagagggaucccucugcgaccacaugaugcggacuggcuuucccuucaugacgucgaaguucaugguguccaaggcccucucagcgucggcuggcugcuggaaguugacauaggcauaacccagagagcgcccggugaucauaucgcgacagacacggauggacagcacaggccccacagggcugaacuuuucauacagcauggcuuuggugauguccgagugcaaaucgcccacguauaaggaggccaugggguagcugcuggcugcagcguucaucuccccaccccacacgaccccgagccccgccuggaggacuucagaaaacauggccuacugcaggacaaaaggggcuccgaggagcuauggcacucuccgcggcgcacagguggcacuagauacgcccggagaaggcaggagcagggaggcuccuagccgggacccgagugcgggacgacuuguacuggacugcaaaagccugaagacaaaaggcucucaaaaacaaaauggcccgcucuuggaguuuguacucuccagcuguccuggcuugaggcuucgaaaauaaaaauuaaaguaggaaauccccucguaaagggggcaaaaaguuuucaagaggcaauccgaugcuccgcucacagcugccuugggaacaugcguuucgcgauaaauauaggccccgggcucuaugggaagggggaaaccaaaucuuugcgggugc

SEQ ID NO: 1790 - RNA, 2974 nt, Mus musculus
ccagaugcuggggguggggggugcggcuggagagaguugaugguggcaggagcuccagaagccuguuggccccucuggggaguuggcggguugagagaagcaggagcucagagaauugacagguucauuuuuuaauauuuccugaaacacaagcaaaccaaaaacuuuauauuauaaauaaacaaaaaaaccuauuccacuauaccauuccuggaugaauauacccaaaggacacuguaauguacuauggagguacuugcauauucacguuuauggcugcuaagaaauggaaccuuccuauaaacauacuaaggaaaagaauagauccagaaaauguguuacauaugugauacauaaacauaagcaauuuuucuucagcuccaaugaacuuaugacguuguagaaauaaagauguaacacaucuuuuuuuuuuuuuuuuuuugguuuuucgagacaggguuucucuguguaacccuggcugucuuggaacucacucuguagaccaggcuggccuugaacucagagaucugccugccucugccucccaagugcugggauuaaaggcgugcggcaccacugcccugcuguaacacaucuuuuaaguaaacuaaaccagacucaaagacuuacucucacauaugugaaaccauguauguguguguguguguguguguguguguguguguguguguguguguugaacuacaaagucagaggucugaaggaagcagggaagagugaaagagaugguuacagaauauacaaauuguuacaugaaugaagaagggaauuaagcgggaaggagacuauuaagagugggucagggggagaggaagacaauaggagaguggggcaauaagaacaaauuauguauuaaaacuccauaaugaacacaugacuugggagguuaaccuaaaauucaaagucugucagguauucuaggaagcuagguuauccggccucaccagacaauaaaaauggcaacuuccacagugucuuuaguuggggaagacagacagugaaggauaaaauacacagggaaaucucaggcagggcuugugcuaggagaaaaguaccacagcucuuuggcaggcagacugguccuucagaugagagucaucagggcugucaucuuugaacagaggccugcagagcuuaauaugaguaaggaaagggaaacuagacuuucuaagagacaagggaagacuauucaccagagagaggucagcagagguagagugugaacaaccucaaguaggagacuugcgaaugcaagagagagcuaggaggccagugugcuagugugggaagggcaagggcagugagguagggauggcagccaggugaggucauaaacaccuuuguaggccaggggagagaguuaauauuuucccauaaggguuuuaggcugaucaugcuguguaaugcagcaaggcaagccuccuuucccauuguaaaauguaaucuucauaauucuacaagaaauaaauucuaguggcacaagaguggaaacguccaguuacaguuuacacugcaguggccagagcacugugcccaguggacacagaugguuaucuuggauaggcaugugcugcauaaauaugggugaacugauccaagacuggccugugcagagcgcuggcagcccaagagcuggcucagagcuaagggcuccgcaucuggauuuuagucugcaaugugaacuggaagcgaacacaaggcuucuguacgguaugggaguaaaugacagagcagaaacggaaauaggagugccuagaugaugaugaugaucaucaucauaaaauauuaaguaauauuucggcagucuuucggauucucuucacaagguccaaguagcauauugaugccucaagguuuaauuucucagacuuauucucauucacaccagucagaagugaugauaucacagugcccugauaauauaacucucacauguccgugguuuuucuucucacucauuuauauacuuccaucaagaaguaacugggauucuuacucuucacucuguggaacaccaauaauugacaauggcaaagagagaaaggauuuuggaagguuccuaaagcaucuaaaagcuagucacaagucacuuggcagaauauaucguggagacugacccaaacacgaggccuggacauagaagucagccuacuaugaccgaguagagaauacagggaauauuuaguacaccuacuacuauucagucauccauaaccauggucuuaacgguugccuguguaucaaugucaaaauuucuaggagugauaauucaugucaacgccauauuccuauuuucaaacauccacuggaaugccacuuuuggguggauaucauggacaucucaacucugaugcaucaacuucauuuguacauaguuguaauauuuuccuuaagucaauggcuuucuucuaucuacuaucucagauaagaacucuagcuaacaucuuugauuccuuaccuugcucuccuagcacugggucagucauaagucuauacauagcucgugaaagggcugguaacagcaacccuuuuuauaaaggucuuuugaggaaucuuuuccacucuacgcagcacagugcuuggcauucaggaaaggacuagggucuagaaggcacauucucugaagaguggcucuucacaaccaauucccugggcuccuaaacaaccgaguuaucuagaagccacugggagacuuugcucucugggaugguacaauuauccuccuacgaacagauaagaacuccuccccuaaagucgccagacagcuuuugggggagagcgacaccccacugcugguuugcaggaaaggucaaucagaagccaaagagaggcacuuggcaagagucccagcagcugcggccaagggucuuugacacgcaggcacgcgcgcgcccguggaagcugagagcgcgcagccccggguccccuuuccgcuucccguggccucccuccg

SEQ ID NO: 1791 - RNA, 44401 nt, Mus musculus
cagacucgaccgacucccggcgggaccgcgucucgaccgccgcugccgcccuucuccggccguucccuccccgcgagaggacgcagggagccgaggccuggcgugcggggugccauggaaggccgcaggcggggggacgcggcgggaguggagacacuggccggcugaggccgaggcaugcggaaccccggugggagccugccccacacgcugccccgggccuugcagcacgccggucggacgggagucguggagcagccgggccgcugggcaccggagcggacagcgggaggggaccgcucggaggaccgccuuccccgcgggggcggggccagcgcggcggcggcugcugcugcggcggcggccucgggcgcccugcucggcgccuaucuggagcgccacggucugcccgcggccucggacuugccggcgccggccggggcguuggcaggcggccccgggagcggcggcggcgugguggucgggguggccgaggugagaaacuggcgcugcugcugccucggcagcaccuguuggugccggagccucgugcuggugugcgugcuggccgcccugugcuucgcuucccuggcccugguccgccgcuaccugcagcaccuccugcucuggguggagagccucgacucgcugcucgguguccugcucuucgucgugggcuucaucguggucuccuuccccugcgguuggggcuacaucgugcuuaauguggcggccggcuaccuguacggcuucgugcuaggcauggggcucaugguggugggcguccucauuggcaccuuuaucgcucauguggucugcaagcggcuacucaccgccuggguggcugccaggauccagaacagcgacaagcugagcgccguuauccgcgucguggagggaggaagcggccugaaggugguggcgcuggcccggcugacucccauaccuuuugggcuucagaaugcaguguuuucgguaaguggggucccccuggccccuccuucucgugcucucuccaaauuugucuuuuagaggccuugugaccacccuaggaggcgcucuguaugacagaagagucauugacauuuuuauggcacccugaaaaaaauuacacuacaaauucauauaacacagccccuuggaagaccugauaaagaacuaucccccccccccccccccgugcguguguuuguguaugaguuugauaaaaaaaaaguacuuugguagcucuugagccauaaagcuuugugacuugacuuccccagcuuucucucugcccugcauaaaugcagcaggguucagauucagguuucugguuauauuggagcauggaucgcuuuuguuuuuaacaguggaggaggagacagcaguagaccccaaguucuuggaguuuccuaaauuuguaguaagcuucuuaaaaguaguuugcugucuuggaaaagcugagaauccuguuuaucuuuguuuagaacucuauuugaagucaccugggugguucauaaaaacaaaaugagcaccggcucuucuuacacacauuaucuaaagacucuugcacuuauggucagagguuuaguuuauucuguguaggcuucuauagcgaggaugcaccugaguuaaagguauaaaucauugcuggugagguggcaaccacuugaugggaacuuuauggccuuaggacaaauuaugaaaccuaauccgacuauguuuuguuuucuagcccaggcuauccuagaacucacugaguagcucaggcugacccuagacuggcagugauucuccugccucaaccucccuuagugcuguauuacaaacaugaauccccaugcccagcuuugacuuuccagaaaaaagacugaauggguuucccacauucagugauugcacauuagaguucauaccugagauucccagguaugcacccgucaacugaaaggaaacugcauguauugagagauagcaguaaguuuggccucagccuuucucagcuuuuauuguuucauguugugaaauaugaacauaaacuuugaucagccuuauaauagaucagcuguaccaaggcuuggaaauaugauggaggauuaggagcauguauaguuuuaauucugguggugugaucugucucuggcacaaccugcaucuuuucuugucuacauaguaugugacaacugcuauucuaggcucucuccagguaucuuccauucuucagcugguacacaugacuuccaauaguuguugccuacaacagaugagaagacuaugcugguagucugcuguccugucuuaggcgucugcugaccuuggcuaaggugucuuguucuuucugcaccuuaauuuguuugcaaagugaggaaaguauugggccuggccuguuaggcuacugggauuacaugugauauauauguaagagucugacuugcauuucaguguuuaucuacuguuugcucuuuauguuguaaucaccuauggucgucucggaaguaaauaagugguagagccagacuuugaccuauggcuuagacagagccucagccuguggcccucucuguuucuucauggaauauuuauuagcuaguaaagucauggauauugaggaagauauauacugauuacaacuuuuuccuuuccuaaugucucguauauauuaaauucauaagaaguacuauacuacugcaaauaguuugagguuacucaguuuguaguugaguuuaacaggggucaggagccuuucauuuuggcauuacuggaucaggagaaaaaaauaaaaaauucuauuacaggaggauauuguuaccauuuuagauagaagaaaacaaagccucauuuauuuaucuuggaacuuuuagagucaccugccgaggcagaacugcaguugcaacauguaaucagcugaugcaguguguguuucuauacaguucucaaacacaaacaggcaggauaggucaggaagccacuggauauggucuguugauucacauccuccucggcugucuucucgcaggagaggcccuuucaaccucagcaguuggcugugcuugcucaggaucugugagacgagaaagcacaguguagggugaaguuggcuuuaaccugauuucucccuuucgccuucuagaccgucauugugccuccacccucaaggcuuccugccgaucauaccuagccaagcauacuuuuuggucuucuacuuuucuccuuauugagucuuuuaaaguacugccccccuccuguugagacuaacuucucauuuucucaaugaccaugaauauaauuagcgcaaagagaaacuuagguauaaaagucagacaaagcacagguuuugaaaaaauagucuuugcuugguuccugcuacgugacaucuaugcuuccucauuuguaggugcuguagagucaugcguaucuacuaagcuacugcuuugaaggcauuauuuuuccuugcccauccuauuguuggugcagaagccaguuguaaaaguugaguauauggaaaaugaaaaagggcucccuuugcuucuaauuauuaaccauaauucuuuaauucucucuuguaugcuagaaagagauuagcaagcucacacacaacauuugauacucucaaaauagaaaauaucacuacauaguauugauccuugagcuauaagaaacaaaauucuucaaguguguuucucucucccaucauuucuucuggggaacagguaaaaccucucccucucugcagggccauuggcgaaacccuguaucugcaggaaacccuguaucugcaggaaacccuguaucugcaggaaacccuguaucugcaggaaacccuguaucugcaggucucguugcauguuguccugaucucgggacuuagaguuugcgucuugcugaggacgguuccuaacuggacacauuugagauggcuuguaugcuuuucuuacuagaguauucaugguagccuaaauuaggcuguagugauaacuucuaguuuucgguggcccaaaagggaaguuuuauucugcuugguauggguugugucaaacuuagcuuuggggaaggacccacugccguauguuguuuugacucuggaauuugggcuggcagagccauugcuuugcacuugguugcugucaguaaggaacugcauuuucugcuuuaaagugucgcuuguagugaucucgauuuuuccuagccugagcaagcuacacggucaugggcaugagcaaguugccugucguauucugugaguucacauacccuccuuugacuucaguuuuaaaggaaaggaacuagaugacugaguucaccauguugugugauucuaaacuagaguucacauugagauccccagacacucagccuuucaacuuuuaccauuuugcaguuauguacgaugaacauaaauuuugaccaacuuuacaauaauuuacaauaauuuaaaauuuaaaaaauuuacaauaauaaauuuguuccaagacuuuaagaaaugacuggguucaaauacaugaccaaguugcguugccuugagcuugguugcucagaacagugaguuaauucuggacuuugacggguccuuuguagcggaucucaccuuuuccuggccugaccccacagcaugaugaugguguggcaguaggagagaguagagcagcuagcauagacuuaaugccucugguacuuggcaugcuguccacacaccaaguguuaaucaagcccgaguccugugagcauugccuccugacagacacuucagucuagccuacuaccucugcugugauucaggaaccuuuaccaaaugucccugcuuuuugcuucaggcuaacauucucccaucuuuaucgaaaagugaacucugcaauacaaauaugauuugauuauuucccuuugugaauccucagguaaguuuucuuuccccugagaauggauuguaucuacccuugacuaguucuuucuuuaccaucuauagugaguggcaaugcaccuuuugaugucuucauuuauuuaauccuuggcacccuuagaaguagacacuauuuaaauuuagcaaaugaaauccugucucuacuagaaacuucagguuucacuuuucucaguuuccagguaaaaggagcucuagaccaguaaagaaggacuguugguacugaguacaggagagacaguucuuaaagacuacccucuucuagaagaaagacuuugaucaguccauucagaccaucgcacccugcaccuuacaccauucuugugauagcugcucugugagguccuccuuaaaaacugcauuuuaaaguuacuuccaauaaaaugguagucuugaucucaaaggccuacaugauugugguuuguauggguaauggaauucauaauagucuuuccaauccacacaggucugacauaaggcugugccacaggaguuccuaaaagacuauuuuacuuuggucaaaggaaaauaauauaaagucaaaauuuucuguagauaauucucuuaaacaaguguacauggaaaauuaauuuucauuaaccuuaaauauuugaaauauauuuuucguuaacauuaaauauuaaaggaagcauagugugcgggguugucuuacauguggugugccacauccccauacagagcagauuuacauguagccuguccuuuaauguucuacuacagcaguuguuuaagaccguaucaaucuuuugugacuuuguuuguuugguuguuugguuugguuuuuugagacaggguuucucuguguagcccuggcuguccuggaacucacucuguagaccaggcuggccucaaacucagaaauucuccuaccuccucugccucccaagugcugggauuaaaggugugcaccaccacgcccggcaguaucaaucuuuuauaaaggacaaauaucacaaucuuaaaucagacuuagcauaacauuuacuuaguuaucuugaagaaguuguacuuuuuugauauacacuuuguguuguaaaacauaucuuaauaauaucuacuacaaagccauuauacauuaugguuugcucauuauuuacuauuucuuccuguucucuauauuucaaaagcaggacauggugcucacuuuuuaaaaguuuaauagugucuacauugucuauaugaaauacugggcaccagucucucauguacacauugcuuauuuaaugcucauaucuguuauagucuucaucuuacaguuaagacuguuggagcguaacuggcugauaguggcugguuccguggaggugcaagaagaacuggcucucucagagguggcuauccuuccaaacccuggcuaguaagcaucuuguugggccuccuuccugucagacauugugcaggaccaugcaccguugagggagauauuagggucagcaaaccauaccccaguauagugccucauaugcucccacaugcucugaaccucagacuuuggcauuugcucaucauauuauguucucuguagcuuuuuucuuuuuucuuuuugagaaaaggcagcauaguucagguguugacaaauccuuaccugcacagccuaaaauauuuaguacuucacauuugauggaaagaguuugccacuucugcuuuauagucagugcaaccaaauacccaccaagccacagcuccugcuguugcgguugaagagaggcccauccaugccaucuucucaagauagaacaauuucaguggaaguuguaugcacugaguguaaaguaaaaacaagauaauuaauuagaaaaguacaaagcaugaagccacucagccugugucucgguuacuaaucuggguccugaccuguguacuccccagugcuucuuuacgcuugguuguuuaguguacucuuagaaaguuagaagcagccacagaaggacuuggcuugcguguuggauugauggugaguaagagaucagggagcauagcccauacugacuggaauaccaccagucaaagaugccaugguaacuuaacacagacauaacugcacauggcaugcagaacccuuccacaugucucccuaggauuugacuuauccacaagaguuucauuuaauaauuuaauucacaauugaucuuacaucuauuacaauuaauuuuuaaaaguggccauguguaaagccauaaaugugaucuuagucuuaaccuggggacucucagggcuucuaguucugugucagcuacuguggucacaaugaaguucuugaaugacucuggccuccaguucucuuacuuguaaaugcucaagaguagguaaggucuuagcucaauuuuuaaaaagcagguguuuugagcacugacuuaacaugaccuuuuaaauuuuucuaaagaauuuagugggaauguguuuuauuuaaaaaguauuuucauuuccuugaauucuuguucugugcuaugaauacagacagacuggaacaaagauaauagacuauaauacuugucccaagguaauguaucaauauaaauacaaacugauuugcugcacauggcaugcagaacagagaaauaggggagauaguguauucugggggaguugguagauagcaucuuagccacacccucaaaccguccuaugucacuaaagacagcuggcuuucauuauuuccuugaagugcuuucugucuuuucaugcucugugauucucuggugucucugcuguauacaugcauaaguuucacauaucuaucucuagcucauaacacuaugugggaugugauaauaacucuuccuggacuacacaggaaaaucaaaguagugaggucugaaagcucuuuuaacgucauuucccucaugcuuuacaaagagauuuccucacaaagcuugaaaaguacacgucaagaaaacaauuagcuguuuuuuugcuucuuugcuuugcuuuguaguuaacugaucuauguuuucuuaacaggaguugguguuauaagugauuuuuaugacuucuugcucaguguagucaugugcugcaccaugacuuuuaaugaccaaacagcuguccuugucucucuccuuuuucaauuccaguuuagagcuggaccuuaugugagaaagguauugaccaauuuuuguugaaugaauagaaaagguaaaccuauaauuuaugaaacuauguuaaagaauuuucaccguguguucuagaggcuauguuuuaucagguuguacccuuccccaccccucaggaagauucaguguuagggguuaaucaaauucucaaauggaccauugcucuccagauuacuugggaaccauuagaagugguuccgaauuuaggguuguagagcugaugaaguuugaguuaugugaagguggauuuugcaucacauggccauaucaccuuagucagucaaagguccuuuguucugacacccucuaucugauaagaguagaaccucucccagcccccaccuccacccugaguccuaccuuuuuuuaguaacaagaguuuucuuuggacuaucaaacuuaaucagaguaucucaauuuuaacacagaaguuacuggaaauacuuuuaguuuccauucuguauccauuuagcaggcaauuaguaggugccuacugcauacucacugcuguucuagauauuacacauaaauaucugaauaaguccaagccuaaugucaaaguccuaagacagggacauucuagggggaacaaacauucuagguauauggcgcaaauauuauugauaguaacucuguagguaguuuucuguacgcuaggugagcauuucuagauaguucuuuacagguagacuuuuuuuuuuuuaaucucagacugauuguaaauagcagcuguuguuuucauauuugcaaacaaaccaguuuugagguugauauaauuagcuucuaauuaacauauauuugcagcuaauauuuauuagguauuuuuuuguaauggucuagaagaauaauaaauaaaauuuauucugggucaggaacaaaucaacuguggguucuccagugcuguccagugugaugggauaaggucuguccaucacagccacuggaagcacuuaaauacugucuuuggguaucagaguuuccuucaggaaucuuuggguagugaaugaccguugcccuagccaagggagugggaagaagccugaguauucuuuccagaagcaaaggaugugcuaggcacuaagcaauuagaugugguuggaacucugaccuaaagcauuauguggucaaaggcuagacugcagaaaugagauggaacucacacugaggcauccauuccuucugagagccacuggccagagcuuacugaggaucagguuugcauuuugcagagguuucuguaggguucaguccguguuggaaaggaagacacuaaguggacucugauggggugguggugcauuuagaagaugcauuuaacaaguuguaguugaaagagugaggaguggggcuguuacuguaggacugaccugugagguucugaucuuggcagccaagacugggaacaggacaggcguggaagcaucugcagaagagggaaugacacuuagagagauuauuugcuuuuggugguuuuguuugguuuuguuuuuugagacaugaucuccugugucagacauuugucuugaauucauuauguaguggaaguuggccuugaucuccucagagccuccugccuucaccucguaugugcuaggauugcagaugcagaccuacagucaguuuaugccuugguuuggaugguccccauggcuucaugcauacuaugugagcaucuacuaacugagcuacuccccaguccuuuaagucaauugaaauacuuuaaaauuuccuaagagugaaaacuacccuggucaggccagcuuuucuagcaagauuuugcugaaaggacccugauguagcugucucuugugaggcuaugccggggccuagcaaacacagaagugauugcucacagucaucuauuggauggaacacaggcccccaauggaggagcuagagaaaauacccaaggaguugaaggggucugcaacccuauagguggaacaacaauaugaacuaaccaguacccccccccccccccagcuugugucucuagcugcauaugaaucagaagauggccuggucggccaucaguggaaagaaaggcccauuggucuugcaaacuuuauaugccuaaguacaccaggccaaaagaacaccaggaccaagaaguaggagugaggggggggagagugggggggcaugggggacuuuugggauaguauuggaaauguaaaugaagaaaauacauaauuaaaaaaauaaauuaaaaaaaaaagaaaacuaccuacuguauuugacuucuuucucgcucuucucuaacauuucugaagcaguaacaguaaguguauggaguauauaugcaggaaagcacauacuauaucaagaaguaaauaaaaaguagaaccuauaguaacuuuaaaugcuuucugucuuuaauaaaaaucaagguagguguucaugauuuuucuguauaauaucuaauauauuauacuuagaauuuacauaauaucuugauaguaauugacuaaacaauaccauugauucacaaagccugaaguguaucuaauguaaggagguguuuaguuugcccaacccaauauuagacucacagaguuacagguaaaauuugagauuuugugaacacauuacuuuuaugcuuuuuacuaauucuauauagaguuauucuauguaauaaauuuuaguguuuuaaguuagaauuuguaaaacccuguguaagaaauguaaacuucaaaaaugacuauauuucuggagcaaaauuccccaaggauaguauuuuaugccccaccucagaagaaugugaguuccaaguuauucuucaggcgagucauaguaacucuggagaaauuacuaucuaucaucagugcuggacaaauggcagcuacuacucuuacaaaggaccugguucccagugcccacauugggcagcguguagcugccagugacccuagcuccagggacucucugaccuuuucaggcaccugcauacuuguaguucacguacauaaacucagacauacauguacagauaaaauaauaauguauacguacacauaaaauaaaaaugaguauuuauuuaaaaguauauauuaccgauguauaauaugcuuagauacacaugucugucaggugacauuacuaaucucugaaaaccuuacuagauaauuucugucacugaccauagcaacuguccaacuaaaacugauguucuagauuaggauuuccauuggcucuuugcaucuggaggauaacuguggugccaggguccuaggguacucuaucuagguaggugguaaucccagugcacugcccugcguggaucuuugucucugaagagacaaguaaacagacauuuaaaauuaugugugcaaagacuugggagaggaggcugggaacuuguguuugucaaagauuagaaaaauguagguucugacgaggauuagggcuuguucaaauucuccuuuaaaauaaguugaaaucuuaucuuuaguagugugauuaauagcuuaggaagugauuauguuauguucucucuagcagagcuguccagagugauuaucugaagucugucauuugcuucucuuagauagcaucauggaaacaguaggugaagugcuaugguacuuucccccaugaugaggcugcauccuuuacauuuugauggaccugacuuuauguuggacgguagucaugguaaaaagcaacuguccagucuguccuguuucugaaaucuguuagcauucccaacaggaauuuuuuauguucuuugcauguuaauuaugaauuccguuuggagacagaucuaaggcuguagacugaaauuuuauauuaggacguuuuggaauguaagcucaguauuuuaagauuuaucuuuuaaauuauguguaugugccuaucuguacaugcugcuauuuauacaugagugccaggugccuguagagccagagagggcuuuggguccccaagcugcccagugugggcgauggcaacuauaauauggguccucuguaagauuaguacaugcucuaaaccacugaguuguucacacacacacacacacacacacacacacacacacacuuuuuauucuuauguaugucuguaugucccuauguucaguguguaugugggugcucuugggagccagaaugagcaucagauuuccagacacugaaauuacaggauuugaggauccacccuggugugagaccaagcuucagucuccugggagagcagcagccacucuuaacuuccucucaagccucuucaauauuuaaauauaauuuugauaaguugcauguuaacuauaucacaggauuuuuaucacucacuuuuuccuuauuuugccauuguauacauuuagcauuuuucccuuuuaaagaugauccucugcuccugugagcaaaggcccugguucuuuucauuugagugacuugguccucuuuaccaagucuguucuguguuucaucuugguugcuuuuauugucuuuaguguucaagauucccuugcaugugacuaaacaacccagaauguccugccaaugucauuauuacgucuggacuuccccucccacagugucccuguugaugcuuuucccagaggaccugccuucauugcacccauccaugucugcuuagcacaugcuucggcuuccauguccuucucacugccuccuuuuauaaaguugcccccuggccuaggcucccauaucuaauuuugauucuacucuacucuuuaguguucugcacuucucuuucucaaggcuuccuuucugugucugagguagugguaugcuugaccauauauguaauucuuugaagaaucuuacuuugugucucuuucagcaaauaaucagggcaucuugcauggacaguuaugucucagugauaaaugaauuaccaacucuguugcuguaauauucuuuccaacucaacaaugcugcaucuccuguuugugacuauagauuaauuuaacaauaauggaauuauaaucuacacgauuauugauauaauugacauagagcagcugccuauggguggcugaaauccuggaucuuaaaauuaguuuaagaaaguuuaauagagugguagcuuucuuacauaccgagaauaacuaaaugguguguggggaagucacauucacaauauagaagaugacuagaauucaacuaacaaauacaugaauauggcuaaauggccaaauuucaguaaaauauguuaauuuuuugaguaauuauacacaucuggauaaggauacucaacacauagauuuuucaucuguaccagauucauuauaaaauuuaauuuaguuauuugaauggcaagauaaucuguaagacuaaguagugagaauagauguaauucuuaacaauaaugaguauguuugaagggggugggaaauucauacuaaagccacaagcaaauaaagaaacuugaauauccauuuuguaaugcuaacaaaauuuacucuugggaaaggaaaggaauaaauccaugccauuacuuuuaaaauuaauaaauuccagaauuauauaauggugaguauuaaaaaggcaagggaaagaagcaaaaaaaaaaaaaaaaccuucaugaacauaaaaaugguagaguucucuuacauuugauuauauauucauguguuucuauaagaugaacuguucaccuuauaguucauaugaggacuguggugccaaggaacacaagcauuugaggcacaucuagauaacauagugaggccaugacucaaaauuuacgguauagggacaguaccauaaaaaauguauguuagguaaaauagaucaacuuguguccuuauauguaaagagcacuuaggaauaggaaaagaauaacauucugagaauauagggcaacuaagaacaaaugaagucauauauaaaaauugucagaaaaacccuguaucaguauaaaugaaaaaaguacaaaugguaucaugggaagcugaaaacugacucuguaguaagcaugauggacauaugccauuguuggcaguacacacaugucugggauugauuuggaguguaguguaaaguuuugcuguuucaguaguugcuuuuuuuagugaucuauacuaaaauaacugagaugcauauuacuuguugcuuuacagaucacuagaacuuaauaguguuugucugugggacaggaaugcaguugcgagcauaacuccuucauaguuccacaguuagaugugggucaggccuccagccaucuugaggcuugauuggcagggaggccccuuccaggcacacucuuguggcuguugggagguuccaggccuuuccuagcuauuggcugcagaaaucagguccuguccccacaaguguccuuggagcuacuuuaacaauaccgcacauagccuguuucaggggaaauggaaggccuucuucucuucauggucuaaucuuagaaauguuuucucauuuggucugcuggagucugucugcuaaggaguaagcaggauguagcuauauuugaggaaaagauugcucagguucuuggguguaugcugacuuucacauguuaauuauggcuuugugaauucuuaauaacaagaaaacagcaauuaccacacagacaucaagaaauaggcaauguugagauuucugcaucaagagugauggaaacaguaauuccuuggguccucaucccugcaguauaccauuccagucuaacuuggcuucagaguauaaccaccccauugcuacuuaagaauguggaugauagcuggguagugguggcgcacgccuuuaaucccagcacuugggaggcagaggcagauggauuucugaguuugaggccagccuggucuacagagugaguuccaggacagccagagcuacacagagaaacucuugucucgaaaaaaaaaaaacaaaaaaacaaaacagcaacaacaacaaaaaaagaauguugaugcuuauuuaauaagaugcaagagaaucacaaaaguguuuacaugcugaucuguauguggacuuugcucauagauaagaaaaauuaguugcuaaaugucucuuucaauaauuguagaguaguauaguaaauucuuauuaaaaguuuaauuuccuucuaagucuauggguugcauauauucccuugauaguuguucgggugcuucauccauauuucagaucuuuacccuaaaaaagccagcagugacaagauuuauagaaaugugacuuugcacuugauaacaaaucgugaccuuuaaccuacuuuccagauuacugacguccccuugcccagcuaccugauggcgucuucagcugggcugcucccgacucagcuucugaauucuuacuugggaaccacacuacggacuauggaagaugucaucgcagaacaaagucuuaguggcuauuuugucuuuuguuuacaggugagugcaaggccaagaguugucuggcuuugcugcucuuuguuuugcugacuguuuccuuggccacaguugaagaauuguuucauuuuagauaguuguuucaauacuucuuuauauuuggaugacaguuucaauugugugaacacccggaaauacaugggcguggucagaugcauagaauauccucuguaaaaucauaagaaaagaaucauaaaaaauggauuccuuuuacggggguuguuuuuaaagucauugcaagucaaaugcuguaucuugacuuuguaugaaaacugcugucaaaaaauuuuguauugguucaaagaauuaguuuuuaucuaggcuuaaaguuuuuguuuugcuugcuuuguguggauaagcaugcuaaucacauaauguuaaauuuugcauguacugugccuacagaauaguagguguaauuuccuaucugugucuauucaaaguacaaugaauacucugacauaaaacgcauucuuaaggguuuuuuuuaaagauuaaguagguaucauuuuucucuuucauagaaauuagaaauaugucugaaauaacugugugaguagaauuccucgauugcuuacagcuuacacuguugaaacuuuauauauuuuuuucuuuccuuuuuuuuuuuuuuuuuuuuuuuuuugguuuuucgagacaggguuucucuguguagcccuggcuguccuggaacucacuuuguagaccaggcuggccucaaacucagaaauccaccugccucugccucccgagugcugggauuaaagguguacgccaccaugccuggcuugaaacuuuauauuuucaugccauuuuuauaaauugcacaacuguaauuguuagugccuccuaaaacuauagaaucaucucguuuccaacacaguuuguuaacuccuuuguuugaaugggcauauuuaagcuugauauacauaauucuuagcucaggcauuuguagaaaacguggaagcagugcucugggguggucugcugauguuaguuacagcucagugguuucagaagggauuuagugcagcuagauugugagguagaggagagaaggauacuccugaagguggcauauguccaaguuugaccugcuuuguaugugcucugugucagaguuaccacagguagaugaguuauacugaaguuccuagguacaggcuuucguuccuguuucccagcucuccgcagacuccacugguucauugucaucguccuccucuacuuuuggcuugaaauaaauuaagcugucuucgcuuguccacacaggcugguuuguccguaccuccuguguccucaggagacuccuccuucuucuuuaguaucagaaauuucuaucgaggagauguucuuaaccugugccuguucucuagccugcucuccagcaacuggugggagagaagcuuguguucucuaggaggccuguuccucuggccuccuugcauuuaaauagagaaacauacauccuguugguuccucucucucucuuauacuucugaggcuaaggaagaaagugggugcaugcugaagaaagggcaaagugugugucuccuacccuacacguuuagcccagccccuucccauagcuucugugucugguagguaccacaaauacagugugucuuauacagguguagcaucuugcucacacagccuguagcacacauucuccuaacacugucauuucuuuacauugccucauagucuauugaaagguacuauugaguuuucagaagggaaaucgugauucucuaaggagaaauaaaacaguuacagaauuuagaaacccacguucuuaaugcccagcuuaccauuguauucaacagugguugcucaauuaagagccaauagcugugugacuuccuaccugucacuuuuaagaaauauccaugugaagccuuuuuacacuguauagucauugaauucauuuccuuuaguuguauaucauaucgguaacuggucaucuuuucauucacagauuguuauaagcauuggccucauguuuuauguaguccaucgcgcucaaguggaauugaaugcagcuauuguagcuugugagauggaacugaaaaccucucugguuaaaggcaaucaaucggaucccaguggcucuuccuucuacaacaagaggacccucacguuuucuggagguggaaucaauauuguaugauucuuacaaacugugauuguugagagccuagcgugcuguccaggccuagcagucacuuaccugauggcagagacaagugcuguuguauuauggcacaaacaaaacugacuaguuuuuaaauugcacaauuuucuaaaagcaagaaucauuuucugggucugucaguguaaauguagaugcagcucuggcugcccccccuuguuauaccuguaauggccuauaggugugcacuuuaguguuuuugaauuauuuuauugcugggacuuaugaacagaaaaauaacccaaauauuuucuuucuguuuaguaucuuuauuuauaaagcccaugaauaguugugugcaucuuuaaggaugagugaaaguauagaguucgcaauggcucuuguuguaugcucuuugcuuaggcauucucuccagaagggugaacuguuuuguuuaauguucacuugcuuguuucaagcagaaaagcucugcuuuguuuuccuugcuuguaaggaaauagcuguauuucgguugacuguauguuauccggcauuaugucacuguggucauuuacaccucucgguacaaguguaaacccuacauugugggacugaagugcucuuaagaccccuuuuauuuucacuguguaagaugcaaagugaaagggacauuauuuagcagguggcucacaagucgagcccgcauucuuauucgauuauauugauuucucccauuagaccucauccaagggcuguccgauagcaacucuuaccaaaccauuucccccuuuuauauuaauaauuaggcuuugaaauaagcuuauuguuccuauaaaauggugggcuuaccaucucugacgucauucagguggccuuguuuagucaaaacgccuuguuaaaaagaaacgagcuuuaaaaucauguuuauaguuucaguuaaaaaaaauauauauauguccccauagcuuucagcuuuaaaacuauaaacauuaacaaaaaucccacauucgugcugucugcugcauuauugcuguuuuguuuggggcuuugguguuccuuuucccugacaagacucaggaauucugaaaugugaaauugucucaauccuuuaucuuguagcauguguguuugcuaacagcacuuaggacuuagcauacaauaauccaacaugauucguauggcgugcacucauuuaucagcuuuauuuuuaaaauaguuuaauugcaaacuuaaugaugaguuaauuuugaugcaaauagauuguaguugauacgguaacguuuucuguuaaggacuucacuuuucuaugacuguuccaaccuaucagagcucucuccgcugccuuuugcuggcaguaaaaccuuugcccuggguacugcugacauccagagaaaucccgcgcaagcagauuuuucuagucuuaaccccagagaagaguuugauuguguucacacacgagguuuuugcccaguucagguggcuuuccuuccccugcugaugcguaaaucccucugccucugaguagcaguagaagaccagaguaacugggacgaaaggcaccuggucuacagugcaugccuggccuccagaccuuuguuaucgguagaaaaacaacuauacauacugaguccuuacugucuguuuaguuaaguuucaguuaguuuaaccaucccaauaaaagaaauauuugauuuauccuuuuuaguacaacuuggcaacauuuuucuuguguuucucauuggcuauuuuucguuaaaggaaucuuuauuugagaucauuauuuucaugcuugcuuuacaauucauguauuuugaagugcauuauauuuacuuagcauuuguaacuugaaugacuucaccaaaugaauaccuuuugguaauuuguaauaacuucuuccaaauguuaacacuuucccugguaauuguauuacauauguaaagacaaaagaaauacuuuucuguauucugccaaucauaauuuuauauaauaaaucaucaacuuuuauaauaguauggauugacaauuucuaaaguacuaauguagcaaugcuuuuucuuucuuuaguauucccaagguaccaggaaacagcacuucauuauugccauguuauuugauaggugcaucugguggcugguggcuggguuauauuuauauucacuguaaucugugcagcagagcuguaucauguucacugucucuaauccuguacccugggcuuacaacagcagaaguucucaagcagugcucuggacacauauugccuccagccauauguauucaagaaaugcauauucauagaaaugaaacaugguguccuuacauugguuaacuacagucuaaaguugcuuuauauucauuuagaguccaccuaguuuucaaucugguuaaaguuuuguucuauuuuuucuaagauugccacuuugacaaguuugcauuaccucuuuuuaaaaccauguuuauauuuacugugcucucaugucauuuuuauuugaucaucugauuugugaauaauugaaaucuguacucuuggugaaaaaaucauguuaucaagucucauuguuggaauguucauuuucaguuuauauucagaagugaauggauauuuucagagucagccauacucacccuugaagcacuguacccagcugcuagugucccacaguggcuuuccccaaugcccauacaguguccccuuggggaaacuguggaauucaguuuguuugcccucacuguaaacaaacuaaaugguugaggcgcacacagcaucacaccuguuaaccuguggugguacucuuccuggggaaguuacaugacuuacauuguugucugugaggcugaucuuuccaguucuugaaagcugcugggugugugccacauuggugcaaauagauccuuccuguguggcagaugagugccauucacagaaaaggagaauugaagagaaaaagagguuuauugugaagccagauaacuguaacuggguugguggccuuggugcugagauuauguugcagcugaaggcuccucccaggcucggaaugauccauguaauauuuauugucuggauccucagauuagauguuucugguuucucuuuuaauaagguauuuaggauauauauuuuuaaaguucauugcuuuaagcugaaaagccauuuaaauggaggagaggaauugcucuuguaggcuauuuaaaacucaggaguucaaauaaacucacaaauugaacagacacuguugacuuugcaacuaaguuaugaccugguacgucugagcugcacagugauugcugcagacuguucucagagguggcugggauuuacaguaccgaauucuaacagcaaagcaguuauaaugucuugaaaauuggugucccaaaucacucgugugccuaagaaaauaaaaggaaauauuuuauguuucuucucucuucucuuucuuucccaugguuguaaagauguguucaugggagggaacaguuccggggggagggaggaagaaugcugcucacuguugaugcugaugcuugcacuagugaucccaugucagguguuaggacuguagaggagaggcuguggacaggccauucucauuucuuauauuagcauuugcuccucagcucccgugucacaaaaugccaucuguuaaacacaggcauuagauguuugaugcuuuuucauaaaaugaaaaccuuuucccaaucuaauucucugugccuaguuccucugaugguugccuugaaagcacauuacagcuaccagaaaugauucuucuuagcauccagagugaugcuugccuguguuacuuuuuaccugauccaauacuguuuuucaucuuuugcugccaaaacugcaugcuaaauacacaaaauaaaggguucacaagggaagucaaguguaaugauguaugcuuauaaucccagcacuccuggaggcugaagcaagaggauuauaaguucauggucagccuggguuacaccuuacucccucacacacacacaacaauaaagaagccacaaaggaauaaucauaguucagaggcugaaaacuggauauagcaucacuauccacaucagagaagcacacuggcauuucugguugcuugucauccaaggccaugagccaccaggcuguggccccucuccuuguugauaguagaaucuaccuuagcacuccuaggugugggaaaauguauaccaacaggguauguacuugagcuaaauaaugaacaucauagcauagcauguguauuguaguguuaaacaagguugugcaugugauaaauuuauauugaaucaccauuucaaguuugaauaaaaguaguuauccagauuuaguaaucaccaguuaauacuacugcuuuaaaaugacucagaaguccucgagacaauaaugugcuagauaggagacuuggaaaauaagaaaaaaauuguuugcaggaaaauugaauaggaaaaauaugcugcauaaaaauaccagaaauacuagcugcauauguaucaaaagauagccuaguaggccaucacuggaaagagaggcccauuggauaagcaaacuuuauaugccccaguacaggggaacgccagggccauaaagugggaaugggugguuaggggaguggaguggaggggaggggggagaggguaugggggacuuuugggauagcauuggaaauguaauugaggaaaauacguaauaauaaaaaaaaauauggcaucaaaaaauaauuugaaauucuuauagaguaggaauguagaguagaacacuuuaaguauauuuaacaugcauaaaguguguggccagcaugaaugucuggaguacgaccuagcguauaucucuuguaaucuuguccaaagcuuuccuuggcuagggacgaaggguacuagauaguuucccacuuaaaucuucaaauuacuacuuugauuucaagucaguugucuguuuuuuugcaaugucaugauucugcugugaacgugcaguuguacagcuuccuguagagccaguguuucugggggaucuuggagagggucuauucauugugugggcgugggcuagcguguguguguguguguguguguguguguguguguguguguguguguguguguguguaguguguaguguguaguguguguggauaucuugccaggaaaaaacggcaggaauuucucugguauuugcuugccugguguuaguggcuuucugaaagaccagagccagagauucuggaaacaguuuuggcuuuuaaagcugagacccucugaaagaaaaucucauuucauuccuaccaaaaaguaccauccucugugacaccaacaaguugcagaggggcuguugggccugagaguucccugcuauguaaggaggagaaaauugugcaagagcagaugcagagaaguccucagguccucauagcuggcuggcuucccacuccuccacuggcguggcuggaggcuuguuaauucuaucauuguucucguugcacuuguuagcaaacugagcuuggcacugaggagagugacuaaaccaugauaggagauuaagcaguccucagauuagaugagcuagagaguuccagaaaguugcagugacuguaagaaaaaugacccccaaagucccauugcuuuguauaugccugugugacagcagcaucugcaucugccuguauaggaugaaauguagaugugaaacugccaaagggaauuuacuaguuuaauauggguuccuuagcuaggagaggggaggggaggggaggggaggggcugguguccccggauggaaugaagaagugaagacaaaagggaaaggccacacuugaaaguaaaaugguguggcagaaguuauccuugaguuaacuugugccuguuccggaagagcacacauucuuaagggccuuagugaaggauguaccuucuacuuaagaucagcuguccaauucaaaucccacgccugccaccauuuccuggaugcaaguccuugagaaguuaagaaaacaagacauuucuguucuucuauuucacugccuggggguaauagucugccuccuggguuuuggggagaguuuaaggggcaguguggggaguguacuguaagcugucacuacccaaaccuaccuuguucuucagagcugagagacccuuccaguguguggauguggaagacuaagacaagccugccauuuacaagcaagagcagggagaguuaaaaccuucauggcuccaggaauuuucaaagucaaaauauaaaacaaacccugcaugcuccauacgucauaaaagaucaacuuagaaacccauugggacagaaugugugacugaggaaggaggccuuggagaagucaccgaguugggagagguacagguguuuguuacugguuuugcuuguugcagaugggaaccuuuaguuaaaaagacaagauggugaauguugcagaggggaaggggcauugauuuuguucuuuuagccagaugaguuugcggcucauuccuucuucccaguuaacuguugccuccccagcugcucucuuaguuacuguaagcuaaugcaucgugaagacuugcuucaguucuugcuuuugagucacgcacacugcauaggugcugcugaguuuauuacaucuuguugaugacgccagucuacauuuuguaucaugucaguauaguucugugagugagggaaagaacauuuaaauucucugacuuugcauucagccagccacuguuuuucaguaaaaagagaaaacugccuagauuggccugggguuacacagguacuggggacuagggggacuccuuugugaggaagggggagagugaaaacagucacagaguagccugagcaggccuguggugaacagaggaggaccaagcagaaaugagagagcaggaccaggcaucauggggauugcagggcauggagcagaauuaggggguauacugucauuagugauugaaugaagucugaagaauaagugcagacuguuaaggaaagaggaaaaugaugagaaaucaaaacacacgaaaguauaaauauuuaagaacagcaagaaugugaagggcaggaagcaaaguauuaaaccagcgcuggagcaauacauaagacgcuguguuguaaaggcaucaauggauuuguauauaaaaagcauagguuucauauuuauggauaagaaagugcugaaguagcaacugucuaaauuuugaauugcaaacaauaguuuggggaaauugcagaaugccaaaaccauuaguguaaagaguaaucagggaagaaguaauggccagaaaucagccaugacaguaaauauuaggaagucaaugugcaaaauaaauuuggcaaauguaccuacauugcagaugggcagaugaggaaggcucugggauagcucacggucucuacaauggaugguggccuaacuaagagcaguuuaaggccugagagcugaaagggagguggaaaugcugcugggguguggugaccaaggaauaggcuaaguggucauguagacauaaaacccaaggggacagugggcacugauagacgcucgggaaucaacaaaaugugcugcuuuauaaggugaggaucaugguaaccaugaggagagggucuacaccugguagugcagccgaagaagcagagccaccagcauuggaagguggaagguucuagaaaggacccugaugacuucagaaaggagaaauaccauuaggcagauguugguaucuugggccagugcauggaagccugaaggaguguugugugacuuccacuaggaaauggacauggcaaauauaagucuuccaauugcuuggaccgguuuggccaguaugaagucgaacagucuucuaaccggggagugaggaugauuauaggaaagacagacaaaagaugcaagagacagacaaugggaggguugcaggucauuaccaugccagccaugaguguauuucucaugaccaucuuauacuacaccacuguaggaagcaaagccacaagcuaacagaaacagguugcuagaauauaacacauaagagauuuguuccuaucccaaauccucccuguuccacccaccacggucaauaggaccuuuaguccuuugccuugagccucaggugcaccuccucuuaucauuccuugcuucagcaggccaggaaaucugccaacggauccugaccugccuugauucauccuggcaggcagccccuacagcccucacuccguuucucucuucucugcuucagagaagcagcaagcggcaccgacaguaacuauagcaaccaaaggacuaacaaaacacccagaagugaagagagaacugcguuuccaagggguuugcauugcuuacugccuuucccuauguuuuguuuuuuuuuucuccaugugguacugagaauggcaccucacguuaggcaaggucuaggcuagugcuaggcagguacaccaccacucugagauacuuagggucucucauuuugugaaacaagaguuucacuaaacugcccagacuggccuuaaacuugaaauagcccugcuuuagccuccugagugccuaggaguacaggugugcacucucaggcuuggcuguuuucccucugacauuacaugucuuuucaauuaauacaccuauuaacugugucaguguaaacuuccaaaagacagacugaauucaagaagagaaagugcaguuggagaauagagaaaagauaaguguuaagacuagaauucuuucauauuaaagucaucugggaaaucaaaucacuugcuaugccuggcccuucuuucuagcaccuaggugugggugccagccaauuuugaaguuuacugcugauuuaaaaccugcuaaguggcugaaguuuguuuaagcagugagggaaauugucauuuacauuuuauguuacuauaugaacuuacuggguuaugcccuuagcuuaucucgaagauaacaguauagauuacuggaacaauggccaggaaacugugccauaacacagcuuauuucugaucauugccaauuagcuacaaaagcgaugcuacagcagaaaauguuccagcacucuguucuuuacuugaugaccauuuccuucuaaagggagucguuguucacguuuuauucuuuaauuuuagguaauguuucaaagaucaucugcagaaaaauacccaagaauuuuucgcuucuccuuccccuuccccuuucuucuucuucuucuucuucuucuucuucuucuucuucuucuucuucuucuucuucuucuucuucuucuucuuuuuuuuuuuuuuuuuuuuuuugagacaggguuucucuguguagcccuggcuuuccgcuguccuggaacucauucuguagaccaggcuagcuucaaacucagaaauccgccugccucugccuuccaagugcugggauuaaaggcaugcgccaccacugccuggcacuaaguauuuuuuuagaaaacaaaaaaugacuuaaaauuaacuucuugcaaagaaaccugcuaagagaauugaguaauuggguuguuucugugaaaaauguaaguacaacuuuaauuaauuucugguuuuuuucuuccaucucuaaaauaagcauaucaaaaggcuccaggggcaagcagauccaagaccauccuuacaaaacucaauucuaaacauuuucucuguuaaauguuuaugguucagugaaguuuauuauguucagaaaaauaaggcagacacagagaaucaaauaccaugucuucccacuuuauguuggaaacaaaaacguugguaacccagauuagcaguggggauagcuggggaagggagaguuauaggaggaaguuagauaagggcucugaaauaccaggaggaguugauucaguguuccuauaacaguaggauuucauuacaccguuccacgaucuacuuuagccuaacuaguguaauucccagcacaugaaagugagcaguguuugaugggcuggaaaugcggauuauccucacuugaucauuauacauuguguuccuguguacacuuaguauuauacacaccaucagagugcauggacaguaugucuccauuuaaaaaaaaugaguuuaaaaacauuuauuuaaaaguuugauccauuuuagaaagcaaaaugcuauucagauuucucacauccagaaagaaaaaguuguuuucuuaaggaucagaaagaguagguggcauaguauccccuugccccaucaugcuuuguacacuacagcaggaccuggaacaucagugagaccaugacccccccgccccccaaugcccgcccugaguuguccacagcaaggaccaaccaucaauuaauggaaccauucugcugucuuucaauauagauuuugauuaaggcagaagucugacuauaucaaguccuauaaaacauaguaauuacaaaggcuuuugacauguaacacuuuccuuguaguuucgaauuucugagauaaaggaaaaugauuugggacaggggagauggaucaauugguaaaguguguguguguguguguguguguguguguguguguguguggcaggguggggguggggguucaucccacaacacauguggaaaagaauccauggaguugaagaccaagggauuucuggauacaccguagucuauuuagccaucucuaguugagccagagguugugucuccagaaaggguagauugcauagguauguggacacacacaucuuuaauuccagugcgcaagaggcacaggcaugcagaucuugaguucaaggccaucuugaucuauauagcaauuuccaggccagauagaacuauugagacccugucucaauuuuuuuuuuaauuuaaaagagaaagguggauaacaccugagaaacaacacccaacguuguugucagguaaccuuuacacacacacacacacacacacacacacacacgcaagaaugauuuuuggagcauauaguuaaaauaagaccaaagucuguuacauggcaagauagaauuuuucacugcaaaaaggaagcaaaaucugugcaaauucagggaauuuauaagaaauagcugaaagaaaggggagguuauuugucagucauguugccaggauuuucuuaccuccuagcuauguauauguggcauaugguagguggcaugagguaguguccuccagcaguaauaaugcucucucuguacaugacugugguccugauauauuuccagggggcagaugaggagaaaggggaggggagaaaggugagagggagggggaggacgagacgaagggaauuacuuggaaugcuccagugucccuuuggcuuggggaccuugugagcauguuauuugcuagaaucagaaccaaaaugggauuuacccccucccccaaacucccaaaggaccuguuuuuucuauccuauuuuuacuuguaauucuacaagaaaguugaagauguuuuagaagcuuuguuuuacuaauuguucacccucagcucuuggcugcgauggaaggugaugcuugguauagauuuucauguguauuauggcugcauucuuuccaagaaguggugaaaugacgguaacuuuugcaaaacauacaagcugugacagacagguggagugggaguuccuuccucacugccucacccaccucauuuaauaucagaucauuaccaguucuacaggacacaaagcuuggggaaaaaaagccaaauauuuucacuuaggucugacaucaagugauuugaaauuaugacuucuguuggggggucggguaccagagccaguuagacucguggugaauuguaaauuggucugucaggguauaaguguugacauauagcaacacuggaguagacuggguuucucugauaccuaugauaaaugguaucagacccagauuaacuucaacuugacaucccaagguuaacagcaggcuuaaucaaauuagaaucaccuuuccccuuaugacuuuccuccucagauuucaagaagaggguuuauaccccacuguugaucuuauggggcuauagcaaugucaggucaaacuuacaggcaggacugagaaacuggcugacccaugaucuugucauaugaaguccuucaaacgagucuagcaucuuacaauaaguauuacaacacauuuuucugcuuuauuaguuguaagaaugaugcaaggaucuucuucaaaaaguguuacgucucugacauugcuauuuaacauaucaaaguggacuugcccuccagguucucucagcaucccucaguccuuaccuguuacagaguauggucucuauacuccaucccauaccuuaaacuucuccagcccaagggcugggcugcccuucccuauauaacccagccauuguuaccuggcccuuuugucuacccuuuacucucucuuuucuucccuggccccucuucucauuaguggccagcucaggauuauguucauucuggacucuucccauacgucucugcuucuggcuuugcucucccucauaucucccccaucauacuuaagagcaguuauguccuucuuuucuauuucuuuacuucucuuuucccauucauucaccuagugcugaaacccagggaaaaggccugguagcugguguaggggaguccuaauaccagcuuaacaaaggagcaaagacagacaacucagauauuacugugaacgugaguggaccuuagggauuuauaaaccuuauuuaucaaaccuuauuuaaaaacccuauuuuuaucuaucuaaacuuuuuagagccccaguguugaauagaguuagcaaaggcauaaaaguagucguacauauauuuuuaaguuagggucuauuaaccugaguauaccuuuauaacguuaggaauuuaucauauacaaauccauccuaauccaagauauuuuggaaacuugcuauagcuuccuuagucugaaauuagauacaaugauaaacagagggcucaauaggacgaagaaauuuuauaggugcuuccuuggucuuuuauccacguagucauguuaagauggggguuaagucauguggcguguauccuuuaaccuuaguagagauggcugccagccaugugacuauuguuuaaaauauguauauuuuugguagacuuauuuauuuugguagaucuauuuuuuuucuuaaagcaagaguugaaucacauauauaguaaauuguagcaaauuaagauuacuccugcauagauuuuuaaaauuauaagccuuuuguuauauguuuuaagccaaaaggaauuauaagccacaauugccaccugguaguuacauggguucuggggaucuaaacugugguccucauuuaggcaucaagugauuuaacaauagacccauaucuccaagccccuauuuaagaagcaagacauacucucaggaucuuuggcaaugcuccguguucugaauucuucaccauuaauuaaaugagaagcauucuuauuauugguuuguuuuauccuaucuaguaauuaguaguauuccuuguguuucuaugaauauuuauaauuacuaguuucacauugguaacuauauagauuguaguuguagaguuuuuauucaucuuucagcuucaugauacuuaaccuaaauacuuagcuacuucugucugaaagcucuuuuuuauguguuuauuuauuuuugaaaacuucauacauuuugaucaugguuugucucuguguguguguguguguguguguguguguguguguguguguguguguguguguuugagacaguucucuugcugaucuguaacuuaauauguagaccagacugaucucaaacucccagggaugcucccuccacuaggugcugggaugaaggguucaagcugacucgcucaacauggcuuaaucuuggccucugauuauuauuauuauuauuauuauuauguuuuguuuuguuuuguuuuguuuuguuuuguuuugagaaaggguuucucuguguagcccuggcugcccuggaacucacuuuguagaccaggcuggccucgaacucagaaauccgcuugccucugccucacaagugcugggauuaaaggugugcgccaccaggcccagcuauuuucuuauuucucuaacaagaugaagucucaccuggauucucuuuaaugucuugaaaagcgucuccuguuacaaucucaauaguaauuauauucuuugaauucucuauuuagcacuucugucauucuugguuugucuuucucucuucuuuucccugcuuaaaauccuguuucuagaauaacacucuaggaugcuauaccaucauguacuaaauauuucagacaacagauaucuuccaugucucuuuuccuaucuggcauuuuuuuuaguuauuauuuuucuuuuuuuuuucuccauuuuuuuauuagguauuuagcucauuuacauuuccaaugcuauaccaaaagucccccauauccacccaccccuacuccccugcccacccacucccccuuuuuggcccugguguuccccuguacuggggcauauaaaguuugcauguccaaugggccucucuuuccagugauggccgacuaggccaucuuuugauauauaugcagcuagagucaagagcuccgggguacugguuaguucauaauguuguuccaccuauaggguuacagaucccuuuagcuccuuggcuacuuucucuagcuccuccauugggagcccuaugauccauccauuagcugacugugagcauccacuucuguguuugcuaggccccggcauagucucacaagagacagcuacaucugguccuuucgauaaaaucuuucuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauccuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguagauaggauacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaaugucuaagaucaaaaauucaggugacagcagaugcuggcguggauguggagaaagaggaacacuccuccauuguuggugggagugcaggcuuguacaaccacucuggaaaucagucuggcgguuccucagaaaauuggacauaguacuaccggaggauccagcaauaccucuccugggcauauaucuaguuauuauuuuucuuaauuuuuguuuguuugugugaaugcuaguguuaaauccuauuuugguaacaccauuugacuguugguugcagcagugacaugaguugucucagaaaccugugcuucuaaaugauuuacaguugaguucagggagcuguucaagaaggagcacagcauugguggggggcugagugacgucgcaugauuguuuuuaaugcaauugggaugaaauacauggaguacaaaaggauauccuguuucucauuaugaaagaaaggaguuacaaacaugaaaaggaggaaacuuagagugaaccaguugguaccgguuuagaauuuuaaucuuauuaguuuuuaaacaugugcaacagauagauagauagauagauagauagauagauagauagauagauagauagauagauagauaaauauauuuuguuuaagcucauugggagggccugggaguaaagauacuucaauagcaauagugucaucuaauacgcagaugcugguuucaacaugccauucaacuaaaaggaacuggugguuuuccuugacuggggcaaggaaagaccaaguggagucuggaccuguuugguacugauaggaaagaagcauaaaagaaugguaaagacccuucagaaagacacagcagucagcaucucaucucggacaauugaagagcaaaaugauaaucacagcuuacuuuucugcagccaccaauccaauacuugagaaaccgagcuguuaccacagcugaccaaguaaacgucacaagaaaucauguguggugaccaugaaugugcccuggaaacagagcguguugugaaggaaggaaaugguugacacaucagucuguccccuugaauacugaggucguuguuuucccuggaugggccaacccaaugcugagcaugcugagggaacugcauggaggcuguccauuccugcuucauuucuuccuuuaucaggcagcucuccuuggagaugccccagcagccucugacacuuucccagaacuccacugcacucugcuucuucuuccuuuuuauagaucuuguguucuuaccccugccuacuccuuccugcucugcgcaccccaccccauccuuugcaaaugugugcauaacaaaccuaucauuaucucuaaucugccuugccuucugcuucuuggaagaagugauaaaaccauauaugaugcaaugagaagggggcagggguaaaaaggcauuacuucguggaauuuuuacuaacaacauagaauaugaauauuuucaugaggaaauacaaggcacaagcugagauaguaauagaaaauaaagagccaguaaucuuaaaauugccaagcuugacauuaaaagaaaaauagaaaccauugcaccucgaaggauccuaaagacauaugacagcugaguagcaugacaucuaaauacaguauguggcccuagauauaaucuuugucaugaaagacacuauuaagaugacuggaaaaugugaacuggcucuuuguucuaaaugauaauaacgugcuaguguuuacucuggauuuaaagacagaggaaggacugacagucucagggaucuaggauggguuuaucaugcuugaaauggcucagaaaaccauaccucucucacuguugguccaacuucauugccaaucugaaaaccuuguuugcugaagucagccugguugacuguggagaauggauggauuacaaggagaccagaaaugucugggaaccaguuugaaggcuaucuucagugugucuagacaagagcacaaaggcagcagguauggcaaagaggaauuccaaaguccacaguucgcagugagagaaccuuuaacaaacuggacauggcguacuggaaaagagugacugaggaugacguccgcuuuugcuucaggcuugaagaacugagugggugcucacaauucaguaaggacggcaggaaugagguggggagcagagugaaacagcucugcuucagacagguuagaaugaagacgucuguuagacauccaagagagguuaguaggcauuggcuauaagagucagacaguuagaaugaaaccuuagagguauagacguuaagaacccaaaccccgagagccuuugaauuagauggaucacccggaggauggaaagagcgcaggucuaguucugacaacccccaacauuuucacgucaguuagaaguggguagugggaaugcaaagaauuaucaucugcuccaggcuucuaaagaacuguaaacauaggacuugguaguggaggggaaaggaccagugcuggguuugccagcuucucugagguaggugcauaaggcccucaggcugugggggcugacccuucuguguccauuccuaaauuaccuuccugcaaagguagcuggaacagcaaagauaaacucuuagcagguucuaaaugcgcauauaaauaggcucagccuuuaaaggagguuugggaauuaacuguuucucgggaggcccauuagcagcuuccuggaguuacaaacaggcaaccauuugcuuuauuacauacauaaaagggagaaggagccagucucaucugccaaccaucccagcgaucaggaaaagaccugugagaauuuucuuaagguccaauacauaggaggccacuuagauuuuccuuucagaaagcagucuuaguuuucaaauucuaagugauguguguauuaaagacaccaaacagguacaucgguguaauaauacuacaugcuugcuauuauauuauacacauuaaauuagaguagcuugacauucuaaagauaaagagaagcagcacauuacugccagcaccacauuaacagauggauauaaaaaacuuaguagauguggaaacaacuucccagggcuguaggaauucgugcccgguaccacgucagcaagaagccaucacagacuuuuuuagugacuagaugccaagggaucuauuucaguccaugguguaacaugcucucccuuaacuucuacccacgacuguccagagagcuccagggagaguuggugucagaagacagaacucuuagggggccugucaguccagcaggaaguguucuagcucagcuuuauuauuaauugaggacuugaggcuucacugagcagacuuggcccugauagcucccuggcucugugcuccuuaaccgacucacuuugugagaagcguagaguaggguuagccauguggucaguuacuuuaaugacauuuauagcuacaauugugcagagcaaaagaagucgccugggcaaaaccuuuccuugccaguagcuugugcacaguugcuagucuuaucuuucauggaguaaaaugcauauacauauaugugcacaugacacaucauacacaagaaaagacaaaaaugggcuuguguuuuucagguuaaaugcuuauuuuugaaaauuuacuuucaugccagacauuuucauaguucaugaacagguaauuuacaucagacaugagaacagauuuuucaaaaugaagggaaaauacaccacuuaucauaagaacaguaucucacuaaacaguauuuuaaaaccuugagcacuuucaauggaacugaaguucacaucguuuuaaugaauuccaaacaaucauugcuucaaugauuucugaauuugacuaagugacauguauuauuaauacaaaauaugucagugauuuuuccuucuuuuugugauuuaacccugaaccucacaacaacuaggcaaaugcccucugcuaaaagaauucaaaaaaaaaaauuaaaaacuagauuuuguuccuuccuguuuuauuucugcauauuuaaagcacucuuuuuaauuuucaaagauuuuagcauacugucuuagucagggcuucuauuccugcacaaacaucaugaucaagaagcaguuggggaggaaaggguuuauucggcuuacacuuccauguugcuguugaucaccaaaggaagucaggacuggaacucaagcaaguuaggaagcaggagcugaugcagaggccauggagggauguucuuuacuggcuugcuuccccuggcuugcucagccugcucucuuauagaaccaagaccaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacauauaccaaguaugucuuugcaauuaaguugacaacaggaugauaauguuccuggaggaaacugugccaagaugagcugaauauugucucacauaucuagaauaauuuagauaaacuuugcucaacauuuaauauccauuucuucaaguccaugaacuuauuuuuacauuucagcauaaauaaugacagugggggggggugggcaaagagcuauagugagaauuaugguuuccuuaagaacccaguuguguuauguuauuguuuuaauccuaggugugggauauggggcugcuucagauuuuccauaccugcuaauuaugacuugucucauagucuaggaggagugugauuuuugccagcuacagauaguuuauguuuggaauucugggaacucuuaaaaggguauaaaugugagagcccugaggggucuguggccauuucugcucaugcuggucaucccugcuacuucuagaucuucuguugcauuugcugcuuuugcuauugcuggauugcuggauugcuggauugcuggauugcuggauugcuggauugcuguguugcuauuugcuuguuguuauugcuuggagauauccuuccaaugaagauuggacaugccccuaggaacuagacaccccaaaucagcaggaaguagacuaaagagaccuaaacucucucuccccucuaaccuucuuucucagcuucagagaggaauaucacagaagaggugaacagauagauggaaggaagaagaaacauaaaauuauuuuguugaaaaaacucauaaugguaccuuaaaaaaacauaaaauuuuaaaagaaauguuuuaacagauguauuuguaaaauauuuuugcuuaaguaccuuuauaaauuaauguagaaaauuugucauuuuaaucuucuuuuguauuccuugaguucuauauuaugcaagagugaaaauuaaaaugaauuaauucucuuuguggcaaauuccuuuuugaauauuguaaacucaaauauaauaaaaucauuugucauguauguguuucaauuguaucuaguagaaaguaauuuuccaauuuuaacuugucuuacucuauagacuuuacagguugacuaaaugauguuaaugugaauagaguagagauaaacaccuagacauuuaagcucuacuauuuaaauauuaauguuaacauuaagcauuguguuuauuuuguaaguaaaauuccuucuuaacauaauuaaaaucacauuaaaauugcuaaauuuucauaucuuguuauuguaacgcaagucccauguuagguuucugaugauggaaaauacucgaauggccaaaauaauaauuuaaaugguagugugaaugcagaaaaugaacuuauuucugaaauugacaucuaugcuauaaauuuuguaagcuagaugauuuucucugcauuuuguaauuuugccuuauuucuggaguaauuauuauauuauuauuguuauuauuauuauuggaaaaauguuugucacacucaaguguagcugugaagcugcuuuuaggagcauagcaugaguguuuccauaguaacgauguggcauuuuuucaagugacuguggccccccucaucuccugggaaaaggaaugccucuuucagcucaucugauuuauucacgagagucuggcuuuuuagauagcccugaaauuugaauauaggauaaugucuaacauauuucaaguucccauugugguucuggcaaaauugcaagcacuuuacaggaaugguaaaacucaugacugggaaguguuuuggaagacagauucuaagcugaguuucaaaucucugaguuuuuccacuucccagucuagagcuuuucaauccugaaugagccacaaagcacaucuccaaguacauccccucagccuguccuucugggaguaccuuaggucuuugcguauuuccacacauuuaaauggugcuugccggugucugugccacaauguggaaggguauagccagggcaccacccuagaacaaagaacguauuuagaagcagacccauggacuauuucccaaucugucacugauguaaauguucgauucagcaguccuccaacaagucuuucauacuuauagcauccuuucuuuguuguuuugcuucuugugcaaguauuacauauggaaaguagcucaagaucuaagagaaacaauuucuuccauugguaucuuguuaugcugcauguugguuauucuuaauugauaaguaggauguauauuauuguucauucacauagguacacacacacacacacacacacacacacacacacacacacacaccuuaacuagauuucaaccacagucauuuugugugucuguguauauuacuauuucuguguuuagguuucaauccugagauuuguaagggugcauaauggaauauucuuuaaagaagcaauacgggcaaucucuuaagaaacacgaugaaaagaaucauguaagaaacgaacugaguuccuuaagaguccuugaguagcaccaaagagaagucaggaaccucacauuauuuugauaccugggauggaagauaguuuccaaucucuagacacucuagguauagcucagaggacucagcugacagucucgagugguuuaaguaaacacguggugacgcacaagcauuuuccuccaguggguuuuuuuuuuuuuuuuuuuuuuuuugugauaagaugauuuauuuucaaugcacaaaccacaggagcucaucuggaaacaugguuucucauuuuccggauuuugaccuuaacagaaacucuccaggaaagaugagaucaaguagaugagcuagaggcaaugaucauuaaguaaauugauuuagaaauuuguuauaaugagauuuauuuuauuaaccagugagugcuuuucauuuaaauaguccaauccagcuucuuucccuggcagaggccaucucaguacuucugacuguuggucauuuggucugccaccuucaguacuggccaaauacccuggaagcuaaaacaaagcugucacugagguugugaggcucaaggucuuagugacugacaguggacuauuuauuguuaaggaaagaguaccagcaagagagggggcaggguguguuagacauggggaucauaacaagugacuucuuugggguuuguaggaggcaagagaucaacugacuggccaacccgaugcucuggaacacaccaacuaccccucccccagagccuugcugcauaucuucugucuggaucauugcucccaugacgguuccucuccugagcacuucguuuacagaaguauggcacuauugucccaacuuuuggcucucuggcugcauaacacucacggaguaaauaaguggaacacaaagcugugcaccggagucucguguccguagucaagcccgaauaaacggaugcggaagugguguuucaggaaacuggcccucccuggacaccaggcuuccggugugcauuccugagugcaggcauaugugugccaggccuucacagaacaaagaccaauauucuuaaaacccgcaggacugucuguuucuugccucugguuuuccaggaacugcaauccuauuuaagccugcuuucccucauugucaugagaguugaucuucaugcuuccugauugauuuugccccuggugagcucugugcauaccacgggaguagaggguacugaugagaucacuuggaagaacagaccacaauuaaggaagugguguaugacauaggggcaaacccaaaacuguuaaaguucaguucaaaaguuaaaaacaaaaacaaaacacaacaacaacaacaacaacaacaaacccauagccaccaagugcuagaagaaucacaaccuagucaacaguggaggacaaggggaaaaaaaaauacauguacucaucucuguuuuuuaauuuuacuuuuuacauuuauuuugugcacaaaugugugugagugaagacauguguaggccaaggagcauguguagacgucagaggacaacucucagaugucagcugugaaggcuacacucugcccucaugucuguaaggcaagugccuucccugaggagucaccugccagccugaaguuguacuuuguuguuguuggcuucugucuuagaagagcgcugaaccaucagaaaaccuuucugaaaaucuagguucugcaacgcuugcacuguggaggaagauggagcuucccaguuugagaacagcagccuuuccuuagccuccuuucuggucuuccaaauugccagaaauguugcagucaggaagcaaacaaaauagaggucaaugaggcguaaaugccgcauauuugcuauuaaaacaaaacaaaacaaaacccacgaaaucaagaaguugaauaaauuauucagacaaagcuccaguuaaaagaagcuucuaggugauguauaauaguugugaaauguuucuuuuuaucaugccucugagggcagagagcuccuucccugaaaguguucucaguuccacaaggcacaguuagguccuggaugaaagccagaaccaugaucagauaauaucuaggaccuaccagaggaacuuguuuuugugguaauggaucgccugcauaacaccuggggggugggaguggggugucgccucuuuuuauuccaaugagcuuucaaggcagacuugacucugugggucaaacugaguguccuacacauacugcuuuaaaaccuagggucauacccuuagcuugccucccuggcaccuccucuuucugaugcccacgguccagauuaugauuauucacuacaaacaacaauguucucuuugaacacucuuagacaggcgguuuauaauaucugaaccuugacugcucaucuguaaacuauggaagauaaaggaagguggugaaaggcgccugugcaguggguggcaagagggaaagccggacaggccaguauuuucauuaaagaaguguaugagggcguuuguugggcuucuucuaucucuucccaccuucagacugccuuccccccccucccccccccccccccccccccggauuucucucaugacuucuuggcucugcaucacaaaacugaucuuuccaucugauauucucaguuugcaaggccagacccaggcacacggccuggccuacuuaaagacuuuuaguagaaaccaccacuuccucacaauucaauuaugguuuguuuguuuuucuuucuuucuuucuuucuuucuuuuuuuuuuuucuuuuagacagcugccugcuguugagcagguuucauaacucuuugcacuagcuuccacucuaagugacaacuuuucagagaccuugaaagaaaacuguagaccacaaggaagacaaacauucuauaagaccaagaacaauuuuuauuuuugaaagcaguauuucuaauuuacacucuucuguaaaaauaaaugugaucuuaagauccguuggcuuaacauguuaagguguucagauguuaagcuuucuuggguacuuauggugguauuugucuacacugacauaguagugccauagaaaccugaauuuaaaugcuguacuuaaagguauuuauaauauuuaaaaauuaaaaauacgugcauuuacucacugauaaguggauauuagcccagaaguuuggaauacccaagauacaauucacagaccacgugaaacucaagaagaaggaaaaccaaaguauggauacuuugguccuucuuagaagggggaacaaaauacccaugggaggaguuacagagacaaaguguggagcagagauugaaggaaaggucacccagagacugucccaccuggggauccauuccauauacagucacuaaacccagacacuauuguggaugccaacaaguacuugcugacaggagccugauguaguugucuccugggaggauccgacagugccugacaaauacagagguugauaguuuuagucaaccauuggacuaagcacaagguccccaauggaggaguuaaaguacucaaggagcugaagggguuugcagucccacaggaagaacaacaauaugaaccaaccaguauccccagagcucccagagacuacaccaacaaccaaagaguacacaugaagggaccaauggcaccagcuacauauauagcagaggauggccuuguuggacaucaaugggaggagaggcccuugguccagugaagacuccaugccccaggguaggggaaauguaggaccagaaagcaggaguggguggauuggugagcagggggagguaggagggguuagggaguuucagaggggaaaucaggaaagaggauaacauuugaaauguaaauaaagaaaaugugaaauuuaaaaaauguuaaaaaauuuaaaaauauaauuaaaguuuggaaaaaucaaauuuaaaauaacauaaaugcauuuuaaguuugcccaggaauuccagacugcugcugauguuuuuauauuuuauaaagaacagaaaaaucagguugaaugauugacucucaucuuccaguaaaugauagagcuaggucaaaaccagucaaaccugaccacucucacucugguuucuacacaaggucuucaacggucugugcaauagcguuuaccccauccaggagagaugauauuccuuuaagggagugcucagagggcuuaagucaugguucucuuugguguacauuuuuaaccuuuuagccuuuuaauauuuucuuuaucaaagcccaugggguuaaauuuuaaaacacuaagacuuaccuguucuucuguguuccuugcagcaagaagcauaaggcuucgggagagccacaccaccguacaugucugaaauucuuugugaaggacacagcagcauaacccggugaauccauucaggaauaaaggcacagugaaucca

SEQ ID NO: 1792 - RNA, 44401 nt, Mus musculus
uggauucacugugccuuuauuccugaauggauucaccggguuaugcugcuguguccuucacaaagaauuucagacauguacggugguguggcucucccgaagccuuaugcuucuugcugcaaggaacacagaagaacagguaagucuuaguguuuuaaaauuuaaccccaugggcuuugauaaagaaaauauuaaaaggcuaaaagguuaaaaauguacaccaaagagaaccaugacuuaagcccucugagcacucccuuaaaggaauaucaucucuccuggaugggguaaacgcuauugcacagaccguugaagaccuuguguagaaaccagagugagaguggucagguuugacugguuuugaccuagcucuaucauuuacuggaagaugagagucaaucauucaaccugauuuuucuguucuuuauaaaauauaaaaacaucagcagcagucuggaauuccugggcaaacuuaaaaugcauuuauguuauuuuaaauuugauuuuuccaaacuuuaauuauauuuuuaaauuuuuuaacauuuuuuaaauuucacauuuucuuuauuuacauuucaaauguuauccucuuuccugauuuccccucugaaacucccuaaccccuccuaccucccccugcucaccaauccacccacuccugcuuucugguccuacauuuccccuacccuggggcauggagucuucacuggaccaagggccucuccucccauugauguccaacaaggccauccucugcuauauauguagcuggugccauuggucccuucauguguacucuuugguuguugguguagucucugggagcucuggggauacugguugguucauauuguuguucuuccugugggacugcaaaccccuucagcuccuugaguacuuuaacuccuccauuggggaccuugugcuuaguccaaugguugacuaaaacuaucaaccucuguauuugucaggcacugucggauccucccaggagacaacuacaucaggcuccugucagcaaguacuuguuggcauccacaauagugucuggguuuagugacuguauauggaauggauccccaggugggacagucucugggugaccuuuccuucaaucucugcuccacacuuugucucuguaacuccucccauggguauuuuguucccccuucuaagaaggaccaaaguauccauacuuugguuuuccuucuucuugaguuucacguggucugugaauuguaucuuggguauuccaaacuucugggcuaauauccacuuaucagugaguaaaugcacguauuuuuaauuuuuaaauauuauaaauaccuuuaaguacagcauuuaaauucagguuucuauggcacuacuaugucaguguagacaaauaccaccauaaguacccaagaaagcuuaacaucugaacaccuuaacauguuaagccaacggaucuuaagaucacauuuauuuuuacagaagaguguaaauuagaaauacugcuuucaaaaauaaaaauuguucuuggucuuauagaauguuugucuuccuuguggucuacaguuuucuuucaaggucucugaaaaguugucacuuagaguggaagcuagugcaaagaguuaugaaaccugcucaacagcaggcagcugucuaaaagaaaaaaaaaaaagaaagaaagaaagaaagaaagaaaaacaaacaaaccauaauugaauugugaggaaguggugguuucuacuaaaagucuuuaaguaggccaggccgugugccugggucuggccuugcaaacugagaauaucagauggaaagaucaguuuugugaugcagagccaagaagucaugagagaaauccgggggggggggggggggggggaggggggggaaggcagucugaaggugggaagagauagaagaagcccaacaaacgcccucauacacuucuuuaaugaaaauacuggccuguccggcuuucccucuugccacccacugcacaggcgccuuucaccaccuuccuuuaucuuccauaguuuacagaugagcagucaagguucagauauuauaaaccgccugucuaagaguguucaaagagaacauuguuguuuguagugaauaaucauaaucuggaccgugggcaucagaaagaggaggugccagggaggcaagcuaaggguaugacccuagguuuuaaagcaguauguguaggacacucaguuugacccacagagucaagucugccuugaaagcucauuggaauaaaaagaggcgacaccccacucccaccccccagguguuaugcaggcgauccauuaccacaaaaacaaguuccucugguagguccuagauauuaucugaucaugguucuggcuuucauccaggaccuaacugugccuuguggaacugagaacacuuucagggaaggagcucucugcccucagaggcaugauaaaaagaaacauuucacaacuauuauacaucaccuagaagcuucuuuuaacuggagcuuugucugaauaauuuauucaacuucuugauuucguggguuuuguuuuguuuuguuuuaauagcaaauaugcggcauuuacgccucauugaccucuauuuuguuugcuuccugacugcaacauuucuggcaauuuggaagaccagaaaggaggcuaaggaaaggcugcuguucucaaacugggaagcuccaucuuccuccacagugcaagcguugcagaaccuagauuuucagaaagguuuucugaugguucagcgcucuucuaagacagaagccaacaacaacaaaguacaacuucaggcuggcaggugacuccucagggaaggcacuugccuuacagacaugagggcagaguguagccuucacagcugacaucugagaguuguccucugacgucuacacaugcuccuuggccuacacaugucuucacucacacacauuugugcacaaaauaaauguaaaaaguaaaauuaaaaaacagagaugaguacauguauuuuuuuuuccccuuguccuccacuguugacuagguugugauucuucuagcacuugguggcuauggguuuguuguuguuguuguuguuguuguguuuuguuuuuguuuuuaacuuuugaacugaacuuuaacaguuuuggguuugccccuaugucauacaccacuuccuuaauuguggucuguucuuccaagugaucucaucaguacccucuacucccgugguaugcacagagcucaccaggggcaaaaucaaucaggaagcaugaagaucaacucucaugacaaugagggaaagcaggcuuaaauaggauugcaguuccuggaaaaccagaggcaagaaacagacaguccugcggguuuuaagaauauuggucuuuguucugugaaggccuggcacacauaugccugcacucaggaaugcacaccggaagccugguguccagggagggccaguuuccugaaacaccacuuccgcauccguuuauucgggcuugacuacggacacgagacuccggugcacagcuuuguguuccacuuauuuacuccgugaguguuaugcagccagagagccaaaaguugggacaauagugccauacuucuguaaacgaagugcucaggagaggaaccgucaugggagcaaugauccagacagaagauaugcagcaaggcucugggggagggguaguugguguguuccagagcaucggguuggccagucaguugaucucuugccuccuacaaaccccaaagaagucacuuguuaugauccccaugucuaacacacccugcccccucucuugcugguacucuuuccuuaacaauaaauaguccacugucagucacuaagaccuugagccucacaaccucagugacagcuuuguuuuagcuuccaggguauuuggccaguacugaagguggcagaccaaaugaccaacagucagaaguacugagauggccucugccagggaaagaagcuggauuggacuauuuaaaugaaaagcacucacugguuaauaaaauaaaucucauuauaacaaauuucuaaaucaauuuacuuaaugaucauugccucuagcucaucuacuugaucucaucuuuccuggagaguuucuguuaaggucaaaauccggaaaaugagaaaccauguuuccagaugagcuccugugguuugugcauugaaaauaaaucaucuuaucacaaaaaaaaaaaaaaaaaaaaaaaaacccacuggaggaaaaugcuugugcgucaccacguguuuacuuaaaccacucgagacugucagcugaguccucugagcuauaccuagagugucuagagauuggaaacuaucuuccaucccagguaucaaaauaaugugagguuccugacuucucuuuggugcuacucaaggacucuuaaggaacucaguucguuucuuacaugauucuuuucaucguguuucuuaagagauugcccguauugcuucuuuaaagaauauuccauuaugcacccuuacaaaucucaggauugaaaccuaaacacagaaauaguaauauacacagacacacaaaaugacugugguugaaaucuaguuaagguguguguguguguguguguguguguguguguguguguguguguaccuaugugaaugaacaauaauauacauccuacuuaucaauuaagaauaaccaacaugcagcauaacaagauaccaauggaagaaauuguuucucuuagaucuugagcuacuuuccauauguaauacuugcacaagaagcaaaacaacaaagaaaggaugcuauaaguaugaaagacuuguuggaggacugcugaaucgaacauuuacaucagugacagauugggaaauaguccaugggucugcuucuaaauacguucuuuguucuaggguggugcccuggcuauacccuuccacauuguggcacagacaccggcaagcaccauuuaaauguguggaaauacgcaaagaccuaagguacucccagaaggacaggcugaggggauguacuuggagaugugcuuuguggcucauucaggauugaaaagcucuagacugggaaguggaaaaacucagagauuugaaacucagcuuagaaucugucuuccaaaacacuucccagucaugaguuuuaccauuccuguaaagugcuugcaauuuugccagaaccacaaugggaacuugaaauauguuagacauuauccuauauucaaauuucagggcuaucuaaaaagccagacucucgugaauaaaucagaugagcugaaagaggcauuccuuuucccaggagaugaggggggccacagucacuugaaaaaaugccacaucguuacuauggaaacacucaugcuaugcuccuaaaagcagcuucacagcuacacuugagugugacaaacauuuuuccaauaauaauaauaacaauaauaauauaauaauuacuccagaaauaaggcaaaauuacaaaaugcagagaaaaucaucuagcuuacaaaauuuauagcauagaugucaauuucagaaauaaguucauuuucugcauucacacuaccauuuaaauuauuauuuuggccauucgaguauuuuccaucaucagaaaccuaacaugggacuugcguuacaauaacaagauaugaaaauuuagcaauuuuaaugugauuuuaauuauguuaagaaggaauuuuacuuacaaaauaaacacaaugcuuaauguuaacauuaauauuuaaauaguagagcuuaaaugucuagguguuuaucucuacucuauucacauuaacaucauuuagucaaccuguaaagucuauagaguaagacaaguuaaaauuggaaaauuacuuucuacuagauacaauugaaacacauacaugacaaaugauuuuauuauauuugaguuuacaauauucaaaaaggaauuugccacaaagagaauuaauucauuuuaauuuucacucuugcauaauauagaacucaaggaauacaaaagaagauuaaaaugacaaauuuucuacauuaauuuauaaagguacuuaagcaaaaauauuuuacaaauacaucuguuaaaacauuucuuuuaaaauuuuauguuuuuuuaagguaccauuaugaguuuuuucaacaaaauaauuuuauguuucuucuuccuuccaucuaucuguucaccucuucugugauauuccucucugaagcugagaaagaagguuagaggggagagagaguuuaggucucuuuagucuacuuccugcugauuuggggugucuaguuccuaggggcauguccaaucuucauuggaaggauaucuccaagcaauaacaacaagcaaauagcaacacagcaauccagcaauccagcaauccagcaauccagcaauccagcaauccagcaauagcaaaagcagcaaaugcaacagaagaucuagaaguagcagggaugaccagcaugagcagaaauggccacagaccccucagggcucucacauuuauacccuuuuaagaguucccagaauuccaaacauaaacuaucuguagcuggcaaaaaucacacuccuccuagacuaugagacaagucauaauuagcagguauggaaaaucugaagcagccccauaucccacaccuaggauuaaaacaauaacauaacacaacuggguucuuaaggaaaccauaauucucacuauagcucuuugcccacccccccccacugucauuauuuaugcugaaauguaaaaauaaguucauggacuugaagaaauggauauuaaauguugagcaaaguuuaucuaaauuauucuagauaugugagacaauauucagcucaucuuggcacaguuuccuccaggaacauuaucauccuguugucaacuuaauugcaaagacauacuugguauauguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucugggcugguggucuugguucuauaagagagcaggcugagcaagccaggggaagcaagccaguaaagaacaucccuccauggccucugcaucagcuccugcuuccuaacuugcuugaguuccaguccugacuuccuuuggugaucaacagcaacauggaaguguaagccgaauaaacccuuuccuccccaacugcuucuugaucaugauguuugugcaggaauagaagcccugacuaagacaguaugcuaaaaucuuugaaaauuaaaaagagugcuuuaaauaugcagaaauaaaacaggaaggaacaaaaucuaguuuuuaauuuuuuuuuuugaauucuuuuagcagagggcauuugccuaguuguugugagguucaggguuaaaucacaaaaagaaggaaaaaucacugacauauuuuguauuaauaauacaugucacuuagucaaauucagaaaucauugaagcaaugauuguuuggaauucauuaaaacgaugugaacuucaguuccauugaaagugcucaagguuuuaaaauacuguuuagugagauacuguucuuaugauaagugguguauuuucccuucauuuugaaaaaucuguucucaugucugauguaaauuaccuguucaugaacuaugaaaaugucuggcaugaaaguaaauuuucaaaaauaagcauuuaaccugaaaaacacaagcccauuuuugucuuuucuuguguaugaugugucaugugcacauauauguauaugcauuuuacuccaugaaagauaagacuagcaacugugcacaagcuacuggcaaggaaagguuuugcccaggcgacuucuuuugcucugcacaauuguagcuauaaaugucauuaaaguaacugaccacauggcuaacccuacucuacgcuucucacaaagugagucgguuaaggagcacagagccagggagcuaucagggccaagucugcucagugaagccucaaguccucaauuaauaauaaagcugagcuagaacacuuccugcuggacugacaggcccccuaagaguucugucuucugacaccaacucucccuggagcucucuggacagucguggguagaaguuaagggagagcauguuacaccauggacugaaauagaucccuuggcaucuagucacuaaaaaagucugugauggcuucuugcugacgugguaccgggcacgaauuccuacagcccugggaaguuguuuccacaucuacuaaguuuuuuauauccaucuguuaauguggugcuggcaguaaugugcugcuucucuuuaucuuuagaaugucaagcuacucuaauuuaauguguauaauauaauagcaagcauguaguauuauuacaccgauguaccuguuuggugucuuuaauacacacaucacuuagaauuugaaaacuaagacugcuuucugaaaggaaaaucuaaguggccuccuauguauuggaccuuaagaaaauucucacaggucuuuuccugaucgcugggaugguuggcagaugagacuggcuccuucucccuuuuauguauguaauaaagcaaaugguugccuguuuguaacuccaggaagcugcuaaugggccucccgagaaacaguuaauucccaaaccuccuuuaaaggcugagccuauuuauaugcgcauuuagaaccugcuaagaguuuaucuuugcuguuccagcuaccuuugcaggaagguaauuuaggaauggacacagaagggucagcccccacagccugagggccuuaugcaccuaccucagagaagcuggcaaacccagcacugguccuuuccccuccacuaccaaguccuauguuuacaguucuuuagaagccuggagcagaugauaauucuuugcauucccacuacccacuucuaacugacgugaaaauguuggggguugucagaacuagaccugcgcucuuuccauccuccgggugauccaucuaauucaaaggcucucgggguuuggguucuuaacgucuauaccucuaagguuucauucuaacugucugacucuuauagccaaugccuacuaaccucucuuggaugucuaacagacgucuucauucuaaccugucugaagcagagcuguuucacucugcuccccaccucauuccugccguccuuacugaauugugagcacccacucaguucuucaagccugaagcaaaagcggacgucauccucagucacucuuuuccaguacgccauguccaguuuguuaaagguucucucacugcgaacuguggacuuuggaauuccucuuugccauaccugcugccuuugugcucuugucuagacacacugaagauagccuucaaacugguucccagacauuucuggucuccuuguaauccauccauucuccacagucaaccaggcugacuucagcaaacaagguuuucagauuggcaaugaaguuggaccaacagugagagagguaugguuuucugagccauuucaagcaugauaaacccauccuagaucccugagacugucaguccuuccucugucuuuaaauccagaguaaacacuagcacguuauuaucauuuagaacaaagagccaguucacauuuuccagucaucuuaauagugucuuucaugacaaagauuauaucuagggccacauacuguauuuagaugucaugcuacucagcugucauaugucuuuaggauccuucgaggugcaaugguuucuauuuuucuuuuaaugucaagcuuggcaauuuuaagauuacuggcucuuuauuuucuauuacuaucucagcuugugccuuguauuuccucaugaaaauauucauauucuauguuguuaguaaaaauuccacgaaguaaugccuuuuuaccccugcccccuucucauugcaucauauaugguuuuaucacuucuuccaagaagcagaaggcaaggcagauuagagauaaugauagguuuguuaugcacacauuugcaaaggaugggguggggugcgcagagcaggaaggaguaggcagggguaagaacacaagaucuauaaaaaggaagaagaagcagagugcaguggaguucugggaaagugucagaggcugcuggggcaucuccaaggagagcugccugauaaaggaagaaaugaagcaggaauggacagccuccaugcaguucccucagcaugcucagcauuggguuggcccauccagggaaaacaacgaccucaguauucaaggggacagacugaugugucaaccauuuccuuccuucacaacacgcucuguuuccagggcacauucauggucaccacacaugauuucuugugacguuuacuuggucagcugugguaacagcucgguuucucaaguauuggauugguggcugcagaaaaguaagcugugauuaucauuuugcucuucaauuguccgagaugagaugcugacugcugugucuuucugaagggucuuuaccauucuuuuaugcuucuuuccuaucaguaccaaacagguccagacuccacuuggucuuuccuugccccagucaaggaaaaccaccaguuccuuuuaguugaauggcauguugaaaccagcaucugcguauuagaugacacuauugcuauugaaguaucuuuacucccaggcccucccaaugagcuuaaacaaaauauauuuaucuaucuaucuaucuaucuaucuaucuaucuaucuaucuaucuaucuaucuaucuaucuguugcacauguuuaaaaacuaauaagauuaaaauucuaaaccgguaccaacugguucacucuaaguuuccuccuuuucauguuuguaacuccuuucuuucauaaugagaaacaggauauccuuuuguacuccauguauuucaucccaauugcauuaaaaacaaucaugcgacgucacucagccccccaccaaugcugugcuccuucuugaacagcucccugaacucaacuguaaaucauuuagaagcacagguuucugagacaacucaugucacugcugcaaccaacagucaaaugguguuaccaaaauaggauuuaacacuagcauucacacaaacaaacaaaaauuaagaaaaauaauaacuagauauaugcccaggagagguauugcuggauccuccgguaguacuauguccaauuuucugaggaaccgccagacugauuuccagagugguuguacaagccugcacucccaccaacaauggaggaguguuccucuuucuccacauccacgccagcaucugcugucaccugaauuuuugaucuuagacauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguauccuaucuaccggaggauccagcaauaccucuccugggcauauauccagaagaugccccaacugguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauauaauuugcuaaacacaugaaacucaagaagaaugaagacugaaguguggacacuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagaaagauuuuaucgaaaggaccagauguagcugucucuugugagacuaugccggggccuagcaaacacagaaguggaugcucacagucagcuaauggauggaucauagggcucccaauggaggagcuagagaaaguagccaaggagcuaaagggaucuguaacccuauagguggaacaacauuaugaacuaaccaguaccccggagcucuugacucuagcugcauauauaucaaaagauggccuagucggccaucacuggaaagagaggcccauuggacaugcaaacuuuauaugccccaguacaggggaacaccagggccaaaaagggggagugggugggcaggggaguagggguggguggauaugggggacuuuugguauagcauuggaaauguaaaugagcuaaauaccuaauaaaaaaauggagaaaaaaaaaagaaaaauaauaacuaaaaaaaaugccagauaggaaaagagacauggaagauaucuguugucugaaauauuuaguacaugaugguauagcauccuagaguguuauucuagaaacaggauuuuaagcagggaaaagaagagagaaagacaaaccaagaaugacagaagugcuaaauagagaauucaaagaauauaauuacuauugagauuguaacaggagacgcuuuucaagacauuaaagagaauccaggugagacuucaucuuguuagagaaauaagaaaauagcugggccugguggcgcacaccuuuaaucccagcacuugugaggcagaggcaagcggauuucugaguucgaggccagccuggucuacaaagugaguuccagggcagccagggcuacacagagaaacccuuucucaaaacaaaacaaaacaaaacaaaacaaaacaaaacauaauaauaauaauaauaauaauaaucagaggccaagauuaagccauguugagcgagucagcuugaacccuucaucccagcaccuaguggagggagcaucccugggaguuugagaucagucuggucuacauauuaaguuacagaucagcaagagaacugucucaaacacacacacacacacacacacacacacacacacacacacacacacacacacagagacaaaccaugaucaaaauguaugaaguuuucaaaaauaaauaaacacauaaaaaagagcuuucagacagaaguagcuaaguauuuagguuaaguaucaugaagcugaaagaugaauaaaaacucuacaacuacaaucuauauaguuaccaaugugaaacuaguaauuauaaauauucauagaaacacaaggaauacuacuaauuacuagauaggauaaaacaaaccaauaauaagaaugcuucucauuuaauuaauggugaagaauucagaacacggagcauugccaaagauccugagaguaugucuugcuucuuaaauaggggcuuggagauaugggucuauuguuaaaucacuugaugccuaaaugaggaccacaguuuagauccccagaacccauguaacuaccagguggcaauuguggcuuauaauuccuuuuggcuuaaaacauauaacaaaaggcuuauaauuuuaaaaaucuaugcaggaguaaucuuaauuugcuacaauuuacuauauaugugauucaacucuugcuuuaagaaaaaaaauagaucuaccaaaauaaauaagucuaccaaaaauauacauauuuuaaacaauagucacauggcuggcagccaucucuacuaagguuaaaggauacacgccacaugacuuaacccccaucuuaacaugacuacguggauaaaagaccaaggaagcaccuauaaaauuucuucguccuauugagcccucuguuuaucauuguaucuaauuucagacuaaggaagcuauagcaaguuuccaaaauaucuuggauuaggauggauuuguauaugauaaauuccuaacguuauaaagguauacucagguuaauagacccuaacuuaaaaauauauguacgacuacuuuuaugccuuugcuaacucuauucaacacuggggcucuaaaaaguuuagauagauaaaaauaggguuuuuaaauaagguuugauaaauaagguuuauaaaucccuaagguccacucacguucacaguaauaucugaguugucugucuuugcuccuuuguuaagcugguauuaggacuccccuacaccagcuaccaggccuuuucccuggguuucagcacuaggugaaugaaugggaaaagagaaguaaagaaauagaaaagaaggacauaacugcucuuaaguaugaugggggagauaugagggagagcaaagccagaagcagagacguaugggaagaguccagaaugaacauaauccugagcuggccacuaaugagaagaggggccagggaagaaaagagagaguaaaggguagacaaaagggccagguaacaauggcuggguuauauagggaagggcagcccagcccuugggcuggagaaguuuaagguaugggauggaguauagagaccauacucuguaacagguaaggacugagggaugcugagagaaccuggagggcaaguccacuuugauauguuaaauagcaaugucagagacguaacacuuuuugaagaagauccuugcaucauucuuacaacuaauaaagcagaaaaauguguuguaauacuuauuguaagaugcuagacucguuugaaggacuucauaugacaagaucaugggucagccaguuucucaguccugccuguaaguuugaccugacauugcuauagccccauaagaucaacagugggguauaaacccucuucuugaaaucugaggaggaaagucauaaggggaaaggugauucuaauuugauuaagccugcuguuaaccuugggaugucaaguugaaguuaaucugggucugauaccauuuaucauagguaucagagaaacccagucuacuccaguguugcuauaugucaacacuuauacccugacagaccaauuuacaauucaccacgagucuaacuggcucugguacccgaccccccaacagaagucauaauuucaaaucacuugaugucagaccuaagugaaaauauuuggcuuuuuuuccccaagcuuuguguccuguagaacugguaaugaucugauauuaaaugaggugggugaggcagugaggaaggaacucccacuccaccugucugucacagcuuguauguuuugcaaaaguuaccgucauuucaccacuucuuggaaagaaugcagccauaauacacaugaaaaucuauaccaagcaucaccuuccaucgcagccaagagcugagggugaacaauuaguaaaacaaagcuucuaaaacaucuucaacuuucuuguagaauuacaaguaaaaauaggauagaaaaaacagguccuuugggaguuugggggaggggguaaaucccauuuugguucugauucuagcaaauaacaugcucacaagguccccaagccaaagggacacuggagcauuccaaguaauucccuucgucucguccucccccucccucucaccuuucuccccuccccuuucuccucaucugcccccuggaaauauaucaggaccacagucauguacagagagagcauuauuacugcuggaggacacuaccucaugccaccuaccauaugccacauauacauagcuaggagguaagaaaauccuggcaacaugacugacaaauaaccuccccuuucuuucagcuauuucuuauaaauucccugaauuugcacagauuuugcuuccuuuuugcagugaaaaauucuaucuugccauguaacagacuuuggucuuauuuuaacuauaugcuccaaaaaucauucuugcguguguguguguguguguguguguguguguguaaagguuaccugacaacaacguuggguguuguuucucagguguuauccaccuuucucuuuuaaauuaaaaaaaaaauugagacagggucucaauaguucuaucuggccuggaaauugcuauauagaucaagauggccuugaacucaagaucugcaugccugugccucuugcgcacuggaauuaaagauguguguguccacauaccuaugcaaucuacccuuucuggagacacaaccucuggcucaacuagagauggcuaaauagacuacgguguauccagaaaucccuuggucuucaacuccauggauucuuuuccacauguguugugggaugaacccccacccccacccugccacacacacacacacacacacacacacacacacacacacacuuuaccaauugauccaucuccccugucccaaaucauuuuccuuuaucucagaaauucgaaacuacaaggaaaguguuacaugucaaaagccuuuguaauuacuauguuuuauaggacuugauauagucagacuucugccuuaaucaaaaucuauauugaaagacagcagaaugguuccauuaauugaugguugguccuugcuguggacaacucagggcgggcauuggggggcgggggggucauggucucacugauguuccagguccugcuguaguguacaaagcaugauggggcaaggggauacuaugccaccuacucuuucugauccuuaagaaaacaacuuuuucuuucuggaugugagaaaucugaauagcauuuugcuuucuaaaauggaucaaacuuuuaaauaaauguuuuuaaacucauuuuuuuuaaauggagacauacuguccaugcacucugaugguguguauaauacuaaguguacacaggaacacaauguauaaugaucaagugaggauaauccgcauuuccagcccaucaaacacugcucacuuucaugugcugggaauuacacuaguuaggcuaaaguagaucguggaacgguguaaugaaauccuacuguuauaggaacacugaaucaacuccuccugguauuucagagcccuuaucuaacuuccuccuauaacucucccuuccccagcuauccccacugcuaaucuggguuaccaacguuuuuguuuccaacauaaagugggaagacaugguauuugauucucugugucugccuuauuuuucugaacauaauaaacuucacugaaccauaaacauuuaacagagaaaauguuuagaauugaguuuuguaaggauggucuuggaucugcuugccccuggagccuuuugauaugcuuauuuuagagauggaagaaaaaaaccagaaauuaauuaaaguuguacuuacauuuuucacagaaacaacccaauuacucaauucucuuagcagguuucuuugcaagaaguuaauuuuaagucauuuuuuguuuucuaaaaaaauacuuagugccaggcagugguggcgcaugccuuuaaucccagcacuuggaaggcagaggcaggcggauuucugaguuugaagcuagccuggucuacagaaugaguuccaggacagcggaaagccagggcuacacagagaaacccugucucaaaaaaaaaaaaaaaaaaaaaaagaagaagaagaagaagaagaagaagaagaagaagaagaagaagaagaagaagaagaagaagaagaagaagaaaggggaaggggaaggagaagcgaaaaauucuuggguauuuuucugcagaugaucuuugaaacauuaccuaaaauuaaagaauaaaacgugaacaacgacucccuuuagaaggaaauggucaucaaguaaagaacagagugcuggaacauuuucugcuguagcaucgcuuuuguagcuaauuggcaaugaucagaaauaagcuguguuauggcacaguuuccuggccauuguuccaguaaucuauacuguuaucuucgagauaagcuaagggcauaacccaguaaguucauauaguaacauaaaauguaaaugacaauuucccucacugcuuaaacaaacuucagccacuuagcagguuuuaaaucagcaguaaacuucaaaauuggcuggcacccacaccuaggugcuagaaagaagggccaggcauagcaagugauuugauuucccagaugacuuuaauaugaaagaauucuagucuuaacacuuaucuuuucucuauucuccaacugcacuuucucuucuugaauucagucugucuuuuggaaguuuacacugacacaguuaauagguguauuaauugaaaagacauguaaugucagagggaaaacagccaagccugagagugcacaccuguacuccuaggcacucaggaggcuaaagcagggcuauuucaaguuuaaggccagucugggcaguuuagugaaacucuuguuucacaaaaugagagacccuaaguaucucagaguggugguguaccugccuagcacuagccuagaccuugccuaacgugaggugccauucucaguaccacauggagaaaaaaaaaacaaaacauagggaaaggcaguaagcaaugcaaaccccuuggaaacgcaguucucucuucacuucuggguguuuuguuaguccuuugguugcuauaguuacugucggugccgcuugcugcuucucugaagcagagaagagagaaacggagugagggcuguaggggcugccugccaggaugaaucaaggcaggucaggauccguuggcagauuuccuggccugcugaagcaaggaaugauaagaggaggugcaccugaggcucaaggcaaaggacuaaagguccuauugaccgugguggguggaacagggaggauuugggauaggaacaaaucucuuauguguuauauucuagcaaccuguuucuguuagcuuguggcuuugcuuccuacagugguguaguauaagauggucaugagaaauacacucauggcuggcaugguaaugaccugcaacccucccauugucugucucuugcaucuuuugucugucuuuccuauaaucauccucacuccccgguuagaagacuguucgacuucauacuggccaaaccgguccaagcaauuggaagacuuauauuugccauguccauuuccuaguggaagucacacaacacuccuucaggcuuccaugcacuggcccaagauaccaacaucugccuaaugguauuucuccuuucugaagucaucaggguccuuucuagaaccuuccaccuuccaaugcugguggcucugcuucuucggcugcacuaccagguguagacccucuccucaugguuaccaugauccucaccuuauaaagcagcacauuuuguugauucccgagcgucuaucagugcccacuguccccuuggguuuuaugucuacaugaccacuuagccuauuccuuggucaccacaccccagcagcauuuccaccucccuuucagcucucaggccuuaaacugcucuuaguuaggccaccauccauuguagagaccgugagcuaucccagagccuuccucaucugcccaucugcaauguagguacauuugccaaauuuauuuugcacauugacuuccuaauauuuacugucauggcugauuucuggccauuacuucuucccugauuacucuuuacacuaaugguuuuggcauucugcaauuuccccaaacuauuguuugcaauucaaaauuuagacaguugcuacuucagcacuuucuuauccauaaauaugaaaccuaugcuuuuuauauacaaauccauugaugccuuuacaacacagcgucuuauguauugcuccagcgcugguuuaauacuuugcuuccugcccuucacauucuugcuguucuuaaauauuuauacuuucguguguuuugauuucucaucauuuuccucuuuccuuaacagucugcacuuauucuucagacuucauucaaucacuaaugacaguauacccccuaauucugcuccaugcccugcaauccccaugaugccugguccugcucucucauuucugcuugguccuccucuguucaccacaggccugcucaggcuacucugugacuguuuucacucucccccuuccucacaaaggagucccccuaguccccaguaccuguguaaccccaggccaaucuaggcaguuuucucuuuuuacugaaaaacaguggcuggcugaaugcaaagucagagaauuuaaauguucuuucccucacucacagaacuauacugacaugauacaaaauguagacuggcgucaucaacaagauguaauaaacucagcagcaccuaugcagugugcgugacucaaaagcaagaacugaagcaagucuucacgaugcauuagcuuacaguaacuaagagagcagcuggggaggcaacaguuaacugggaagaaggaaugagccgcaaacucaucuggcuaaaagaacaaaaucaaugccccuuccccucugcaacauucaccaucuugucuuuuuaacuaaagguucccaucugcaacaagcaaaaccaguaacaaacaccuguaccucucccaacucggugacuucuccaaggccuccuuccucagucacacauucugucccaauggguuucuaaguugaucuuuuaugacguauggagcaugcaggguuuguuuuauauuuugacuuugaaaauuccuggagccaugaagguuuuaacucucccugcucuugcuuguaaauggcaggcuugucuuagucuuccacauccacacacuggaagggucucucagcucugaagaacaagguagguuuggguagugacagcuuacaguacacuccccacacugccccuuaaacucuccccaaaacccaggaggcagacuauuacccccaggcagugaaauagaagaacagaaaugucuuguuuucuuaacuucucaaggacuugcauccaggaaaugguggcaggcgugggauuugaauuggacagcugaucuuaaguagaagguacauccuucacuaaggcccuuaagaaugugugcucuuccggaacaggcacaaguuaacucaaggauaacuucugccacaccauuuuacuuucaaguguggccuuucccuuuugucuucacuucuucauuccauccggggacaccagccccuccccuccccuccccuccccucuccuagcuaaggaacccauauuaaacuaguaaauucccuuuggcaguuucacaucuacauuucauccuauacaggcagaugcagaugcugcugucacacaggcauauacaaagcaaugggacuuugggggucauuuuucuuacagucacugcaacuuucuggaacucucuagcucaucuaaucugaggacugcuuaaucuccuaucaugguuuagucacucuccucagugccaagcucaguuugcuaacaagugcaacgagaacaaugauagaauuaacaagccuccagccacgccaguggaggagugggaagccagccagcuaugaggaccugaggacuucucugcaucugcucuugcacaauuuucuccuccuuacauagcagggaacucucaggcccaacagccccucugcaacuuguuggugucacagaggaugguacuuuuugguaggaaugaaaugagauuuucuuucagagggucucagcuuuaaaagccaaaacuguuuccagaaucucuggcucuggucuuucagaaagccacuaacaccaggcaagcaaauaccagagaaauuccugccguuuuuuccuggcaagauauccacacacacuacacacuacacacuacacacacacacacacacacacacacacacacacacacacacacacacacacacacgcuagcccacgcccacacaaugaauagacccucuccaagaucccccagaaacacuggcucuacaggaagcuguacaacugcacguucacagcagaaucaugacauugcaaaaaaacagacaacugacuugaaaucaaaguaguaauuugaagauuuaagugggaaacuaucuaguacccuucgucccuagccaaggaaagcuuuggacaagauuacaagagauauacgcuaggucguacuccagacauucaugcuggccacacacuuuaugcauguuaaauauacuuaaaguguucuacucuacauuccuacucuauaagaauuucaaauuauuuuuugaugccauauuuuuuuuuauuauuacguauuuuccucaauuacauuuccaaugcuaucccaaaagucccccauacccucuccccccuccccuccacuccacuccccuaaccacccauucccacuuuauggcccuggcguuccccuguacuggggcauauaaaguuugcuuauccaaugggccucucuuuccagugauggccuacuaggcuaucuuuugauacauaugcagcuaguauuucugguauuuuuaugcagcauauuuuuccuauucaauuuuccugcaaacaauuuuuuucuuauuuuccaagucuccuaucuagcacauuauugucucgaggacuucugagucauuuuaaagcaguaguauuaacuggugauuacuaaaucuggauaacuacuuuuauucaaacuugaaauggugauucaauauaaauuuaucacaugcacaaccuuguuuaacacuacaauacacaugcuaugcuaugauguucauuauuuagcucaaguacauacccuguugguauacauuuucccacaccuaggagugcuaagguagauucuacuaucaacaaggagaggggccacagccugguggcucauggccuuggaugacaagcaaccagaaaugccagugugcuucucugauguggauagugaugcuauauccaguuuucagccucugaacuaugauuauuccuuuguggcuucuuuauuguugugugugugugagggaguaagguguaacccaggcugaccaugaacuuauaauccucuugcuucagccuccaggagugcugggauuauaagcauacaucauuacacuugacuucccuugugaacccuuuauuuuguguauuuagcaugcaguuuuggcagcaaaagaugaaaaacaguauuggaucagguaaaaaguaacacaggcaagcaucacucuggaugcuaagaagaaucauuucugguagcuguaaugugcuuucaaggcaaccaucagaggaacuaggcacagagaauuagauugggaaaagguuuucauuuuaugaaaaagcaucaaacaucuaaugccuguguuuaacagauggcauuuugugacacgggagcugaggagcaaaugcuaauauaagaaaugagaauggccuguccacagccucuccucuacaguccuaacaccugacaugggaucacuagugcaagcaucagcaucaacagugagcagcauucuuccucccuccccccggaacuguucccucccaugaacacaucuuuacaaccaugggaaagaaagagaagagagaagaaacauaaaauauuuccuuuuauuuucuuaggcacacgagugauuugggacaccaauuuucaagacauuauaacugcuuugcuguuagaauucgguacuguaaaucccagccaccucugagaacagucugcagcaaucacugugcagcucagacguaccaggucauaacuuaguugcaaagucaacagugucuguucaauuugugaguuuauuugaacuccugaguuuuaaauagccuacaagagcaauuccucuccuccauuuaaauggcuuuucagcuuaaagcaaugaacuuuaaaaauauauauccuaaauaccuuauuaaaagagaaaccagaaacaucuaaucugaggauccagacaauaaauauuacauggaucauuccgagccugggaggagccuucagcugcaacauaaucucagcaccaaggccaccaacccaguuacaguuaucuggcuucacaauaaaccucuuuuucucuucaauucuccuuuucugugaauggcacucaucugccacacaggaaggaucuauuugcaccaauguggcacacacccagcagcuuucaagaacuggaaagaucagccucacagacaacaauguaagucauguaacuuccccaggaagaguaccaccacagguuaacaggugugaugcugugugcgccucaaccauuuaguuuguuuacagugagggcaaacaaacugaauuccacaguuuccccaaggggacacuguaugggcauuggggaaagccacugugggacacuagcagcuggguacagugcuucaagggugaguauggcugacucugaaaauauccauucacuucugaauauaaacugaaaaugaacauuccaacaaugagacuugauaacaugauuuuuucaccaagaguacagauuucaauuauucacaaaucagaugaucaaauaaaaaugacaugagagcacaguaaauauaaacaugguuuuaaaaagagguaaugcaaacuugucaaaguggcaaucuuagaaaaaauagaacaaaacuuuaaccagauugaaaacuagguggacucuaaaugaauauaaagcaacuuuagacuguaguuaaccaauguaaggacaccauguuucauuucuaugaauaugcauuucuugaauacauauggcuggaggcaauauguguccagagcacugcuugagaacuucugcuguuguaagcccaggguacaggauuagagacagugaacaugauacagcucugcugcacagauuacagugaauauaaauauaacccagccaccagccaccagaugcaccuaucaaauaacauggcaauaaugaagugcuguuuccugguaccuugggaauacuaaagaaagaaaaagcauugcuacauuaguacuuuagaaauugucaauccauacuauuauaaaaguugaugauuuauuauauaaaauuaugauuggcagaauacagaaaaguauuucuuuugucuuuacauauguaauacaauuaccagggaaaguguuaacauuuggaagaaguuauuacaaauuaccaaaagguauucauuuggugaagucauucaaguuacaaaugcuaaguaaauauaaugcacuucaaaauacaugaauuguaaagcaagcaugaaaauaaugaucucaaauaaagauuccuuuaacgaaaaauagccaaugagaaacacaagaaaaauguugccaaguuguacuaaaaaggauaaaucaaauauuucuuuuauugggaugguuaaacuaacugaaacuuaacuaaacagacaguaaggacucaguauguauaguuguuuuucuaccgauaacaaaggucuggaggccaggcaugcacuguagaccaggugccuuucgucccaguuacucuggucuucuacugcuacucagaggcagagggauuuacgcaucagcaggggaaggaaagccaccugaacugggcaaaaaccucgugugugaacacaaucaaacucuucucugggguuaagacuagaaaaaucugcuugcgcgggauuucucuggaugucagcaguacccagggcaaagguuuuacugccagcaaaaggcagcggagagagcucugauagguuggaacagucauagaaaagugaaguccuuaacagaaaacguuaccguaucaacuacaaucuauuugcaucaaaauuaacucaucauuaaguuugcaauuaaacuauuuuaaaaauaaagcugauaaaugagugcacgccauacgaaucauguuggauuauuguaugcuaaguccuaagugcuguuagcaaacacacaugcuacaagauaaaggauugagacaauuucacauuucagaauuccugagucuugucagggaaaaggaacaccaaagccccaaacaaaacagcaauaaugcagcagacagcacgaaugugggauuuuuguuaauguuuauaguuuuaaagcugaaagcuauggggacauauauauauuuuuuuuaacugaaacuauaaacaugauuuuaaagcucguuucuuuuuaacaaggcguuuugacuaaacaaggccaccugaaugacgucagagaugguaagcccaccauuuuauaggaacaauaagcuuauuucaaagccuaauuauuaauauaaaagggggaaaugguuugguaagaguugcuaucggacagcccuuggaugaggucuaaugggagaaaucaauauaaucgaauaagaaugcgggcucgacuugugagccaccugcuaaauaaugucccuuucacuuugcaucuuacacagugaaaauaaaaggggucuuaagagcacuucagucccacaauguaggguuuacacuuguaccgagagguguaaaugaccacagugacauaaugccggauaacauacagucaaccgaaauacagcuauuuccuuacaagcaaggaaaacaaagcagagcuuuucugcuugaaacaagcaagugaacauuaaacaaaacaguucacccuucuggagagaaugccuaagcaaagagcauacaacaagagccauugcgaacucuauacuuucacucauccuuaaagaugcacacaacuauucaugggcuuuauaaauaaagauacuaaacagaaagaaaauauuuggguuauuuuucuguucauaagucccagcaauaaaauaauucaaaaacacuaaagugcacaccuauaggccauuacagguauaacaagggggggcagccagagcugcaucuacauuuacacugacagacccagaaaaugauucuugcuuuuagaaaauugugcaauuuaaaaacuagucaguuuuguuugugccauaauacaacagcacuugucucugccaucagguaagugacugcuaggccuggacagcacgcuaggcucucaacaaucacaguuuguaagaaucauacaauauugauuccaccuccagaaaacgugaggguccucuuguuguagaaggaagagccacugggauccgauugauugccuuuaaccagagagguuuucaguuccaucucacaagcuacaauagcugcauucaauuccacuugagcgcgauggacuacauaaaacaugaggccaaugcuuauaacaaucugugaaugaaaagaugaccaguuaccgauaugauauacaacuaaaggaaaugaauucaaugacuauacaguguaaaaaggcuucacauggauauuucuuaaaagugacagguaggaagucacacagcuauuggcucuuaauugagcaaccacuguugaauacaaugguaagcugggcauuaagaacguggguuucuaaauucuguaacuguuuuauuucuccuuagagaaucacgauuucccuucugaaaacucaauaguaccuuucaauagacuaugaggcaauguaaagaaaugacaguguuaggagaaugugugcuacaggcugugugagcaagaugcuacaccuguauaagacacacuguauuugugguaccuaccagacacagaagcuaugggaaggggcugggcuaaacguguaggguaggagacacacacuuugcccuuucuucagcaugcacccacuuucuuccuuagccucagaaguauaagagagagagaggaaccaacaggauguauguuucucuauuuaaaugcaaggaggccagaggaacaggccuccuagagaacacaagcuucucucccaccaguugcuggagagcaggcuagagaacaggcacagguuaagaacaucuccucgauagaaauuucugauacuaaagaagaaggaggagucuccugaggacacaggagguacggacaaaccagccuguguggacaagcgaagacagcuuaauuuauuucaagccaaaaguagaggaggacgaugacaaugaaccaguggagucugcggagagcugggaaacaggaacgaaagccuguaccuaggaacuucaguauaacucaucuaccugugguaacucugacacagagcacauacaaagcaggucaaacuuggacauaugccaccuucaggaguauccuucucuccucuaccucacaaucuagcugcacuaaaucccuucugaaaccacugagcuguaacuaacaucagcagaccaccccagagcacugcuuccacguuuucuacaaaugccugagcuaagaauuauguauaucaagcuuaaauaugcccauucaaacaaaggaguuaacaaacuguguuggaaacgagaugauucuauaguuuuaggaggcacuaacaauuacaguugugcaauuuauaaaaauggcaugaaaauauaaaguuucaagccaggcaugguggcguacaccuuuaaucccagcacucgggaggcagaggcagguggauuucugaguuugaggccagccuggucuacaaagugaguuccaggacagccagggcuacacagagaaacccugucucgaaaaaccaaaaaaaaaaaaaaaaaaaaaaaaaaggaaagaaaaaaauauauaaaguuucaacaguguaagcuguaagcaaucgaggaauucuacucacacaguuauuucagacauauuucuaauuucuaugaaagagaaaaaugauaccuacuuaaucuuuaaaaaaaacccuuaagaaugcguuuuaugucagaguauucauuguacuuugaauagacacagauaggaaauuacaccuacuauucuguaggcacaguacaugcaaaauuuaacauuaugugauuagcaugcuuauccacacaaagcaagcaaaacaaaaacuuuaagccuagauaaaaacuaauucuuugaaccaauacaaaauuuuuugacagcaguuuucauacaaagucaagauacagcauuugacuugcaaugacuuuaaaaacaacccccguaaaaggaauccauuuuuuaugauucuuuucuuaugauuuuacagaggauauucuaugcaucugaccacgcccauguauuuccggguguucacacaauugaaacugucauccaaauauaaagaaguauugaaacaacuaucuaaaaugaaacaauucuucaacuguggccaaggaaacagucagcaaaacaaagagcagcaaagccagacaacucuuggccuugcacucaccuguaaacaaaagacaaaauagccacuaagacuuuguucugcgaugacaucuuccauaguccguagugugguucccaaguaagaauucagaagcugagucgggagcagcccagcugaagacgccaucagguagcugggcaaggggacgucaguaaucuggaaaguagguuaaaggucacgauuuguuaucaagugcaaagucacauuucuauaaaucuugucacugcuggcuuuuuuaggguaaagaucugaaauauggaugaagcacccgaacaacuaucaagggaauauaugcaacccauagacuuagaaggaaauuaaacuuuuaauaagaauuuacuauacuacucuacaauuauugaaagagacauuuagcaacuaauuuuucuuaucuaugagcaaaguccacauacagaucagcauguaaacacuuuugugauucucuugcaucuuauuaaauaagcaucaacauucuuuuuuuguuguuguugcuguuuuguuuuuuuguuuuuuuuuuuucgagacaagaguuucucuguguagcucuggcuguccuggaacucacucuguagaccaggcuggccucaaacucagaaauccaucugccucugccucccaagugcugggauuaaaggcgugcgccaccacuacccagcuaucauccacauucuuaaguagcaauggggugguuauacucugaagccaaguuagacuggaaugguauacugcagggaugaggacccaaggaauuacuguuuccaucacucuugaugcagaaaucucaacauugccuauuucuugaugucugugugguaauugcuguuuucuuguuauuaagaauucacaaagccauaauuaacaugugaaagucagcauacacccaagaaccugagcaaucuuuuccucaaauauagcuacauccugcuuacuccuuagcagacagacuccagcagaccaaaugagaaaacauuucuaagauuagaccaugaagagaagaaggccuuccauuuccccugaaacaggcuaugugcgguauuguuaaaguagcuccaaggacacuuguggggacaggaccugauuucugcagccaauagcuaggaaaggccuggaaccucccaacagccacaagagugugccuggaaggggccucccugccaaucaagccucaagauggcuggaggccugacccacaucuaacuguggaacuaugaaggaguuaugcucgcaacugcauuccugucccacagacaaacacuauuaaguucuagugaucuguaaagcaacaaguaauaugcaucucaguuauuuuaguauagaucacuaaaaaaagcaacuacugaaacagcaaaacuuuacacuacacuccaaaucaaucccagacauguguguacugccaacaauggcauauguccaucaugcuuacuacagagucaguuuucagcuucccaugauaccauuuguacuuuuuucauuuauacugauacaggguuuuucugacaauuuuuauauaugacuucauuuguucuuaguugcccuauauucucagaauguuauucuuuuccuauuccuaagugcucuuuacauauaaggacacaaguugaucuauuuuaccuaacauacauuuuuuaugguacugucccuauaccguaaauuuugagucauggccucacuauguuaucuagaugugccucaaaugcuuguguuccuuggcaccacaguccucauaugaacuauaaggugaacaguucaucuuauagaaacacaugaauauauaaucaaauguaagagaacucuaccauuuuuauguucaugaagguuuuuuuuuuuuuuuugcuucuuucccuugccuuuuuaauacucaccauuauauaauucuggaauuuauuaauuuuaaaaguaauggcauggauuuauuccuuuccuuucccaagaguaaauuuuguuagcauuacaaaauggauauucaaguuucuuuauuugcuuguggcuuuaguaugaauuucccacccccuucaaacauacucauuauuguuaagaauuacaucuauucucacuacuuagucuuacagauuaucuugccauucaaauaacuaaauuaaauuuuauaaugaaucugguacagaugaaaaaucuauguguugaguauccuuauccagauguguauaauuacucaaaaaauuaacauauuuuacugaaauuuggccauuuagccauauucauguauuuguuaguugaauucuagucaucuucuauauugugaaugugacuuccccacacaccauuuaguuauucucgguauguaagaaagcuaccacucuauuaaacuuucuuaaacuaauuuuaagauccaggauuucagccacccauaggcagcugcucuaugucaauuauaucaauaaucguguagauuauaauuccauuauuguuaaauuaaucuauagucacaaacaggagaugcagcauuguugaguuggaaagaauauuacagcaacagaguugguaauucauuuaucacugagacauaacuguccaugcaagaugcccugauuauuugcugaaagagacacaaaguaagauucuucaaagaauuacauauauggucaagcauaccacuaccucagacacagaaaggaagccuugagaaagagaagugcagaacacuaaagaguagaguagaaucaaaauuagauaugggagccuaggccagggggcaacuuuauaaaaggaggcagugagaaggacauggaagccgaagcaugugcuaagcagacauggaugggugcaaugaaggcagguccucugggaaaagcaucaacagggacacugugggaggggaaguccagacguaauaaugacauuggcaggacauucuggguuguuuagucacaugcaagggaaucuugaacacuaaagacaauaaaagcaaccaagaugaaacacagaacagacuugguaaagaggaccaagucacucaaaugaaaagaaccagggccuuugcucacaggagcagaggaucaucuuuaaaagggaaaaaugcuaaauguauacaauggcaaaauaaggaaaaagugagugauaaaaauccugugauauaguuaacaugcaacuuaucaaaauuauauuuaaauauugaagaggcuugagaggaaguuaagaguggcugcugcucucccaggagacugaagcuuggucucacaccaggguggauccucaaauccuguaauuucagugucuggaaaucugaugcucauucuggcucccaagagcacccacauacacacugaacauagggacauacagacauacauaagaauaaaaagugugugugugugugugugugugugugugugugugugaacaacucagugguuuagagcauguacuaaucuuacagaggacccauauuauaguugccaucgcccacacugggcagcuuggggacccaaagcccucucuggcucuacaggcaccuggcacucauguauaaauagcagcauguacagauaggcacauacacauaauuuaaaagauaaaucuuaaaauacugagcuuacauuccaaaacguccuaauauaaaauuucagucuacagccuuagaucugucuccaaacggaauucauaauuaacaugcaaagaacauaaaaaauuccuguugggaaugcuaacagauuucagaaacaggacagacuggacaguugcuuuuuaccaugacuaccguccaacauaaagucagguccaucaaaauguaaaggaugcagccucaucaugggggaaaguaccauagcacuucaccuacuguuuccaugaugcuaucuaagagaagcaaaugacagacuucagauaaucacucuggacagcucugcuagagagaacauaacauaaucacuuccuaagcuauuaaucacacuacuaaagauaagauuucaacuuauuuuaaaggagaauuugaacaagcccuaauccucgucagaaccuacauuuuucuaaucuuugacaaacacaaguucccagccuccucucccaagucuuugcacacauaauuuuaaaugucuguuuacuugucucuucagagacaaagauccacgcagggcagugcacugggauuaccaccuaccuagauagaguacccuaggacccuggcaccacaguuauccuccagaugcaaagagccaauggaaauccuaaucuagaacaucaguuuuaguuggacaguugcuauggucagugacagaaauuaucuaguaagguuuucagagauuaguaaugucaccugacagacauguguaucuaagcauauuauacaucgguaauauauacuuuuaaauaaauacucauuuuuauuuuauguguacguauacauuauuauuuuaucuguacauguaugucugaguuuauguacgugaacuacaaguaugcaggugccugaaaaggucagagagucccuggagcuagggucacuggcagcuacacgcugcccaaugugggcacugggaaccagguccuuuguaagaguaguagcugccauuuguccagcacugaugauagauaguaauuucuccagaguuacuaugacucgccugaagaauaacuuggaacucacauucuucugagguggggcauaaaauacuauccuuggggaauuuugcuccagaaauauagucauuuuugaaguuuacauuucuuacacaggguuuuacaaauucuaacuuaaaacacuaaaauuuauuacauagaauaacucuauauagaauuaguaaaaagcauaaaaguaauguguucacaaaaucucaaauuuuaccuguaacucugugagucuaauauuggguugggcaaacuaaacaccuccuuacauuagauacacuucaggcuuugugaaucaaugguauuguuuagucaauuacuaucaagauauuauguaaauucuaaguauaauauauuagauauuauacagaaaaaucaugaacaccuaccuugauuuuuauuaaagacagaaagcauuuaaaguuacuauagguucuacuuuuuauuuacuucuugauauaguaugugcuuuccugcauauauacuccauacacuuacuguuacugcuucagaaauguuagagaagagcgagaaagaagucaaauacaguagguaguuuucuuuuuuuuuuaauuuauuuuuuuaauuauguauuuucuucauuuacauuuccaauacuaucccaaaagucccccaugcccccccacucuccccccccucacuccuacuucuugguccugguguucuuuuggccugguguacuuaggcauauaaaguuugcaagaccaaugggccuuucuuuccacugauggccgaccaggccaucuucugauucauaugcagcuagagacacaagcuggggggggggggggguacugguuaguucauauuguuguuccaccuauaggguugcagaccccuucaacuccuuggguauuuucucuagcuccuccauugggggccuguguuccauccaauagaugacugugagcaaucacuucuguguuugcuaggccccggcauagccucacaagagacagcuacaucaggguccuuucagcaaaaucuugcuagaaaagcuggccugaccaggguaguuuucacucuuaggaaauuuuaaaguauuucaauugacuuaaaggacuggggaguagcucaguuaguagaugcucacauaguaugcaugaagccauggggaccauccaaaccaaggcauaaacugacuguaggucugcaucugcaauccuagcacauacgaggugaaggcaggaggcucugaggagaucaaggccaacuuccacuacauaaugaauucaagacaaaugucugacacaggagaucaugucucaaaaaacaaaaccaaacaaaaccaccaaaagcaaauaaucucucuaagugucauucccucuucugcagaugcuuccacgccuguccuguucccagucuuggcugccaagaucagaaccucacaggucaguccuacaguaacagccccacuccucacucuuucaacuacaacuuguuaaaugcaucuucuaaaugcaccaccaccccaucagaguccacuuagugucuuccuuuccaacacggacugaacccuacagaaaccucugcaaaaugcaaaccugauccucaguaagcucuggccaguggcucucagaaggaauggaugccucagugugaguuccaucucauuucugcagucuagccuuugaccacauaaugcuuuaggucagaguuccaaccacaucuaauugcuuagugccuagcacauccuuugcuucuggaaagaauacucaggcuucuucccacucccuuggcuagggcaacggucauucacuacccaaagauuccugaaggaaacucugauacccaaagacaguauuuaagugcuuccaguggcugugauggacagaccuuaucccaucacacuggacagcacuggagaacccacaguugauuuguuccugacccagaauaaauuuuauuuauuauucuucuagaccauuacaaaaaaauaccuaauaaauauuagcugcaaauauauguuaauuagaagcuaauuauaucaaccucaaaacugguuuguuugcaaauaugaaaacaacagcugcuauuuacaaucagucugagauuaaaaaaaaaaaagucuaccuguaaagaacuaucuagaaaugcucaccuagcguacagaaaacuaccuacagaguuacuaucaauaauauuugcgccauauaccuagaauguuuguucccccuagaaugucccugucuuaggacuuugacauuaggcuuggacuuauucagauauuuauguguaauaucuagaacagcagugaguaugcaguaggcaccuacuaauugccugcuaaauggauacagaauggaaacuaaaaguauuuccaguaacuucuguguuaaaauugagauacucugauuaaguuugauaguccaaagaaaacucuuguuacuaaaaaaagguaggacucaggguggaggugggggcugggagagguucuacucuuaucagauagagggugucagaacaaaggaccuuugacugacuaaggugauauggccaugugaugcaaaauccaccuucacauaacucaaacuucaucagcucuacaacccuaaauucggaaccacuucuaaugguucccaaguaaucuggagagcaaugguccauuugagaauuugauuaaccccuaacacugaaucuuccugagggguggggaaggguacaaccugauaaaacauagccucuagaacacacggugaaaauucuuuaacauaguuucauaaauuauagguuuaccuuuucuauucauucaacaaaaauuggucaauaccuuucucacauaagguccagcucuaaacuggaauugaaaaaggagagagacaaggacagcuguuuggucauuaaaagucauggugcagcacaugacuacacugagcaagaagucauaaaaaucacuuauaacaccaacuccuguuaagaaaacauagaucaguuaacuacaaagcaaagcaaagaagcaaaaaaacagcuaauuguuuucuugacguguacuuuucaagcuuugugaggaaaucucuuuguaaagcaugagggaaaugacguuaaaagagcuuucagaccucacuacuuugauuuuccuguguaguccaggaagaguuauuaucacaucccacauaguguuaugagcuagagauagauaugugaaacuuaugcauguauacagcagagacaccagagaaucacagagcaugaaaagacagaaagcacuucaaggaaauaaugaaagccagcugucuuuagugacauaggacgguuugaggguguggcuaagaugcuaucuaccaacucccccagaauacacuaucuccccuauuucucuguucugcaugccaugugcagcaaaucaguuuguauuuauauugauacauuaccuugggacaaguauuauagucuauuaucuuuguuccagucugucuguauucauagcacagaacaagaauucaaggaaaugaaaauacuuuuuaaauaaaacacauucccacuaaauucuuuagaaaaauuuaaaaggucauguuaagucagugcucaaaacaccugcuuuuuaaaaauugagcuaagaccuuaccuacucuugagcauuuacaaguaagagaacuggaggccagagucauucaagaacuucauugugaccacaguagcugacacagaacuagaagcccugagaguccccagguuaagacuaagaucacauuuauggcuuuacacauggccacuuuuaaaaauuaauuguaauagauguaagaucaauugugaauuaaauuauuaaaugaaacucuuguggauaagucaaauccuagggagacauguggaaggguucugcaugccaugugcaguuaugucuguguuaaguuaccauggcaucuuugacuggugguauuccagucaguaugggcuaugcucccugaucucuuacucaccaucaauccaacacgcaagccaaguccuucuguggcugcuucuaacuuucuaagaguacacuaaacaaccaagcguaaagaagcacuggggaguacacaggucaggacccagauuaguaaccgagacacaggcugaguggcuucaugcuuuguacuuuucuaauuaauuaucuuguuuuuacuuuacacucagugcauacaacuuccacugaaauuguucuaucuugagaagauggcauggaugggccucucuucaaccgcaacagcaggagcuguggcuugguggguauuugguugcacugacuauaaagcagaaguggcaaacucuuuccaucaaaugugaaguacuaaauauuuuaggcugugcagguaaggauuugucaacaccugaacuaugcugccuuuucucaaaaagaaaaaagaaaaaagcuacagagaacauaauaugaugagcaaaugccaaagucugagguucagagcaugugggagcauaugaggcacuauacugggguaugguuugcugacccuaauaucucccucaacggugcaugguccugcacaaugucugacaggaaggaggcccaacaagaugcuuacuagccaggguuuggaaggauagccaccucugagagagccaguucuucuugcaccuccacggaaccagccacuaucagccaguuacgcuccaacagucuuaacuguaagaugaagacuauaacagauaugagcauuaaauaagcaauguguacaugagagacuggugcccaguauuucauauagacaauguagacacuauuaaacuuuuaaaaagugagcaccauguccugcuuuugaaauauagagaacaggaagaaauaguaaauaaugagcaaaccauaauguauaauggcuuuguaguagauauuauuaagauauguuuuacaacacaaaguguauaucaaaaaaguacaacuucuucaagauaacuaaguaaauguuaugcuaagucugauuuaagauugugauauuuguccuuuauaaaagauugauacugccgggcgugguggugcacaccuuuaaucccagcacuugggaggcagaggagguaggagaauuucugaguuugaggccagccuggucuacagagugaguuccaggacagccagggcuacacagagaaacccugucucaaaaaaccaaaccaaacaaccaaacaaacaaagucacaaaagauugauacggucuuaaacaacugcuguaguagaacauuaaaggacaggcuacauguaaaucugcucuguauggggauguggcacaccacauguaagacaaccccgcacacuaugcuuccuuuaauauuuaauguuaacgaaaaauauauuucaaauauuuaagguuaaugaaaauuaauuuuccauguacacuuguuuaagagaauuaucuacagaaaauuuugacuuuauauuauuuuccuuugaccaaaguaaaauagucuuuuaggaacuccuguggcacagccuuaugucagaccuguguggauuggaaagacuauuaugaauuccauuacccauacaaaccacaaucauguaggccuuugagaucaagacuaccauuuuauuggaaguaacuuuaaaaugcaguuuuuaaggaggaccucacagagcagcuaucacaagaaugguguaaggugcagggugcgauggucugaauggacugaucaaagucuuucuucuagaagaggguagucuuuaagaacugucucuccuguacucaguaccaacaguccuucuuuacuggucuagagcuccuuuuaccuggaaacugagaaaagugaaaccugaaguuucuaguagagacaggauuucauuugcuaaauuuaaauagugucuacuucuaagggugccaaggauuaaauaaaugaagacaucaaaaggugcauugccacucacuauagaugguaaagaaagaacuagucaaggguagauacaauccauucucaggggaaagaaaacuuaccugaggauucacaaagggaaauaaucaaaucauauuuguauugcagaguucacuuuucgauaaagaugggagaauguuagccugaagcaaaaagcagggacauuugguaaagguuccugaaucacagcagagguaguaggcuagacugaagugucugucaggaggcaaugcucacaggacucgggcuugauuaacacuugguguguggacagcaugccaaguaccagaggcauuaagucuaugcuagcugcucuacucucuccuacugccacaccaucaucaugcuguggggucaggccaggaaaaggugagauccgcuacaaaggacccgucaaaguccagaauuaacucacuguucugagcaaccaagcucaaggcaacgcaacuuggucauguauuugaacccagucauuucuuaaagucuuggaacaaauuuauuauuguaaauuuuuuaaauuuuaaauuauuguaaauuauuguaaaguuggucaaaauuuauguucaucguacauaacugcaaaaugguaaaaguugaaaggcugagugucuggggaucucaaugugaacucuaguuuagaaucacacaacauggugaacucagucaucuaguuccuuuccuuuaaaacugaagucaaaggaggguaugugaacucacagaauacgacaggcaacuugcucaugcccaugaccguguagcuugcucaggcuaggaaaaaucgagaucacuacaagcgacacuuuaaagcagaaaaugcaguuccuuacugacagcaaccaagugcaaagcaauggcucugccagcccaaauuccagagucaaaacaacauacggcaguggguccuuccccaaagcuaaguuugacacaacccauaccaagcagaauaaaacuucccuuuugggccaccgaaaacuagaaguuaucacuacagccuaauuuaggcuaccaugaauacucuaguaagaaaagcauacaagccaucucaaauguguccaguuaggaaccguccucagcaagacgcaaacucuaagucccgagaucaggacaacaugcaacgagaccugcagauacaggguuuccugcagauacaggguuuccugcagauacaggguuuccugcagauacaggguuuccugcagauacaggguuucgccaauggcccugcagagagggagagguuuuaccuguuccccagaagaaaugaugggagagagaaacacacuugaagaauuuuguuucuuauagcucaaggaucaauacuauguagugauauuuucuauuuugagaguaucaaauguugugugugagcuugcuaaucucuuucuagcauacaagagagaauuaaagaauuaugguuaauaauuagaagcaaagggagcccuuuuucauuuuccauauacucaacuuuuacaacuggcuucugcaccaacaauaggaugggcaaggaaaaauaaugccuucaaagcaguagcuuaguagauacgcaugacucuacagcaccuacaaaugaggaagcauagaugucacguagcaggaaccaagcaaagacuauuuuuucaaaaccugugcuuugucugacuuuuauaccuaaguuucucuuugcgcuaauuauauucauggucauugagaaaaugagaaguuagucucaacaggaggggggcaguacuuuaaaagacucaauaaggagaaaaguagaagaccaaaaaguaugcuuggcuagguaugaucggcaggaagccuugaggguggaggcacaaugacggucuagaaggcgaaagggagaaaucagguuaaagccaacuucacccuacacugugcuuucucgucucacagauccugagcaagcacagccaacugcugagguugaaagggccucuccugcgagaagacagccgaggaggaugugaaucaacagaccauauccaguggcuuccugaccuauccugccuguuuguguuugagaacuguauagaaacacacacugcaucagcugauuacauguugcaacugcaguucugccucggcaggugacucuaaaaguuccaagauaaauaaaugaggcuuuguuuucuucuaucuaaaaugguaacaauauccuccuguaauagaauuuuuuauuuuuuucuccugauccaguaaugccaaaaugaaaggcuccugaccccuguuaaacucaacuacaaacugaguaaccucaaacuauuugcaguaguauaguacuucuuaugaauuuaauauauacgagacauuaggaaaggaaaaaguuguaaucaguauauaucuuccucaauauccaugacuuuacuagcuaauaaauauuccaugaagaaacagagagggccacaggcugaggcucugucuaagccauaggucaaagucuggcucuaccacuuauuuacuuccgagacgaccauaggugauuacaacauaaagagcaaacaguagauaaacacugaaaugcaagucagacucuuacauauauaucacauguaaucccaguagccuaacaggccaggcccaauacuuuccucacuuugcaaacaaauuaaggugcagaaagaacaagacaccuuagccaaggucagcagacgccuaagacaggacagcagacuaccagcauagucuucucaucuguuguaggcaacaacuauuggaagucauguguaccagcugaagaauggaagauaccuggagagagccuagaauagcaguugucacauacuauguagacaagaaaagaugcagguugugccagagacagaucacaccaccagaauuaaaacuauacaugcuccuaauccuccaucauauuuccaagccuugguacagcugaucuauuauaaggcugaucaaaguuuauguucauauuucacaacaugaaacaauaaaagcugagaaaggcugaggccaaacuuacugcuaucucucaauacaugcaguuuccuuucaguugacgggugcauaccugggaaucucagguaugaacucuaaugugcaaucacugaaugugggaaacccauucagucuuuuuucuggaaagucaaagcugggcauggggauucauguuuguaauacagcacuaagggagguugaggcaggagaaucacugccagucuagggucagccugagcuacucagugaguucuaggauagccugggcuagaaaacaaaacauagucggauuagguuucauaauuuguccuaaggccauaaaguucccaucaagugguugccaccucaccagcaaugauuuauaccuuuaacucaggugcauccucgcuauagaagccuacacagaauaaacuaaaccucugaccauaagugcaagagucuuuagauaauguguguaagaagagccggugcucauuuuguuuuuaugaaccacccaggugacuucaaauagaguucuaaacaaagauaaacaggauucucagcuuuuccaagacagcaaacuacuuuuaagaagcuuacuacaaauuuaggaaacuccaagaacuuggggucuacugcugucuccuccuccacuguuaaaaacaaaagcgauccaugcuccaauauaaccagaaaccugaaucugaacccugcugcauuuaugcagggcagagagaaagcuggggaagucaagucacaaagcuuuauggcucaagagcuaccaaaguacuuuuuuuuuaucaaacucauacacaaacacacgcacgggggggggggggggggauaguucuuuaucaggucuuccaaggggcuguguuauaugaauuuguaguguaauuuuuuucagggugccauaaaaaugucaaugacucuucugucauacagagcgccuccuaggguggucacaaggccucuaaaagacaaauuuggagagagcacgagaaggaggggccagggggaccccacuuaccgaaaacacugcauucugaagcccaaaagguaugggagucagccgggccagcgccaccaccuucaggccgcuuccucccuccacgacgcggauaacggcgcucagcuugucgcuguucuggauccuggcagccacccaggcggugaguagccgcuugcagaccacaugagcgauaaaggugccaaugaggacgcccaccaccaugagccccaugccuagcacgaagccguacagguagccggccgccacauuaagcacgauguagccccaaccgcaggggaaggagaccacgaugaagcccacgacgaagagcaggacaccgagcagcgagucgaggcucuccacccagagcaggaggugcugcagguagcggcggaccagggccagggaagcgaagcacagggcggccagcacgcacaccagcacgaggcuccggcaccaacaggugcugccgaggcagcagcagcgccaguuucucaccucggccaccccgaccaccacgccgccgccgcucccggggccgccugccaacgccccggccggcgccggcaaguccgaggccgcgggcagaccguggcgcuccagauaggcgccgagcagggcgcccgaggccgccgccgcagcagcagccgccgccgcgcuggccccgcccccgcggggaaggcgguccuccgagcgguccccucccgcuguccgcuccggugcccagcggcccggcugcuccacgacucccguccgaccggcgugcugcaaggcccggggcagcguguggggcaggcucccaccgggguuccgcaugccucggccucagccggccagugucuccacucccgccgcguccccccgccugcggccuuccauggcaccccgcacgccaggccucggcucccugcguccucucgcggggagggaacggccggagaagggcggcagcggcggucgagacgcggucccgccgggagucggucgagucug

SEQ ID NO: 1793 - RNA, 1577 nt, Mus musculus
aggggaacggguucgggaccagccgauacaaaaguuucccuaaaccaugagacuugcaguuaauccaccgaaugccuuucgaucggucgcguuuacuccuccaugaugaaaagccgugauccaugggaauuccgucacauaccaucagauuaauauuuuguacuuauauuauggcuucuguaaaugccuauuagaaguuuggcucugacccuccaaccccuugcuuucuuuuguccaaggaacgggugcauacuugaacaacaaaagcacaauuauaguguaaaugacuugggauaacaggguuugaaaugcccagggcacuacaaaagauuacaauuuuucagacuugagaaaauaauuguuuauuuauuuauuuuuguguauacgaauacacuguagcugucuucaaacacaccagaaucggaacccauuacggaugauucaccaugugguugcugggaauugaacucaggaccucugaaagagcagucaguguucuuaauccuuuggagccaccucuccagcccggcucgaaauuuaagaaaaaaaaaaaagucuauccuuauuaggaaaaaaaaaauccuuaaaacuaugcuucuugguuuguuuucuuggcggaaugauaaaacacucugauccugacgggacaauggaguaagguaauugacuggcgaaggaacuugcguccaagcccaaguuccauggcuaggacucacaagguagaagaggagagaaccaaccccagcaagcugucuucugaggucugcacaaaugccuuugaacacaaaauaauaaaucuauuuaaaaauuuuaaacacuuugaaaaaacaggauuaaguguucauuucagcucacagcuccaggucugucaugacgggaagucgagagagcaggagcuuggaaaugugcucacacuguguuggaagacaggcggcagccaugaauguagcugccagugaucaggccucuucuccaccuuguacaguccaggaucuccagccugggaaacagucguguccaaaacgaagaugggucuucccacaucaguuaacacaaucaagauaacggccaggccucaaaggccagucuguuauaucauucuuucaaguucacaguuaaaaacaauucgugcagcucugcugcuuaucagccugacacccaaccucauuauuuuuaggcaauaaccguccaccuuugccccaaaaggcucauaaccaugucauaacgugaaauguauucagucuaacuuugaaaguccccauugucuuuaaugacuauagcacuuuaaaauuccaaagacuugggucauaaacaaguuacauacuuccaacacauaaugguacagaauaagaaauccuauucaaaaauggaagacccaggauauaauacugaaugaaauggagacaugaccacuccuggguguaauugaggagaagguuuuuauugcagauaugagaaagagaacaacccagaggcaucuggaagaguccagacugaacauggccagcagaauagacaggaccaugaaaggagcugggguagagagagagggaggaagaaaagagggaggggcaaga

SEQ ID NO: 1794 - RNA, 16839 nt, Mus musculus
cauuuccuaugaaugaacacuguuacagaucucaaaauaaucacuuugagaaugggaaagggcacaaucugauuuuccacauuaaccuuuaauaauucugccaauacccaaacaguaaccgugccccaaaucauguuucauuaauagaaauuaacucaguguucacacaaggguaaguaguuccauccacaauuuauugaauuacaaaucagauucauuagcuguuaugauggcuaaacagaauaaaucucuaaaaaguaucuuaguggguucuuggaugucagcauuauugaaauauuaaauuaugagaaguuaaagauaucaaguaccuaucugucaaaaucucaacuuguaaaaauauuuuuaaugaccaucauauuugauaauaaauuagguuuauauaacugauaguuucaaaauaaauaaaaccugaguugcaaaugcuuccuccuauccuacucaaacauauuuauagcccauuuucauuuagagaguguacuucaaacgucagggacuacacgcauaacccuuggagaucugugcaagaggaguuaagucuaaaugccuaaugagcuacagaggaagcuuaugcucuugucccuuggaccaucucgagcaguaaggugacccaguaugaauuaaguaugauuucugucugaauaacuggcuuuauaaaugccaaguuagaaaagaauguucuaguuaaaugaaagcauaaauuauaccaaguuggcaguguuuggguuuaucugagagugacaccuuugacacacuugaauacaacuugggauaccaagcuuugcuaacuugaagagugacagcuggaggcucucccaguuaauucaagccaauacacugcaaaccacuguuaaaaaacucuuuaauaguaaaguguccauuuaaauuccuugugaacuuuaagcuaccccaucuccuccuccucuuugaacaaacaaaugcugcuuuuucuucugucuuguagccaaacagcgaguaacacccaaugccccucccuuuaagaaucgaacgaaauuaucuccaaccaaagggcccaaagcaaaaagauuggcuucuuuaacacauucauagguguaugcaucaaccuccacaggguuacccuugcauguuauuggcuggcuugaguuacggccuagguaacacccuuguuccuuuagaaaagauagguuaggaugagaaccuaucaagauuacagcugcagacagcuuaaauauuuucuucaauccagagacacuuugaagaaugcauuucaugucugccuuaaaggaaagcacacggugcucaggaaagcugguauaaucagacagaggaccugagucugcagaguaggacugacuacacaucauaugguagacuuugugguacucaggauacagcuuuuugggaagcuguuugaaaauuaagcuuggaucaguuacucgucugcgaaacacguggaucacagggauauuauuguuauaggcacagagcacugcaucagcggcaguaaggccggaaccuacaaucagcacuggguccacucugccacacagcuuuccuuuguuuauagcagcuccaaacucaggcaucgaaugaaacacaaacggaaacucuuccccuucaacuuccagaugggcaggagaauccaaaguuccaguugcaagagcuacauucucagcaaagaggcaaaagggaacaugagaaccaccugcuauucgcugauagccucugauuucccaguuucucuugauaaauuuugacuucugguucuguaaaugcuuuguggaaauaucucugucuugacuaccguuaucaccuuggucucuauagagucuugauacagagguuauguaaguauucucucgaaaauucuucugaaggcccaugaccuuuacguagugcuuguaguagcgagcuauuuccuccggcaugacacggucccccuuuaaguuccuguaauaugaaaaggaaaaauacccuaugagaaguacuucauuacuuuuucaucugguaggcuuuuauaucuuagguuuuuccacaauuguguuaguuaaaaauuauccucauguuuuauaaaaauuauuuuuaugcuuucuuauccuaaucagacuggcagucauuagcaaagcacauaacaaaugcuacuaaggauguggguaaaggggagcauugcuguaaagaauucaaacuggucuugucacaucgcagaucuguguggagaguccucaaaaccugaacaccagcucuucuaugauaccguuuuacuaugcauggguauuuacccaaagggucucaagucaacauaacacagacacuggcacagcaauacuuacuacagcacuacucaacagccaagcucuggaaccaaguucaguguccagggaaagaaaacacagcguagaaaaacacuggcucucccuccccagacaugaguaaagucaugcaacaggaaaauggaugugccagagagaaccauauuaagugaauuugaccaaucugaaaagaacaaauguuuucucucauuuauagcugcuagauuuuaaaugaguauaaguucauaaaaucauguaugaauguauaaaugagaagaaacaaaacucuuuaggggaucaaaaacaugugauuagggggcugcuugauaaauuuucaauuaauaaauggguuaaaauguagacauuugaaaaucagacaacuauuuucucuuacaacuaaugacuuaaaugacaucauuaacagauuacuauucaggggcuggacaugugacucaacaaucaacacuuaaggcacauaucauccuuaauccucugguuaacuuaaaaagaucuaugcuucuuuuuaguaaaaaaaaaaacaaaacaaaaaacaaaaaaaaaaaaacaaggaaaaccuuucccuuuaacaaauccaagaauaugcugaacuauuuugcuugcuuaccaaaugaacucaagcaaugugacggauugugcaacuuuaaucuuccaccucuucauguuucaagauuuagcuuuugguugcacuuacuuauuauacauguaugagucuuucuccugguggaucuauguguagcacacacaggucugaugcaaaugagcaucugagaaggguuuugcauucccugugacuggaauaauggguggucgugagccacccaccauguguggggaacugaaccuggguccucuguaaaagcagcaagugcacgguggugcuaguguacaccuuaauccuagcacucaggaggcagaggcaggcagagcucugugaguucaaggccagccugguguacagaguaaguuccaagucagcuaggacuacagagaaacucugucucaaaaacaaacaaaacaaaacaaaacaaaacaaaacaaaauauaagaaagaaagaaagaaagaaagaaagaaagaaagaaagaaagaaagaaagaaagaaagaaagaaagaaagaaagagaagggagagaagagaagagaagagaagagaagagaagagaagagaagagaagagaagagaagagaagagaagaaaagagaagaaaagagaagaaaagagaagaaaagagaagaaaagagaagagaaaaaaggaacgagaauaagaaagaguaagacagaaggaaggaagauuuggggcugaagaaauggcuuagcaguggaguacugaugcucagaguccagaagacucugcauuacaugacaguucacaacuguccauaacucuaguuccaggaggacacccucacaccgacauagguagauaaaacaccaaugcacauaaaauagaaauaaaugaaucgucagagcuccaccugccugccucuaucuccuaaaugcugggauuaacugugcacaccaccaggaugaucuagaucuaagacugauguucuuaaaucuuuuaaaauuaagggaaacuucuauggauuaagcaugguugcuaccuagcaugaugucaauuacacaaacuccaucucuauucuaacaaagauuaaguuccugcuuugacauacugccauuagugguaaaauuagauucucuguauuaguuauucaaaucugguuuguacaugaaccugaaaaugauagggauuuuuacauuucuccuuuugaacuuuauauaccuucccccaaaauaagaccuguauucuuccaaugagaaauuacucaguccuacuuaagguacuaauaauuaaauauugaccuucauguccaugguagcaagcccauguuuuaguuuaucauucuaagugacaaaucauaauaaguguauuauuacccuucaaaaauaaccacuguguuggguguggugguaugcaccuuuaauuccagcagauuuaauccuggcagaggcagacagaucucugugaguucaaggccagccugaucuucacagugaguucuagagcugccaaggcuauguaaagagucucugucaaaaaaaaaaaaaaaaaaaaaaaaagccaaaacuaaaccaacccaaaucaaacaaaaccaaacaaacaaacaaacaaacaaacaaucaaccaaccuucuuaggcauauauacacuuaguauacauaguauaaguaaauaaagucacaaccucauugaaaaacugacacauuugggaaauaaugcauagguagaugagaaaguaacuaauuuaauauuaaauauaaauccuguuuaauaaguuaauauaaacaggaaggcccuacaaacaguccuuuauguacacacagcuuuauagcauccuacauggaaacuagcucauaaucacugcuucacaugaguuuuauuuagcaaguguauuucuauuuguguaauacaggauucgcagauacugugaacauuucucaacagucccuuuuucauacguccaagaacuuuaauagagauagaucuuuaccuucguuugcuagauauccagucuuuaaauugaaguccaggaagcuccauccaauuuccaaagcugauugucaacauagaaccuuccauauucuaguuuaaaacaguugaaaaaagcacaaugaagcaguauuaccuuuugaaagcaagcacaucuuacuuauauacagauuuggauuauauaaaacauguucacaagaguccaagagaaacagugguauauaaacuauggauuuugguuucagguauaaagaauaacaaucacacaacaggaaaauagaugcacccagagguaauccuaccuacuaagugaguuaccccaucuucagaaauacaagcaucugccguucucucauuugcaguguauuuccucugaaauucuauacuaauaaaacuuucauguauuucaccgucugaaaugacuaacaguuauacauguuugagacaaaucacagcacuaguuuuggccucugaucuauaauuaagaucuacauguuaacgaacacaucagcauuuuuauuucuuaaagaaaagaaaaauguucacuaauuuccaaaauuuuggguuuuuuucaauaugguggcuuuuuugcuguuucgguuuuuuuuuuuuuuuccuuacagauuuuuuaaaaauuggaaaacagcuuuucucuaucaauuauaauucugaaaucuggacuaggcuaaauacaacauaaucacuuucuaaaaauagaaaauaagcagugguugccugagaaacagacucagcauugggguuaauguuaccgucaaggaaauaagccccucaagcuacuccugcuucccucaaaacagagagaagagcuaagugccagggccuacgucauccccagcaaucucagcagcgcucuagacaaggccccuguugucacagcuugcccuguucuacacagcccagcacugagaacggguacauuauaguaguuuucauucacucacugacaagacuuuucaggcagggucccaugcaucucugaguaagaaaugaguacauuuaccuaugccauuuuuuaacacguggugucauauaugccagucuugccuugaccaugugaucuauuaagcaugcugucacugggacagcaguauucagaaagggguagaugugacacaaguauuguccaaguguaugugaaaugguacuucuucaaagaugcaaguggguuuugaggagugugucauuaggaagggaaacuauuccaggcaaaauaaaaaccgaugugacagauuaauaucaaacaacaucaucaguuucauucaggaauucaaagaaacuaaacccuggguaagaaaugauguacucuguaagucugggcuacuccaagguugcacauuucuaaaaaugucaagucucccacagcuucuuagacuaucuccaagccuuuagaaucuuccacugaaucagauuguauuugcauccccaagccuuaggcaauacugugagucugcgaugaugauaguuuuauccuaaggaugugauauauggugaauaauaguguucuugagacacagaugcuuacucuuacacacacacacacaccacacaucacaacacuugcuuguauacacgcacauacacacaaucucugaagggauuggggcucuagucugguugacagcauacuugcuuagcaugcagagcuuugucccuagggccucaugaauuaggcauagugggacacaucugaaauuccaacaucugggagguaaagguaggaagagcagaaguuaaaagucguauuuguuacacuuggaguuuagggccagccuaggagauuaaaaauauaccuaucaaggcuagcugggucuacagagggaguuccagaacagccgggacuuuaaaaaacuaguguguguguguguguguguguguacuaagcauaaacaaguuucccugcuaggcagcucuacaagcagauuuucauauacuguucacugcuggaagauuucaucgcaucuucagcaaacagcaagguuugcagggcaagcgcagcagcacagggcgaacgguuacguguaggaaagaaaacugugugagugugaaugagaauggccccauaggcucauacacauccuuagucagcagugguuuuaacuauugggaaggauugggauauguggccuugggggagguacguagcugagaguaggcuggagguuuuaaagcccuugcugggccacugucacucacucucucucucucuuccugccuccugugcauggauguagaucucagcuuuuccucugcacucugccucccugaaugccaccacgcuccucaccaugauaauaauguaggaaaccgccgaaacuguaagcaagcccucaauuaaugcuuucuuuuauagaauugccuuggucaugugucucuuugcugcuacagacacuaaacagucauuaaaugaaguucaaacguagacuuuacaggcucugaaucagggagacaugucuuuuguucaaauuaaaccuuuuauuuacaauauuuuuuuucuuuaaaaucuuaaaaauacauggaaauacgggcuggagacauggcucagugguucagagcacagacucgucuagaggagcaggguuugauucccagcaccuccauggcagcucacaacaaucaguaauaccaguucagagcaucucaaguagcccucuucuaauugcuguaggcaccaagcauccacacagugcacugacauacaugcacacaacacuuauacacagggaaaagauacaaauacaucuauuaaauaaagagaaagaaaauacauggaaauaagauacugauuuucaaaauacccugcgagacuucucuaagcuuuaaauuauugaaauuuuauugacuaugaaaaguguucucuuuuuuuucuauacaauuuguauagguuaguauagauaugcuuauucaaagacuacaacauuaauaaaaaucugccuuaacuaccuauaguuaauguaugcuuaacaaaacacagaaauaaaauguucauguuggugcacaccuuuaguaccagcacuuaaggcaagguagauggaacucugaaaucaaggccagacuggucuacaaaaugaguuucuugcacagucaauauacagagaagcacugccuugaaaacuaaacaagcaaaaccccuugucaucgucccccccuccgcccuccccaaaaaaaaaguagaaucaagcuggaagcccacaugguagcauaugccuuuaaucucaaaccuaggaccagaggcagguggaacucugaguuugaggccagccugaucuauaaagugaaaucuaggacagcaaggguuauguagagaaguccuaucuugaaaacaaaacaaaacaaaaaucaaguugguuuuauuagagcaauauguaauaaaucccuuaauauacacuaaaaugcaaauauauacuuacaugccaugccccaccaggcgggcccuuaccaagaacuaagugagggauauaaugauguuguuccaauuuccagugcagaauggauggagacucauauccgaagucagcaucugggugaagaagggugucaaaaaggacugccacuggauuggacgaucgccccucaagacccucagacagguauucuaaguccugaagcaaaggaaaaauaaaugugaguuagaaaaaaaacaagacaacuagguugaugaaggacauggcaacucaguagcuucuaagagcuaguuagagaacauguauuuuccuugaguucauacauacuauauuccucagcaaaauaaauguaggcaaaguuuggaucuaaaaaaaaggcuuuuuguuuuuuaaauaaaaacccuuauagguguugaagaugccuuuggcauacaaaugucaacugggcuguaaaaaguagaacuucccaacuggauuucagcauagagcacacacuaagcccucccaguagggcugcauagacggcucagucagcagccugcuuuccucacaagcaugacgacccgagucucaucgcuagaaccacauuucaaaagccaugccuauaaucacagcaacguggaggggacaugggaggacuucuccagaucacuggcuaggcagccuagccgaggggagauuaaggccuaccuacgagaaaccucauuuaaaaaaccaucauggacaguuccugagaaacaacacucaaguuaacgugcagccuacacacaugcacacucauguucucauaucaacaugcacucaaagccauauaaaauuguuuaaagcuccacuaggaaacuagaaauuuuugcucaaaacuucaauauaguuuaauacgacaucacaauguauuuauaaaacuaaauacauuauuuaggaugaaggauuuacaacaaagaaauacauaaauaaaguuaaucguuucagcauuaaaauguuuuauaaaacauguaacaaagaauaccugauccacaauggacagaugucuugcuucuucuaguuuacuauguaagauuguauuuggauguauugcuuccgaugauaaauacggucuguagccugacagcauauaugaaaggcauauuccugaagguccauuuccuauuuuuuuaaaaaagcaaagugauguaaguugguguucuuauuggcuggcuuccccuuucugcuccuccucccaucaacuaaaaccuagcacucauagcugaccucugccuucuaagcuuccacucuaugcuacugacuuccaaacuagcugucuagggugaccugaucuugagaaauacauauuuucauaagcuacuucuuuauuauaauugauguggaaucaaaaauuagccaauagaaggauagacagcucaacagguaaauacacuugccaccguucuuagcaaucugaguaaaaucucugcaacugacacuggaaggagaagcaaguuuacaaaguguccucugaccuccacacauguacuguggcauacacauacacacaccuacacauuaaaucaguaagcaaacaaaauaaauguguaaaaaagaaccuuaaagauauuuuaaaaccaauucauacgguuauauccacaaaugcaaggaaaaccauuugacaaaacccagcauaaaucaagcauccacccaugauuuaaaaacauacagaaguagaaagaggaaaacuucaacaugaugaagaacauguuuaaaaaacaacaaaaaccuaauaacaguccuacucaucaccaugaugggcggccugaaggcaugaaauagaaagugcacaacuggagaaaggaggggaaaucacuguuugccagugaugugauuauccaucgaguaaaucccaagaacugaccccucaagagcucagagccacaguuauggcaauacgcaaaagccugcuacuuucuuagagcagcaaugaagaaagugaaauuugaaaugaaaaccacacuaucacuuacauuuaugucaaagaacuauuuuaucauaauuuuaacaaaauguguaugaguuacaugaagaagagcaauucugacuacagaaauaaauguuaaaaagcccacagauaggaagacacuccaucuucauaggaagaugaaagauuauugcuaguuguucuuaaccugauuuguaaacuuaaugcaauuccaaaaaacaauucaagaaaggcaauuagaaaggcaaauagccaccacaaugcagucuuaagacaggucuugccugucuuccucaagcuugaguauuagauggaaaauauaaauggcagguaguuaaauaaaucuaauuauccacaguuuuaaaaaucucaauuguugaauuuuaguagcuuuacauccuaucuguugaggugauacaaacgauacaagugguuauuauaauuuagggaauuauaaaucuuacugcaaaacacuauaaugucaaauggcucaaguuacuaacuuacaguugucauuuaguuuuaagucuuucuacacgggccuaaucaauacaacagagcuauaggguucaaaaacaauaauaauauacacagagugaccugcacagaacucuaauaauacuggucaucuuaauaucuaucauuaguaauucagggaaaagcuauuacaucccaaauugacucuguaaucauauaagccaaucuuucuccaaagaccugaaugguuacuuuacauaucuaacaccuuaaaacuucauuauaauucuguccuuuauuaccugccuccauucacagaagcaucuccuuuuauuuuuguccuuuuaagauacuuauuaauuagcacauaguaguuguacauauuugugaggcaaaguguggcauuuuaaugcacauauacaauaaugauaagaucaagguaacauauacaucaccuuagauacauaccaaucguuugagcugggaacauucaaacuauuuuaauaaguggagccuuuucaauagaauggaagaaccuuaggauuacagaagcaauaagagcaguaacuagcuuuaagaaucaaaauacaggggcuggagaguuugcucagugguuaagaguacuaacugcucuuccaaagguccugaguucaaaucccagcaaccacaugguggcucacaaccaccuguaaugagaucagaugcccucuucuggugugucugaaaacagcuauagcauacuuauaauaaauaaguaaaucuuuaaaaagaaaaaagaaaaagaaacaaaauauaauaacuuaccaauuauuaccauaggcaaagucacugaugaaucuucaaguaaagacguuucuucaacuaauggcaucccuuuaacuuuuggccccaaauugucaccaaaauauugcacaaaagaauuaaaaaucucuccuucaguuucagugucacuauaguuucuuuaaaaaaaaaaaaguuaauauagguuuuauaaaauccaauucauucuuauauuguauguaggcaauaaaauauccauaaguugcauaaugcuuucgauuguauaucauguaaguccacaagucugaaguagcuauuuaucuuauauuaauaucuuaaaagcacauuaacuacugaguaagcuuuuuaccgggcuagggaaguagcucaguugguagaguaccugccugcaucaggaccugaguucagucaccagaaaccacacaaauagacugaucacuauguccacucccuggggcucaauagccagccaguccagucugcuuagcaagcuuaaggucaguaagagaaaccuugucucgggggaaaaaaaaaaaaagagugauuucaucuagaaaauauagguggauaguuucuaagugcauugagcguccgugcgcacacgcacaccaacacauagcuucuucaaagacaauuacagaugagauuuuguaauucuuuugggaugccugagaagaacuuguuuccucucuacuuuuuuuuuccucagccaggagcugaugaugcacaucuuuaaucccagcagucaggaggcagagacagguggaucucugaguuugaagugagccugguguaccacagagugaguucuaggacagccugggcuacacagagaaacuguguucaggaaaaaaaaaauuuacacagagaucuagucauauauagugucagauauuuuaaggacacagagagcacaaacacuggucuuuuuggauaaaagaaauaagaccuuaauguugacuucuaauccuuauuuaccaacugcaucucuagaaacuaguuucaguaucccgucauucagucaaaagcuguaguagccucugaacucaaugcuguuguuuuuagauuacuucaaaacagaauccucaaauuaccuuucaucucucaucaacaauuucaaugucuggaaggguuaauaccauacauauuagcuguguuuauuagggcuuucuaaaugacagauguuauuucacaggacuaaggcgaaauuguuuaucccagagggcugauaaauggaaccuugagagagaggcuccaaccugccuuugauagcucauuucuauugucaaugugacuuagucucaggaauuuucuagaucagauuauuugaagcaugaaaacguaucuuaauugugggccacaccuucuacuagaaggccugauaaaagaacaugaaaggaaauuugcuuucuagucuguuugucuucauuuugcuggcaaguuccuguacuauccuguugccgaaacauuccuucacugaucuuagaaccagcuucuuccggcuggagagauggcucagcgguuaagagcacugacugcucuuccaaaggucccaaguucaaaucccagaaaccacaugauggcucacaaucauccauaaugagaucagaugcccucuucuggggugucugaagacagcuacaguguacuuucauauaauaaauaaaugaaucuuuaaaaauaaaauaaaaugaaauaaaagaaccagccccuucaggguguucaccauagacagcagcagcagcucuccagaaucuuucaggaauccagucccagccugggagugcugagauauccagcuccauagucuauggacuaaacaacuaucagauucgccacuuauccagccugaagcagccuuuguugaacuaccuggaccauguaagccaaucuacuacauuccuuuaauaaccauuccaucaguucuguucauuuagagaacuuaauacacuaccccagcuaguacaaaguuacacuaaguaccaaauacacuacccaggauaguacaaaguuacauugaccauacaauacacuacccaggauaguacaacacuacacuaucuaaugcucuacccuaggacaguacaaaguuacauuaaguauacaauacacuaccacagaauaguacaaaguuguuaagagacaccaaccuuuccuagcucuuaaaacaaaacaaaaccaaaaaucugccuuaauagcaacuaguacuauuagauuucuauuuguuuuguuuugcuuuguuuuuaagauggaauauuuuauuuaaagcccaucagugaaauggacagcuuguaucuaugacaaauuauucauguuuaaagucaguaacuguaugcccagacuacaacguucugaguugaagcagaauaaacuuccuuguaaaaguugcaccuuugugaaauuuaauuuaguauucagcuucuuccucacccucucuccucaacagaauccacaccaauuuccucauaauccuucucuagggcagccauauccccaugggccucugagaacucccccuccuccaugcccucaccaacauaacacuacaugaaggcaugcucugcauucgcaagaucaaacuugugaucuaggcaagcccaggccucagcaaugguugugguguugcuaagcauacacacagcucuguuggccagauacacugugggaggcugguaacuaaugccaaucuuaaaagugaguggggcacaaguccacaaacuggaugguacacuuggucuuaaugguaauggcagcacugacaucuuugggagccacaucucugccguacaguaggccauguauuuacgacgccaacggaucacuaucuaguuggcugacuaaaagcagacauuggucaucucugcuauaaaguuccucguaguaggcuuucuaagcaaaaauggcaggagcauaguggccagaggacguagauucuaggacagggcacaagauuggucugggauucugucaggucaacauucaaggucccaucaaaucugagggaagcagugacagaagacagucugaccuaucauccuauuuaaguuaguguaaauuggguguucaauguugagauuucuauaacagaugucacagauggccccauuaucuaccacgaagguacaaucagagugcuccauccagggugguauggauggugaggauggaauuguagggcucaacuacagcaguggaaacuuugggggguugaguaauguagaacuccagcuucaacuucuuuucauaaccaauagagagccacuccaucagcagggagaugaauucacagccugauccccugccaaagccauggaaaaaggagaaacccugaagcucuguacacuggucagccaguuugagaguccugucaagacaagguuaaugauauccuugccaaugguguaguugccaggggcacaguuauaggcagcaucuuccuugccugugaugagcugagcugcucaggguagaaaagcuggcaguagguaccagugcgcaauucaucaauagcuaugcauuccaggucuacgaucacugcccagggcacaugcuugcuagugccugucucacugaaggagauccucaaagagucaucucuuccccaaugaucaugucacuuggcauguggccaucagguuagaugccauuuuccuagcaguagagcugccaguaggcauuucccaucuggacaucagccuggccaacauuuauggagaugcacucacacauggaugcuacuugaggcugcugaaugaaugggggaagacaaggaagcaguacuucuuauagcuugacucuuaaaaggucucuaaugauacauuuaacuauaauaauguagcaaacacgguuucuucucucccaacacuaaacuguagcaaacacuuuucacucccuccccuaaauuucucugcacagagauaagaggauggaugguauuuaccacauagccucagaguaagaauuccaagcucuccccuuaccgcucaacaguaccccaaaggugucaggagacuuucagaggguuauuuucuaaaagaaauguagcuccccaagaggcuucaaauuuucacuccagccugcuuuuuacaauacucaaaguggacgauguguacauacacaacaaucugucuagaacauagaauccagcagucuuuggcauaaaacuuuucuagaucuagaauuuaaagucuccuuacaaacucaggagguugggcagaccuaggucguugcuauuacagcaggagucugauuucucugcaccucacauucuuuuuuaaccucuucugugaagguuauuaaauacacacgacauuuaucuauaucacauaaaauaagcucugugauuuguauugaugacagucacaaauacugugacuuguggcucacauuaguaaagaaagcaauguuaguauuuuuagaaaugauauuaauauccuuuccacccaaguuaauguuucaccuaaauucuaugagccucuauuaaacaagucuuuaucaguuuauucuguaacauucacacauguaaagccaguucccagaguccuuacuaaacguaacauuucaucccauccaguuucuuguacuuuugaucuuauucuguaauuccccgaaguguuggucaauuguucugaaucuagaacauacguucauucaucuuugaaacuauuguuuuucucaccguaagaaacuuucaucauaauuugaguauaaaacugccacuuccuaaauuucuccauucuaacauggcuuuacaucacucauaccuuaguaagucacgacccacugucacuacaugacacauucuucuccacuucccuucaagccaguaacuuauguuauuagauuuuuaaaagaucaaaaauucaaaggaggcucuucacagauuuucaaauuuaccauuuacauguaaccgacucaccgccggccuagccacucucgccguccugugacccgcgcgguccaggaacaagaagaggggacaagaaaagagcgggguccacggagcuccgagcagcgccggcccagcgggcggcggccgaggagcacacgcugcagagccagcuccgacccaucccggggggaaagucaccugaaaugaccggccagggagcagcggcagcaccacacaggcauggagagcggcugccguccuccgggagggccgaccgcgggcuggucccggcgcgcgcucugccugcaccgcggcucacaggcgcgggagucuguccccggccagcggcuuccgcuccuccccgccggcggcagggcggcgcagcgagugaugagcgccgc

SEQ ID NO: 1795 - RNA, 971 nt, Mus musculus
ugacagagacucuuuacauagccuuggcagcucuagaacucacugugaagaucaggcuggccuugaacucacagagaucugucugccucugccaggauuaaaucugcuggaauuaaaggugcauaccaccacacccaacacagugguuauuuuugaaggguaauaauacacuuauuaugauuugucacuuagaaugauaaacuaaaacaugggcuugcuaccauggacaugaaggucaauauuuaauuauuaguaccuuaaguaggacugaguaauuucucauuggaagaauacaggucuuauuuugggggaagguauauaaaguucaaaaggagaaauguaaaaaucccuaucauuuucagguucauguacaaaccagauuugaauaacuaauacagagaaucuaauuuuaccacuaauggcaguaugucaaagcaggaacuuaaucuuuguuagaauagagauggaguuuguguaauugacaucaugcuagguagcaaccaugcuuaauccauagaaguuucccuuaauuuuaaaagauuuaagaacaucagucuuagaucuagaucauccugguggugugcacaguuaaucccagcauuuaggagauagaggcaggcagguggagcucugacgauucauuuauuucuauuuuaugugcauugguguuuuaucuaccuaugucggugugaggguguccuccuggaacuagaguuauggacaguugugaacugucauguaaugcagagucuucuggacucugagcaucaguacuccacugcuaagccauuucuucagccccaaaucuuccuuccuucugucuuacucuuucuuauucucguuccuuuuuucucuucucuuuucuucucuuuucuucucuuuucuucucuuuucuucucuuuucuucucuucucuucucuucucuucucuucucuucucuucucuucucuucucuucucuucucuucucuc

SEQ ID NO: 1796 - RNA, 40917 nt, Mus musculus
aagccagggguaggaggcaggggcugaggaguuggugaagguaggagcccgcccagggagggccggcggagggaggagcccgccgaguccaggaggagggaggaggacgguccaccccggcgcggccgcagacccgacgggcucccuggcacagcugaccgggccggaacugcagcggccacgcgggaaugggccgccccgggaccuagcgccgcggccagggucgggcggagccgccgcgcagccggagccaugaacggggacgccaucugcagcgcgcuaccccccaucccguaccacaagcucgccgaccugcacuaccucagccggggcgccucuggcacggucucgucggcacgacacgcagacuggcgcgugcggguggcagugaagcaccuacacauccacacgccgcugcucgacagguagggcgccggcgcggggccccacacagacgcgggcugggugguccacagaccggccgcacuauggcgaugcgccggcuccgccgcggcgaguccuuaaguccuugggcuaaccugauccaagggagaaaccauccuggacgugcgucagacuuugcaacucgcccugccucuccucccacccgagguguucccacucuccaaaaaccugcaaucacggccaccucuaaaacccuguuuauugaacccgacguguguugguacagugcuugugggcuuugcuuuguuuuagcuagcuguuagcgguaagagcuguggaacucuaaaaacugcucuuggaaaugaaguacgcagugacugcaaaauacacaccggaguuugagcauuuagcacuaaaaagaaaaauaauaauacuauaccgguguuuuuauauugauuaaacgucaaaauauuuuucuaggguuuuauguguguuucacuccugcuccugagccugcauauuauggcuugguuugguuugauuugguugguuuuguuuucuuugugguuuauuacgugcccucaugaaguucaguuaucaaauucuacauuaccaguuguuauucgagcucuugccuuggaaguccccaaaggaagugugcaauguuuuuuguaacaguaaaaugaaucaaaagcuauuaaauggucaaaauuugugaagaauaaaaguuuugaccaucccuugcccugguauuauuuguguccagcucccacauauucagaagaaagaaaaaaaaaaagcguugguuucuguuucuaggaaaacauuacaacuaaauaccauagaucuguggcuguauguguuagucaauggaucuagucagaacucuuguguguuucacuuccaucagaaauugaacuagaccuucauucaguucuuagugcacuugcuaaccuugguggcuacaggccucuucuccugcuggaucuagugugaaaauacagagaucauagcggcccuauuggucagaggcuguuaacccuggguaucaggucagauacagcaucagauaacuaacucucuugcuucagcccugguagaauguuggacuuucaucugccuggaggcgcccucccucccuccaagggcuagaucacaguguauguggagccagugcuguguguguguguguguguguguguguguguguguguguguguucacguguucgagcacgugcgccuaaguagucaacuuuaaagggagguugguuaguaccaagcaaacgaauggucuauggaaauguagcacuaauagaccacuagguagacuaaagcuaguugcuuucucacuuuugauucugcuuuucaaagcuucguuugugccauuuguaggccaagggaaaaagauggacaggaugguauugcuuucccauauucaccaaccacuuaugguauaauuuccuugcauuggauagggcauugucuuuauaaaaccagcacaauccccuaccuuacugcauugcauucuuuuaucuugcugucuaagaucuuaccaugagcacaggccuaggcuuaugcaacugacucugagggugucuuacuuccucaccuguuaaauaugaauaauaaacacuguauguauauuuguugugcucugguguggauaauguacccauuguucuuuaagauuaccugaaaagaaaauaagucuaggugacguugcauauuauuuuaauaauuagugagucacucuccauugccagugagugggacuuccauagcagucuuccagccuuaauggacugaugacucugauugguuguucaaguacccuagagauggagagcuguuuccuauugacauuuugaguuaggccauuuucaugauacaauuauugaagcuguauuuugcauuuuaaguuucuaaaaaucuuuugcuuuuguuuucccccucaaucuuguugaauucuaaccucacaaacuaucugauuugcuuuucucaucaaacaauagaauagaaaagcacagauguuagaguaccagggcuacaauuuaaaucugacuuaaacccugucacuuuguauuguugucaccaaaggaucauucauuuuuuucugacuguagaugcuccaauauguaaaccagagagaaugaaacaagcuuuagagaguugauucaaggguuggacuguauauaaaauggcuggcagggaggaggaauacaucauaccuuucuauguuuguauguacaugcauguguuuguauuagcauacacacauaggagauccaugugcugcugacccacaugcaugauggguaggccagaggucaacuucagguauuguuccucaggaccauuaagagagagagagagagagagagagagagagagagagagagagagagagagagagagaggagaagagaguaucuuuaauguuuuggaguguguauuguugccagcuuuuuuauaucuauucuuaggaauuaaacucauauucuccugcuuguaugacaaucacuuuacuaauguauucucugcuaauacuuuauuucauacuuuggacagaaggagggaaggcuaucuuauauguaugugucacuggaacuuccacacuguguccucucaucucaaguguccagggaucuuuggguucauccuguaagguacuacacaggaacugucuuguugacccauaucucuuggggcaaauacagagcuugagaaauugaaguuuaauuaaauaggcuucacagacugauauaacugguuuccuuucagucaagguaaggaacagagaauagagaaacuuugcuuuauggugucuugugccucuugaauuuaaaagcauaaaauauuuugccuacucaaagacuucauaacuucuuacuaugguugggugugcguccgugugucucucugcucgugugcuuuaaguagucuggucaggaaugucugucuguaugcuuauuucaacagccacucguccagagcucagguuucuuaagaaccaacuaaucauccuugcuuacccaauagacuucuccuggaagccuuucuauuuaugucagcgcugccaacacccaugcaucuggggaaaugaugauggcgucagaucagcucucccccauugcuuuuguucacuugagucccuuguagccagugcauccugacgucuaccacucuuuucagccaguguuuucuugucuuuccacuacuuuaucaggcuucccuugcuuuguaucuggacuauuguuacagucuucauaguuguuccccuuucucuuaaucccauauccuguuuccaagauaauuaucuuuaaaccuccuuuuacugauuucuuuucucuugcucaaaaccuuccauugcacuugacugucagacaaaguuuugggccucuuaggaucccaacacgucauuuaugccacccccucugucgugcacucuuuccuaucuuagcucucauuaaacagucacagucuuacuuucacuuccugaauucauuugacacauggcugguggacaugcacuguguugcugcauauaaggcauuguuuauguccugggaauggauacacucaugggcaaaagagaagcaaggucuuaucuuuugugcaguuacuuucuggaucuucucucugauguugaaauucuagccauacuucaaauuccacugaaagucugucucuuugaagacgguggugacauuaccaugcucaaaauucucucuccucugaaugucccauaguuugcuuuucuuauuuccuguguguguguuuguguguguguguguguguguguguguguguguguguaaguauacauauguaaaauauacgguaauuaucacauuauuccuuguaguauuuauuuauuuauuuauuuuucuuaucugaauuaugggccuuuaaaggcaaagaugccauuuuaucuuuguuaugcuguaaaaugcuguccauagcucuauuugauagucuuuuauucaugaccaugugauaugccagggguugggcugugagugcuuaccuguuugcuauuauuuuaccaaguuugguguguaaguucuacauauuccugacuuugauguagcuuaucaugaugcagaucauaaucuaaggcagggguucucaaucucugggucaugaccccuuuaaaggggagggggucaagugucaccuaagauggguuggaaaacagauacuuauauuaccauucauuacaguaacaacauuacuguaacaaaauagcaacgaaaguaauuuuauggucgggggccaccacaacaugaggaacuguauuaaagcauuaggaagguugaaaaccacugaucuaagcaaucacaucuacaguauuagaauguuuuagaauucauguuuggaaaacuuuuauaugguauuuaaugauguuucuuuuaguauaaaauaaucucaauaguugaauuaguucaagcauaagucauucuaacauagguggauuuuuggagcuuccucuagugcuguuccugcucuuuccuagaaaaagcacaauaagaacccguaugcuacacuuuuaccguuaguggaaaguauagucacagccauguguagcucucuucccaccaguggcuuagagaaguuauuuuggcugaucucuaaacagaccaguagaauacauagcguggauggucaaacuaagagacacagaaguuagcaacucacauaaagcuacguagcuaauuaguguaaaagaaaauccaagcuuaauuuaucuguugucacagucuuuguauauuuuucauuaucugaaauaauuaucuuuuuuuuucucuuagugaaagaaaugauaucuuacgagaagccgaaauauuacauaaagcaagauuuaguuacauucuuccaauuuugggaauuugcaaugagccugaauuuuugggcauaguuacugaauacaugccaaauggaucauuaaaugagcuucuacacagaguaaguacugcuugcuuucagugacuuucaccacuauagucuguucaaaguaaauauacuauuuguguucuucauucagucacaucacuuugcaguguauaaaugaaucauacuagguaggcacgggaaguaaaagaaauucacaguauauaaucuauuuuuaagccauauuuuauauuaguggugacuuaggauccaaguuaaguauuagcaguuaaugaaccagguaaauugucuccagugacaugauacauguuauuuuucuaucuauagcaguuugagacauuacugacuuauuucuggagguaugaguuauucugacuuuuauuugugaauccuaucaacaagcacacuugagaauccucauucucaaaauacaugaauucuauguuuauuuuugcuugaucuuacacacugauuuuuuuuccagucugcauuuucuuucagacaucuuuuuaggccagaugcugcugcauuuuaugaggauuugagcuaauuagaauugcauaacaccugugaauaccuauggcacucccauguuauacuauaucacagugcuuucuacacaggcaagggaaggugggcaccacugucagccacucauggagugacuuccucuuuguuucagaauacaucgcauucuauucaugacuugugaccaucugaaacaaagacggacuaaaguaacuggugucagucuguaagguuuguguaccugccccagaaaucaacuuacaaagauuccauaaaucaaguuuuuuguuuguuuguuuguuuguuugagaagugaaguuuaagcagaaauucuaauguuuucuuuccacaucccuguauauacucugccacccagacagauuuggagcccauuggaaauucuguagccuucucuagggguauugcuaacucuuagaugugaccauaaaacacagauugucacuguacccuugacugcaugaggaaaagccuccuuauggcacugucaugcagaggcuccguuguuauuaaacuucauaauguuuugaaaaaguugccucuguacagaccaacaaaagauuugcuuacugcaaaguauugagcuuauguguccccaaggaggcaauucucuacauugguauuucguguuccuuuugguuccuuagucuauuacccuaaauuauacacugguuacucacaguggaauuuaucuugaagcacucaucccuaacaucauaaaagaucauuaagccgcacaguggugaugcaugccuuuaaucccagcacuugggaggcagaggcagguggauuucugaguucgagaccagccuggucuacagagugaguuccaggauagccagggcuacacagagaaacccugucuuaaaaaaaaaaaaagaaagaaagaaagaaagaaagaaagaaagaaagaaagaaagaaagaaagaaagaaaaagaaaaaaaaucauugaaugaaugaaaauggaaauaugcuauaaaaacagccuaaaauauucucaaacaucucccuaccaacuggucacugaaauguaagcauauuuguuuucagagucagaggcaguuuuagcacuuccaaaaaagugacuuuuacugaguguuuuaaaaaaugaaucugugguucuagugccugguugcuaccaccuuuuccaaagugcuggauccuucugagggaacacauucuccugggaaacugccuuaacuuaaucuauucagaaacaauuauuuuaaagaaacucaggaagauaaagguuuagaaacaaaaguggucuuugauuucacaaagagaaacuucucaaaaguuaauguuucaagagguaaggucaauacguuguauaaagagaaguaugagcuucugaugaguggagugacucagaaggugcagacacccgccaccaacaagacaaccuugaccugaggcugagcccaaagccuguguaaagguggaagcaaaggacucacugcagaggguugcccucugaccccacacucacacucuggcacacauaccccuucacacgcgcgcacacacacacacacacacacacacacacacaacuguaguaacaaauuaauuuuuucagauaugacauauugacacuucaaauaaauguaauaauuuuuaauugauauagagauuauagugacaauuauaguuuuaaauuaguauaaaaaaguuaaaauuuugaaugaaugguuuggcaugucagaagcaaguauauauacauauauguguauguauauauauguauauguguguguauauauauauauauauacauauacauauauauauucucuaugugcaugugcuuauggguauaagugauuacaugaagccauggaacugaacaguggaugggaugggacuauaaauacaugugucuggcuguauaaacauacaaauaacugagagcuauuucugcuaaagaacaagaugguaaucucaugcaauugcauggccaauauaaaaagagaaauaccacugcugaaguuaucauaaacaagucuaaaaccuaaaauauaagacaauuaaacagaauggaggaguuagaggaaggacccaaggagcugaagggguuuucaaccucauaggaagaguaacaauaucaaccaaccagauccccaguguucccagggacuaaacgacgaaccaaagagugcacaugcacauggagggacccaugacuucagccauauaugugacagaggauggucuugucagacaucaaugggaggaaaggcccuugguccugugaaggcuccaugcccucauguaggggaaugugaggugggaguggguggguggguggguuggggaacacccuuauagaagcaggggaaggggggaugggauaggaggguugagaaggcgaaaccaggaaaggcgauaacauuugaaauguaaauaaagaaaacauccaauaaaaaaaaaaagaaaaaagggggaagaauauuaaacaguaucaacugauacuaugcuauagaauugaguguguguuucaucuuaguuuguaaucuguuuccugguggauuucuuaauuuuuaacuguuaaacuaagguaguacuuuuuauuucuuucacccauacaaagaaaacugaauauccugauauugcauggccauugagauuccgcauccugcaugaaauugcucuugguguaaauuaucugcacaauaugaaccccccucugcuucaucaugaccuaaagacucagaauaucuuguuggauaaugaauuucauguuaagguaacuauuuggggguagggggguagggacaguuucucugggucuuuuucuuaauaauucugaaaaagcuuuguaguaguaucuuaauuucugucuuuaguaccaccucccuguggcuugcgguaggaaaccugacuggguaugugaaggaaugaagcagucugggcuguaaagguccaggaggaggaagcucuaguuccuaguguuuguacaaacugccaacuuugcagugggaccagggguuuugccuuccuauggcucugaggcauuggggguucuugacauguucacggcucuuugucagcaagucauucauucacucaggugguccucagcucucuauacuucagccccuuucuugaguucaguuauuauuguugguuuguuuuggacccgggggaaucguggaaugagguuggggauaggguggggguaggcugcgugucccagcacaaauaguucugugagcuuuccacguuugcacuaccagaggaggucauguagcccuguagccagguuaaacuuccucuucccuuauaacaccaucucuagcugacccgggaauuccucccuaugcaaaugaggcauccccagugcccuggcccuggcccuggcccuggccaaugauguacccucaccccauagccccaaaucacccucucaagguuuacauagccuuuguuuccccauuaaacaagcugucucacuggucucacugccaucugaggccucucagccaccagccauucucaucccacucccccacucugaucugcaguuuguaugagacggggccucacugugcaucccugguuggcauggaacucacaggaaucuccuaccucugccuuccaaguacugggauuaaagguguguacuaccaccaccaucaccacaccugcuuauucuuuuuucuuuuuuuuaaauuuuuuuugauuggauauuuucuuuauuuguauuucaacuguuauccccuuuccugguccuccccagaacccucuaucccauccccccuccacuugcuucuaugaggguauuccuuuacccacccacccacucccaucucucuacccuggcauuccccuacacugagcauugagucucaguuauucuuaagcuucagagagagaauuugguacaaaauagcaauucgcuguguuaguuaaaauugucaaaaauguuuuuaccuuuuuuucuuuucuguuuuaaaauuaguguagagucauaggauguuguuauacaacauggucccauguacccacuacccaguuucccugcauaacuagaauacagcuuccagacuagaaauuggacagggauuggagauuuugaaccuucuggugugcuuccgugucacccauguagccuuuuccaugaaaagcuucuucaugagcccauuuccuaacuguuucauuuuuaaccacucaguuuuaagaacccuguauauauuuugaauaugaguccuucauucaucagauaauaauuuucaaauauuucuuucaaauacuucuccacagcuuguauuguuauaugugcguuuguguguacugaaucauggagugugugugagugugugugugugugugugugugugugugugugugugagagagagagagagagagagagagagagagagagagagagagagaucauuggcuauucuggauggcuagugacaggauccuccugucuccaguuccccacugcuuagauugcagguguacccugccacaccuggauuuuuuaugugggcucugagacauuagacauguuugcccggcaguacuuuuccacugagccauuuccuaggccuauuuuuauccuuuaucaaagccuauagccaagaaagaccugaacauuuauccaguuuaucacucucuucccuuaugcaccaugcuucugcugucccuuuuaagggcuguucuuuaaacucuagguuuuccucuaugauagguuucuuacuauuuugcuuuuauacugaaaucucauguuuguuuugaaccuguuuuuguauaaagggcaagguguacuguaacccugaauaaaguaggggaacggaaauaaggaguaauuucugagucguuaauacguaaugcaacucaguauucuuaugccuauuucuaaagcagaaaaaugaccuuaaauauuaaaaauauucaaagauuacaaccaaaauaaagcuguaaaaggcauacuaaaaaaaaaaauguuuaccauuggucaauuccuuagcugugcauucuugggagcacacacauaugugauauguagccauccaaagggacccuuaguagugagcauaaagcauuuaauggugacuuuaguauuacaagauuuuacuuguuuuaacauuuaacaacaccacuuuuagaacaagaauaauaccauaagaaccugagcugucaaacugucucaacuacacaaguguuugcuguuacggcucaugacagaaguuccauccccagaaaccuuauaauggaaagagagaacagacuccugagcugucuccugccuuccauggccacacauauacacaucauacacaaaugaauaaauuuaauaaaaagacuuacugaggaccacguagaccucauuuguaagccaugcgcauggcguauggggaggacgagucaaugguagggcguugaaaagccucccuuuaagcuucuugccauaaaaaccaauauugaguauauaugcuuagacacccgcugaaaccaauaguuccccugaauauguguaauauccugcuaugaaccuuacuuguguauauaguacaugugcaguuauugguacuagcauuauaguauuuaauuugguaaaagguuggaguauuaauaguauaucacuuuuuuggguauucuagacauuauaaauacaguauaugaaaacaacagcaguugguucuugaacauuuuuuuuagaaaacuaauuauuuuaauucaacgccacuuacagauugcagauuuugguuuaucaaaauggcgcaugaugucacucucucaaucacgaaguuacaaaucugcacccgaaggaggaacaaucaucuauaugccaccugagaacuaugagccaggacagaaaucaagggccagugugaagcaugauauauacagguacaggguauuauuacuguuucaguagaaauguaauguuaaucagccagaauuuuccagcuauauuuuauagugagauuuucuucuaagaacuuacgauaaaaauaaauuagcauccacaauuguugauauuuuucaaauuaaacccauuaaccuuaagcacuuucaacauuguuuaaaaauaugacgguuuuuaguuuguccuaggaacauguaacaaggccaaagguuuuuagcuuaagugacuuaggaaagcauagguugacaacaguccauaauguuuagucauugguacuuacauaucacauacauuuuuaaagagaaauaagcaaaguguuaaaccuguuaagcaugguuuuuuguuuaaaucagccauaauauuuauauauggauggauccuuuauacagugaauuaaugcaucuaauagaaguaugguuucauguuucauuuacagcuacuuauaacuucacaguauaguguuaagcauaauucaugguuuuuaacauugcuucuuugaccagagaaaaggagaauggaaauuuauuaugcacaguauuagaguaagggagcuuuuaccccaaguguaauucacaugucucuuuaaccugccaaugaauguaaagucaggcuuccuaaacuuaucaaacaacuuuuucuaucuuuaauaaauaauuaucaguaaaaugaaagugcuuuuaguaguaagucauaugucuugacuagaaaguuauguaaucaguuuauauaccuuuuuaucaagaaaagauuuucuuuuuuuauuuuuuuaaauuauuuuacguauuuuuauuccaaauguugccccacaacaagaaaagauuugcuuacuacuucuucuuaaauccaguggcaaccaauucaugugagugagcacuuggauacauucauauuguccuauuaaaaauuaccucuguuacuguuccuuaacucauuaaaaucagcuacugagagaggagcaacagaaagaauugauuucugcuacaugaagccuacauagucuagccaggacuucccaaacacuggugugauucuauaaagacagaccacugggguuggaugagguuaguuugguuggucgguugguuuuucccuguauugagaugauccugugguucuuguccuuaugucuauuuaugugcaggaacuacacuuccugacuggcagguguuaacccaaccuugcauaccugagaugacgcuagggugaccaugguguaugagcucuuuaaugugucuuuuaacuugauuugcaagaauuuuauugagaacuuuugcacauauguucauugagggaacugaacccugguuuccuuuuucuguuguuucccuguccaguuuugguaucagugcaauauuguaguaaaaaaauauuuaaaauccuggcccaggguuucuacccugccuuuaguuacugguuucccaaacacacacacacauacacacacacacaugcgcacgcacacacacacagccuuuauauuuauaauaugcuuuauccggcacaauagcuggggaguugccuacccuccaugcuguuagaaucuacuuucuuaacaauaaccccuaauuauuacuuacuauguuucaucuuggcagcucuuaacuccaguuggggaccccucagggccacacucuccucucucuuaauccauggccgcuguccccucuucucuccugcuuguucuucacuuauuacauggcccauggcaacacaacuucuucuccuccuucccuccucuuggcccucucuacaagccugugaaaccccaaccccaccauuucucuucugccaagcuauuggcuguuggcaucuuuaccaaucacaauuaacuggagaaugucacacagugucuuauguaugaacucucucuucucuggguuaaccuaccuuggaggccccaaauuagcauuagaauacaagcagcauuaggccaacacacuacaagauguuggcuucauagaaugaguuuaguagugcugcuuugcuuuccauuugucuuaauuaagauuucuauugcugcgaugaaagaaacacugaccaaaugcaagcuggggaguaaaggguuuauuuggcuuauacuuccacaucauagucuaccauuaaaggaauuuaggacagcaacuaaacagguugagaacccugagacaggagcugauacaggggccaugggggaggggggugcugccuauuggcuugcuucuccauggcuuacucagccugcuuucuuauagaaccaaugaucagcagcccaggaauggccccaacgaugggcugcgccuucugccaucaaaaagcuugauagaauuugacaacaaauucaucugguccugagauuuuccuuguuaggaaacuuuaccguaaaauagcuaucacugauugcuaguguaugcuugugugcuugugugcauguguuugugugugaacauaucuugauuuaauuuugguuggucguauuuaucuaauuuaccauuccuuuuggauuuuccaguuuuuuuaaaaugaauuuuucaaaguacuugcuaaugagucuuuggauauuauugaaaauaaaaucuagcuuccccuuuucaucucuaauuuuacuaauuuuggccuucaugucuugacuauuuagcuaaaaguuugaccaucuuauuuguuuuuagagaacucuuuuaauauauaacucuugggcuggagagaugacuuagcuggcuggacucacaacaaaaauauauauaguuguggucuccauuucaguucugccaugaucuuuguuaccuuauuauuugagaucuuaacuuuuuuuuugaaaaaguuucauuagauauuuucuucauuuacauuuuaaaugcuauccaaaaagcccccauacccuccccccgcccugcucgccaacccacccacucccacuuccuggcccuggcauuccgcuguacuggggcauaagaucuucacaauaccaagggccucuccucccauugauggccgacuaggccaucuuccgcuacauaugcaacuagagacacagaucuggaggguacugguuaguuuguuguuccuccuauaggguuacagagaccuuuagcuccuuggguacuuucucuagcuccuucauuaggggcccuguguuccauccaauagaugacugugagcacccauuucuauauuugccaggcacuggcauagacucaaaagagagagcuaugucgggguccuguaagcaaaaucuuucuggcauaugccauagugccagaaagugucuggguuuggugguuguuuaugggauggauccccaggugggacagucucugaauggucuuuccuuccaucuuagcuccaaacuuugucucuguaacuccuuccaaggguauuuuguuccccauucuaagacggaacaaaguauccacacuucggucuuacuucuucuugaguucuaugaguuuuacaaauuguaucuuggguagucuuaaguuucugggcuaauauccacuuaucagugagugcauaucauguguguucuuuugugauuggguuaccucauucaggauaauauccuacagaugcauccauuugccuaagaauuucauaaauucauuguuuuuaauagcugaguacuacuucauuguguaaauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggaucuuccaguaguacuauguccaauuuucugaggaaccaccagacugauuuccagagugguuguaccagcuugcaaucccaccaaaaauggaggagugucccucuuucuccacauccuggacaguaucugcugucaccugaauuuuugaucuuagccauucugacuggugugagguggaaucucaagguuguuuugauuugcauuuaccugaugauuaagaauguugaacauuuuuucagaugcuucucagccauuugguauuccucaauugagaauucuuuguuuagcucuguaccuuauauuuuaauaucuuuauuugauuuucuaaaguccagcuucuugaguucuuuguauauauuggauauuaguccccuaucugauuuaggauugguaaagauccuuucccaaucuguugguggccuuuuugucuuauugacacgucuuuugccuuacagaagcuuugcaauuuuaugagguccuauuugucaauucucgaucuuacagcacaagccauugcuguucuguucaggaguuuuuccccuguacccauaucuucaaggcuuuuccccacuuuguccucuauaagucucagugucucugguuuuauguggaguuccuugauccacuuagacuugggcuuuguacaaggagauaagaauggaucaauuuguauucuucuacaugauaacaaccaguugugccagcaccauuuguugaaaaugcugucuucuuuccacugcaugguuuuaguucccuugucaaagauaaguaaccauagguguguggguucauuccugggucuucaguucuauuccauugaucuaccugucugucgcuguaccaauaccaugcaguuuuuaucacaauugcucuauaguacagcuugaggucaggcauggugauuccaccagaguuucuuuuaucauugagaauaauuuuuccuauccuagguuuuuuguuauuccagguaaauuugcagaaagacccaacaaagauagaguauuucagaauaauuucccuuaugaauaccuaugcaaaaauacucaauaaaauucucacuaaccaaauccaagaacacaucaaaacaaucauccaucaugaucaaguaggcuucauuccaaggaugcagggaugguuuaauauauggaaaucugucaaugaaauccacuauauaagcaaacucaaagacaaaaaccacaugaucaucucauuagaugcugagaaagcauuugacaaaauccaacacccauucaugauaaaaguccuggaaagaucaggaauucaaggcccauaccuaaacauaauaaagcacucuacagcaaaccaguagccaacaucaaacuaaauggugagaagcuggaagcaaucccacuaaaaucagggacuagacaaggcugcccacuuucucccuaccuauucaauauaguacuuaaaguccuagccagagcaauuugacaacaaaaagagaucaaggggauacaaauuggaaaggaagaagucaaaauaucacucuuuguaggugauaugauaguauauauaagugacccuaaaaauuccaccagagaacuccuaaacuugauaaacagcuucagugaaguagcuggauauaaaauuaacucaaauaagucaauggccuuucucuacacaaaggauaaacaggaugagaaagaaauuagguaaacgacacccuucacaauaaucacaaauaauauaaaauaccuuggugugacucuaucuaaggaaaugaaagaucuguaugauaaaaacuucaagucucugaagaaagaaaucaaagaagaucucagaagauggaaagaucucccaugcucguggauuggcagaaucaauauaguaaaaauggcuaucuugccaaaagcaaucuacagauucaaugcaauccccaucaaaauuccaacucaaggaauuagaaagggcaauuugcaaauucuuucuuguuuuuaaagcacugcuuguuggcauuucaucuaggcuccgccccacaguuaucuggcaauagccagcugugccugacucacuauaaaagggacugcuggcacccuccucucucuugcucucuucucuugcucccuuccccucuuacccccucucccccuuccccucccucccuccugucucuccacaugcucauggccagucucuacuugucugucucugucagucucucuccuuccccucccucucccugucuucuucuccuucucccucuccucccccuccccucaccccuccccuuucccccccccccuuuccucaacuccccuccccauguccuaaauaaauuccauucuguacuacaccauccuguggcugguaccucaggggaaagagaggccucagcaugggccugcagagggaccacuguccccuacaucauacugcaccuccaccaaacauaucucaccuuguuacaaaagauaacacucauaucuacaaauguuccucuuauaccuaccuuguaaguugugcuuucaccacuuuuuuuauaaauuggauauuuucuuuauuuacauuucaaauguuaucccaccccaaccccuuaucccaucucccccucccccugcuucuaugaagguguucccccauacacccaaucccaccuccccacccucacauagcccuacacugggucauccaucuagccuucacagaaccaagggccucuccucccauuaauggucuacaaggccauccucugcuacauaugugccuggagccaucagucccucccucuguacucauugauuggugguuuauucccuagagcucuagagcgucugguuaguugauauuguuguucucccuauggaguugcaaacccuuucagcuccuuugguccuuucuuuaacuccuacauuggggacuuugugcucagucuaaugguugccugugagcauacaccucuguauugucaggcucuggcugagccucucaggagauagcuauaucaggcuccugucaacauacacuucuuggcaucugcaauagugucuggguuuggugacuguauaugggauggauccccagguggggcaguuucuggaugaccuuuccuucaguuucugcuccacacuuuguauuugcucccgggaguauuuuguucccccuucuaagaaggauugaggcacccacacuuuggucuuccuucuucuugagcuucaugucuucuaugaauuguaucuucgguauuccaaucucuugggcuaauauccacuucucuaugaguguaugucauguguguucuuuugcuacuggguuaccucacucaggaugauauuuucaaguucccuccauuugccuaagaauuucaugaagacauuguuuuuaauagcugaguaguacuccauuguguaaauguaccacauuuucuguauccauucuucuguugagggacaucuggguacuuuccagauucugucuauuauaaggcugcuaugaacauaguggagcauguguccuuauuacaugugggaucaucuuuuggguauaugccccagagugguagagcuggguccucagguaguacuauguccaauuuucugaggaacgccagacugauuuccagagugguuguaccagcuuacaaucccaccagcaacggaggaguguuccucuuucuccacauccucgccaacaucugcugucacauggguuuuagaucuuagccauucugacugcugugagguguaaucucaagguugucuugauuugcauuucccugaugaauaaggauguugaacaugucuuuagguguuucucagcuauuugauauuccucccuuggaaauucuuugguuaacucuauaccccauuuuuaaugggguuauuugauacucuggagucuaacuucuucuguucuuuguauauacuggauauuagcccucuauuggauguaggguagauaaagaucuuuucccaaucuguugguugcuguuuuguccuauugucaguguccuuucccuuacagaagcuuugcaauuuuaugaggucucauuugucuauuguugaucuuagagcauaagccuuugguguucuguucagaaaauuccccauguccauguguuuaaggcucuuuaucacuuucuuuucuauuaguuucaguguaucugguuuuauguggagguccuugaaacacuuggacuugagcuuuauacaaggagauaagaauggaucgauuugcauuuuucuacaugcuaaccaccaguugagcuaguaccauuuguugaaaaugcugucuuuuuuucacuggauggugucuuagucaggguuucuauuccugcacaaacaucaugaccaagaagcaaguuggggaggaaaggguuuauuuggcuuacacuuccaugcugcuguucaucaccaaagaagucaggacuggaacucaagcaggucaggaagcaggagcugaugcagaggccauggagggauguucuuuauuggcuugccuccccuggcuugcucagccugcucucuuauagaacccaagacuaccagcccagagauggcaccacccacaaggggccuuucccccuugaucacuaauugagaaaaugccuuacacuuggaucucauggaggcauuuccucaacugaagcuccuuucucugugauaacuccagcugugucaaguugacacaaaacuagccaguacagauaguuuuagcuccuuugucaaagaucaagugaccauaggugugaggguucauuucuaggucuucaguuacauuucauugaucuaccugcccuguuucuguaccauacaguuuuuaucacuauugcucuauaacacagcuugcggucagggauggugauucuccagaaguucuuuauuguugagaauaguuuuugccauccuggguuuuuaguuauuccauucuuuuucuauuuauuuauuuauuuuuauuagauauuuucuuuauauacauuucaaaugcuaucccgaaaguucccuauacccucccuccacucugcucccccacccacucacucccacuucuuggcccuggcauuccccuguauuggggcauauaaaguuugcaauaccaaggccucucuucccagugauggccaacuaggccaucuucugcuacauaugcagcuagagauacgagcucuggggguacugguuaauucauauuguguuccaccuauaggauugcagaccccuucagcuccuugggugcuuucucuagcuucuccauugggugcccuguguuccaucuuauaaaugacugugagcauccacuucuguauuugccaggcacuggcauagcuaugaacaggguuccuucagcaaaaucuuucuggcauugugcaauagugucuggguuugguggcugauuaugggauggguccccaggugggguaugcauuugcaaauuguccuuuuuaacucuaugaagaauugaguuagaauuuugauggggauugcacugaaucuguagauugcuuuaacuuuugacaagauggccauuuuuacugaauuaauccugccaauccuugagcauaggagaucuuuccaucuucugagaucuuugauuucuuucuuuagagacuugaaguucuugucauacagaucuuucacuugcuugguuagagucacaccaagguauuuuauauuauucgugacuauugugaaggguguuguuuaccuaauuucuuucucagccuuuauauccuuugaguauaaaaaagcuacugauuuguuugaguuaauuuuauauccagccacuuugcugaaguuguuuaucagcuuuaggagcuccuugguggaacuuuugggaucacuuaaguauacuaucauaucaucugcaaauagugauacuuugacugcuuccuuuucaauuuauaccccuuugaccuccuuuuguugucuaauugcuuuggcuaggacucugaguacuauauugaguagguaggggaagaguuggcagucccugauuuuaguggaauugcuucaaguuucucuccauuuaguuugauguuggcuacuuauuugcuguauauugcuuuuauuauguuagguaugggccuugaauuccugaucuuuccaagacuuuuaucaugaagggcuauagaauuuugucaaauucaucucaucaucuaaugaaauaaucauauggguuuuuuucuuugaauuuguuuaugagugaauuaccauauauugaaccaucccugcaucccuuggaugaagccuacuugauugugauggaugaucguuuugauauguccuuggauuccauuugcaagaauuuuauugaguauuuuugcaucgauauucauaagggaaauuggucugaaguuuucugucuuuguugcgucuuugugugguuuugguauaagcguaauuguggcuuuauauaaugaauuggguaguguuccuucuauuuuguggaauaguuugaagaguauugguauuaggucuucuuugaaggucugauagaauuccgcacuaaaaccaucugguccugggauguuuuugauugggagacuuucacuuucauuugauucuaggaacuuuuaaauuuccccucugguuucuggaaugacccaagaguucauucuucagucucuagguauuuguauaguuucuauacccuuucucccauguuuugauuucuaguuuuguugcucugggagcugagaagauacaagaggcgguuuugauucuuugguauuugcuuugacuuuauuuguagccuagaauguggucugguuuagagaugguccuuggccugcugagaagaauguguggucuuuuucaguuauauguacuauucaguagacauauacucaauccauugagcuaugguguuuagcaugguuggcuaacuauuggcugauugaagucacucacuauuguuucaaaaauuagaccacuuauguccauuugucuuuuuaugaaauuagguaugccaaaguuuguuucauauauaguuacaguucuuacuucucuuuuguuaagagauuucuuuuuuauuuuagauguauuuauuuuuauuuuaugugccuugauguuuuggcugcauuuaugucuguguaagcaugucagauauccuagaacuggaauuagagaauguucugagcugggaauugaacacugguccucuggaagaguggucagugcucuugaccacugagcuauauagcucaagccccuguuacuucuuaaugugugauaaucuuccucaugucuucugacuaauugugguuggagguuggcuuuuucuucagaauaaccacucagcuuguuuggauaauuguuuuauuucuaccaauaaggccugacuacuaagaacaacagaaguaggaucuuguuucuuagugcagccaacucugccuccuuauuggugaguugaggccguuuucaucuguuaugccaggaaacauuuguggaccccaaaaagaccaccaaggagcugaaucugaugcagucacauuggggucucuuuauucaagcuugagguugggcuccccaccaacccugacacagcaagaagguggaacccugagccuaguuuuaggcaagcauuuauagaggcaaauaaagggguaucuagacugguacacaucugauugggaggggucauuauggccuuuagcauaauuggcugguguugggagccaaagccuaaauuuuuuuuuuuuuuuuuuuugucuuuuugagacaggguuucucuguguaggccuggauguccuggaacucacuuuguagaccaggcuggccuugaacucagaaauccaccugccucugccucccaagugcugggauuaaaggcgugcgccaccacacccggcuuccaacuuaaccuuaacuucugcuuuccuccugauuuuaguuguuaggaagugaagugccaggggugggcuuauaaucugggggcacagauuuguuggggaacaaccuagaaacugguacuagaugcagguuuuguugggaguaaccuguaaacucguguuagacaagguucuuguugaggauagccuggaaacuggugcuagguaccagccuguuaguuaacuucaguucaucccuaggucagauucucuaagauggagucugaacccaaaagauuuggucucucauaucuacaaagacuacugagagauauucacuaauuccugcacuucuguugguugccuuucuguggcuuggauuacugucuguuccuuauuuucuccccuauugauaucaggguuuugagaacagacugaaaucaucaauguacuuaucauuugcuucuugaauuauguuuuuauguucaagcucuguauucccuaggggugaaaaaugaaauauuuuuacuuaauuugggugggauuuucucuguaauccucacuuugcacaaagauacuguguugguaucuaaucaaguucacuuauuguuuuugaacacauaauucacuugaagauacugcagaauuucuauguucugcucauuuauuccaaauauaaacucuauucagcuuaacuaggcaauuugcaacugaauuauaauuguugugaaaauacuugcacuaugaaaagacugucuucuguuacugcucuuuacuuugugugaaaaauaaggacaucauaucaaagggcacauuuaucugaauguuuagaauaaauuaucacaaauauuuauccuggugaguagcagcccuaggccaguguuauggaaacuucauauucuucauuaaaauucauuauuuuuaagaacaauuucaggcauaucugaacauucaccauccugacuguaucugggaauucuuuaccucaucauccucaaaaauggugggauuuuuuuaaauaauucuauauaguuuauauacaaaguuugcuuacaauguauaacuuucuaacuuaaacagcuaugcaguuaucaugugggaaguguuauccagaaaacagccuuuugaagguacguauacuuuuauuccagaggacaucaugugggugguacacgucucaacugucuaaaccucaccagauuuuaaauauaccagccauucauuuuguacacaaacugcacuguacaaacauagcaguauaucaguuaugcaucuauugcauacuauaaaauauacuagauuaaggaucaguuaugaagaguguacuuggcuuaaagaucagaaaaauuuaaauucuaguuuuuauucuagcaauaacuaacccuguggucaagccacaaaauuucaugaccucauuuuuuuuauuugcaaaaugagaacuuauuuucuucgagacagaggcucacuauguaauucuggcucuccugguggaacuauguagacuauagaccaagcuggccuagaacucacauauuugccugccccugccucccaaaugcuaagauuaaaggcacgugccaucauaccugguuuuauuacuauuuucaaaaucaugauaucaauaaaauucugugugaaaauuuaauuguuacuccuucuauaaauaccaacaaacauugaaaaauaaccuuugucauucccagauaauauuggggcauuuuuuuuugaaguucauaauguugaacuuguuacaucaugaauauccuuaauauuucaguaguuuaacagauagcauuuaucucucauucacauuaacuguacguuacugucccucguugccuaugcuaggcucugcugagcucugccuguuuggcucuucucacagagcaaaucaaauaacuugucuaaaucuagaacucgggaggagaggcuauaaauuccuccuaggagaggugcaccaggcugagaguggcugggacguaaguccucuuacagaaaaggguauuuugaauuaaguuaacacuuuaagauauccucauuuugauuugaaauguguuaguaaugucuuuccaguuaaugaaauacauuuguuuugacagaggucaccaauccuuugcagaucauguacagugugucccagggacaucgaccugacaccagugaggagaauuugccauuugauauaccucaucgaggucucaugaucucucuaauacagaguggaugggcgcaaaacccagaugaaagaccauccuuuuugaguaagugaacaguuuuaaucuggaccuuugaauuauagaaauuaugaguauacauuaaauaaaguauuccuuaaaaauucaugccuaucuugaaacuauucuauacauuaauuugcucuuguuguuuguuacauuuacauauaggcaauggcuacuagaaaaagguugagaauuccuaacagaaaagcgaaguuguuuggugguaguaacauuccguucccuuagugaacaccugccuugugagcccuccucacugggaugagcagagagagcuaagaauaaauguggcaucuucucaauguaaccuucuucuggagaaagcauggagggaaugaauaaauaacuaagacacaacuugucaagucaguccugaauuaaaacaaauggccucacccaugagaagaauggcaaaggguuuuuaggagcuuguauuuggguucuuguuucaagcuugaaacagagccagucauucucggacuaaauaguccagcaaagaaaacauccaaaguaaagagucugagacgauaggaagaaaauguuuuguguuuucaaggaaaaaagaggaagccccuguauuuagagcauagugaaccaagaagguggugaaggugccuuagagaguaagggaaugguugccagccccucucagaccuauacucaugcguaauggaaagccauucacuccugucuccucugggagcaaugugaucuaauuuaaguuuaggucaaaaucccucuugacugcuagauggggaagugacugugugagaacagagagagcaguucggaaacucccucaguaauuguccaauucaagugacaguucuagacacagaaaaguuauccaacguuaaggcacauuucagaggaagaggaagaucagacaucuaaguauaagcaggagggacucuuaagaccuugcuuaggcagaguucuuagauuugaauccauaggaucuaaaaaaaaugguuuuuuucaauaaauaaucuuggagauugaacuuuuauaaauuagaacuuuguacuugaauaaauaccagcugagaacuggcuuucaggagaaagugcuugucauacaggccugaggaaaggagcuucgauucucaacacccaucaaaugcucuacagguaugccgcagacugccgguaaucccagcauuuaggagguggagaucggggcuccagaacaagcugacuagugagcgagacuagugagcucuggcuucagugagaccuggcaucauggccucaguguagaaagcagaagcagagcaguccuuugcagaugcacauacaugcaaacaugcaaauaagaugcucacaucacacacacacagacucuuacaaaaauaaauuaacuacaaaaacaugaaaagacaagccacggauguuuggaauauauuuucauauccuauaucaaaaggacuuaugucuggaaauaaaaaaaucauucugucuaauccaauaauaagacuaauagcaguuuuaaaauuauagauuaggauucuaccaaagaaaauauacaguugacuaaaaagcauauaaagguguuguucauaucacuagaaaauacaaacggagagaucgcaauacaaacccauuaaaacggcuaugguuaaaaaugacagauaauuugcaaauucgucuggaauaacaaaaaaccuaggauagcaaaaagucuucucaaggauaaaagaacuucugguggaaucaccaugccagaccuaaagcuuuacuacagagcaauugugauaaaaacagcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacuaaaagaccaccaacagauugggaaaggaucuuuaccuauccuaaaucagauaggggacuaauauccaacauaauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccgcaauggaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacuugcugauaaguagauauuagccccaaaccuaggauacccaagauauaagauacaauuugcuaaacacaugaaacucaagaagaaugaagacugaaguguggacacuaugccccuccuuagaauugggaacaaaacacccauggaaggaguuacaaagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucauagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagaaaggcccauuggacacgcaaacuuuauaugccccaguacaggggaacaccagggccaaaaagggggaguggguggguaugggggacuuuugguauagcauuggaaauguaaaugagguaaauaccuaauaaaaauggaaaauaaaauaaaauaaaauaaaacaaaaugacagauaauaagauaauggccuugaucugagguaaugaaaucccucacacacugcugauuguguacagacaugauucauaaaaccaacaguagaaggaauuauacuguuacuacuauaauaacaugcaaauguuuuugccuaaggaagaaucuaggacucaugauauaaaaucagguggugcuaaugcaaguaauuuagacgagaccacccuagauagagaacuuagcccuucagcaaauacuaaauauccauauuagaccuccgaggcauuucuuagaaauuguauagaggaacaagaaaauagauugcgaagaaugacuggagucucugucuaagaaggaaugcucuaaggagagaguggucagucagucaguccugucuacucugacuauaagcauaagcaagccuuuagcugagagugguggugagaggcugaaguagcagaauauauugaacucaggaguuugaagccaacccauacacauacaugugugaguaugugugugcaugcauguauaugugagugcaugugugacugacugccugugugugcucacgugugugcccauguguguggaggggguguguauaagcauauuauguuaguuaucagugggcagcuuucaaaauaugguuuuugcacagggcugggaucaagcuacggcaggcagucuucacagcaagcgcuuuuacccacugagccaucauccugagccacccuggcagaauggcaagcgcuuuuacccacugagccaucauccugagccacccuggcagaaugcuucacucacgccagaugcgagcccuuuagcagauacuugagauacuacauucuccuccuacuccuagccuggggcuucacuucucauuuuuuuucuuaaggacaucaacucucuagagccugguucucagcuuuacuaaugcugagacccuuuacaucaguuccuucuguugugguaaucccaaaccauaaaauuauuuuuguugguacuucauagccguaauuuugcuacuguuauaaacguuaauguaaauaucuauuauguagaauaucugaugugcagccccuggaaagggucauucaguccccaacagggucacgacccacagguugaaaccacugcucuagaguccacuuuucaaaauuguuuuuggaagucuaguuguuggguuucuagaaaucuuauuuuugaucucaccucuaaggauuuauauuuaagugaaugaucuauuuugauuuaaguuuuauguaugauauacaauaaggguauaaaugaccuguuuuaauauggguauucaagugucuuaguaaaaguuuacuuuaaaaggcuguccuugccuugccuuguggaauuuaagguccuauguugaaaaucagcauccgagaauugugacaguucauuuaaaggcugccuacuugguucuguugauccucaugucuguuuaugccagcaauaaaauuccuuaagauaauuggauaucauaguuuuauugaaagauugacguggaaccuuauaaaauaaauguuaacguuuugguuuaauuagaagugaucugaacuuaaaauuguuggguuuuuguuuuucgguuuuguuuuuuccguauuuagaaugcuuaauagaacuugaaccaguucugagaacauuugaagacauaacuuuccuugaggcuguuauucagcuaaagaaagcaaagguaaaucccccuuggaaauguuauaacuuagagcuuuacaaaacuguaugucacucaugaaguuuuaauuaaguuucccaggaacaggcuggguggagggggggagaauuuacaaggguccugauuacugccuuuucccugucaccaaugggcauuuccauuucauucaaaugggcuaucuucagauuuaacaauuagaauccucaguauaucagaggugaacuuagaaacugugcugaggcuccugugcaccacaaacacccugugucucucacagcgugcuuaugauaaguguugcucuguauuuacuucugcuaaguguuaacaccugcagaggcuagugcuugcuccucuuuaaaguacuugggguuuuuugguuugguuugguuuuugguuuuuuguuuguuuguuuguuuguuuuuugagauuuaucaccaaguaaaauaauugcauuuauguuauauuugagccaccaaaguauacuuuuauuccuugauuuuuauuuuguuuucucaaauacuucacguugcauaaauuaaucugucagaaaaguuaauggaaauggccugggaaaguuaugugaucaguguagcucuuguggaucagaacagcugaggauuuauagaguaucuguaguuccuuagagcaaagugagcauaggcuagcacucgcugggcuucauuaaauugcgcuguguaugugauaaucagauugccagcuagcccaaucuauuguuucuuuacugacugacaguuugcuuuccccuccuacuuugcuggaccuacuagcaucaucuuucauuuacagauuaguauguaaaagaaacucaugaucaaauuaaagacuuaccauagcaguauuaauauccaaguuuuuagucaauuccauugauugaugagcaugucuuuuuggugccaaugccauggagaguauccaaguuuuagaggauccaaauaugaacuaugaaugcuuuuccuaauuucuccaacuccccaauuucgggauaggguacagcccuuuucagagauaccagugucaagacagacugcuaaguauguuaccuuuugucuuuucuuuucuuuuccuauuuucuccuuacaaguuucucuuuuuucucaucuuucucuaagcaaaacuagaugaguagggaccuggugguaccauccuguaaucccaucuacuuguguaggcuaagaggaggauugcagacucaaggugugccugggcuacagugugagcucaaggccagcauggguaaguuagcuagagcugucucaaaauuaaaaauaacagaagggagggggccuagggauagaguucagagguagaucauuaaacaaaaaggaaacagagagagacgggaaauacaaaggccuguugucuaggcuaugaggagagagaacugucccacaaccccuuuuccuuuucuguccccaaacaguucaaacacucacguuuuauauauaagcuugauguuuaaaaguuauaucuucuuaaggaaaguauacaucucagauaauuuguuaaucauacaguggacucaucguuguuuuuaugucacaguguuauuuuuacauaaaguuagaguuagggggugaggugaaaugcugguucuuuagauaagaugacugcgguauagaauacaguagaauagaaaguuaaaagcccagcaugcugcugugcuucuaaugccagcugcucuacagggagaggccguagaacugaauuugaagccgggccagccugagaagcaggagcaacauagugagacucuguccuauacacacacacacacacacacacacacacacacacuuaauauuucucuaucuagaauguuguuuuacuugcauuuccuguauuuuuuaauucuuuuaaaauucuaguucuuacuauuuggauuuuucuaaauaaguguuuccuauauguuaaaaaaauaaaaacuaaaccaaaaaaaaaguuuucuuuaauaauuucuuguauugucuucuuuaggaaugauuugcuaguacauaaucaauuugaguuaccauacuucauuaguuuuuuuuaaaauagguauuacuaauaaagagcuguauuagaaauguuucaguaaaaaagucaggaaaacuuuauguaacagacauagccaaaaauuaauugaaagaugcauauaacauuugaugugguaugguggugcaugccuuuaaccccagcacucggauggcagaggcagaugggucucuguaaguucaauagaaagauccaacuccucaaaggccacagagucucaguccaugcaggaucgcuugcugagcugcagccuacugaguaauagcuacacccacuguauauacagcuggcucuuaguccucuccucccaguggagcaggccauuggaguggaguguggagagcagaacccacuaguuucuaaagugccgaagaacaauuaauaccaugcugguauagagacggaaaguagacuuuagacuuggcuaugugugguauuuuucaccuguaaucacaggaucccagaagcaggggcauguagauugcucugaguuugaggccaccuuggucuacauaguaaaaaucuaugccagccugacccuaacuacacagugagauucugugugaaaagggaguugaggcagaggguagaccucuagauugguuuuuaaaugacuuauuagagaugacagucugucuuaagucuaguucacggagccaaaaguaaaucacuuuuggcuccguuacuguauuuaaggaaacaaaucaccuguuuagcagcucccuuuuauugaauaccugcaaagaaucuuagugccgucuugcaugaauuacuucuaauucuccuuauauuaacccuacuaaaugaguauccuuaucucuaauguauaaguaggaaaauuaauauuagguuucaucccuuggcccaugcacaugcaagcaacacuaaguaaacucaguagaauaauagauagguagauagauagauagauaauagaaauuauauagauacaguuuuuuuaauuuuuaagacaugaaaguaggacagaagacaagaugagaaguagaguuucaaaggaaguaugagggacauaaggaaauggagugguaaugugaccaauauauauauauauauauauguguguguguguguguguguguguguguguguguguauacacacacacacacacacacacacuauacaacacacacacacacaggggccaguuauuuacauaucuugggcucuaugcuugaccaucacacaugcacaucacacuguaccaugguaacacacuaccaccuuuacauugguccaaccuugguuucuuuucaguacaaugaaaauagucauagaaguauaguccuugcauaauaacaguuauggauaaauagagcauacagcaaaauugaauacccagcuugaaccaaaugcuuuauuauuucaaucuuuaaauaguccuguuuguaagcauuaaagaugaagcugcaacucucuugagauaauaguuacuaaaucaaacaauauggggcaagaugcaaaaucuauucucuaagcauuucuuguucuguacugucucuaccuaauuaaguuauauauucacaaaugauguaaauuuuguuuccauugauuuuucuguaaacacaaaacauguguauguucauuccagauacagaguuccucaaguacuauucacuuaugugauaagaaaauggauuuaucgcuaaacauaccugcaaaucaucccccacaggagguauaaguauacuucuguuauacuaagcuuggaugugagaacaauguuaaaaaaaaucuuuuagucagaccucuuuuauagcgcuggaaaacuaaaguccaggaagcauuuauaauuagcuaaguagucaugacaaucucuaaccugaaaucucacuccacccucuuuggaugaugcucuagggugguggguagguaaaucauaggugaucauuucaucacuguuuuauagcacccuuccaccucuuacaguaaauaauaaguuucuguugcucucuaagaguuauaucuuuaauuggucauuuuuaugaaucauuuuaagauuauauaucuacuuuacagguucauaaaaguaacaguacauucaaaagaucauuaaagcacaccacauagguuuuuuuuacauuuguuuacccagcauguguacauguguauguauguaugcauguguguuaaaggauaacuugcaggaauccauucucuccuuuacuaugugguucucaaggaucacauucagguuauccacuuggcuacccacugaaacaccacacugacccacaauauguaguuucaaaaucacuuauauauaaaguaucuaauuugauccuuguaacaagcuaauuuuuuauuggauauuuucuuuauuuacauuucaaauguuuuccccuucccaggucuucccuuaggaaacccccuauaccaucuccccucccccugccucuaugagaauaauaagcuaauuuuugaugaaacauuaaagccagagaguuucaaugaauauuuggaaagcaguaagcaauucagugacagagcuaagugugacgaucuccauaguuucuccaagcauuuuucuaugccuucagguugaaagagccugauaaccagcaucuacucuaaaucaauaaauaaccacauguuuguuguucaucauuuuagccacaaacguccucuaaaucauaauggguguauaguuauuuccaguacauagcuauugccccaucccuuccauuugaguugauaaagacauuaaauuuagagauugaggcgauagcucagugguaaagcacucaccuaucaugucuggggcccuaggugcgaccccuaguagagaaaagggugaaaaagaaaucacauuuguuugugaugguuuuauaccuuacuuccuuauaauuuauaguaguucuagguuuccuuuauuaauaaccaagaaucuagaaacuauagccauguaauuuuaaagacaaugccuuuucuacaaaacuuuauguauacagcuccccucaaccuguugguccucuguuuccuuuaggaaucguguggauccucucugcucucuagaaacacugguucuccuggacccuccagaucccuaucagcuccucaagacaagggauuuuuaucugguaugccaguuuuccagucagcgugcuuacauaccuuuuuacuuucuuucaaauuauacccuugucagacagauggugugcguggaacucauuucugauuugcauucaugauccauuuuuuuaaaguaacaaggcuacauauguaaagguagcaguagcaugaugaacaaauauguuuauauuaaaggcacucuguaaucaugauggaaaacuuauauauaauauauguguguguauauauauauauauauauauauauauauaucacaucacuacaggaaacaagacacauucuuaagaaaguauuuuuuuuaauagcugugugagggagccagucuuaguccuuguugacagauuaugaacucuggaucacuuagcaaguagcuagcagacccaagacuugaguaaugccaggcucuuugaugaauacuuuacuuuggcgaaugucacucuauuaugucaucaugaagaccguauuucuggcugaaagcugaccucuacuuaugacaggcauuccguaaaaagaacaauauggaguccagaagcaaggaaacgggugacaugaguaauuuaguuugucuuguagauagaguaaaaaugaagagauaaaagauuaaggaggauuacagugauaucugcaagaauuccuagggacuggagagagcucaguggaaagggugcuuacuguuguuccagagcaaucaugccugauucccacacagugucucagaacugccacgacugcagcuccaaaagaucucccacccuauucuggccuccauagacaccaagcaugcacagugcauagacauaaaugcagaauaaaacacuuauacauacauauauuuuuaauuaaaaaauuaaucaauuuuuaaaaaauacuacauuucacuaauauuacuuaggcuucuaaauucaggaggaaguaacucuuaaagaaggcuaucauauacaaauuuuugcuuuaggaagguucaucauggcuggaauuagauaaaaaaauuaaaucucuuguuagggggugggggauggguagggcuagaccaucacagugcacguguacagaucagaagucaucuuugagagucacuuaucuccuuccacuguggagucugggaaucagauuuaagugaagcaagcgccuugacccacugagccaccgugauagcccugcagaagccacuugaagucaagaggaggcuuggagucagggcaguuaaaagggaaaacagggaagguggugugagaaauuagggcaacucccugacaccuucugacugcuuaccugagcugagggaggaggccauaaagcugagugcuacauuguuuagcuaugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcuacauuguuaaacugugagcacucacagcuguuagaacuaaggacugagugcuacauuguuaagcugugagcacucacagcuguuagaacuaaggacugagugcuacauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcuacauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcugcauuguuaagcugugagcacucacagcuguuagaacuaaggacugagugcuacauuguuaagcugugagcacucacagccguuagaacuaaggacuaaaguggggcuaggguuaagacagaugaugauuaagauuuacaccuuuuuuauguuauguuuguuugagucuuugagucgucaucagugcccuuuggggaggugaugugcagugagccucugagaauguugaagggacuggguguucaauggugacagaaagauaauuacauaagcuugaaguaggauaaacaguuggagcacugaaauuguuuucuaaaggagaaaguagaaaacacaugucaaguacagauuuauuacacuuaaaaguccauguauuugacagauauacauaagacauauuuaaaguggaaaagggggaauucacagggaagaaguaugagacugugagaagaugggaaauuaugauuuauaagcauagaccaggcaagcacugauaguaagaaaaaaacauucaguauaaauguuuauuacucuaaaaaguauuugcagggcuggcaagaugacuguguguaaaaguacuucccaccaugucagcaaccugaauuugaucaucugaacucacaggguagagagagagcugacgucuacauguugaccucugaccuucacacacacacacuaaaaaauauuucaaguauuuucagaauuggauuucugaaguagguucaauaacagugcagaaccaaagccguuagagccuaccuucugugugacccacccauugguauuuuaucuaaugaaaacucuaccuguaaugaacuguccuguaggagcaccucaagacugcucuucguugaaggcacaccacuguccuggaaaccacagcugggaugguaucguuucuguaccaccaggggcagccuucugugaucgcagggccuccucguguuccuuggcuguaauaaguccauucuugguugagaaagguucaggugaguguaugcugugaguuauacugcaaauguugguguuuacccuacaaguacgcagugcauggauucaccauauaguauguuuucuuaguguucauuccauacuucaguaaguauuuguuuaaguaggagagcauuuccagacucagugcugaccaaaugcauuccaggaaugucugaccuagaaggaagugggaagaagcagcguuacuuucaguguuaguaaaggcgaaacuguuuucauuuaucacaucggcagguauccuuuauauuugaaacuaaacaaaaauucaagucauuuugcccuacaacauagcauauaaaaauauaauacucuuucuggaaggugaauggggagcuaaaacucaagucucuugauaguuccuggauaauagaagcacuuucaaauaauacucuucacacccgcagucauacgggaaugagaguucugcuuacucacauucacacagaauuacacucauugccucuacguauccucagcuugguaauucucaugcauugcuuugcugcagagcgcccaccaauugguauagcccaacaguggauccagaguaagagggaagccauugugagccagaugacugaagccugccuuaaccaaucgcuggacgcccuucugucucgugaccugaucaugaaggaggacuaugaacucauuagcaccaaaccuacaaggaccucaaaagucagacagcugcuagauacgucugacauccaaggagaagaguuugccaaaguuguagugcagaaguugaaagauaacaagcagcuggggcugcagccuuacccagaaguaccugugcuuuccaaagcaccgccuucaaauuucccucagaauaaaagcuuguaagggggccuucuuugggaggaagucaguuuacaaaugguuauuuauauuucuguuaccuguauaauauuuguauagaaaacaugagaguauuagacgcuucacugaagguugauggaagagucucuucccaugacguugcaguauuuuuuuaaauuaauauaaguaaaaaguuugcuuuaugcuguguaguucaguuuuuacgucaguuucacuacuugaacuuuuuaugugauaauuacauuuuucuaguauguaacagugccuuaaaguggccuuuguuucugauggaagacacuuucacacucaccuucucugcggauuccucauuauucgucuagagugcaguuugacuuuacauagcagugauucaggcuccccauuugccaaucccaaguucagaucuccaaagaguuacucgguuuuaaguuugacuuacaaauucuuuagcagguggucucaaggaauguagaguauauaaagaagcgggggagaaaaaauuaacacuggccagccguggaccucugcuuaacuuuugccuccugucugucuccagagcgagcagcccauugugcauccugcugcagccugcuuccggcuccuguuuuaagcauaugcggguuggguagaagccgaccuuuacuuagcuauuuucuuuguaaaacaccaugguuuuugaacugaaggcagguacacuccuccacacagcuaacuccguucaaucaccgcaugucggccacgccucucuguguuugauuuuccaagauugcucuuaucaacuugacgagaaacaauaaaaaggcaauacagugugcauucuuuuua

SEQ ID NO: 1797 - RNA, 1683 nt, Mus musculus
auuaggccacgaauucauauggaaugggcuccaacagcucaaacuuuuuuccauuaguccucaaaaugugugcuucucuggguggcacagucuggcacuucaguugaacccaggugcccuucucuuugacuuccuuuuucuucuggucauucuccuucacccacuucaggaagcugucucugugcuuugagugcuugaugugcucaauccacacauugauccucuuggccagaauguugcccuuaacuugcuuguuuacaaucuuuggacugucuacuaggacauuuggauaguuuuauaaauauauuaaaaaauaccagagaccaaucaucucuaauuuuugguuuucaaaguuagacugagagaauaguucauuuuuuccuauauguguucuggucaacagacagaugagacucuaguguuauggcccaacauucagguuccuggagauuuacugugaggagagaaguuuagccagggaggagaggaagaagaaaggaggcuuaaagagaaagaauugaaggauaaaaauaaugaaaaauauauuccauucugaacaaugauauauuagaaaaguuuguuuaauaaugcaaugguauauauuaaaugcucacaaauaauuguugcucaaaauauuuuccaaaauucaaugacauagcuuuucuauuuucuaucaaaaagaacuguaauauucaaucaauuauauaguuuuauuuuuguuuuuuguuucuuuuuacuuguauugaaacagaaaacuaaguaguuauggagcucauuauuccuuaaaacaaauugcaaauacaagucacuauuauucaguuuggguuuuauuuauugaaauagauucauuuuucacauaauacaccuugcuuaugauuuuaccucccucuaaucuuccaaguuccucuccauuuucccucccaucuggauucauuuccuuucugucuuucacuagaaaaagagcauccuucugagauguaauaugaaaguauuacaaaauaaaauauagcagaaaaacuaucacauugaagauggcauuuauagaaguaaaaucuuaaucuuuagagacuucucagagcaacagaaccaggacugggcagaaagccacuaaugcuuugggccaucagcaucacuauccaaaaccuuccugaacaucugaccugagccugugauccugcauuguauaccuacucugucuacuacaaaaauuugaaauucuuacucacggagaauauuucuuacgaugacuuguugcaaucuuaguagaacuuuggaucaacgcauuauaaaguucauuuacuucauucuuauaauugugaaaaauauaauaauguuuauguuguuuuaaaauagaggugucuguuuaauuuacacaaaauaucaucuggagaaaacuuguucucagaauccucuacuucauuauuaagauaccuagaacuaaaauuuuggaaaauguuuuuguaaaauuagagacaaaguuguuuucugggaaaagugucaagggcacaauacuuugcuuaauauuacuaucaucuauaaagagucuuuggcuaaaggaauaaauuuuugccugaggagaaaccauaucccacagauagucuacagcucucuuuugguuguuaagaaaaugcacccauaaaacuaccucgcaggccucucaaauuagagaugccaucagccauu

SEQ ID NO: 1798 - RNA, 2227 nt, Mus musculus
aaugaaagcaaaaauauaucaucauuuaaaauuaauaucggucgggggcacggacgguggugggcgcuggggucccaccaggggaaccuguccgguggcagagcccggauguggcccgagccgggggcccaggaugcugaacgucccuucccaggcuuuucugggccccggcucccagcagcgcgucuccuaccaggggcgcagcaagguaccuuuaaaacaaggcaggagucuuauggauuggauccgacugaccaagaguggaaaggacuuaacaggauugaagggcggguuaauugaaguaacugaagaagaguuuaagaagcacaacaagaaagaagacuguuggauaugcauaagaggguuuguuuacaaugucagccuuuauauggaguaccauccggguggggaggaugaacucaugagagccgcaggagcggauggaacagaucuuuuuaaugagguucaucguugggucaauuacgaauccaugcugaaagaaugccugguuggcaggauggcugugaagccugcuguuccaaaagacugucaugaaggaaagagagucuuaaauggcaugcuucccaagugucagacacacugccuagggaugugacagacacacugcccagggaaggccucaguucuccaagcuaugauugguuccaaacagagucuucagucaccauugugguauacaccaaacaaaagaauaucaguuuagacucaguaaucguugaccuccaggaugacuccucgagagcagacgcagucaucaaggaucauucuuaccuuguacauguugggcuaagccaugaaguucaagaaaauuuuucuguacggguuauugaaaauguuggaaaaauagagauuguccuacaaaagaaagaaaguguuucuuggcaaugucuuggugaucaccuggagaaacaugauccuuucauuccaaagaaagauacaggcuuguacuacagacggugccaguuaauaucuaaggaagaugucacucaugacacgagacuuuucugucugaugcugccuccaaguacucaccuucaggugccaguuggacaacacguuuaccucaagcucagugucacaggugcagaaauaguaaagccauauacacccgugucugauuccuuacucucagauuuuaaagaaccaguucuuuccccaaauaaauacaucuacuuuuugaucaaaaucuauccugcuggacucuucacaccagagcuugaucgucuucagauuggagauuuuauuucuguaagcggaccugaaggcaauuuuaaaguauccaaacuccaggaaguagaagaucucuuucuauuggcagccggaacaggauucacaccaauggucacuguauugaauuaugcuuugucucacauguccagucucaggaaggugaaguugauguucuucaauaaaacagaggacgauauaauuuggagaugucagcuagagaaguuggcauuaagagaaaaaagauuugauguugaauuuguucucccggcaccuucucuagaauggaauugcaaacagggacacauaucacgagcucuucucucugaauuuuugcaaagaaguucagaaaacucuagggccuuccuuugcaucugcggaccaacaccauuuacugacgaggggauaagguugaugcaugaucuuaacuuuucugaugaugagguucacggauucaccgcuuaagaaaaagcugccauugucuuuuauucaacuaguuuauauuugugauugccuaggaguuuuuaaaugaguuuuuguauguacggaaggcuuugcuuucuggaaugaaaucauguaucuucaguacaaguaacuucuugguuuaauuuuguaccgugacuuaucuuacugcugacccugaccuggagggucagucauggcagcaggugcauaugggagccuuuguuaugaacugcaaguuuccugaccacugaaguuguaucgcuguucugcagucaacacuuguauuuuaugacaugguaaacuaagcaaucauuuuggucacuuuuuaugcugcaagauaucuucugagcaauauguauuaaauauuccacugcacuguucacucaggaauugaugguguauguccuuaguagucuuaaaacuuggaaugcuguaacuauuggugguccaguuuugugaacuggacagauagaauaaaacuauacuuucauacuuuaaaaaaauaaaauaaaau

SEQ ID NO: 1799 - RNA, 1783 nt, Mus musculus
cgcccaacgcgcgaccugcaacucgcaucccgcggcccagcgaguggcacgcgcgcgaaggcagcuguggagaccucugaaugcucccugugaacucuuauguggccuggcgaggucaccuacaccaaguggauacgaccaccccgggaccugauggcgagcucgggucccaccuggcucugugcgguaaccaagcagcaaggcccgcaagguucuagaaguuaccagagaacuaugcugcauaaacgcauagguuuucuggcuuugauauccugacagcauucgauguuaggacagggguucacuuccgaaaaaccacugauaacauauuuauuugggcacaaggaugucuggaggaaguaaaaagcacagaguacuuagaguacuugugucucccuuuccuuuagaacccugucaagggaaggggcugauucuugccaccuagccccccaaaaaacaauaccaggccacacucgauacaaagugcuugauuaacuucgcuguuaccagcaaccccagaaaaccacuaguaucuuauaaaaugauaagagcaaagcuaagcaguuaaaaacucagguugacuaauauauuuugaauguucaaaugcaugcacucauagccagcagcacaagguaaguuucuuccuaucaagguucaacuaaacuccagguuaaaauagaaaaucuguugaagaugaaacgguauuuugaaugguguuauuuguguaagagguauacaauuuagggggaaaaacauacaaugugacuuguggaaaacuagugacaagguucuggcauucaucaagaaaugcaauacauuguuuaguuuagcaagacuauuguagacuggagugucgaaagauauugagaaaaugcaaagcaggauugagccugaguugauaaggaucuauugcaaauaugcauccaugccucuggagcagcaucuauccacaaaggaggaaaauuaucugcuauuauucacaaaaauaaaauccagauagagaaaagauacaaaggggaaaggggaaauacuagacuuugguaugaaaauauaaauuauauguguauccauucauaacuuugauggucagauguuuucauaagauaucaaguuuuaugaacaucauaaaacauuuaaaaaaucaaguauuaaugaaaaacgaauggguuuggccauguuaaauuuuaauaguucugauagcuuaucaauuauuuuuaacuguuuuaggaagcuauuagguaauuucugcuagagguggaaagucacguauucuguaaucuacuacuucucaagguauaaauaugugucuacuacaugaucuuacuaaacuaggucauggggacuccacccucauaaauagauugcugcuaucucacagauaugggucaagucugacgggagugcauacuuuccuuaaaaggggguuguuguacguggaacgacacaugccccuguugguucucuugcuuccuuuuguaucauaugaacucucuuacccuuccacucccauacaugauggcauuggcuaugaggcuauaaacagaggccaagaugcuagugccuguuagaacagagaccuaagaagccugaucccccagccuaaagacaucagaccaugcaccuuguaccucucucccugggacagaaaaucaagcaacuauucuauguugaggacuaacaguagucacuaaucuguguugcugaccaccaccuggcucuuccaugcacuuugucacuuaucccaaacuaaaucgaaugauguaaaacuucuuacccgccauca

SEQ ID NO: 1800 - RNA, 24756 nt, Mus musculus
ccgcaccgcaagcacccggacugcacuucccagaggccugagcggcgcggccuugcgcgcccucgagcuuggcaccgcccaggccgcgagaccgcgccccaaccuggccgccgggcgcgcgccuggcugaagaaccuuuuuaagugggggcggaggccggauugcgauugcgaucgcgauggcgaaccugggcuaccugcugugcuuguuggguuugcuacuaugcgggcuuucaagucccgggauguccagacccuacaaccauggcuccgagaggcccaucaucgguaaggaggcuuggggcagguguugcggaccgguagucugcgaggcgcucuguuucucagcggugcagaccccgcggcgcgcuucucaucaaugggaccuuaugcugauguccuucuagagaccucugcaucuggaggaucgggaucccaaugaaggcucagcucuucgcuacuacuuggcacccaaagcagcuagaggcggucccguaacuuuuaggaaccacaguugaggcaaacccaggauuugagguuuccgugcgggaaaagaauuuuaaggacagucagugugaaccaagcuaggauguaucagaaguaggaagagaagagcucaaguuaagaaggaagcagaggagaaaucgugcuguggguuucucagagaagacuccaccucggcugaccuagugcucaauuucguaguucaagaaguuuccagaggaucucacucuuuauuccuguucucguaguccauaaugauaauuaagauuauaggacggcugcagaggugccuugaauaagauaagagcaaggagcuacuaguguugcacaagggguuaguaugugucuuuuacuguacaugaaguuuccagugaaauaucagaggaaauaacagagaagggagaaagaccuuaaaaauguuaguuuacucuugaguguuaacuggugagaggauuuagucagauuucagggugaugggugcuuuuccugaccuguguuuccaccauuuucccugccuuuccaaucccagaaauucugcacacagguaaaacuuacguuucuuugcuccaggacauacaugaagauacaacacacacacacacacacacacacacacacacacauacacacacacaugaaauagguaagaaacuaaaguguguccuggacuuggacuuugccauuuuuagcaucaaguaucaacaucgacuuugaggauuugaauauucauuuuaucucagccaaaucgugacauuguuucugucuggcauauuuauguuucaaucaggguaaaacugguuugcauucaugucagacauuugauagcauccaaggagaaaucagccuguaguuaaaguugacaaaagaaauuuauagguagacaaauguaggaauuugacauuuaucuuauuuuuuucuuccuugaaguugaacacuaaagagaaacuagaaacuuguuuuauguauucaggagugguccgguuuucaaguggguggcuuacuaauauuuggaacccuuccuucaaagcuauuuccauagauggguagauucuucaaguugagucauguaacauauguagugaauugcguuuguggaucuagcgaauagaaaaaaaaauuaaaagaugacaggagauuuuguuucuuagaauuuuggcaacucuaaguugcauauaacaaaagagagaaaguaugguuuuggcuaaccuaaucaauuauguuuuccuuuuauacuuagaguuuguguguauacaugugcacaugcaugugcaugcuucucacauacaccuauggaggucaaaagacaacuucaggagucaguuaucuuucuccacaugaguccuggggaucuaacucaggcccucagacucagcagcaagugccuuuaccuacugcuaaaugauggugaagccaccucuccaaucaauuaagauaauauugucgauugggcauguaauauggauacuuuauuacuguaggaaacacaaaguauucaaagacaaggaagccacagaaguggugaaauagccuaaaguguacaagccaucauuugggagcacauguugagaccagggcauacaaucugagcucuuugccuaggagugagguaaaaaaaugaaugggcugggguguguuguggaauuaauuuaguguugcaggcacuuauauucacauaauucugcaugccuuccuuguggcaccuccucuccugucugugucacucuuuucuaugauagcucuuguacucuucuauuuuuggccaaauuucacuuuccauugugaagaccaucuuaucugauaggagagaaacauuccuacuagauacauuuugacauuugauauucaguagugauucaugucaacuauuguaagaagcccagcguacaggugugauuaauauagaugauaggaguugugucccacugagacaguuaaacucacagaggcacagauauccaaaugagcaggcaugauaauuuuguuguuuguuuaaguuuuggaggcuagggauagaccuaaggccuugcacaugcuaagcauaugugacauguuuugaugaaugucaugugucaguaguguacuagacuuggguuucagugguaagaggagaucagagaugagugggacagagcaugacuucacagagccaauguagaaccacugagguaugugaggaacaugguagccuccaugcgucuguaauucucugcucuguuaccuguugucuucuuguuuucucuuacauguucccagucugauagacuucuugcagaguuacaggcuggcucaugaccuuugcaugguacuguuuccuuugcucugaaucgcucugcuuucagauaugggugugugguucacugccucaguccacugaugccuuugaauaaguguuaugucacaccuuccuagggagaaccuguuccaccucucugaagucuuguucuucuuucccagcgagaguugccacccuuuuacagagacauuguaaauggaacccauauuucauugacuucuuaacacaagcaccagcggucaucacuggcccuagaauuaaaucucuguuguuugucuuuaccacuuuccucucccacccacuagcaugagagccuauaaaguggagaguauuuuccuuauuacuguguccucggcaccuaguucagugucuggaaugcaaugcagccaguauucaaugagugagggaaugaugguggggccagccuuauucuguggaaacacugaaguaggaggcuuacuuuagagaggaaagagacguuuuaauaaucugggauggguuuggagaaugcugguugcuuagauagugagguuauuagaaagauggcgaucaaaguuguuugcacugcggcuuugcugacaaggauacaacuguggcuuuguggggaaagggauuugcccuuuauacauuuagugaguuguuuaugaauagucuuaauguugaaugaaaaauguuggggcuauuauaacuuacuuugggagcuucuuagauauucauugugugugguggguuggucugauauuacuuguauuguaaugcuaaauacaggucccuaaagccugauugccuccagagacagagagugcacauauagaccuaaguuaugcuaagugaccuugugcuccaaauuauuccugauaaagaugccuacagccuauagcugggcagaauugggauagauaaugcuugggguuccggagcuuggggguggugaagacgagaggaagguggagagacgagaagacuccauguggugagaaucauaaaaucauggccauuagagacauggaguuaagagcagcccagaugaaacauaguaaguaauaacucgggguuaucaguaggaaaguagauucuaauagcagagaggguagauauuuucccagcauuagugcugauaaaggcuuaugauaaauuaaaggucaaaugugccuuucaucuuggaacugaauaaucaaaggugacguagaagccacugauugagauuaaauauacuccacagcaauggugugauaagaaacucagaugguccuuccccaauacuuucccaacaacuguggguaaacuugcaggagcuguaggucuguacauugagaaacuaaaguagugacauuuuuacugugcugugauucaguguugaguaagaaauaaaagaauuugcuugaaacuaaagcuuuucuuuuaaauuuaggaguaguaaugcaagaauguuuugggaaaauggcgaaguugggaaacuacuacauugcugcauccuaugugaaguauauagagucugcaggugcacgaguugugcccauaagguaugcuugagugguuuucaccagggauguaaagacuggucuuuugucucuaaaauuaaugccuucuucuuuccuaugauuguaucauuaaaaggaguguuguugcaucugauuucagccacaaaccuauugccugcagucucccacuaaauuguuuacgaagcucucuguguguuuguaaugucauugauaguauucuauaugucuauuagcauugagaaaaauaugauagcuuccuuuaccccagaaaagacacuucucaugaacaccaugaaaauuauaaccgauucuccaacuuaucuagcuuuccaccuacuauuagcauaagggaauccucaaggaaugagggagacauuuuagaauauuacuguaauauacuuucacagcuaggaaaagcuugccaguagugacuguuuaguguugcugcaguguaagugauaggcauugcaguuuuaacugggugaagcgugggguuagagacauggcucagugguuaaguacacuugcugcuuuaucucucucucucucucucucucucucucucucucucucucucucucucucucacacacacacacacacacacacacacacacacacacuaauaaaaaacuuuauaaaggugcuuuauuuuauaauuauauggcucaguaaaaauaauaugauuaaucucauauuuuuuuggaggaauuauuucaccacagguuuucacuugaaaagaguuaauaaacaaaaaucuucuaagcacuuaaauuuucagcuaaaauuagugcaugagaaucucccagaucucucauauaaucuacuaugacauuuucagaacaaagcacaacuauuacaaccuauucugcaaguaauuacaaagacauucuuguacucuauauauuacuaguaaucaaaauguaaauauaguguagauaugaaaaauagucuucauguugagauucauaaggauugucuucuuucaccuuucaccuuugauuaaugacacauacccuuaaaauuaguauuuaauuuuuuaguaguaaucuaaucucaugugaaaccauacacucuaguuuuagcucugaggaagagaucucugcguggcugcagcacagugucucagauuuugaugauggaaguguuuaaaugcaagcuauuuaggaaguuagugugaauggggauaagacauuucagaauugccacaguugggcagcccaguucagaggccacuggaaaguucuggcuaugaaauagagagagagagugggugugacuuggagccgccauugugaguugcgagguagaugucuuuaaaaaucagugaagacgaucacucaucacaucuggguugcugagaaugcauuaagugggcaugauggacaguuguuagccuggggaguuuugaaaccuaaugaccuguggaauauuagcaucuaugacaagaugcugaaacccuggcuggcagccugcaggcuaaacuccagcuuugacuucaaaguucauuuugauauuaauugcuugaaguuggaaucaugugauccuguagaaaugguguaauauaugugagggaaauucuacauguaaaaugaggagacucucagcauuacuguuagguugcuagaccuucuuucugguucagaggagagaagaagauagaugagagaccugggcagaguucuacuguaggugaugcuugacuuuuuucauccugccuuuuuucuuuuucuuuucuuuuccuuuuuuuuuuuuuuuuuuuuuuuuuuuuuuuuuuuuuuuuuugguuuuucaagacaggguuucucuguguagcccuggcuguccuggaacucacuuuguagagccggcuggccucgaacucagaaauccgccugccucugccuccugagugcugggauuaaaagcaugcgccaccaugcccggcucauccugccuuuucugaugacauucuuucccagaacuuggugcuuuggaguugccucuuaguauggagagguauuguuaaagcaugcagucucaaguggugcagaaccuacuuguuaagcugguucagagcuuuguggcgugcugcucauccugaucgauggggaagaucuugccauugcugggacaaccugaagaacuuggauuggcaggauaccgagaauauguguacuuacaauucaucuuaguacucugaggccaagucaccugucacauuaauaguucuauagcugucucacugacuacuuuguggcucugaucccgaaagaagauuacuauggcuuucugaauaaccuauguggauuucagagcuuacugggacuugguggagagucagagaaguucacugccagaacuaggcaagggcuaggaauuacagcucacuuaguaacaacaggaggcauguucuaaaucaaccuauguccacguauaucuuuuuccuggggcagaaauggaguauauucuacuaaugacuauacaaguuuauggaugugucuauggggagagagugugugccuugcugguguuuuauagaaacaaaaaaaucugcucaguguaggagaguuacugcaggauucacacacacuuuuauagacaucacaggaugauugcaaggucguagccaguugucauggauuagcuccuuuggauuuucucuggggcaaagagaucagaccuucaguaacauggcaguagcuagaacucuugucaaggugcuugaucaaggaugcuucagaguacuugagcccagcugucucugaggagauugcccuuaggccuggauuauucuagauuuuaugugcaguagucagaccuuugcugcugguuggaagggaugagauguugggauuugguguccauucguauauguuuccauuuucccaagcugccugugguaagaugggugugauaguaaagcuuuuuaaaaagauggauguuucugagugugugccgguacccacugaggccaaaguguguguaugaucuccugaagcugauguggggacaccugcagugguaaucucuggacacuaguauuaucugcuagcaagaacuauaaacugcuaaacuaucucuccugccccacagagcuuuauauuuuuugucuuuauaaaaaaaacaggugaauauuuauaaguuucuuggcuaacagauaauacuaguguccacuguuuauuauauuagcauccacuuuaaaauauugaauuucauucaguuccccaaaaaacagauucaccuuucugauuagccaaauauaguauaauuuugugauuuuuguagcuuaacaagaauaccucuaagguagagauguacuauugucugauauuuaggcaggaguguuguagcacuugcccugaauggacagagucuugaguucaauaugcaguaccucaaacaacuuauuuuucauuuaauguuaaaauaaaugaugugguggcuucuauugaauguuaacuuuuuccuuaggcuucagaacugauuuucuuguaaaauucauuuuccuguuuucaggcccgaucuuagugaugcagaguaugaagaacuuuuuagaucuauuaauggguaaguaggcuugauguugcaucaaaucuuaaaacaauguguuuauguguacauaucaacguuuugcaaaauuuacauauaaguauucuguguuucuauagagcuuccuuaaaaguugucugauaauaauuucccaaguguauuuguugaaauguuuugaagggagauguaaagacccaguaaagagugggaagaggacaugaucuggggguuuaagccuguacugcaaauccagggaagagagcagacaguucaccagccugagaaagaaagaaaagagagcugagcgugcaccucagugguagagccuaguuuucaugaggcucuuucuugguucaguccugcuauacaauaggaugcaaaauaggaaauauguaauuguuauaugauaggcucacuauuuuuagcuuaaucuuuguuuaaaugcuuaaauauuuugaaauuuccaagucucuaggucugaaguuacagauuguuuaucuuucagagguaauuugaaacaaacuuagaaaacaauuucuucucuguuucuccuuaaaauaugugaguaguuagagugcagaaugagauuggaaaucacaugaaaaauucccuuuauugcucguaacuuaaaguacaauuaauuauagaaaucaugaaucaaguuggcagaagugagaaaacguguuaauacucuguaaaggggauagggcgggggacaagacucucacuguggguguuagaaugaaccaaucuuugaggcucuucuucaguaacuagugcaauuagaaagacaugugcucuaugacugggaacuugaaaauuuaucuaauaaauaaauauuuguacagaguuauguaaagacuugcacauaacauaggcauugucccaaaaguucuaaacuguugaaguugcuuuggagguggagguggagguggaggugggaggugugggaggcaugggagaggugggagaggugggggagaggugggggagaggugggggagaggugggggagagguggaggagagguggaggagagguggaggagagagguggaggagauagagagguggaggugggagggagguggagagguggagguagaaggaauuaguucagugggauaauuauguauguuuaauagaaccuuaugcagggauuucaaacugaagauauuuguagauguuguuuugaaacacgacucuuguguuaacaguguuaacaaaaccugcuguuuaccaguguguuucuguuaucagcacagcagauguugguagucccuacacuuuauuggaaguaggguagaaaauuaugugggagaacacuaccagaugaaguguggagccugcccuaagggagacugucuucuuggagaauuaguccacuuuuacuguguaaaagagcuguaguauuccauagaccagacuuggucagagguggguuuuaaaagacugaguuaacuggggacugaaggggaccuguuaauugguccccuuaagucacacauggcuuucugcugugacuuugugguagcugauuuagcagaugaguguuuaaaccuuucccacuugacugugaguuuccuaacaauggaaacuagcauugucacaggcugauacaaagccugauucauagaagaaucaggguguaauucuuaaauaaacaauagccucuggcuggaaagauaccuccagaugcgcuugccacacaagccuggugaguugaguuccaucuccauauccacaugagaagagagaucaugugugcuuccucucucucucucucucucucucucucucucucucucucucccucccucccucccuccuucccucccuccuucccucccuccuucccuccuuccuuuccucccugccuuccugucucucacauacacacaucacacauacaucacaugcaaauuaaaaaaauauauucucaguauaauauggcaaagucauuuuauauuuucagaauauuaauauguuaaaagucuaacuuuuaaaaguagccagagaagccagaauacuuuugcauauccuugcuuauuucaagauguguuaaagagcuuauauauuuaacaucauuccaaaacccuaauauaaaaacaugguacauuuuuuucuccuaaauuucaucuuuuugggguagaauaaaagagaaccuaauauuugggacuccaaaaaaaaaaaaacugucuagaauaauucuguugauuuuucaggauuccuaauauuguguuucuuauuaagaaauaucaagacuauuaugauaucuuguagauauuuaauccuaguagaaauaauuaugauuauuaugugcuuuuuaauuuuacauauaauuuuggaguuagaauagcuguauauuuacaguugacuuggccuugcugaucaccuuaauucaaagccagcuauucuuggaguuuugucucuucauacucuuuagucuuucucccccuaacccuuuaugccuuugguuuguucaugcuauauuuccuucagugagcuuguaaaaaaauuucauugaaaaaguuuuaagauaauauguguaaaauucuuauccgcaguaguuucugaaagucuagaauuauaaauauuauauauguauacaugaguauauauacacacauauauauacauauacauauauguauauauauguguguauauauauauacacaucuuagauauauaucuaagauauauaucuuauauauauaaauauauauauuuauauauauaucuuacugguaauauaauaaggaaaaaguucuuuaagugaagaauguguauugacuuggugaauggaggaaaauacaucuuaauugauuuuguuucagaguucuccuuccuggaggaggugcuaaccuaacagauucagguuauucccgaguggccaaaauauuuuucagcaaggcucuagagguaaauaucuccuauuucucauuacuccccaugggguugucuaucuccauaaggacaauucucuuuuuguaaguguacaguauuaauuucuucauaguuauucuaguauauagucggacaccugcucugcaggagucagguguuuacucaccggcuguuuuuuuguuucaugugcucuggggauuuuugguguggagcucacccucauagcucaguaaagcuugugccucccucuggccuguuauacacucggcauuguuccuuugauacuaacucuccuccuuucaguucuccauccagccucauucucucagccgcccucuaacacgagacacagcuauugcuagugagcuuuuauucugagccaaauacaacugaaagacacgagucuuucauacucuucauacucaacagaacaaaaaggaaguaucaaaaauacuuuaccagguggaugagaacaucacaugacacauuaugguagaguggacagauuacguaugggaauuucaggugcuaguguacaaaauauuuaguuuuaggguugccagaagccagaaguuugcuaagcucagcaaugcauuugaaaaaguugcaccaaguaguaguagccauguccggucagacacagacguugguaauaaauggcuauuaaaacagacugaagauagcucgagagaauucaggcucuaucuauaguaugauguuacuucaugggcacaaaguucuagucagucaggccauagacucuuccagacagauguggcaucuucagaacacuucagcucauauaccuuagccuuugucuguuuaucacacacagugcccagcuacuauacaaugccucagcuggguccacccauagcguuuuugguccuuguuucuccccugaaaucuugauaucaauuuucauuuauuguuccuggcacucagaucuugucagucucccuuaaauguuuucuucaguaauuacuuuuuuuggagauacuugcuuaauaacuuuuaaguuaaaaugcauaacucaugggccuuugggucaagacauagugugcccacaacucuccuuuuucuauuccaccugggaguuuuugugaauacagauuaagugguagccugcugaugauuuccagagaauucugaagaaaacuguguagcaguaaugucucugucucucugucuugcucugucucucucucugucucucugucacucucugucucucucugucugucucucucucucucucucucucucucucucucucucucucucucccucucuuugaaucaacguaauuuucucuuucauucucccaaagagcuuugauaauggagaccauuuuccuguguggggaacaugccuuggauuugaggagcuuucuguccugguuaguggagagaacuuacuaacgaguacagacacuaagucaaagaaauugcccuugaacuucacugaagguaagaauaagcaccaacucuuucaaauuauuuuucagcagcauuaguaaauacugaauaucaagacaggaauugccauuagucuuugaauuauuuaaagaccaaaacuaugagugagcccuuuguuauucauuugugaggaugauaguauuuguguuugaucuaguuuuucuuaauauuuguguuugauauguauucuaguggucucaggaucauaugguaagaauucacaaaccaguucugguuuugaguucuaacuuucucacuuuggucuuggagaaucauucugucuuucuuaguuuuucacuauaaaaguuucuaccgcugggaaugcuuucugagaauuaaucaagaugauuuccaguuuguauguauaguacuuuaaauauagaucguauaaguaucaaguauuauugcuaucaugccaguauuuucuccuuccuuccuuccuuccuuccuuccuuccuuccuuccuuccuuccuuccuuccuuccuuccuuccuuccuuuuuuuuuuagauuuauuuauuguuauaucuaaguacacuguagcugucuucagaugcauuggaagagagcaucagaucucauuacggaugguugugagccagcaugugguugcugggauuucaacucaggaccuucgaaagagcagucagugcucuuaaccacugagccaucucuccagccaccgguauuuucucaucguugacacauguuguuucugucuugaguauuuuauauuacagauuuuuucuggcacuaaacucuuggacauaaugagaccucacaaauuaaagggcuugaugucaaaugacaccacuguauuuguguccaacugaaggccagucaccuggucccaccaguguucuugcuaccugcuguaccuuugcaaauaccuaugacauggcugucauguuuuauaauucacuacucaaaacuuuuacuaaucaacuuuuguugcucaaaggcaaagaaagaccccuuguauuugcuuaccaucuuggagcuuccaugagcuuggguuccuagaguuucagagauuuuauuggcauuuccuugcaacacaugauugagucauugaucauuuggcugaguucagucuccugugccucuuccacuuccugaggucgggcugcuucaaaguccucuaaucacaugaguagucuuucugguaaucagcccauucugagguaauguaaggguuagcagugaaucauuucauuaucauaauacacuucuaucaggaaauaucagugccuuaagaagcucuuaguuggaaaucuaaaagaaauuccauauaaagucuagaucaucauaauuaggugcuaccaacuauugauauucuuauuaacgauuuugggagggaagaauagugaucagucauaguauucauaggauauuccauacuuucagaaaucuuguuuucucagucacugagaaaaccuuaugggaaguauuuauuuuuggucagaguuuugggguugcuauauaacaaaagcccaguuucuacaacaaagcaguuaugcaagguacccacugaagccguuagcaagacuagaggccugacuuagcaucagaaccuuaaaccugucagguuuguguuuucauuccucuguugguauuccagucugcguaccugacuacagcccccuuggccucuuccauucccagagguugggcuccuugaaacacauggauaaucuuucugguaaucagaacccuuuccgaggugauccacaaaucaacacugcccucucuaucuguuugcagcauagaucuuuucuuuaacuuaguuaaugaucuuuucuccuuaguuggcauaauuaaccuuuccucaguugauuaaacauauucuuugucagccuuguacauggauauaauauauucauacucaacacccucucuuauuucuuuuuucgaccucuuccccacuaacaagccuccucccuacacaugccuuucuuccuuuaugccuuuuuuauuuuuguuuugugacucacugaccuuuaacuagguuuccuugugugaccauggguuuugaaaagcguuucacauuucuucuguuuucucauuuuuuacauccuuuccuucuucccuucuucuucacugcuaacccuuacauuaccucagaaugggcugauuaccagaaagacuaaucaugugaugagccaugggucuacauucauugucauucacugcaaagagaaacuacucuaacuaggagagguuagcauuuagguauaaacacauauuuagaaugaggcuuggcaccaugucaguuuagcuaaacaauaguggugcuuuccacgucagggcccaugaucuuccuucccauuuuagggcccaugaccaucccaaaauucauguuggcccaaccuuaggcauuuguguggaaacaugcuuugcuuaccauuuacuuugauaauaauguuaauaaugccugcuguuugacuggagguaagugccauaguggguuuuauuuucuucaugcguuuaaauuauuucucuguucuuaaauuguuuuagguacuaaauuaugucugcuaaauuagggauuucuugguggguuucauagcccacuguauauauucuuuuaacagagaggaguugccuuauuuccauaacagucaugcugcuguuaaaacaaggugcacaucuggcuuucuagguuggcauuuagguuuguagguccacagcugggugagaccacgguugccuuuucucccucagcauagcacuuucuggcaguaugcacgcuaaccagcaugaagaaagccucuaccucaguuccagcuugaucuuguaccccagaugugugguguccucagcaacagagucuuaucaucuaguucuguggggcaacuaagaggaauggcaagagcuuauauuguuuuaggaguccuauuggccucccugaacagcaguuacaagguugugucccacaccuagcacagggauuuauaggagcaguauuaccuaaucauguagaguaccucuuuuuaaaguauauauccauauacacaaacauacaugcuuguguauauggauauauguuuuaaagaauauuuguauuuguguaugugugugugugcacgcacaugccaaaagagggaguaggauuccaugaagcuguaguuaaagggguuuugagccugcuagacaugguugcugggaauugaacuugaauccucuugaaagagaagcaagugcucuuaacugaggacccaucuuuccagcccuguaacuuacaaauuguaguugacuuacaaaauaauagguucucauagagccuuucauuuugguuaaucugcccuaaaugcccucuccuuuaaagucuuauauaccuuugaaaauacauuggaaauauuaauguccuuuucugggagcauagacuuauauauuugggaauucuuauuuuucagaggcgucugaggaagccagaguuaagauucucugcucuuccauggauagccuauuuguggucauucuauuaaaaaucuaaaaagagguaauuacaucuggagcauaucuuauuugccuccauguuagagcugccuuugucaggcuauagguacuugucuggaagccaguggagauaugcuuugcccccauucacucacauugaauauuggcugcuauuuggccaaagguaagugacuuggugggcuuuaucuuuuauuuauuuauuucauguguugaagucuuuuuuuuucugugcuuaaauuauucuaggugcaaggaagagcagaauguucaaacauuuuccuacugaauuauuggauucauuagcauuagaaaaucugaccgcaaauuuucacaaauggagccucucugugaagguaucacaugacuacgcaaucaguaucucccagugagaugaauccaaucaggcuaacuacagaaucaaacccucuguuuuguuuuuguauuuuagaauuuuacagaaaaugaaaaguuaaagaaguuuuucaauauauuaacaaccaauacagauggcaaaacugaguucauuucauccauggaagguauguauagcuauagagcaacuaagcuuuaauuuucucauuuuaaucuuauagaucucuuuucuuguuagugacaucaugucacuuuggagcucagaaguaggguuauuuuugaagagagaagacacauucuguucauaucccaaaucagugcaggcuuaccuggguaguuuugggaaccgggccaauaaugaagaaaacugagaaucaaggaagggugagaaaaccaccccauuucuagaguuaucacagaucaagugccuuguuuauuuuuucagauguucugaaagauggguugauagaggagaacgucuuucuagaucuguuagcuagguggcaagacaauaagcacauuaaagccugaaauccuaaggguauaggaugcacauuauugucgguccagugcaagagagaaagcccauauaucaaaaggacaccagggagcacggcugcaggcuguacuugccugcaagguuaagcucaaaaacgcuuggaauccugauguggaacuuugagaagaauugcuugccugaccaugcuaaggacagagggugaugaagguggagugagugagccuuaagcccucagagugacagaauggucuaguguggccuacauuguccuaguugggaauguagucagagggcggguugaaugcuuaacccguguuugcuauguacaugaaaagguuucauguacgcaguagcacacaugugcagggcagaagcaaaucagaaugcuugucuaggaaagggcaagcaucguucugucucugcuucaggauauuucuuuggaugacauuugaugggauaugagugguucaggucucagauaacguacaaggaaaggaggcaaaguaucacaugugggaaguuggagaaacagcagccaggccugcucagacuucugcuauuaagcauuaugacauuauaccauaaguuacaaagaaauaaggaauauuugaaaauaaaucucuacggcuagguagaauggcacucaccuuuaaugccagcgcucuagaggcagaaccaggcagauugaacuccugagcuccaggacagccagggcuacacaaagaaacccugucucagggggcuggggagcagaaaagagacucgacaaggacuaccuuugcuuacugaaaacgaaagaaguucaaacggcaucucagaagagagguuaauccuaagacacaaagagagaaugaaguagcauagacgggagauagaucuagaggaaacauuccgaguccgucuuagguggcugcccagaggugggaaucuggaggccagggguaagguauuccaacaccagacugggcucugggaaccaaggaggaaggggucagagacauuuuuuuuucaauguuaaaaagagauauuugaguggauaaaagacuuaacuggaaagguaaagaaaggccuuagagaaauaaaggagaaagucugugaucuuggguaagggaaguuuucaagacauaaaaaaauauaauucauaacuguaaagacugaggaauuuggcugaauuuguagguuauauuaagagagagggaggagagaaaauauauauauuuauaaugcauauagcugcaaauaguccauguuuagaagaaguaauaagguuuaaauaacagccuuuauauuaauaaagauuuaaauaauagcuuuuuuuaaauagcuaggagcucugacuagaugccuuggagagugcacaccaguguguuguccacacaugguggauugagggaauuugucagugugagcacucacuaguggaaugcaauggaagcucaggaaggaauccauuuuacaucaggacugacaggguuaagaccaaggacuacaagcaccagccagguuguugcucugggcacauucagccaguucagucacugugagagugccugguagccuuugccuuuucucggugaagcugaaugguuuccaguccuguuaaccagcagucucaauauuuaaacauucccuagcaaagcugcauaugguggcacacacccuuauuuuaacacaugggaggcugggacuaguuaggccagggcuauauaguaagacggucacaaaauccaaaaccaagauaaaacaaaaguaauaucaauaaaaccacuucaaugaaccuagcuagaaauguacauauaauuaugccuauuagcaaaaagagagguuguuaaaagcaagccaaguaccucacaauacaaggagugaaucauauaacggaauacuaugcaguuauucaaaucacugcgcguaccuguguuccucauucuggauggacuuugaaaaacaauuuugaguuaaaaaacaacauaaagaaguauaaugaaauauauaucacauuuuguuuguguuuugagauaacuucccuucgugguggaagccuagaaagucauuauccaaggcuggccuccagccuguaguagucuuccaguuucagcuugccaagcuccgaucacagucgugugucaguguuuccuccuacauaguuacacauaguuuuccuuucuacgaucuuacaaaaugaugcaaagacaacacacacucucucuugaugguaacgugaaggaaacauuaaggggaugaacaauuuauuaugguaguuacuguccagaaaaggagauuugccaguaucagucacacuugauguuucaguguuuguggugcauaauaaggaaccauauuguuuuuacauuuguucaaauaaaugauucacccaggacccccaagacaugucauuuuauagacuuuguguucugucccucagaacauccaugacuggaugacuguaaacuuagaugggaccaucuagaagcaaaggcugauggaggaggcggagcuggaaucaggaagggacccagagacagaagauacuuucucugcuuucucagguagacucuuggauuugaugaagcugaagagagcaaccugagaggacagaggccuagcaaggaguaacccauaauaagguggggauagggauugguacuuggagauugugacuuaguucauucuauguugcuguaacugagucucugaaaccaaaucauccaaaaauaaggauuaaucuaaguguucuggagguugguggguccuugaacaucguguuaagaucugguaaggaccuucuggcuauauguagcaucccugagugagaugcucgaucaguuuuccuucuuacggggacacugauacugucauggucucaucuuuccaaccucuucuaaucugaauuccuaagguuacacuuccauguaccauuaacaugauuuaggaguuaacuuuccaaccuccaaaucugaggaccacuccuaaaccauagcacauuggucaaguuagugagguagaaagaaauauaugcaggaaauucugagaagaacuggucagcccaggaugaaguagaguuaucuuuguacccaguugcuagaguuaccaccuucgaaacacccugcaguagaaaccugcaauccauguuggcuucccugccucauuaucuacuucuaaaaaccuuucaccaauucuuucaucccaggucuaacuuguguaugcuuucuucucucuacccagaccccuccuaauugcccauaagucaucuuccagcuacacauggaaucucacaaagaaaccaaucugauugugcugcccaaacaaaacucaguagcucuucacuaugggagggcaaagccagauuuaccugaucauuguagucugugcucucugcugcuuucccugcagaauggucuuuugagaugugugcaucccacuggugcccuccacagaccagugcuugucaccucucuuuccucccauguuucucauguccucuggugagcucucaacuacauugaaagacucaagcuagaugucucaucuuugagaagccuucaucuuucuuuguauguuugcgucauguuccuugggaauguugcuuuuugcuugaauuuguucaaacuccaacuuucucucucaacuggagccuauugagggcuggcauuugucuuacuuuccuuuuuauagggcuuuggggaaacuagagguagugaaugaaugaaugacugcuuaagcaauaguguuggguuggaagauuucgguucuuuguuguuuauuucugacuauguuaucauguaaacauuuuagagccugaaaauguuauacauacauauauauguauauauacagacauauauauacauauauucagacauauauucacacauuuacauguauauauguauguguguauauauauauauacacacacauauacauacauauauauauacauauauauauauauucacacacauacacacauagacauacauauauauagacaggcauauauguuaggagcauauauaauauaugugcacuagggacccuugaugcucuacuacuuguguauuuucuuuucacucuugaugaucucguucuaacccagugauugagguuaucauuucuacaguuguaaagaagugccauugaucuuuuaagaagaguuuucuaaagaguaagccuuacuuguuucugaacaucagcaucugcuugccugugugugucugauuaugaaauaaauccucaucuagacauuuuuauccucagccaugcuuuugccugugggccaucccaggcugcagaaagacaaugcuacaaccugagagggagagggaggcagagggaggugaggagcucugugucuggagcugcuggcugguaggcgcugcuuccuguggacgccaagaagacugggaugaggagcuggcuuucuggcaagcugcuguuacaguggaacagcuagugaguggggugugagaagacaguccuucccccugugcccuccaagggcuuucugggagcauucauggucuccagucuaaaacguugagggugggagugcuuucucuuaagaugaggagagacacaugugaauaaaaauagacuugcucauuuucagagauguauauauccacucuucuaaaacauugugcagcuuuuauagcaugugagaaaaauaagggacuaauauauuaaacuuucuaaguucuaaccaaucaguaagcaaaugaucacucuuuuauacaaguuucucccaaaacugaguuauuuuuuccaucuaauucuagagauuaaauaauuuaccuagcuaacaguauguauacuaucugaguucuaaaaauaacuaaauuauaauuaccaaggguacaaauguuuuuuaaagcguuagcacuuauuuuagcaauuauuauucuaaagucacaaaucauucauuccaucggcugggaccuagaugauuaguuuucauuuucccuaagucuucaugggaggaaacuuguaugaagagagguaaaauacagauauagaaaugugugucaucaacuuaguguguccuuaggccugaagauauaaaucaguggaagaauguuuacuuagcaugggcguguuccuaguuugauucacagacaacagaaacuauucacuuggcuguugacuggaauguauccccagcccagacuuuacucugauuuccuggaaguguagcucccauucauuuuuuaggaguguauaugugggugagguacacuauuggguauuuuaaugcugacugugagccauccuuucugugagagaauauuuacaaccuuuacauuuuccaauuuggaugaguugaaacauguuuuuaugucacaugcauggcaugaaacaauggacaguaucauccuaagacauucuuuuuguuuaauggugcaugcucuccacccaggauuuaaguauccaguguaugcuguccaguggcauccugagaaagcagcauuugaguggaagaaucugggcggcauuucucaugcaccaaaugcugugaagacuucauucuacuuagcagaauuuuuaguuucugaagguaauauaugggcguauaauugauucaucacuccauuauaauuuugagggaaagugcauacccuugccuuagcuucuguauacuuuuuuuauucuauaaauguucuuuaaggucuuuagauuuaacugaaaaguacuaaguaaugguacauucuugaaauugagauaguagcuauucaagaaaaaucagagcaauuauuuaauagagucaucugugauccagugggcugauuuuuugagcaauaauuuaaagaauguguaguuucuagucaaguaugguggcacaugccuuuaauuccagcauucagaagguugaggcaggcagaucuaugaguuugaggccagccuggucuaugaagagaguccaggacagcuagggcuauuucaaagagaaacccggucuuggaaaaaaaaauuuggauguggaauucuuucuucuuucuccuugaguacuuucaauuuugauuuucaggaacaaugauguaauuauaacaaccucugaguauuauauuuuuccaagacaaugauauaaauuaaauuauauucuaucacagugcauuaugauuauuugucuucagcauugggauacuagggaaaaguuaauaacuuuugucugauugcugcugacaauacagauuuccaugcuauuuauuauugugguugaauagagaguuugaguguagguauuuauaucuuaguugagggagguggguaagagcaguagaggcaacgugcaagggacagagcagcagcauuuaggugagguguggcuaauugaagacaugaugaaccuagaguuuaucuuagcuccagcuuucccuguguuuuuugucuaccuucuugcccauauuaggaagccaccauccuccuaucuguuucauuuguguuugaaauuauuacuaguugaauggaagaauuacugaaaaaaaaucuaaauaaguuuuaaacagcaaauccaucccaugugcaaugcugguccugagcagcauuucccuguggguggaaugaguagcuacagugggcagaagagccuuugcugcagcuuucauuuuuuggugguuguugggucugugugugccaacauucccaaucaaaaaucagaggccuuacuuuugacuugcucucaaaaguuagcucucaccauguacagacuacucauuggcuuucuggauugacuaauccugccuuguuuccuucacuggcauucacuuuaguuucucugcccccuuaacucauucaccaucucaguugcagguguacuauggagauaguccaccauuuaagucugcauguccgcuaggcuguguuucuccugugaugggucagugucccaucucuacuuucaucgcagggcuguaacaaguuuugugcacauuuagccuuauaaugaauuauacugaauuaggggugaauuagcuacagcaacaguagcaacugugcucacauuggcacugcuguauuagagaggagaugcuuugaggccuuuccguccuugcccaugcuuccccagugaguaauucugaccucaggaagcacuauuacaaagcagucucgugagcucuuguccaccagccuuuacaaaugaauauuguuuucucuuguagcucggaagaacagucaccacuuugagaacgugguuaaggagacggcauccuugauuuacaaguucaauccaauuuauacuggaaauauuucuucauuucagcaagcuuauauguuugacugaaauucuucaauaugguaacccagcagcuuugaguaauucugugauugaauugcuaacacagcucagggcaguaugagaaagccacacagauaucuuugcugugugccugguucugauuccuggcuuaauacaugauuguuuuuaucagauuugauaaccugacaaugaaaaauauaaaaaaucagaguguuuuucaugaaaaugccuucuuaugucugaagauucuaaaauacaaguuuuugaaaauauacuuugucugugauuauuggcucaaggaggaaaagcuaucccaaaucuacccaaauuaauuuugcaaaaguuuuuuugaguuauaccuccagguaccuauuaugucuucauuugggugucaggaguaugugugcauguguguguguuuauaaaguuauguaaauguuuuucuuuuggcuuuguuuauguucaugauuaauauacugaaaucaaagucuguuuuauuucacuuuuaucugccacauguaacuagacuuucaagaaauucuaguggcuucuuguaaaaugagcauuuucccuauguaaauuaauugaaaaacauuuauacccuuauuucugguuguuugcucgacuuccuguggccccuuccuauccuauauacuuccucaaaagucuggagcagagcuguugcuugggaccuguaagcagcuagauuuuuuuuuccccuuccagguuuguuuuguuuuuuuaauuuaguuauguugaugauuguuggaauccacugacaugggugcuugaaauugaccuugggcccucugucugcaagagcaguucacguucuugacugccaauccauugcuucagccccagaaauagaguauuugguuugugucuaauaaauggugcuuauaacugguucu

SEQ ID NO: 1801 - RNA, 8699 nt, Mus musculus
agccauucagaggccucgauuaugcagggggcugagggaaccacuccaugugacccucucgggugggacucugcagcugcuucacagcgcaacucucucaccaaacuccgcgcccuugcgcucgcagugccaaaaggcgcccgcccggauugaaaaggcgcagugcaugcccgcccacgucacuccgcggacagaagacgcacgucggggugcgggucccuccucugcaugcggcugcuccugguucugucacuugcgccccguggaggaccccgcgagccccagcgucugccuggcggcgguggcaacaaugcacggaacuucucgcacuucggccaccagcgugaacgcugacugcugcaucccggcuggcuugcgccuugggccggugccuggcaccuucaagcugggcaaguaccugucagaucgcagggaaccagggcccaagaaaaagguacugggccauucuggaucuccgucccuugccucucaccuccuauuucccugauccagaaaaagggguagagacgagcagcagagaaaagggauaccugauaaaucugcaggacagaauuaucugauuauccuuagcaagucugauaacugagcuggacguggggccggcuaacgggagggcagagcuaagcuggaacagaccuuagugcgccagggucuguagguauggggggccucugggaaccggugauuucucagcgcuccaggauguccucagcaaggugauggagacuccuagcucccaccucagucuuugccuuccuugcaaagguaccauuuucguuguagucauaggacggagaggacuuuucuccucuucucuuuacuaauaugaagcuuacauuuuuguuuuaaacaauuuaauuccauuucaccgaagagauaguccuugggaggcucuuagaucugggaauauauccccacucaaaccccuuuugcuuguagguuuguguaggagauggagaggggaugagcaaggugauuaauuuugaugucuguugagagguaggggagcccacccucgaaagaacaccuaguuaaaccuuguggcuggcucuuagagucugaggccccagguacaacucucccacucugaccccccuaaccucaacacacccccaggaucccugaccagagagggaaaguaaagacucuugaucgcagcgggugggguggggggcgcuuuaguagccaaggacuggcagacagcaaccagggaaugaaauggaacgcuuguuuaaaagagaaagaccuugguuuuaguaaccuccuagagcuuucuuauaagaaguaucuuucauaggaggagcagggccagcaucuuucuccggugcuagaaagcccggugucucucaucccaggcaacaccggguuuugaagcucaccacgccucucucuuuaaacgcaauuuaauugcuuuuaaauggccugcuagcugcaggcaaaauuucuccgugcucgcuuuguucugagcaucucacugcugaguucacuugcagccuaguacgguacuagagaaucgggaggcugagaaacaggguaggaguacugcaucaggcuucaggaccugcuugaacuuagaaaccacuucucucucaguguuaaggaucccagaacaucacuuagggaagagcuggugaguuuugcaauaagaugcauccuggagcucugagaggacgcuuuuuccagcugguguuuccaaggugugugugugugugugugugugugugugugugugugugugugugcugcuguuguuguuguuguugguggugguggugauacugucuacuauccagacuccuuuauuuuuccacucucuaagcuggggcccugagcagcuacuagaggcugggucaaagagaacacaucugcuuuccugagcuccgugggcuguaggauaaacuuuccucugagcugugagccuggcuguggcacauuggguaaugaccacugcuuguauugcaggugcgcauggugagaggggagcugguggacgagucagggggcuccccucuggaguggauaggguuaauccgggcagccaggaauccccaggaacagacucuggaagcuauugcagacuuaccaggaggacagguacugucagagccccucauuguuauuaauuccaguuucaucuacuaauggucccuaaggcagccaagcauuucaugagcaaagaacuuugaaaggcaagaauucucuccucaacaucccaaugaccuuguaaggaagauacuuuugcuuugucauuuaaaagaugaaggaugagauuccaaguuauccagcagcaucuccaggaucacaguaccagucuuuuaaucuuuauucccagucauccaggaaauaacacagcaccuuauuuauuuauuuauuuauuuauuuauuuauuuauuuuuguauccuagaucuucuaucgggcauugcgagacguccagccuggggaagagcugacugugugguauucuaacuccuuggcucagugguuugacaucccuacaacugcgacuccaacgcaugaugagaaagguacugcucugaggucuccccaacagcgagggugagcaagaguagaguccaguucuccuggauuguggaaggugaacacaggccugaagaaucuuucuguuuagcuuuguggaaacugaauucaugcucuugacaagggagagagggaacugcuagccuagagcucauaagcgaaugguaauaaaaguaguaaucugguccccauggcagaggaauacuccuuacaaacuucauggguccuuccuguccuauuucauuccgaaugacaaguauuuacucacuuaagacacaauaaagaagauuugauaugcuacaacaacuacauccugaauucuagacaccaaaguuacaaggauuacaucuugaauucuagagaccaaagcuuaaacguagaaugcuuuuuaaaaggcacaaggguacucuuucucuguaaguuuuucaggagagcaguguauucgauggcauuuagaagcauuauagagcuuacagcuggucccuuggcagguacuaacauccuuccuugaaauggaauuuauucauuucuguuuaagucuacuuaaacagaaucugggaugucucccaguuucuucucagauuuauuugauuccuuucaagccaagagccaauccaugcaaauuaaggcgcagcaacgaaaaggaaaaucauuucaaccccuccacacagcacugaaggucauuuccuguggaaagaaggcugggaagagcugaaagacuuaaggucuugaaaguccacucccacccuucacaaggcaucgccuguccugauccccaaccccuugagaguuguuugagcauguucauuauuucuccaaagaggcuauuuauuuauagacaacaaaaaacguuccaaaguauuuuaauaaaucuccuccggaacugcugugccacggccuccauuuagaagcagguauauacugauaaaagugugguaauuagcaaacacuacaugcgcgggacacauuauucacagcaaugagucauuucacuucacagugucacuguccucugcaaaucaauucuauuuguuuaaaaauagauugguauguccaauauuuauaagaauuauacugauauuguuuguucccugaaccacauucagauucuucugucaauaauaaguacugcuguccuagggggaacucucagacuugaaacuccacaacaaauuguuccagcacagaacacuuucacauaggaaugacuaaacagaaaagcaacguguuuaaucauguauucuauuucagccaacugguuuuauaaaugccauaagccaaaugauaauaacaaauuuauaauuuuuccuguuagggaagguacauuguaccuugaaccugauauuuucuagacugggcaugccuaaaaucuuuaaaauuacaugaagagggaggaacaaagucauuuaugaagcguguuuggcucacuuggcaagaguugaaccuuagggucugcaaaaccuguugaugaaguuaaguuggaaaaguaauauguggaauaacacacacacacacacacacacacacacacacagagagagagagagagagagagagagagagagagagagagagagagagagaagcacauauggacacacuuuuguuacauuuugagaagaggaagaaauaaguaggaauaucaccuguuuuaacaaugcuggcuaacuuaaguuaguuucauuucauagaaagauuuuuacugcuccuucauuuuuaagaacacagcuuacuuggcuuugcauuggcagagucacuccggaacaaacagaaaacucuugaagaacugcuacaaaagaccuuaugaauuucagacacccccccccccccaaaaaaaaaaaaacuaaggggucacuucucuuuccaagaguuguuuuaguaaaacaucuuuucuacauaaaauccugcuuuucauaggcagcaggaauauugagaugguuuugccuaagucuucaaccaacaacugagauagacuguuauagauaaauccuuaucuccgcauuucucccaggucuccuuugaccucuuguggaauaaacuccgcccaccccuccuugagcuuguuacguagccccggcuggucuggaacucacuauauagcucaagcuggccucgaauagcucaaguuggccucgaauuccgaacucacaaagauccgcccgccuuugcuucccaagugcuagaauuaaaggcauguuucaucaugacggguucuguagcaagguuuuagaaguaugagcagaggaccuaaagagggagcauguaauguuucuaguaaaucucacagaccuacaauguacuuuggaauuuccucaugguccaaucaacuuuucucacagacaucuuaaguauuaucaguuaaucacuuuaaaaauaaacugcauuguaugcacacuagcacguagaaauuaguuucuagcacucaauuaguagcuaucucauguaccugucucuggauuguguuuacagacccuagcaagucaaaaacaguuaugugagagacacacagaauugacgcugcacgugcacacaugcacagcacuugugguagagaaaucugcacuuuaaaagggggaggaccuuucucauuuuuauauauuuauuaaaugaauuaucuugcuuaaguguuuucuaagcuuauaucugugcaccuaucuaggaguuaauuagccaccagguaaaacaacagaaaagccaaugcuaugccauccucagaauaucagcauccauuccagaauaucagaaaguaguagucccccccccccaauccaauuagauaaaguuaaaauaggaaauaagggugcaaaccaucauccuuauguggggauucauuuggucacgcuccaggaaaaccucaagcaaauauuuuaagucugggagggggugaaagggcggagagaggacacaaaagacauuguuauaugaaaaggaaugauuacauauggcccauacauacaggauauugucucgccugguaaugaggcgcucacgacuauuagauuggccuuuguucaguuuauccaaacuccuugacauacgccaccuauucuguaaacgccaacagaugggcacaggcacagcacagccucaacacuugauuuaaggcaacagcugcucucuguucuuccaggcuagccuuccugagcagggcucuuccaaaggagauuuacugugagggcuugguggaaaucuucacuggaaagguccaggucaccuauuuugcucuuuaaguaggccuuugaggauggaagugacaaggguuggccauuuacacgccuugggagguucuugauaggguugcuaaacuuuaucucuuggcccuaagaccuucauccuuuacccucgcuucugccaccucgcaggucaaacccgggcuaugccugcugugccugcugggcuggagcuuuccuucuggcucccuagcuucucacuuguuacucucgccuuucuugcccaggggaggagcgcuacaucugcugguacugcuggaggaccuuucgcuacccuaacagccucaaggcacaccugcgguuccacugcguccucaguggcggcgggggccgugcuuuccugccccaggagcacgcggcccggcccggcgcuuccccgguggcagaaggccucggccucccuccgaaacccaccgucccggacuugacggcgcccguccaggcaaucgcuuugcgaccccaagcuccggccgcucagcucgcccaggcgugcggggcgcgggagagcaucaagcgggaggcuucccuggcgccccuggccaccuccccgccgccgggcaaguggggaacgcccaagaagggcaaggagcagccggaccgcgcgcacagucaauuccuggggauagugggcggcuccucgggcggcggcggaggccugccauucuacccaggcgugcgcucggcuuucaagccggccggccuggcccgggcggcugcgcagagcgaccccuaccgggaagagggcggcggcaagggaccggggcuggcgcuagggcggcugcugggcgggggccgggccggcgggcguccgggcaguggggagagcccggcgggccaccaccaccaucaccaccacgcucaccaccaccaccaccaccaucccaagugccugcuggccggggagccgccgccggcgggccugccgugucccggggcccugagagccuucccccugcucgccggccacccggaagaggcgucggccuucaagcacguggagcgggcuccgcccgccgccgccaccaccucccugcccuccgcgcgcuacgccgcucucccggcgcccgggcucccuguggagcgcugcgcgcugcagccccucgacggcggcagccucaaggcuuaccccggcggcgguggcggcggcgagugcagcccccugcccgccgucaugccggccuucacgguguacagcggagaccugcucuacggcccuccggccgccuauuacccucucaagcugcacuugggcgggcugcucaaauaccccgaguccaucuccuaucugaguggccccgcggcggcagcggcggcggcggcagcggcagcggcggcggcggcggcgaucgggccggccgaacugggcucccuggccagcaucgaccgcgagaucgccaugcacacacagcagcuguccgagauggcagccgggaagagucgcgcccgccuggacucggggacgcugccuccagccguaguggcggcgacgggccccggggguggcggcgguggcgggagcgcggcaggcaagcccaagacaggccacuugugccucuacuguggcaagcuguacucgcgcaaguacgggcucaagauccacaugcggacgcacacgggcuacaagccgcucaagugcaaagugugccugcggcccuucggcgaccccagcaaucucaacaagcacauccgacuccacgccgagggcaauacgcccuaccgcugcgaguucugcggcaaggugcuggugcgccgccgagaccuggagcgucacgucaagucccgccacccaggccagagccugauggccaaggcgggcgacggcccgggcccggagcccagcuaugcucuggagccuggggaucccaagagcgaggacagugauguggaugucugcuucacugacgaucagagcgaccccgaggcugggggucguggcgagcacgacuccuaacgcgccuuccagggacugagcagggacgaggacacaguagagagugaaguggggacaagaagggcuucauugauauugucgcaauucuggggauggugucggauuaggaacagugagccgcuccaguucucgaguggagcaaaguuuaacgaaggguugaagaaacacagccaacuaacagcacauagguugugguucucuaucauuaagaccccuagacucuggcauagccucucauucugaaagcauucuggccuugagguucaggaucacgucaauauaagcaucucagugcgcucaaaggugaugauuuuuacugccacacauuuuuaaaacgcucuugucuguggaggaaaucgugccuuuugaaaagauguuccgugugaauuuuauguuaagcauuucacugcauagcaagcaaaacaguagaugugacacccacacaccuguuuccguuuccuaucuguucuccugucaaagaacacuccuugccacauugaguauaucgugguaguggauguauaaauuggucaaguugcaauuauuuaugagagaauaaugauaaauguaaaaugacgcaugaauauaagagcacgcaauauauaaauuuaaaaaauccuauuugguagaguccaaauguuuauguuguuuuauaaugaacgauguacaguggauacaguacuuugcccuugcuuccauuuugugcaaucuguaagaauaauaaagauacaaaggagaguucuauuacuuggcuacugcagaggacccuuuaaagauauaguuuaauuugaaaacaacuucugaggagacuugacaacaugauaagccacagaagauuuauauuauucgcagaauaaauguuaguuaggguuuuauggagaacaggcaaaacccauugguuucuaaaaccauuguuaaucaugcuaaguguuuuuaugcugacuccaaggaccuucca

SEQ ID NO: 1802 - RNA, 70719 nt, Mus musculus
cacuuccuuuccucggcuccuuccugcucuucuuccuacaggcgcuguccaggcucuugagcgccccgcagccagcaccggcagaaagagguacugccacacaguuacuguuuuacuuuauuaggcaagguuuuuggcagguuuaaauucaaguguguuagcuuuccauugcuacauuaacaagucaccacauauuuacuggauuaaaacaacagaaauuauaguuuuuuuuuaaaaacuccugauaauauuuuacuuuauuuuauuuuuaauugccucauuucuuggcuccuggucuuuaccugucuucaaagcuucuucuaagcaucuucaaaucucucaggcugacccuugcaucuacuguaagcccuaucauuugcccuucucucuucuuccucuaagggccuuuacauucagaucacuggaauaauccaugucagccuccccaauucuugauauuuuuuuguuuuuguuuuucgagacaggguuucucuguguagcccuggcuguccuggaacucacucuguagaccaggcuggccucgaacucagaaauccaccugccucugccuccuaagugcugggauuaaaggcgugggccaccaugccaggccccacuucuugauauuuuaacgugcuaauaucugcaaagucccuuuaaccagguguggugguuagaaugaggguggccuccacacgcucauauauuugaauacuuagggagaggcaauaggacguguggccucguucagaaaagcaggcuuugauguuucaaaugcuuaagccagguccagaaagucucucucuuccuacugccugcaggauccgauguagaacucucagcuaccucuccagcaccaugucugacugcgcgucaccgugcuuucugucaucacaauaaugaacuaagccucaauuaaauguuuuccuucauacgcgcugugguguucauggugucucuucacagcaguagaacauugacuacgacaccagauacaauaacacaucacagguuucagggauuacagcauguauggggcuugggaguuggggcuuuccccuucccuacauaaagucucuccuucccuuaacuuuauccugaguguaguucuccaaacauaauaaaaguugcauugaacuagaauuaagucaguuaaaaauuaauauauuaagucaaacugauauuaaaaugugugcccaggggauaauuccauuaaauauauacuuugaaaucagcuuacuuuaauaaaucaguauuucuuauuguauguuagguguguguaguauguugucuguauguguauggaauauacguacuuguuggagagggugcauauguauguauagaagucagagguugauacuggauaucuuuccucaaucauaccaccuuuauuuuuugagacaaggucucucacugaaccugaauaugaucaaaucaauagagagaugguuucaugguuaagaguauuuauugcucuugcacggugacacagguucagcuuccaauauuuauauauaguucacaacaaucuauagcaguuucauauauaggaaauccaaugcucucuuuuaaucucugaggguaccagacaaacauguggugcacagacacauacaaaaacaaaacacucauauacauaaacuaaauaaauacaaaauuauuaaaaaaaaauaagaugaccaagucagauaggcuguguagccacggcacuucaaggaucagccugucucugcacucucacccgggucucccucagcacuggaauuauggaacauccugucugagauucugaacuuagguccucaugccugugcagccagcacuucaacugaaugacccuccuaaauccaauuacucaguauuuaauaagccucaucagauuucuaugccaaugacauuaucuaccauauuuuuccuaaucauuuaaaauuuaauuuuugaaauuuccauguguguagggggcacaugugugccacagcaugugugcuguuagcucaauaaauaacuuugcagagucuguuauucucuugucuuaguaagaguuuuauugcugugacgagacaccauaaccaaggcaacuuauaagcaacaacauuucauuggggcuggcuuacagcuuccaagguucaguccauuaucaccaugauguauuggugauaauggccaggauuggugaggugguagggcaggugcaggugagacugaaaaggguuugaaguguccgagcauggcaguguccaaauagacaggacauuggagaaggagcuaaacauucuaccucuugaucugaaggaagccagggaagacugucugucucacacuaagcagagcuugagcauauauuaccucaaagcccugccuccacagugacacacuuccucuagcaaggucacaccuccaagaacuuccacuuccuaugggccaagcauauucaaaccaccacauucuacucccugguccccauaggcuuguucaaacauaugagccuauagggccauaccuaaccauagcauaauacaaaauauacuuagugcaacuucaaaaguccuauagucuaccacucucucaagaauguuuaaaaauccaaaguucuaagucucuucugagauucauguaaucaccuaauugcaaucuccuauaauaucaaaaucaaaaagcaggucacauacuuucaacauaucauggcacaggauauaaauuaccauuccaaaaugucacagugaggaaauacuggaccaaagcaagaccaaaagccagcugggcaaacuccaaauuccaugucuccauuccaaugucaaagcaagcacucuucagauuuccaacuacuuucauucuuauuagcuguaacaaacuucauucuuuugggcugguuccacuccuuguuagcagcuuuccucagcaggcaucccacaacucuagcaucucuaauaucuugggauauccaaagcaacuucagcuucacaguuucuuguuccaaagucugguauccacacaugaucuucugggcuccucuaaagggcuuggaucacuucucuagcuuuugcccucuguagcacucuaggcucugguugacuccacuccacugcugcugcuguucuugguggucaucccaugguacuggcaucuccaauauacuggggucuucuguugcaaguaggcuucaccaauagccucucauaggcucucuucacgauccuaaguuucacuucuugcauaaccccuucuguccagagccauuuacugcaacugggucuauacccucacuaauggccuuuguuggccucucacgguaccaagccucgguugcucuucauaaccucaucacaccuuuaaaacuagauugaccuaguugacucuuaacauaauaccaaguccagcugccagcauaauguccaucucuggauuuaauuggggauggcuuacaaguucagagguucaguccauuaucuucaagacaggaacauggcagcauccaggcaggcauggugcaggaggagcugagaguucuacucuucaccauaagguugcuagcagaauacuagcuuccaggcagcuaugaugagggucuuaaagcucacaccuggggcuggugagauggcucaguggguaagagcaccugacugcucuucugaagguccgaaguucaaaucccagcaaccacaugguggcucacaaccaucuguaaugagauuugacucccucuucuggagugucugaagacagcuacaguguacuuauguauaauaaaaauaaauagggggguggggggguuuggagagauggcucaguaguuaagagcacugacugcucuucugaagguggugaguucaauucccagcaaccacaugguggcucacaaccauucauaacaagaucugaugcccucuucuggugugucugaagacagcuacaguguacuuacauauaauaaauaaauaaguaaaucuuuaaaauaaauaaaaaaaaauaaaucuuaaaaaaaaaaagcucacacccacagugacacaccuacuccaacagggccacaccuucuaauagugccacucccugggccaagcauaugcaaaccaucacgcuuaguuauccuggaacuugcucuauagacugacuuugaacucugcaugaacuuugagaucugcaugccugucuccagaguauugcugagugcuggauugaaagaauggucuaccaugcuuguacauaagcuuuucucuacuugaaacugugggaacagggucuaccagucugacccugaacucagagaucugccuguaucuauuuccugggauuaaaggcauguguaccaccauggcuagaccuaagcuuuucauggccacuaugccucaagauccagaccaaaagcuagugucaucccaugucaauauccagaucuaaaacccaugucuuccagccucagcaucuggaucacacaugugcccuccauuucuggauugcaguucauuccauauuaaaaauuccaaaugaaaauaauaaccagguaacaauaacgccuaacacaaauacaagccauaagcuuaucucagugagaucuugccugaggucaccacuuccuaaauuccacuuaauauccuucaacacaggaucuagcuacauuccacuuccuggaaucuguauuuuuccuuuccaagcuugcuacacuugaucaaaaugaucuuuaugaguguacuugagaggacaaagucuaugcugggcuucauugagacuucauugacaaugcaauuaaucugaaucuuucaccuuagccucaggcagacucuucagauaaggguaaaaggcuuccacaagcuucaccaaaauaucauaagaauaaucuccagggaacauguuaaaauuccacuucucugaaaccucuagagcaaggguugcauaguucaaaucagcaucacuguguuuuauauuccuucuaggaugguucauuaagccccacuuaaagaacuccacuacuuucuaaagucccaaaauacacauuccucuagacaaaaucauggucaagccuauuacaguaauaugcuagucccuuguaccaaauucugucuuaguuaggguuuugugacuaugaagagacaccaugaccaagucaacucuucuaagggacaagguuuaauuggggcuggcuuacagauucagacaguugguccauuaucaucauggcaguguccaggcagauaugaaugaugcuggagaaagagcugagaguucuacaucuugauuugaaggcagccaaggagagacugucucacacugggcagggcuugaacauauuuauuaucucaaaguccugccugcacagugacacacuuccucuaacaaggccacaccuccuucaauaaggccacacccccuaauggugccacuuccugugggcauauucaaaucauucacaucaucacaccccuuaaacacuuauuuggguucuggggauuggacucagguugucaugcuuaauggcaggcacuguuaccugccaggcuauuuugcuagccuucuguuuauguauauaaacauauauguauauucacgcacacacauaucuacauauguaugcauguauuuguagauucucauaugagagaaaaacugugugguuguuagcuuuaauugucaauuuaaugcaacuuacaaucaucuagggaaaaucucaguguuggauuguuuacauuacguugguccgcacguaugucuuucuuugcaggacugcuuuguaaauguagcuuuuauuuuccugacauaauugucaucuuggagguuuauugccuccauuugcuaaccuaggcuuaguccuggaaacuucuagcuuccugucuuagucagaguuucuauuccugcacaaacaucaugaccacgaagcaaauuggggaggaaaggguuuauucagcuuacauuuccauacugcuguucaucaccaaggaagucaggacuggaacucaagcaggacacgaagcaggaagcaggagcugaugcagaggccauggagggauguucuuuacuggcuugcuuccccuggcuugcucagccugcucucuuauagaacccaagacuaccagcccagagauggucccacccacaaggggccuuucccccuugaucacuaauugagaaaaugccuuacaguuggaucucauggaggccuuuccccaacugaagcuccuuucucugugauaacaccagcugugucauguugacacaaaacuagccaguacacuuccuuacaaaccuuaccuaggccuagaacguuuucagccucugagacugacugcuaaguaagcucgccccuuucuaguucuuucugaacucuggcuggcugguugugcuguucuggcucaaacuucucuccaagcuaauugaaucaguuugacuuuucucuccucagcucugacuuuuugcucagcuuugcuucauucugacuuuggcaauauguucuaacuuucugacuccuccucguucucuggcucuuucugucuucacccaugucuaguuuguucucucucugaaaccugucucagugaaacucucucaguaaaacauaaaaaugccuccuucccuuuucucuaucuucacgggucucucuuaaguagccucucuuuuucucucuauuuccauaagaguugggcauauucuauucuguagaaucuuucucugagucagcucuuuguuugccucuuuucuagccaucacuuucaaacaugggugcuuccgucuacaaaccaauuuuacuaaggggaugucuguauucuacucagagggauuaaagaugugugcuaagggcugagccacaccacaucugaaaacaguuuuuaaaaagauuugaauauaguuuuucaagggcauaggguaaaaagaugugaauuguguaucuuaaacacaaguuuuauaguauuugaaacaaaggauuuauauuugcuauuucuuauaguaugauaauuauagucuugaguuccugcuucuuugacuucccaauaugacggacuugcuuccucagagauugcuuguugcuguggcauuuuaccgcaguaauagaaaugaaaugagaauaacauuuuauuugucuuuuuuuuuuguuugauacuuaacaugaucucuaguuccauucauuuuucugcaaaccuccaaguuugaauggggguuucagucucuaaagauuuugaucagucuaagggcauaucuguuagauaucaugguagccacaggacucaauucuaagacaaacuuaaauauugagggauuaauugaugaauucuugaauuucuuuuuauuaagagaaucuaaauuuuaauuuuaaaauucugcccuuuuuccuuuaacuguaaguugagucuuuuguuuucuauuuuuaaaaauuaaaaaaaaauuucuuuucuucuguuauuuuuuccaugaguuuuaauauauacuuuuuaaaaagaccuauuucugacacaauuuaggcugggcaaugguggugcaugccuuuaaucccugcacuuaggaggcagaggcagguggauuucugcguuugaggccagccuggucuacagagugaguuccaagacagccagggcuauacagagaaacccacagucaucuauaagaaggaacacaggggccccaguggagaagcuagagaaagcaccaaaggagcugaaggggucugcaacccuauagguggaacaacaauaucaacuaaacaguacccccagagcucaugucucuagcugcauauguagcagaagaugaccuagucggccaucacugggaauagaggccccuugguauugcaaacuuuauaugccccaguacaaugguaugccagggccaagaagugggaguggguggguagaggagcagggcggggugggggguauagggaacuuuccggauagcauuugaaauuugaaauauauauaaagaaaagaucuaauaaaaaaaaaaagaaagaaaaaccagaaaaaaacaaaaaacaaaaaccugacacaauuuaggaugcaaauuuuugcaucuuuuacauagucuauuucaaauucaauacuaacauaugaaacuugauauuuauacagacaaauuugaaauuuguauauagacuuuggaauuauaucauaacccaaacuguucuuacagaugcagcauuucuuuuuuucccuggaagaaaaugaccuucuaaaagacaauuauguaccccauaccuaguaucuugaccagcaugcuuguauuccacugcauuugucuaaugaaugguuccuauaaacaacauaaaggaagaguucucuccuuugccaaguuuccccauggaaaugaauuagauuuuuaaguuaaaaaaaaaaaaaaaaguggaaacaacaaaccacaacaacaaacccagucagcuuuugguucuuaacugaacucuuuuaaacuccaaccccagcacacgauccauuaggucacaacuugucccuugugaaagacuguggcucaucaacuagugcuugcaagaaauuauuuuuuguuuuuuaaauuuuuuuauuuuuuguaacaggaagaggguaucggaucccauuacagaugguucugagacaccaugugguugcugggaauugaacugaggaucucaggaugaguagucaguguucuuaaccacugagucaucucuccagccccacaacaaaauuucaaaccaacuguuuuuacucaaaagcaagguguacauuguuguaacagaugaucggauugagcagaauuacaggugugauguacaaucuaguucagaagugagaaccacgugaaauaaaacguuaaaaucauauagagugaaucucagaugcgacuuuagguuccgaguugggugauggaacaagggaagcugucuuaaaaggcacccagcaagugggacgcagcucacuaaagccagcgccugcauccaggccccguggcuggcacuguaaucaguuggcugcagggcgccauccccucaucccaucuacacuccuccaccaugcuccaaccuccaagccgccaaaggaaaacccagaucugggucuggacucaaagucccgccuucggcccacccagaacaccagaccccgcccucgcccccgcccaggacgccaagccccgccuucuccggguuccccucugcacaggcgcagaagcuccugcguguggaagcugcggcccggcgggcggggugaguuggggcccaggcuuuggggucacuguaaccacugugucuucgcuugggcgacgagaccuuccuguacgucaaccagccuagaaagagagguuuccuagccuacccucgcguccagauucacaaaggcaccaggcggccucccgggccgagugcuggcggcaggggggaagagccggggucggggagggagccaggccgagucucgucuuuuuggugacccgggcaugcagcguccgcuuguccccucggggucuccccucgcagcacaucccgcucugcuaacuuggggugcauucauggccugacgaagagccuagacacagcuuuuuggcgacgccaaauauuagguuaggggucgauccuauaccugagcccacguccggcucccggacuucugcaagucacuuuaccucuauccaguuccaaguguaaauuaaggaugaugauagugacguaucucaaagugcuuguaagagguucauagaauugaguguuuugagcccggguaucuaaaaggaagauguuugcauuuccucuucucacgcuggagaauagcagcccaaaacuuaaaaaaaaaucaaaacaaaaaccaauuugacaagggaagcuuguagccaguugaaaagugugauauuaauugcguuagccguacauccuuuguuagagguaacgcaagugcuagauaauauuuaaauuaaaagcugaaguugacgucucagcaggucgccaaaccugaugguucaaucuccuggacccacgaggugaaagagagaagcuacucugaccucacuaaugcaaaucgaaacacuaaacacgugcacagccauacauauaaaauacaucaauagauuuauguuuuaaaagaaagcuguaacguuugauguuugcaaaaccucaaaaaaaaaaaaaaaaaagaaagaaagaaaaagccagaacauguuuguggugaagucaggccugaaacuucuguccuuugauggcucugccugcaacauuggcccuuguuuggcaucuuaaaacuuggaguuugggcauguucugauguaguaguaauuguucuauacucagcauuauguuucaugccaaaaugaccaguuaccauacaguuucugugcuccaagucucuaauggguuccccugaacccagauucauguugcugcuuaguccuugucuuacccaccugaagagagagacuuuauggaaguuaugggcaaaguacccuuuuccagucuagucggguugaguguucauagaauguaccaugaaauauacaaccaugugcugaauccugugagucaguccucuugacuccucagugccaggagagacuuggagguuuccagacacaauuuugauaauggaaagccuuugaaaguccaguaguuggauuuuaauguuguuugcuugcuuguucugccuuaaguggcauuuguaggagaagguuacaugguauugccacauuauggcuuguggauguucagauaacguuacaucugcuagaaaaaugauuggaaauugccccuccauuaccgggagacguuugagacaacgguuucgaaaaagguagcagguuguuuacaaagucaaaaucaaaaaucugccucugaguauucuuccagaggucaucauuaucuguacauaaaucuucaucaaggguuuaucuguuauaggggaaaauauaucauuucucgugagcuguuucugucugagaaugccuuacucuggccagggcucaaauuaaaguuaguggaugcagguuuguaaauuuagagguggaaagccgggauugguggggcgguaggggaggugcaggugagacugaaaaggguuuggagugucugaguauugugcacagaaguuguccagggagaggugugggggaugaggguaagcccggucuuacaagacuuucugaauacaugagaaaauggugacuuggguucaucuagaauuggcuucugcuaaauggcugauagaguguuuacuuacuaaagcuaaaugugaccacgugauuuucuuuagucagcuaauaugagcuuccaggcaaagcuuuacaaaauagcucuguauuaaucuuucuccguucugcucuaggaauugaagcauuguugaggugugcuagcaaggacacuugcacacacaccccauauacacacuuaaaaaaauaauaugugaaaacaguauuaaaaaaagaaaagaaugaagagcuguaacagaugaaguuaaaaacaaugacugaaucuccaucccccucucaaaaauaauccuuuuagaaaacacaaaucagauaaggaaauuagaauauguuaggauuauaagguauaagggcguacuuuucuuagaugugguagugauguuaugcaggagaauuauucuuuuuuaaaagcacuaugcuuacauauuuagggauaaaauuucauuauuucuucaacugcuuuucaggugcuaucaaaauagucauauguaucgggcugaagagauggcacagugccuaagaacauacgcugcucuuaggaagagugaguuucguucucagcacccgcauugggcagugcauaugccuguaacuccaucuucagggaucugaugccaucuucuguccuccacaagcagcgauauuaacaugcacacacccagaggaauacauauacuuuagaauuuuuaaaaaauuguguauuucuaccuggacaugguggcacacauuuuuaacuuacacucuggaggcagaggcagaggcaggcagaucucugaguuuaggguccugauuuacagaguacauucuaggacagccagagcuauacagagaaaccuugucuugaaaagcaaaaacaaaaaaacaaacaaaaaaacugaaccaaacaaaaaaugcaaacaaaagaaaaaaucccuccuaaacaaaaauuauauguuucuauacugauaauuagauuuuuuuaaaaaggugaaauauauguauauaugcauuuuguauacuagauauauaugaaugugcauguauuuuuuggggggggggguucgagacaggguuucucuauauagcccuggcuauccuggaacucacuuuguagacuaggcuggccucaaacucagaaaucugccugccucugccucuugagugcugggauuaaaggcgugugccaccacaccuggcauguauuuuguauucuagauauauacauguauaaucuagacaguguaugagcauucaguaaacaguucuuuuagccuuuguagauuuaaaaaaaaucuucauaacgaaaucuugaagagaaaaugugguagcuuaaaagguggaauucauuuuugugucagugguccauuagguaguacagcgguuagggcuccuaacuccuaggucuaauaucuuuuuuccugguccaaugugggucuucagcugccauugucugcauaagugacaggguaaggaaagagcccaucauaggaagcaguacuuauuuucaaacuuuaccucugagaugauaugcauggagauagacugucuuaguucaggucaauaaaaaaauuacuauccacugaguaacaguaaucacuaguuagggacucaggggcuagaagucccuugcuacagggaaggguacugguaggcccugguuuuaagaagcuccauuugucuuggcucucuucuuguuacuuuccauaaaugaagggugacucucaucuacucuuacuggggcccaucuccuagugcugucacauuguagguuagaauucagccaagggauuuugaaaugcuuggggaauaaucacagucuauacuggagcggcuggaaugugcccuuuguguguuaauuguaucuaaggcaauauuggggcuaggacccagggucuuccaugaguucugucgcuucacacucaguccugugugccuguauugugguuuaauuuagucuuccuuaucuuuccucuguugauuugaccagucuaguuugaauaugcauuaagcauaguuuaauuuuagagauuaaaguauuauuauuuuucuugaaacuuuacaguaaauaacagaugcggguaaaagauccaucaaaagaucuaccugaaaaaggcaaaagaaauaaaagaccacugcugccucaugaugaagauucuuccgaugacauugcugguaaauugugguaucuggcaucucagaccguggugggcuaaagaaguagcaauagaugcuuuucaguaauaaaaucaguacuuuauucucaccguuuucugcauacaucugagacuuagcuucucuagcuccaccuacaaagccauuguugguguucuuauuggccuuuuguuuaaguuauaaguacauucaaauugucauauuguucuuugucuuucucguugcucuuuaaaauuaagucucucagacaccacagguguacagauggugaaccuuuuugagccauggucucuagcccuggcuagccuuaaacucacugugugggugaggguaagaagaauucugaaaaguucuguuuuuuuuguaaguuauacaguuuggguuuguuguuguuguuuuuauccuaacaauggugaaacuugcaauauagcaaagcuagaauagguaaaaagauuuucuguacuuuucuauuuuacuuaucuacuuacugguacuagcaaaugagcacagguccuguguaugcugagcaaaaccuuaucugugcacugcacuacuagucuagauaggcauucuccugcuaucucuucaguccugagcgaggaggggccauauggauaucucuuuaagaacaauuuuauucuuuuuuuaaaaauguauuauuuaauuauuuauauauuuuugguuuuuugaaacaggguuucucuguauagcccuggcuguccuggaacucacucucuagucaccaggcuggccucgaauucagaaauccgccugccucugccucccaagugcggggaucaaaggcgugcgccaccaccgcccgacuuaguaucauuuuaaugauacagccuuuugcuuacuaugcugugguaaacacuacaaccaaaaucaaccuggggagaagugggcuuauuuuaguuuauuguuuauaaucugucaugaagaaagucagggcaggaacagagaggcgggaacuaacacaaaggccguggaggaacucugcacacuggcuuguuaccugugacuugcucagcuuucuuagacauaccagggccagcugcccagaggcagcccugcccaugugugcugagcccucacaucaaucauuaaucuagaaaaugccuacagacuugccuacgcgccaguccaauggaggcaauucucaauugagguuccacuuuccagaugacuccagccugugucaaacugauuaaccagcacaccugcuaacaguaguucuuucaucuagagagaaaauguuuucauuuugucacauauuauucaguaggucuaacgugccagcacgucaguuaugcugucagugugaaucaugugaagaaagcaguagcugagagucuguggucaguuuguucagaauguuugaaagagagaagauucugcgauggacagccaguacugccugcugauguuugguugugccucaagugugguuugcagguaagaaagauauuuauauguaugucuucuguuaccuuuaaaaugccuugugugaauuggacuugguuagauauaggccuuaaaauagauucauugcacauuuaguuuccuggaguuuguucucuauuugugugccccagggaucaaauucagguugucaguauugccuguaggugccucacucacugagccaucucaccagcccuaauaagggaauuuucuacugaaauagaaaguuguggcacaugucuuuaaucucuguaacucuggaggcagaggcaggugggucucugaguccaaggccagccuggucaacagagugaaucccagaauagccagggcugcacagagaaacccugucucagaaagcaaaaaguaguuaauuaacuaauuaauuaaaaugcagaaauugagcacuucagagcuugugauuaauucaagaaaaagaaacccucaaaaucaguacuuuuuuuuuuuuaaacugucauauccagcuucaugguuucagagucugaagaugcuucaggcaguaugugucacacagcgacucccaaagccaucaggaaggaaaguacaucucuuucuucuuacagaucuguaacacuuuccuagacuuuccuccucuuaucucaugagggaaacuacuuggcuggccucauuuccauucucagugagguuggaaggcagaggacuggaaaauauguguuugaggagggcacccuggcccagcacugcucagugucccacaguauauaguauacaggacaggagugcauacauuccugaugacaggaaaccaaucugugguuauuagacguauauacacaaugaccaguaaguuaucuacuuuacaaauaauuaaauuugguaaaaaaccaaacugaucuuucuugcuugaaaucaaaacugcuuaaguauaauuuaagauuugaucaguuggaaagaaacuuaugugucacucuguucaucuucagggaugcgguaaaaacucagaaagccagcauucacugagacacuucaagagcucugggacagagucccauuguguugucaucagccugaguacaugggucauaugguaaguuaacuuuuguuaguacuacuguaucugcuaaaaaaaaaaaaaaaaaaaaaaaaaaaaaacccuuugagcacuacaaguaaaaugaagauauaauaucacuauauacaguuuucucuuauauauaaucugagaugcuuuaagaaaaauaauuuuacgcaugaagauaaagcuuaaaauuaaaaaaauacuuauuucagacauuuuuaguacuauaaagaaaaauucuguuuaguugaauucuuacagugagcucaggcugagucgcaguguuguaagaggaggauggugcuuuaagcacuuagguaguucagagauucucuaagcuacacgggggucuuuuaaaauauuauuggagucaaguaugguguaguacauuuguaauuacagcauuaggaagaaacaggcaaaugauugugaguucuaggccagccugggcuauauaccaugucucagagagacaaaaaaacuggggcuaaagaaagaauucagagguugaguguauacuguaguagcaggagugaugguucagcaguuagaagcacuggcuguuuuuccagagcaccuagguucaauugcuagcacccacaauggucuguaauucuccagucucaggggagcuggcacccgcuucuggcaucucugggugauguaugcguguggugcacagacauauauccaggcaauacucauucccauaaaauagaaacaauaagguuuaagcaacagcaaugaaaauaggcaugaugaugcacacauuuaauuccagcauuugagaggcagaggcaggugacuuguaggcuagccuagucugcauugcaaguucuaggacagcggaugcuauauaaauauagccgaugcuauauaaaacaacuuuguuuuguuguugggcuuguuguucuguuuuauuuuuugagacaggguaaucuacauaacccuggcuguucuggaacucaaccagaggguccugaacuuacacggagcugccugucucugccuccuaugaacuggauacugccaagaaaggaaguuucuuaguuaggguuuuacugcugugaucagacagcaugaccaagacaaguuuaauaaaggacaacauuuaauuggggcuggcuuacagguucagagguuccguugauuaucaucaaggugggaguauuggcagcaucuagguaggcaugguacaggcagagcugagaguucuacaucuucaucugaaggcugcucauggaagacugacuuccaggcagcuaggaugaggauuuuaaagcccacgccuacagugacacaccuauuucaacaaaaccacaucuccaaauagugccacucccugggccaagcauauuuaaaccaugacaggaagaaaggaaggaaagauggaagggggagagggagagagggagggagggagggaaggaggaagacaccccuccuuccauuaauuugguacauguauaaguugaaccauauuucucuccaugagacugugugacauuuuauuacauuuaagacaaacugcaaaaauugauuugaauggugaggaucuguaagaacggccccuugcuuauuuguccaggcuuagcuaaugccuuccucuuugaguucuugguuccuauuaauggcagaaguugucaacugcauaccuuauauguaauuauugaagcuucuuucauaacaucugcuuguauuuuuuuguuuuucagguguuaugaaugcaaugaaaaguugucgacacauugcaacaagaaaguuuuggcucaaauaguugauuuucuccagaaacaugcuuuuaaaacacaaacagguaacuuaagcaauuugugaaagcaauauggauuaaaauacaacauuucauacuuugccugauaaucuucccuucaauuccuggaacccacuugguaggaggagaggcaguguguguguggccccacauuccagggcaguugguucuuuccuuguaccuugugaguccugaggaugagacuggguuaucaggcuuggcuuguguugucucacccgagcuaccuugugggcccucaaauugccucggaagacauuaagugcuugcaguguaguaccagcaagcgaaagguuuuauacaaagauaguugugauaaaagggcuuguuuuguuuauuugcuuuuuuaacagugcuggguuugaccccagggccuuguguaaggcacaagcucuaccacuaagcuacagcccagccuuuuaguugucaugaaaggcaaaagcaaacaaacagaaaucauagugcaaauuguauuucuguaguccaguauguaguugucuuuguuagcuaccugucacugugaagaggcggucacgagaggccagaggaggaacggguguaaacccagacuucuggagcacaaaaggaaucauuaauuuguuaugucuauauuaaacuucuccaacaagcauuugggagauucugacuuugucucagcugugccauucguggcucaaguucugcugaaacaaggaacgggagaugugguucaagaccuugagugcuucagcagcugaguguagucugaaugcugccucuugagaacugucauuacauucgcuuucuuggccauaaaggacucacgcagucauuugaggucagcagugacgaggaaacugucuacauuucuuaccuugaguucccuaaaguucagaauaaagccagugugauagccauuuagucgugauuucuugagcacuuaauuguaggaagaauauuagcauagaauguguuaggcuuucauugcuggaacaaaaaccugaaagaaacuuguaagcagaauuuauuuugcucccuuauaucuuaauggugucagagguuucugcuauggucagcuuacccuuucgcuauggacuuacagcaagucagacaucauuguaggcacaggaaaggugccugccucaugauggcuagggagcagagagaauuaggaaggaagagggagagcauuaggagggccagggcaggauggaacacccaaggacgugcucacagugaccuccuuucugguacuagcacauccaggccaagugcugagcuuuggugagaaugucacauuuguguuacuuacuuuucuaaugcugugcuagaauaucgaugaaaagcagcuuagggaagaaagacuuuauuuucacuuauaguuucagagagauaagaguuuaucacagaaggaagagcauugaagcaagugacaagauuaggaaacagaggucacaccuucaacuccagacacaaaucagagagugaacuggaaguagggccggacugugagcucucaaagccuccccccauugacacacuuugggaagggaggcugugucacuuccacacgaagugcacagacagaacgaacgcaaguguuccaauaugugagccucuggggacauucucaugcaaaccuuugagguauuccgauccugacagagugcaggcuuugagucacggggugcagggugacccgccucaggugcucauuuugcugcuucuuuuuuuccccuuagcacgcgcuuuguucucccugggguauacuggguguuaaauauaaucguuagcgaauaagggacuggagcacccaguacuuuugcagaggaccuggguuugguuuccagcacccacauggcagcuuacaacuaucucguuacuguaguucugggaugucugauggcuucuucuggcaucuauaggcaaugcacauguacaaagcaaagcacucauacguauuaaaacauuaauaaaaauuuuuuucuugggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccugggccaaagggggggaguggguggguaggggaguggggguggguggguaagggggacuuuugguauagcauuggaaauguaaaugagcuaaauaccuaauaaaaaaugggaaaaaaaauuuuuuucuuaaagaagguuacaggacuucacucaguguucuaauugguguuuagagcccugcagacacuuguaagcagguguguucuuuugaaaaggaaaccagucauggaugaucuuaguuuuuuuuuagcugaucucucaaaggaugagcuguggccagauggagauaagagaaaucacgucagguggugggaagcuaauaacccuuagcugucuuugaggaagcuucaguggcacccaagagaugggacucugaaguggugagacauucagaagcagaaagcuggauaguuuuggauucaccauuuccaaaaguuccagcugcugugcuucucggacagauuugguuuugacuaagaucccauggcacauuggaaguaaguuuagggguuuaguaauuugucauacccugguaugaaguuucaauauauuuuaacaaaauacuuuggaaaugaaauaugaguauugcuauaaaggaggaauuuggagaaugguuaaggauaaaaaaaugcuuuuuuucuuucuuuguuuaguuuguuuuguuuuguuuuuguuuggguuuuuauuuuuuauuuuuuggguuuuuuuuuuuuuuugguuuuuuuugagacaggguuucucuguauaacccuggcuguccuggaacucacucuguagaccaggcuggccucgaacucagaaauccgccugccucugccucccaagugcuaggauuaaaggcguguaccaccacacccggcucuuuguuuaguuuugagauuguuuuuuuaaaguuuuuuuuuuuauaauuuauuuuuauuuugugugcauugauguuuugccuacaugaccucugugagggugugggaucuccuagaaccguaguuacagacaacugggagcugccauguaggugcugggaauugaacccagguccucugagaaaguagcugaugcucuuaaacacugagucaucgucucucuacuccccaagauugaacuuucccccuuuccuuuccucccuccaacccucucugcucuccuucaaaaucauggcaucuuuucuuuucuugaguuguuauuaaaugcauacauguauuuauauaaauauguauuucaaaauagaaccuauugaguccauauaauguuacuuggacguaugcuuucagggcugaucauuugucgcuggacagccagugguguauucuuccuuggagaaggcaccucucccagauuuccucagaugccuggaauacuuuauguagggaagaguaauacuaaaaaauucuuuuuaugauuuuuuuuaaaagauuuauuuauuuauuauauguuaguacacuguagcugucuucagacacaccagaagagggcgucagaucuuguugcugggacuugaacuccggaccuuuggaagagcagucgggugcucuuacccacugagccaucucaccagcccucuuuaugauuuugcacuaaguaaaacuaaccacugagaaggcagccaguaccuguucccuaagcaugcuucagauuaugcaaggccuucuuucuaacacguauaauguugcuuacagagaaucuaggcucgcucuccguguaccucuaaaacaaggagcucuuugagucucaagauuugaugucacuggcuucuuugcacuuuaaaaaaauguuugauuauguaacaaagacagauaucuuuguuagaagugaaaucuaaagagugugaauguucacuaagaaauaccaauaauuccacgacauguuaacauaaauacuauuuuuuaggaaugauacuuuucaaaauaagguugaaugagcaguauugcuuuacauuguuauaagugucuuuacugauugccucaguagaaaagagcugucgucuuucugucccugucuccgucucucuuuucucuuuuugucuuuuugagacaggguuucucucaggauucucaguccuggugucauggaacucacucuguaguuagaggcuggccucuaacucacauaaucugccugccucugcaucguagaaaccucuggcauuaagggugugcuccaaugcugccuagcaagauugccuauauucuuguaugugcagaagcagauacaagauaauaucacuugcccuguaacacucugaaaaccaguguucgacugcagcauccagcguggcuccaggcauuagccugcagccugacuaagcagcaagggaauaaagaaaagacaaacgcacaggcacaugacacaggacaacucagauugggugguccagggucugcuauucguaggauuuguccuuaggacaaagaagaaccacuguuagauuuucagucgagaagugaauagucaguguuguauuuuagaucaguuacuugacuuguaagacaggcagaaauggauauaaaccagcuauuaucaaagugacauuuaucauaugacuaaauaagucaaugcuucuacagcugaugauaaacugggaauuagacuuugagaauaagugaauuauuauucauuuuuaaacuagaggaauuguggugaaauaguuuuucuuaaaacuucuuucagcugcagaaaugggcaaauuagcauuaauacuacaugacugguuuaggcaauugcauuaagcacuugagaugaauccagugcagguucccagaagaaugcuuacagcuguguagaauucacaucugauguuagaauuuggguugggggugaggggaacacucacccuugugugcauaaugaaaaggacuuaagauugaaaaaggcaaaaaaaaaaaaaaaaaaaaaaaaaaauccuugcaagacccagccagaaagcuguauaauuaagaaguagaccaucaaccuggagucaguacgagagugaauaagguuggcagagcuuguagggagggacaaacaagccaagugcagagggcuuuuagggccaugagacuaccccacagaaggguggguaccugucauucugcauuuggccauuugcaaggaacaugcagcaccaagaggaaagcuaccguagacuggaugcuggaugaugaccaagugucaguguagguucaucacuucuaacaaacgaacuguucugguggugaaaguguggcgacaaugguguggggcucaauuuugcuuugacccuaacaucugcucacauuuuuucuuaacugacccaugcacuauaaaagggucauuaagccaaguuacuuuaguagacaaauaauaaaugcagcaauuccucauagaauaucgaugcuuugcuuuuugcgaacuacacaggaaacugaaaacuuccaugcuuuuucuaagagcaucugcuuagcucaaaaugucagugcugacaggauguuauccuuaucaggacuaaaggagauaaagucuauacuguugaguucauuaugcuaaugcuucuuaggguaccgaagaccugaagaguguuugauuuuagaaaguauguguuuuuguguaccacuccccccccccauauauuuuuuucauuuuuaaaguaaaacaguauuaaaugguuaauuagguucugaagcugaggauaauauugugaccuuauuuaguaagaguuagaaagugcauuuaaaaagguaaauacaguuucuucugccauaagugaaagcccugaucuuacuucacaagacgaacacaagcucuuucccugucccugcccaguccugugaggcagaggcuuggguguauucaagguuuggcuucagcuguaagccacgaaagaggaauuauagcugccagacggcuacuggguaucaguacugaguuaugggauguguggggacugcccuuauucaggaaggccuggcacugagauuugugcaacugccacgccuaucugugugcuugugugggauucuguugagucuacauguagcagguugauggaggcccuuuguucugagcaucacaucaacuuaauuaaaugccuuaggguuucuauugcugugaugaaacaccaugaccaaaagcaacuugggggaaaaaggguuuauuuccuucacagucccauaucaaaagcagugagauugggaacucaggcagggcaggauccuggaggcaggagcugaugcagacaccauagaggggugcugcuuacuggcuugcucagccuacuuucuuauagaagccaggacuauaagaagguucugugugccuuucaccacucuuaucuuauaagugccuacagaacagccuugggaucucaauauugaguggcuuuucuagcucaaaguuccgaaguucuuucaaaauccuugacaaaaaacauaggucuguuacagccaugccccaugguccugguaccagucugucuuaggguuauuauugcagugauaaaacaccaugacuaaaugcaacuuggggaagaaaggguuuauuuuacccacaguuccacaaaacaacaguucaucuucaaaaggaguagggcaugaacucaagcaggacaggauccuggaggcaggagcugaugcagaggccgugaagggaugcugcuuacuggcuugcuccuccuggcuugcucagccugcuuucuuguagaacccaggaccaccaguccagaugcagcccuaccaacaagaggcuggguccucccacaucaauugcuaaauaagaaagugcucuacaggccugucugcagccugaucuuaaggauauauuucuuaauugaaaaaaauaagagucaccucucugaugauucuagcuuguggcaaguugacauaaaacuagccagcacauuaagauguugagagcaagaaacuaggggagugguuaggccugauguccuccaagaguaugccagguguaagaaauaaaauauuuugaucaccaaaaaaaaaaaaaagaaaaagaaaaaaauauuuugaucauuaaaacauuaauucuaaaacaauuuaguaauuuccaugcauaacaaggaguugggaagaaaagauaccaugcguuaauaaacaagaccccccaggcauucaucaaagcugucccuacuucccaaaugcugggguuacaggugugugccgacauacuuugcucaaacucauauaguaaguaagaaaaacucaaaacaagcauugcucccucuuguaagaaaagugggaagaaacagugguuuucucuggcuuaauugaggcaauucacaaauucugauauuacauuccaguguaauauuacuugacaacaaagcuucaucuuuauguacuuuagccuuuuauuuuguggguuguuuuggaauuccuuuagacaaauaauaaacucagguuaaauuccgauuacccuuuuaaacugcacuuugaaaagauuauacagaguagacaguugacaacaacagugccaucauuccucauuugacugucauuucaucaugaugaaguuuuucgugucuuucuugcuagaucuguaaauguguucugugauguguuuuagccuaccaaguuguucucugagagucuuuagcccucuaaaauugccaguauuauacaguauuauacagccacucacaacauuuuucugcugcuuucuuuguuuacuuugauugccuguguuguguggugcagugaauuuagacccgcuaagcaagcauucuaccaucaagccauauuuccaaccuagaugaaguaagaugauauuuuuacacacacagagguguguguguguguguguguguguguguguguguguguguguguuuaccugugaguggaguugccuguggaguccagaagaggacauccaacccucuagaccuggagcacugacugacugggugcugggaaccagacucagguccucugcaagaacagugcauacucuuugaugcugagccaucucuccagccuccaaguccugucugucaaccugucugucugucugucugucuuuuuuaaaguuauggguaaaacuugagguaaaaaaaucaaugguaauagaaauauuuuuuuguucuuucuaaaaguuuuuauuguagcagcuuugcucuuuucauuauaacuuacuuaaaaaauccuuggcguucagucuuuaggaucuaugguucuguguuuuugaaaguggaggggcuaugaugcagcuuuuuuuuuuuguuagcaugcuuaaguagauuugcguagggguucaaaccugggguucaaaccccauuggcacauaaacuggacauguuagcaaaaacacacgcaccuuuagguguaaaauaauugagucguucauuuccccccccacacacacacacuuuuaaaaauagaaucuuggcucauggcuuucagcagccaguucucuagugaauaaauguacaaaaugcauacuuaguauugguaugauaguaccauaaauucaaggcuuuguguacuaagucugugcuuucuggucauuaaucauaagccuucuauauaaauaacaaauaguaguucauaugauaccuggcacacuguggacauuccguaagccaauugaguuuaaauuguuccguauucuaaaacuuucccuauuucuuuaaauaaaaaaguagcuguuagaaaaugucacuguguuuucuuguuaaaauacugaucuguuuuaucagccuaauaccauuguugaucuuggauauuuucucauagacuuguaaaagugcacaaacagacccuugccacuugugugaaguggcuguuuaaccgugaaaucaacuguguuuauugcugcugcccugugggcauguucuuucuggcagugcuguccuuauuugguggcugugcauggagagccagguggugcugugaagcaucgcacagugaagcgugguuaucuccagcuuugacauuugucauuccucacugcugaagggaaggggcagaaucugguuuuccauauguuuaugcuuuuuuugccugcaguuuuguccagauggucuuaugaacauugcuuacuuugggaugucaucccagauguuuuaaauagugauggauuaaugagguacacagauacauaaauuguauacauuuaaauuuaauuuuuuuaaaaaauuaaaauguuaccuauuucuaggacuuuuuaaauuuguuuuuuuuucuuuuauuaauuuguacuuacucuauaguuuauuuuuuccaaccauuguuuuuacguaaaaaguuaaaagaacaagacugguaauuucaguugauagagggcuugacuaggaugugagaguccuggauucaguccccaacacugcauaaaacccggccuguugauaacugucugucauccugaagcaggggugggaaacaggaggaucccaccuggguaaggcuacgugaacccuugucucagauauguuacauaucagaacaguacuuacuaaggaugcuaaacacacgaaagucuuuugaggauucauuuauuuagagcugcagacauccaaaucguagccuacugucuuuuauaauuaauuuauaaucauugaacacuagucauugaugggaauuuagauuguaaagugaugguuuauaauugggauguuauuguuauacccuuaaguaaaucacuuaaguugucugagacagugcugggauuaaaggcaccagucauagagacauuuucuucaguggcauagccacuaguaaggagccauggcucuaguacaugguuccucaccugugcucuuggaagaaacacuaaaaauggaucaccaaaacagcaccaucuccaccaaaacaaccauggggcguagaaacggguuagcugggaagcaggggucagcaaguauaagaggagaccaaaguauaauaaugagggugaaugugucaaaaacaauggaagcuauuacuauguaaaauuauauaugugaauaaaagaaacaaacaguccacaaggucacguaguaacucugauagaaauucagcuuuuuugugccuagucaauuccaaaggugggcaugaaggacuuaggaucugugauuuggaaguccuagaaucagucugcugugggucuauuggggugucuauaaguggguugguuuguuuguuuguuuuuuaagacaggguuguauguaucccagcuuggcuucaaccucacuugguugccgaggaugccccuaagucucugauuuuccugcuucuaucuuccacaugcugggauuauaugcauaugccaccagccugguucuccaugguauagggaguggacacagguccccucuauaaugguuuugaguuacauuuacacaguuacaauugaguuacaauuacauaggucagcaugucaguuuauagaugcuaggaguugucauugaaaaacuaauaaugcaguuuucaccuggacaugguguuacaugccuuuaaccccagcguuagggggcugaggcauguucaaaaccaaccugaucuacaugucaaauuuuaagucaaccagaacugcaugaacccugcuucaaaagaaaauaaaaacuaauaaugaugcaauuuuuagaucuguacuaguuaucuaaauugucuagaaagcauggcacucgaguguauuacuuagacuuuuugcguuuuuguagugugcuaugaccccaucaacuguuuuaccuuuuaagauuucagauguguaggaaagaugccagaccugcaaaaggcaucaucgcugcuagauggaaguuuuccugaccccguccuuccuccuguuugcuaguugucaucuuuucauuagauguuuccccucugagccuggcgugggcaugcucgacuugaaucccaacacuuaggaggcagaggcggcagcaggcggaucucuguggaguuugaggacagccuagucuauguaaugaguucugggacagccagagcuacauagugagacucggucucacaaaaagagacagacagagacaaagaaaguuuucccuuugggggcugaagagauggcuuaaugguuaagagcacuggcugcauuuucggagggucuggauuugauucccaguacucacauggugacucacaaccaucuauaacucuauucccagggaaucccgugcccucuuuggccuuugugggcacuaggcaugcuaaguaguauauaggcauacauguagucaaaaauaccucuauacauuaaaauguuuuuaaguuagaaaaaaacaucagaauuuccccucauaacuuaaucucauuuaaaaaaucaauuugcauucauucuguaaucucuuuuaauacccuuauuuaccuugauguucaaaucuugauccagugguuuguucugagcaagaucucauguaguccaggcugacuucaaacuguauuuguagcugaagaugaccuugaauuucuggucgugcugcuucuuccuuccauugcuguaauuaucagaguauucccccaaaugcaagugguccgugcucuuuggaguucuuucauauucuuuggcacaacggcaguuuuauagguucacuugccaccuuugcuccgggaggcuuagagucagcuugucuuuagcacuccuuugguuuuggggauggcauguagaaggaaggucuuuuuccauuccucacuuuaaauguuuaaggccauguccugauuacagaaguuacucuguacugugaugucagguacagauaccuguaguagagugaguucaguucaacagcgguagaauguaaaaccaagauacuuugguuugugcucuucuuguuuggcuuuccgugauuuacuuaaauugucaagagacucagacuuagucuucugcuucaugcuaguuauguuuucuguaacuccuaggugcauuuucuagaaucauaaaacuuugugaagaaaaacgugaagcaggugaaauaaagaaggggaagaaaggcugcacugugccaucugucaaaggaauuacaaacuuagggaauacuugcuuuuuuaaugcagucauucagguaagagcuaucagaaugauugguaagcgguaagaguuacuugaacuaguuaauaugagcacacacaaugcuguagugcagacuguucgggacugguaacaguuacucugcguuuuccuuuggguaguuguuggucaugacgucgugaugguguugcacucagcagugcuaccuggaagucuguugucuuccauggcuuccuuagucauacugacagaugcagagcgcauucacccaagcuuuuacguuuuaaauggauguguuuugcugugcuaugugagauucgaaucucucagaguacucauuucaucagaucagagaugcaguguaaccaaaucaggaggcuuaacuuuuucuguuguuuagaacuuggcucagacuuacauucuuuuugaacugaugaacgagauaaaagaagauggcaccaaauucaagauuucucuuucgucagcuccacagcuggugaguaacgaguacaaguaccuguuuccaaaauacuuauuuucuguuucucuaaacugccaaauguggucagaggucucuaaaacauaauucagagugucucauaaaaaauaaucagauaacuuuuucagaaaucauaacuuuaagauauucuguaauucagacauaucacgauuaaaaagguacaaaaauauuaaggcaauuuuuaugugcacaugcuggaaaaaaauagagucaaacuuuuauugagcaaaauguuauggacccuuguuuuguaguaaaugguaauauguacucagauuaagguuuuuguuuuuguucuuuaaaguuagauugaaauauuuaacaucugaagguuuaaaauauuuuuauuaacaauuuauuaauuugguguguacaugugugugcauggcaugaugcagguuggggucagagggcaacucgaggcauucauuucucuccaauguggcuccuggggauugaauuccaaggccacuggguucaagagcaggugccuuuggcugucaagcagccaucucauaggcagucuagugugaugaugaaaauuuaauuagaaauaaagaaaauaacaagaagcagucccuggcauucagaagcuggccugacuaagacccauagggaggucaugguacucugagccaggggucaaaugagaccaaaguggucugacaaguuguuagcauugugaaaucacgcuucaugcucccugcuccccucucccuucugguuggcaccuuuccugucucccaggaugagauuccuggggaaguuuccuucuuuucgauccauuguuucagauugagucucuuaagaauaauugcauuucauccgggcgugguggcgcacgccuuuaaucccagcacuugggagucagaggcaggcggauuucugauuucgaggucaaccuggucuacaaagugaguuccaggacaaccaggucuauaaagagaaacgcugucucgaaaaaacaaaaagaaaaaaaaaaagaaugacugcauuucuguaacuggacucagucacaagcauuuaaucccguuuuauauuuucaguauuucauagaugaaggacuaaaaguuaacauacuugagauaauuuaauuacugucauuuaaauaguuguagcucuuagagucuuggcaauguuuuguuuugaaauuccguacuucugacauagcacuuaucauguuuucaaaggagccguuagugguggaacucucgagcccaggaccacugacgucagccuuguuccuguuucuucacagcaugaaggaggcugaaaaaggaccacuuucuccuaaaguucuuuucaaucagcuuugucagaagugagugugugugcauucuuaauaugaacaaugaggucacaaaguacuaaugcagcauucacacagcaaggguuuuacuccugcuuagucgcugcccagacugccaagacaaagcggcaaugucaccguccucugaagaacugauugucuguccccagacucagaaacuacuuagcucaccuaguaugugggcaacacacugagaagcaagugcagucuguccugacucgucuaugaugcaguauuguuguaaauguguguaucuaccaggauuccagcuguuucugugucgcacgaguuacuugugcuaccuggacauguguuuuuugagacagaacugaauaguuaggcuggggcugagcuugagaccaucacccaccugugaaaucuagaaggcagcaugagagauacauuucuuuuguuggugccuccuaugugagaaguuacuucucugcuggugaagugagccaguuuaagccauauuggaauauaugaacacagguuuauugggaagcugugaguucacuagccucccucaaagacagagacuagggaacucacauugggaagggagaaagaagggagaggggagagaaagagaaaguauguacagagagagagaagagaaggagaaguagggagagagcaaaauaucuacauuauauaucaaagagccaauggagaagggcagcccagccccuguacugaaaaguucagggucagaggcuggguauuccaaguagggacugagggaugcugggagaaccuagaggccaggugugcuuugguauguaaaauacacaccucagcauuuuguuccuggucugaaauucaguaucucagccuuuuguugauuguaaaugaauaaggggcuacagagucguccaugacuaugcccugcuaacauuggagcacuguuacugguggugggaaguuaccagagcagugucaagauaugacugggcauuucuguuccucagaaaacuaaaaguagauugaccgaugacccagcacuacuguaacugagcauuuaugucagcacacagaagucauguacacucauguuuacuacaauagucacaacagccaagucacaguguacagaauuaguuugguguugucagugcacaaauagauaaagaaaauguaugccuacacaacacaggcauaaagaaaaaaauguaauauuugcauagaaaucguugaaacagauuauuaaaauguuaacucaaauaagccagacucagaaaaauucacauuuuccuuauauguagacaucucaauaaaacuaaauccgguaugaaagugaaaagggaauauuugggaagaguaaagggccgaguacaggagaaugaaacaugcaugagaacaucauaguagaaucaacuguacaaugaauaaacaugaauaaaaucuuaaagucuuaacaaauuccaauguuaagaugaauguuucaccuuaaaugcaagcuacccuugaaauucaguccaaucuaaaaugaauuuuaugaaaagaacacagacuaguauuaaauguagcacaaaacaaauuuauaauaaauaucucauuugauauaaaacauauuguugaagaauuugugaaaaugaacuaccuuuuucuacuugagaagacuaaagaggaguaaagcuaaacaccacuaaauaccagucugauggcucuuaugacccagaaucuaguacuuuaaauaguaguccucauuuucucaaaacuagcauccacccuacagugcacuaaugugccugccaugaaauuaagugaauuggcaguaaaguaagcauagaggagaaaacaccauuucaguuacucuuuugcucaguagcuauuagcugcaaauagcgucuuaugggaauaggucagagaaacucaggcuagaaccuaacucacuguuacuugagccuccacagcugacaucagaagacacagaaauuacguaauagacuugugcugucagaaucaagcagugccggugaaaucaaccagaacagaaacaggaaucccucagacaccugacccucaggguagagaucauuucugaacacaaaagcugccuuccuguagcuccaucuuaaccauguacaaacuauuuauugccuucuaaauaaucacgggaaaaaaauuuaacuuaugagucucuuuucauucuuuuacugagaacuuggaaauguaauccaauaacuuagaagguuuuugaaggagcuuauauaagguaccaaugucaagaggccuucaaacuuacuuuuaaaaagguuaacagauaacaaauguaugaagacauucagccuacuuaauaagaugaacauucauaggaacugugccuuauauuaacuauuuuccccacuauuauaacaauacaucugacagauacaacuaaaggaagagagguucauuugagcucagaguuccagugugugccaucgaucauguuggagauggaaugccaaggccaaguugguccauggcaguagggccaacugcuuauucaugucaugcagcuuauucaaucuuggugguucagggaacagagaggagacuggacucagagggacauaugaccagccuacaauccucuuggucuaacacccaccaacucagucuuauguuccaaaguuccacagccuccccaaacagcaccagcagcuugggaccaaguguuuaagcacaugagccuugaaggacauuucagauucaaaccauaucacuuaauaaaauuggugcugucagaagagacgagaagugagggaaagguggcucaguggauaaaaacaaucacuauucuuacagaagagcagcuuuaaguuuucaauacucguaucaauacucgcagccauaguuaccucuaguuccagugauccaaugugcaguucuucugaccucagaaggcacuaacacacaguagugcacauaaacacacacacacacacacacacacacacacacacagaguuuaaaaagaaagaggugagggcuuuuacaguucucaagauauagggggguagggaguugcuuagcaguuaagagcacuaucugcuuguccagaugacuggguucagguaccgguagugagauaguaauuagcaacugucuguaacucaaaucccaggggaucuaacacccucuucuggccuggugggcacugcauguauguguucacagacauauaugcagccaaaucacccauacacauaaaaauaaaaucucaaaaacaaaaucgcucaagauacuaaaagaaaacugugggaagcaaguuggguaugcuggcucaugucuuuaauccuagcauucaagagacacagguggaucucuguaaguucgaggccagcauggucugcauaaugcacuccaggacagucagagcuacauaacacauagacccugucucaaaaaaaugaaagaaaagaaaaaggaaacaaauuaaacaagcugucuucugaguaaugaugcauucaucaguuuacagucuaaagacuuccucuacuacaaacacaccaccaaaauauagagaacacaagggccugcaauauggcucaccagguaaagguacuccccacccaacaugcaauucuuacaacccgaguugaauccccaacaccuacuuaaagguggaaggaaggacuguccuuacaguguuguccucuuaccuccacauauaugcugugucauagguaacuacauacacacacaccaacaauaacaacaacaguauaauacaggggaaacagaaacaaaaguuccaagugguacucacugcaaaaugaauuccauugaacacauauaaguauaaaguaggcagaguaaaacacagccauguugggccugaaggaguucagcuuugagacaguaaaaagacauacaugggcuggagagauggcucagcaguuacgagcacuggaugcucuuccagagggcccaggcucaaucccagcauccauacagcuuacaacucccuguucugacacccucacacagauauacaugcaggcaaaacacccuguauuuugugaccaucugaauacugucucuucaauguucauuucccauuuguugcucgguuguuuccuauggcuuugugcgugcguguguguguguguguguguguguguacauguguguguguacaugugugcgugcagugugauugugggucuuuuucuucccucccucccuccuuuccucccucccucccuucauucuuuauauggauauucuagauacuaaucuugucauuuauggcaaggguuuuuuuuuccucaaacccuuuuuucucuucuugcugguuauuguuugcuuuuuugugaaaagucuaauuucaugaaaucucacuuguuaguuuugcuauuauaaucuauuggaagcugccuaugccuauaucuuaaagcguuuccccuguuuccuuugaguagcuucaauauuucagguguugcauuaaggucuuacccauuuuguguugauuuuuauaaagaauggcaucuaguucuauucucucuguggauacaaaguuuucucagcaccauuuacugaagcggcugucauuccuucaccaucugccuuugacaccuuuauugaagcgcgcgcacguguguguguguuguauugucuguuuacucuguuggugcacagaacuguuucugugccacugccauucuggcuugguuacuauggcucuuagagcacagugaugucagauauugugauacccccaggacuguucuuucccagacuaaaaauuaccaauaucuacuaaauauuggcuuuuaguaucucugugcauagcacuuaacugucuaauucagucacacaggaaaucuaauuguacaaucuuuaggaggaguauaucacauaguuagcaauauacaguuagauuaaaauucauucuguaacuuaauauauuucuucuaaaacagaaagcaaaugaauauauuaagauacagaauguagggcugaagagagaucagugguuaagaauucugacuguucuucaauucccagcaaccacaugguagcucacaaccaucuguaaugguauccagugcccucuucuggugugucugaugacaguuacaguguaaucguauaaaaugacugaauaaauuuucaucuguuuguucuucaagguagaaagauaaauuacagaggccuggaucuuaguucuauuucucuggcuggcuguaugacuuugcauauuaacuuuuuuggucccucauuccgugagauuggggauaaaggaguuaaaagugcauaaagcugucagcacuguguaugguuugcuuaauaaaaguuagccauuuguucgcaguguauaccugguggcucauuuucacuggaagaggaacagcaucuugucuguuuacuugaaaaguagcaagcugacuguuaacuuauuucaaaaugaucuuaaguaagacugguguguuuguugcucaggauucgaggaaugaugauuuuuuucuucucugcuuuguaaaauccuagggcuccucgguuuaaagguuuccagcaacaggacagccaggagcuucugcaccaucuguuggaugcagugaggacagaggagaccaaggucagacccuuaaugcuugucacauguucucuuaaaggcaaggguaugagucuagagucauuucucuacuauuaaaguauagggagaaguaauuuuuaucuacguuguugccuuucuucaguaaguuuauuucuuuuauacuuuuguauaaaaguauaaagcccuguuuuucuuuuucuuaaugucucuuagcuuuuaaaauaaaucaaacaaaauaauucaaaguagcguagagacaaaacucacuguguuguaaauuuauagucccagauacucaagaggcugauggaggaggguuguuuggacccaggaguuuauagugagaucccugucaagacaaaggaggcaggagucguguuguaugauuuuaaucccaguacaagggagguaaagucaggcagaucucugugaguuggaggccagccugguccauauagugagacccugucucagaaaagaaggaagguagggaagggaaggagggagaaaagaaaaaagaaggaaagaaagaaggguaaaaauguugucuugaauauugaggccaaggagaugaagccaagggauauaaaucuuggaagaugaacagcagucugggucgugaccuccuuauuaccccuguucuccuucccucuaauugcucuggcuuucagaaguuuuucauuucugucagcagagugagcaguguccacugcucaugcugaaagccagcucgugggcgucgugauuugcacacuucagcuucacgugugcaaaaccugggacgaccguugugguuugcaguucucggaguagaccuucauugccucaugcuggguuagguucacaccguggcucagggaguagaccuucagccugauuuggagaaugaaggagcauucuuuaaaaagaguagcugcuaaagcaggcuccugagacagugcuuauuccaguccuuaauuuacugguuguuuauuggcauuaauaugauguuggugaaauuuaacuuuugggggauuacauauagauaguauguaacuuauuagugagggcacaaaauguuaaagacauuagauacacagcacauuuucuacauugcuauauuucuaaaguguucccuaaaaguaccuguacuagaaacauaauuccuaacgccacacgguaaugauauuuggaaauggcaucuuuggggguaguuggguuuagauacggugugagaaugaggaggagggaugcaagcaggcauuggcacugucacuccucagaugccucuuacaugccauucucuuucucccuggguuuuucaaagcaggucuugcuuuauaacccaggcuggccuugaaccuaaggcuuguuucauguuacagaaagagaaaaauagacuaacacuggauuuucugccuuucucaaagcagauauuucuaagugcuuguagcaguuguaagccuaccuucagcuucagacucauugucuuacaugugccauggaccauucuguuaguuauaauuagauaauaagguaaaaccuucucuuuucaaagcaaauacacuucuuguuuuuuuguuuuuguuuuuguuuuuguuguuuuuuuugagacaggguuucuuuguauagccuuggucucacucugaacucacucuguagaccaggcuggccuugaacucacaaauccaccugucucugccucccaagugcugggauuaaagguguguaccaccacugcccagccaaagcaaauacacuucuuaaucuauguggcaguuaugaaauacagccgucaaguguaaacagagugcuucuauggcaugguaaguuccccugccauccuucacucaucccaggggcuuacagaagccaugcaaguccucaaaaagccugcuuuguuugaacuauauuaauuuuauuaauuaauuguauuaguggcuaguuuuaguagagucaggguucugauguuuucuuaaaaauuaucucaguaaaacaaagaauaaguugauuucuccacucuacaaaaccauaugugcuguaauaaugcccuucucugacauucuuacucagcuggcuucagcuuuuagcccucccacucccuuucuucugcuccaccauuuuucuguguacuuugauuuugaaccgacuaccuuauauuaagauuucugucaugguggcugggaagauggcucagcucuuaagagcacuggcugcuuuuccagagcacccagguucauuucccagcaucuauaugguaccucaaacugucuguaauuuaaauuccaaaagauccaacacuugcaacacugauaaacauguagacauaaaacacccaugcacauaaaauaaaaauagauaaaucauuguuuuaaaaaugugaucuggcacggugucacauucugguuaauugcuguacucuggaggaggcaagaggauggaggguggaguucugggcaagccuaggcuacauagugagacccugucugaaaagccaaggaauucaaaagaaagauugcuacuauuuucuaucguuaugaacuuccucugagaaagugcaguuuuugucuccuuuuauaccuggguggagcucugugaagacuguuggacacauuucuuacagcuuggugagagcuugagcuggaaagaaagcagagucaccaguuacguagguuauucugucugguuuccuggccguuugcaacuguuuugaauauauuaucaucugaauaaguugaaggguaacuacuacaucauguuauacuuuuuuuuaaagauaaauuaagaaauuuacaaugacauuuacauuuuagagacauuaacuguccccugaacuaaauuuuagucacauuuuccuauagcuuuguaguuuuuuuuuuuucuggagaaguauacuuauuaugauagucauacaucauugcaaauuaauuaagaauuuucuuuguauugucuuccucuguuguacaaguaccauaaaaacucagccagaacacauugcucuuauuuuucuaauugagggccauagacagugugauaaaauuaaauugucacaucuguggauguucuuagccucauaagcagggcagccgugcuggucaguuaccaugcauccgcaggcgggaacuucauugucucgccugggaaugagcagaugcuaagugugcugugguggacacgugucacugcccugggcuuuagucuugucugccaccagaaccauguagaaaugauguaaaacuauggacuuuucauccuguuucuuaagguuuugugacuauagaguugaggaauaugcuauugcuaacuugacugccaugcuugcuaaagggggcaugugagucaaaauuauacauguuuguguauauacagaauauaugauuauauauacuguaaacaguucuuuuauuggauagccuuucccccuucaaauucaagcuuucuuuauauuuuuuaccuuuuuacuugagcugucacuaagaauagacuauuauuaucauuuaagauacauccuuuuaaccuauuguugaguaaaauauguuaaaggcagaauaucucagcuagcugcacccugauguguguuuaagcagcuccacgccuggcguuuccuuuucuuguaacaugagugugaaggucacuuuuguguguguuuuuguuuuuuguuuugugaguuuauuauagaucuauaguuggagcuuaagagggugagagccaugcuaauugagaggcuugggagucacccaggugguccuuuucacgcccccaggacugcaguuugaaugcagggccugucugucaggccgcagucuaccuacugcgauauuuccucagcuccaagucacuuuuagccuuauucuauucuucguaaaggugguuuggaaugucuguuguugucgucguuguuuugagacucagguuuuuuuucugugugcagcccuggcuguucugaaacccacucuguaaaccaggcuggcucugccuuccgagugcugagauuaaagacgugcaucaccacaacccagcuuggaaccuuucuaaaaauuauuauucuaaaaaaaaauuauucuauugcuuaaaacagauuuuguggcaaucugugaaauuauuaggguuuuauuuguuuuccuucuccuuccuuccuucuuucuuccuuccuucuuccuucuuccuccuggcaugguagaugauuuucugucuuuucuaguauuaauuuaaaaaauuguauuuucuuggaaaauugcccacuauauuuucccuuaaguuucaaauguaauuauguuggaaaauauucccuugggguuauuuagaauuuuuuaagcauuuauuuuuaauuuuuauauuuauuuuauuuaaauaugauauuaagcgucccuuuauuauauuaagauaucuaguacuuucaaacaaauaauuauacccaaauaccaaacaaauuccaaacccaaauaauuacuuuuguauucauauauuauuucucuucaguuucuguucucauuuccuuugaaauuuugccuucuacuuuuauuugguuuuggcauuuucuccaaauucauaauuugccuuuuuaaucuauuugcuuuuauuguuucaauuuauucaaauauuuaggucugaaauuacuucagaacauugggaaguaucuuaacuucugauauauaguguuuuuauuuucuguugaaguauaccauguagugugacuuugacauuugcuuuuuaaacagagaguucugugucauuuucacaguauaaaaccuuugucaggggcuggagagauggcucagcauuuaagagcacuggcugcucuggcagggccaaaguucaguucccagcucacacaucagccugugacaaagaucuguaacucuaacucuaggggcuccaaugcccucuucuggauuccuuaaguaccugcucacacacauacaccuuauacacagacacguauaaguacaauaaacccuuuuuaauaguuuaucucaagcaguagaguuguguuuuguuguauuuuguuuuucauguguguauuuccauguguguuuuugcauggaggacccagguugacuuuggcaccuuccuuagcacuuucuuaugcugcauaucaaaguggugucucuugcugaacccggaagucauccucucggcuagucuagcuagccagcuuacucagaugauucucuguccacacuuuucauacacuggauuccugccuacacugcucccgcacugggaucacaggcaggcccccucacccacccuggauucaauuuucugguccuccugcuuccaugacugagcugucuucccccccaucuaccucucagaccauaguuucauauaguaaaaccuggaaccaauacauagaaaagggucuuuucaaagauuacaauuuuucuuucaccuuauguaauaaugugacacuugacaaaauauaucuuaauuagagauacaacuuaugugaaggcuaauaauuuguugacuuaaauagguauuucuuauuggaacacauaguuuauucuguuuugaaaauuuuuggcaagauugagacuugccuaacauagacaggagauguaaaaauaagggccaugaguguguggcucagugguagcaugugugagccccagcuucggagcucagcagcacacaggcacacacgcucccacccagguguaggaauagaaaccuuguaacuuacugcaagcaacugaagacacagccauuauuaacaacacuaaguguaacgauugcuauaauugugauugggaaauucuugacagauguuaguugauagucuggauuuuaggguuucuguaugcauagcgucuuaucuauuaauguuucuuuauggacagacaguuucaugugaucugaucuuuuguuuccuuucuuuugucuugacaaggagugacaguuucgauggagggagaaggggagagagccacucuaacccugaggaaaaacugaauuggguuacuuggcuugugcaaaaugcguuaaaugugagaggaaaccuaaacagaaaguuaacucucaccuaugaacacuugucauuagggaagcuuaguaguuuuguuuuccuuuguuuuuacuuuugaguugacuuuagaagcaaggucguucucuguuugugaguccagacuggcccuaccucacaauccugccccucuuccaaaugcugagauuacaggcaugugcuagcaugccuagguagaagguugguuccuuuggggaauuguacagcugaaagagaggugacacguagcauuucuacauguguaucuguucggcaaggcucagucuuacaaaacaauucaaaacaaugaaaaccacauuuccuaacaauaaguaccuaguuaagacuucaagauuuuacuuuaaagguagccaagacccacaguguaccuugcucuguuguccuuuguugugaaugagagcuucuugaacccucacuagauucucauaucucuguuuuacagaggauacaagccagcauucuaaaagccuucaacaacccaacuaccaagacugcugaugaugaaacuagaaaaaaggucaaagguauguugacucuguuaaaaauuacgucauagagcaauuuauuaagguuucuucuucccuccaagguucggggaacaugacaggguaggugagggaaaggaucuaagaaccagggaggguagaguguuggagaacaccuuccucugcacauagccuggccucgcacucaggaacuuccagccacugugcuuuccagugccugaacaaaacugucccgaagaggggaggggucguaaagccucuccuucccugagugcauuaauacguuagcgguugcuagaggaaggagauggccaugugucuguaaguaaccucccuucacccauucuccuguacacaggaggacgggaucaguaggagugggagauacagaaguguuauggauaaauaugaugaaggacauguaugaaaauguaaugaaacuccauuauuauauaacaggaauauaugcuaauaaccuaaaacaggaucuuuacagaggagcaauugaggacguggacuuaucucuaagguaguaaccuuaggaggagagugcgucuccccaggcucugaccuauggugcaggggagcagaggcacuacccagugguguaucuucccuuuucacaguguuaaagaugacucugucugcacuauuccuacagcuccuccacgugggacauuaggaaugugugagcugcugauaucagagcuguagagugaauuuguccagguaguuguaaauaaaugcacauuagaauauauuacuuuaguauuacauuggauuuuacagcuacaaugguguguugcguuuuaagguguguguguguguugcaaagauacuauuguguaguacuugagucuugugggcaaugacugaggagacaaaucauagaggaaauaguccuacgucgcuuaguacgucagauagugcuguguauuuaagaugaaacugugggaucuguuuuacauauugaaaaaaacauugucaacugcaaaaugccaugauuuuucugugagcccuaguucuuguccaggcuucacagucauguucuuaauccuugcuaacuggagucucuugguuguaagaauuagagccauguacagaagcauaccuuauauguugagaagacuagaaucuuguuacauguggcuaggauucaguucguucuaauuugugagagacuauucuagcaagagugucucuguuugaauguugcaguaagggucagguggguguggcuucacagacgcucccucaaaaauggguuugugauuagagccacugugcuacaggguggaggacagcuuuaauuauuucauaacuggccaaugugggcaguguaggcagguaguuggauacaguggaaagggucauacccuucucuguuaaagggaggcaagaaaucucuagggcugggcacagaggcagagcacagagcagccucuuuccagugacaaggcugcacagcugagaaccgacucccccaaauuaaggggcuggagaugcugaguucuuaaaagcgcuuguugcucuuacaaaggacccacauucaguucccaggcuccgcagagguggcucaucgccaucuguaauuccagguccagaggacccaacaccuucugacguucacguauaugguauuuauguuaagcaaaacacucauacauuaaauagaugaauccaaaacuaaaaauuagaaagggaauacucucucaaggaaaaggauggggagauacgugcucaguguuaaaauuaacuagacuagaugccagagaugcuugcugggggccuguccgggccugugaaggacuugaaaaacuccaaucaucaacagcaaccggcuuucuaggugaggaaacugaugaguggugacuaagaccagguaaggagacaggacucaaguggugcuucuagaaggugcuacuuugaugcuuugugcuugagaaauauaggugacauuaugucacuauagaaauggguaucaacagucuuccuaugaaacccauacuugaacauuugaaaaugcugacucaggaucuguccgcaagaaagaaugucugcgauagaaagaacacgugacaauauaugggugcuuguuuuucuuuuaccuauuuuuguuuguuugguuuuucaagacaggguuucacuguguagcguugucuguucuggaacgcacucuguagagcaggguggcuucuaacucagagaccuacuagccuuugcuucccaagugcuggaauuaaaggagugagccaccaucaccuggcugcauuuuuuuaauugaacuaauaucacauguauagauugacacauccguacauaggacuucaggaauuacggaaaguagcgcccucucuugagaacugagcucuagcaccuuuauguuagaugaggaggcuugcugauauaccuaaggguuuucuucuuaaauggcuuuuaauuacuauuauuguuuuuuauaauuucacauguacacuuuacaauaguuguaucacaucuagagaaugaaauuugguagcccuucccccugucuucuggcucuuaaauauuuccuguccccucuucugcaguguucccugccuuagagggaguuguguaaguggcuugauuagggaugggcccagacuaucucuuuauuuucugcauccugggacagccaugagugugagcacaccacuguuuauuguaaggaggggcuucucuuauuuaagucaggagacacuugucuauagaaaacgguucgcugcuaugucuaguucaccaucagaagcguguuccccacaugagucuacccuccccccccaccccgccccuguaccuccauugauucccaggcuuacacucucaggcguugguucaccaccucuggagaagguuuaagcccacuucugagggcagccaccuuaccuaguuuuaaucuagacaaaaugccuauaagcuccaaagauguugcagacucacuguuuauuuaagagacuaauaauaaauagcagcaagucuugacuccuucagccuuuugcuacagucugccaacaugagacaagccagugauuaagcaaggcuuguucagauauugcaguucgaguuuauauccugugacaucuaauucucacuuaguguacauuuuguuuugagauucuguuaguaugagcucaucauuguaaaggacacuguaagaugucguauguauuuuauuucuaacuuuauuuuugugguauuauacuguuuauaauaugugacuaauuuauaagcaagugcucuaacacuguuguaguuacaguugggacagugguacacaccuuuaauugcagcacuugggaggcaaaggcaggugggucucuaggaguuugaggccagcuuugucuacauaguguguuccaggacagccagagcuacauagugagacccugucucccaaggagguggguggggcauaauuucuccagcaugugccuuguuacucuguguugcaaugcugccaucuagugcaugcauagagcaauaacgcugguuuucuuucaacugugucuccuuuuugugcauuuuuucguaagaagacagaauuucuuaauaguuacuauaaaaugucuauugguuuuaaaguaugucuucucuguuauucagugcuuuggauaaugccuuuuaauaguuuucaacaaagguagaggcuugcaaaggauagauuuuaaaagccagugagcaguuuuguuaauguacuuucugucagcuggcuaaugguggcgcaugccuuuaauuccagcacugggaggcagaggcaggcggaucucugugagcuugagagcagccugugugugugucaacuaguuuaacuacacauacuuacagccuauuguuuggucagugucuccaacaccaguuauuuuacggccaaccauuagcacagcuuccuuugauucguaagcacuccauaaaucaaaugauuucaacuuugaaaguaaucaccaagcacguguguguguguguuuauacuaauuccccaggugaguucuuauucugugcuucacacacuguauuuuauacccccuuuuauugcucugauucuggaaucuuuagccuugaagcagcuauuuuucccuguccuguccaccuuuagauuagauacagaaaugucaaaaaaguuaauaggagcagcuuggguguaguaugagcuaguaguuacugcuauauuuaccuauuaaaauaauuugcacuggcaagaugacucagcaaguaaagauauaugcugccaacccuggcaaguggaauucaauuccugggaccuacaugguguuaauucuuaaagauuauggaacucaauagucacaguuccucuacaaaauuguaaaggagaaagauguaaugugauauauuaaaauacauuauuggauauaauagagaagcuauauuuuauccaaaugacuugaguaguagcaugucacucucggaucagugguuguucugugaauuuuuuuaauuuagaagaaauguguucuuuuaacagccuauggaaaggaaggugugaagaugaacuucauagaucgcaucuuuauuggcgaauuaacuagcacagucaugugugaagaaugugcgaacguauguaccuagaauucacuucauggaauacacuacagucacauugcuguguuguguugcuuuauuucucagguaucacggugguuaucagaagauaacaauagcaaaaucauggaugugaucuaauaaauugaugauagacuuacuuucaauaacaagaaguacuaauucaaauucccaauauuugcuucauacacaaauaaaaccucuuaaaggacaguaguggugucucagaaguaacuaguuuugugcaagugaacugccuuuccuuuauaaagcuuugcuugcccaggcucuaagacuuauaguacaugaaacccauuacugcagaaaguagaacuacacuguuaugacaguggccaucacuuaacuucccuguagaaacccuauggauaaaggcuacagggauucugaguagaguguauuucuccuguacucagcaugcuagucagcuuuucuaaucuaaaacagccagugauaaugacagcaaagaguuuuccuucuacaugaagucuugucauuaaaaaaaccuuggcacauggcuaugcaaugauuuucguaauaucugccuuccacuucuaaguggcaagcacacuucuaaguguuucuaaguccguguguuucugugcuguguaacuguuuuuccucuugacuuccuugugagguccuuaggcuuuuccucacuccauucugcuguguauguguagcucaggcuuugaacuggaguucuccugugucagcuucccgagugguacaugucagauaagccuggcugaauggaucaaauagguuagcuucuaguuuagacugagaugagagagacaucucugaaacaaguaauggucauagugccccguccuaaaauguggggacagaaaaagacuaucacauucgauucggguuuuugggguuuguuuguguuaugugauguacaaaggguguguguguauguguguagaaacucuuacucuucacuuaaucuuugauuuugaacuucauauuuaaaugccaacuucaacaacguaaagcaggcaugaacguuuauagauuuuucaacugcuuguuaagaaauauuucugaaaaugugguugacuacaauagauuaaacuuuuaucagauuuuaauaagaauaaaaauuuuccaggucuucuaucaucucuaguuuuagaaaacagggauuauuguaucuccucuuacuuaugacacugaaacauaaaaugugacuauaacuauuacuacauuuuauacagcauuggacagaaaugcugauuucucucuuauaccaguaucuucuaaaacagauuauccugagaaaucggucaaaugcuugucuacuuuuuauuccuaacacuucauacaguauuuuaacuuauaaguuaaaguuauaaguugucugagagguuugacuuguuuuucucuuuaacaacagugugcaucuaugcuagaauucuaaccgaaugucuccaucuuauuuuccuuuaagaucucuaccaugaaggaucccuucauugauaucucacuuccuaucauagaagaaaggguaaggaggagaaaucacaacauucucauaaagaauaugcaucuauucaauuauuuaaacaucuguuggcuuuaucuguuacagagucaugauuuacacagaauuaggucugugugguguguuugauaccagguuugcguaugugugcaugaaguauauauauuuucuuauucccgggauuaaaucuuuuaaccuuguauuuugaaauuguuaagaaaauuacccuuuuaagugggcuggagagaugggucagcagcuaagagcccuggcugcuuuuccauaggacccugguuaaguuccaagcacccucacgacuugugagcugacagcuguguguaacuccacuucuaguuccaaggugaaauucaguacccucuucuggccuccgugggucugcaugcaaguggugcacaacauccaugccaucaaaacacccauacuaauagaggaauuuuaaaaauauauuucuuaauaagaaaauuuucuuuuuauauuucuaguaaguuacaaguguuaaaaagaauucauucgcugaaaauguuuuauguuacauguggcauagguuucaaaaccuguacuuuuggggaaaaugaguaaaugcagaaguuuacaagaaacagaccaagaucauaacaagggcaccgugacuguaggaaaugcccaucaacccagagcuuccaggaagcacuccucaccuaacgacaaggcaagucaggcuguggggggcugcuguguuuuuaauacuuucauugugaaagaacguucucaaguagaaacagcagucuaagaacacgcacccuccuguuucucagcuuuacagugcucaguuuacugcuagccauguuuccacauacguauugcaccaugucuuaguuaggguuuuacugcugugaacagacaccaugaccaaggcaagucuuauaaaaaacaacauuuaauuggggcuagcuuacaaguucagagguucaguccauuaucaucaaggugggagcauggcagcauccaggcaggcauggcacaggcagagcugagaguucuaugucuucauccaaaggcugcuaguggaagacugacuuccaggcaccuggggugagagucuuaagcccauacccacagugacagaccuacuccaaccaggucacaccuauuccaacaaggccacaccuccaucacacacugcuuccccccccccccccuaccgcuccagcucugaggaaaucguagauacagcauauauaaaaguuacuuuguagggcugggcguagagccugugguggagcgagcgcuugcuucagauguucaacacccacggcaacaaagaaaugaacagugaagauacucacuacaaacacaaccacggcaccaguguagcgcuugaaauuaucccucaguaguaacaucaaaaauauuuuaaagauuggcuuuaugaucugaaaaagggucaacagauagugaucuguugauuagcacacuuuuuuaaaaucuaugaaucaauaauuuuuaaauuugaauauuuauaaaucauguuacaguaauaaggagguauuacaaaaucuugucauaaagagugucacaucugguugaggggaacuguucuauugguucacagaucucccacauacagauacagaaugauacauuaucucauuaauacuccagguacuucuuuucuuuucgguuucucuuaucacugacaguggcauggaggauaugcauacccuugccuauuugccuacuuauaauuguuuuuuacuauaauugacucuguaaacagaauuccucagaaaagcaugguccuuucaaagcugggagaccugggcucucaagauggcucagcauguaaagguugccaagccugcuucccugaguucaguccccaaaacccguauguuagacguaaaaaaaacugacacacuaauuaucuaguaaauuaaauuaguuuaaaagcuugaguuuauuuauuuauuuugcuuugugcugugaauguaauguuuucaugaucguaucuucuguccaugauauucuuuuauuuugcuuugucugcucucuugcugaugcguucagcuaugguaucuguuauuugauuuguugaguuuucguaccuaacaguucccccccuuuuuaaaaguauuuucaaugauuuaucacgcaaauuauuugcacagcaucacuaugcagaucagaacauuaucuagacuggaaacaaaacaauaaucugucccacugauugcccaacauuauaugaaacacaucauaucagcacucacuaagcagguucaguguguaaaauagagaagaacagaaucugcauguguuguuccauacagugcuggugccuagaaucauugucgucaucauccuagcucugagaucaguacucauauuuccuagugucaaaaagaaaaaagauauauaauauccaaaauuguauaaggaauaagauggaagcccaaaacaaggcaggggcacggagucugaagaagcauuaucacuuagcgcgcacagcccagagauacggcauugacucaaaucucagccaucaccuaauguccuaggacacuucucuccaucucaguucucuccagucagagccauugguagaaaacacuuaauauguaguugaagauuaauaaacaauggcuaaaacaaagcaacauuaaagcuaaaauuaaacauuuuaacacacuuuugagauggcuauucccccuaaaaaugcugcugaagaugggaagaucuugcaaccuuuguauacuauccguauguauauacaaucuuguucugaggaagagagugugcugguuccucagaaguugaaaauauaaccagcacaugauucgccagcuucacaucuuccccgcuugaaagccgugccucuaaaaggcuuuuguacaucuguguccacagaguccuaaaggugggagcacgcaagggcauggaaagagaaauggauuaacaagauggguuaagugcacaaacuucacaacauuugcuuuuuucauccagauuuuccaguuguguugauuguaggcuuuuguaauaggaucugauguuuuuuugaguuuccucauuuucuguuguuaugucucccuuuucauuugauuuuguuaauuaggauacugucucugugccuucugguuagucuggcuaaagguugauuuucucaaagaaccagcuccugguuuuguugauucuuugaauaguucuucuuguuuccacuugguuauuuucagccccgaguuugauuauuuccugacgucuacuccucuugggugaauuugcuucuuuuuguucuagagcuuucagcugugcugucaggcugcuaaugugcgcucucuccauuaucuuuguggaggcacucagagcuaugagguuuccucucagcacugcucucagugugucccaugaguuuggauauguuguggcuucauuuuuauuaaacucuaaaaagucuuuaauuucuuuaucccuuugaacagguuaucauugagaguguuguucggcuuccacguguaugugugcuuuccaucuuuguuguuauugaagaccagccuuaguccguggugaucugauaggaugcaugggauuauuucaaucuucuuguaucugcugaggccuguuuuaugaccaauuauauggucaguuuuggagaagguaccaugaggugcuuagaagaagguauauccuuuuguuuuaggaugaaauguucuauaguuauuuguuaaauccaugugguuuauaacuucuguuaguuucacugugucucuauuuaguuuguguuuccaugaucuguccauugcugacagugggcuguugaagucuuccacuauuauugugugaggugagaugugugcuuugagcuuuaguaaaguuucuuuuaugaauguggcugcccuuccauuuggagcauagauacucagaauugagaguuccucuuggaggauuuuaccuuugaugaguauaaggugucccuucuuacauuuuuuuuuugauaacuuuuaguugaaagucgauuuuauucgauauuggaauggguccuccagcuuguuuuuugggaccauuugcuuggaaaauuguuuuccaagccuuuacucugagguagugucugucuuuguccuggagguggguuuccuguaugaggcaaaauccuggguccuguuuauguagccagucuguucgacuaugucuuuuuauuggcaaauugaauccauuaaugugaagagauauuaaggaauagugauuauucccuccuguuauuuuuguuguuauagguagaaauauguuuuuaugacugucuucuuuuagauuuguugaaaaaagauuacuuugucgcuuuuucuaggguguaguuucccuccuuguguugguguuuuccaucuacuauccuuuguaggucuggauuuguggaaagauauuguguaaauuuguuuuauuuucauggaguaucuugguuucuccaucuauguuaauugagaguuuugcuggguauaguagccuaggcuggcauuugugguucucuuggggucuguaugacaucugcccaggaucuucuagcuuucauagucuuuuuugagaagucugguuguaauucugauaggccugucuucauauguuacuugaccuuuuucccuuacugcuuuuaauauucuaucuuuauuuagugcauuuguuguucugauuauuauguguugggaggaauuucuuuucugguccagucuauuuggaguucuguaggcuucuuguauguucaugggcaucucuuucuuuaaguuaaggaaguuuccuucuauaauguuguuguagauauuacuggcccuuuaaguugggaaucuucacucucuucuauaccuaugauccuuagguuuggucuucucauuguguccuggauuuccuggauguuuuggguuaggagcuuuuugcauuuugcauuuucuuuguugugucaauguuuucuaugguaucuucugcaccugagauucucucuuccaucucuuguauucuguugcugaugcucgaaucuaugacucccuaggauuucugucuccagaguuguuucccuuuggguuuucuuuauuguuucuacuuccauuuuuagauucuggaugguuuuguucaauuccuucaccuguuugauuguguuuuccuguaauucuuuaagggauuuuuacauuuccucuuuaagcauuucuagcuguuuaccgguguucuccuguaucuuuuaaaggggguuauuuauguccuucuuaaaguccucuauuaucguaaugaggugugacuuuaaaucugagcccugcuuuucugguguguugggguauccagggcucucuggugggagaacuggguucugaugaugccaaauagccuugguuucuguugcuaauguucuugcccuugccucuugccauuugguuaucugugguguuaguuggucuugcugccucugacuguggcuuguaccuccuguaagccagugugucagcacuucuuggagaccaguucugucugggaggauuuuggguaugacaagagcuguggcacagggucaguucagagugcagacagaaaccggaaggauccugucccagacugcuccuccguuccuguguccugaggguucaggcgggcgccucugagcagaaguguuggucuuaggucugugcucacagguguguccucaguccuggaagagcagcucucuccaggcuguauuuggguauggagcacuguggcacaggaucagguccaggcacagacagaaaccagaaggcaauuagcacacuuuuuauaucuccuuauaaucuacagauuucugcucuuauauacuuacugaagaaaugugguucuuuugacaauaguuuccuauauuggacaauaguuuacuuuguucuugaguucccguggcucuuacaaguucuucucuuuccauuacucccucuaauggaagcuagagggaaauguuagcuuugacuguuuaauuuucagcaagacaacuuguagccggcuucggcgguacgggcauguguuucuagagcccaggaggcuggagcaggaucccaagcuaagcuucagagcaguucuagucagagcuggacuauagcaagaucugucucugaaaccauaaacaaaaugggggcacggugcugggugggugaggagagcuacugacuuuuauguauuaaguaggggcaugcaauuuuuacaaucucuccauauagcuauugaaguauuuuauagauacguuauuucucuagagauauaucuggcuguuauuauucuauuaaaauagaaaucaaucugaccgccacuauguguaccuucucccgacacugucuuuuccugcaggaccuccagagcuucuggccccucucuucaccucugggccuuugagcccggagugcccacugcuggggcucuccuguucugcucuguaucugacgaguccuccaauccccuuaaccucagauuaggucauccuguacguuucuauggcacuuguauuuucccuguaguaacaggacuucuuaucgacguuuggguucuugaccguguggugcucacuauuuucaguucuguacaucaauuauauugagucaaguuaaaaacuaagaaauaugccuaacagguggaucucucaguucaaggucagccuggucuccagagcaaguuccaggacagccagggcuacacagagaaaccuugucucaaaaaaccaaaaccaaaacaaacaaaauaaaaaacaaggaaagaaauaugccuaaaaaauguuguagauuacaguugcagaaacaaggucuuaaguagguuaaguaaggaaugugggguuuuuucccccuuguuuauuguuugcuugcuuauuuugaggcaaggccucacuauguuaccacaaaacacagauaacacaagaucagcaggccuaaaacuggcuagauuagaagucauucuacuucaucaccuguuuaguaaaacaacagugcuugauaaagucacaggugagcucagauuuuuugguuuguuuugguuuugugaggcaggguuucgacauaucccugacuguccucacagaaauccuccugccucuuccucuugagugcugggaguaaaggcaugugccaccaugcccagcucgacuuggcggauguuauccugaaguuuauaauuuauuauuagccauuuacuguguguucuuuacucgaccaaacacagugauagaagcgaacagcuccuuuguguuugauggguuuaagucucccucagauuccuguccuauagcaggccuggucccuuccuuacagguagccacuguuaagagucccaggcaacaguuuaccuucaaaccagagcaaguugauuuucauuuagguagauggaugucagaggaguauuuauugaauaauugcaggcagcuaaguaggacuuuaguggcauuuguuuccaauaagaucacaagauuguuuucucugaaaaauauugucaacuuacagaaccaacuaagucaugacagaaaacauuuaagaaaauggccaucugaagaagagaaaacuguuguuacacacccaaagaaugacaacuuggaagccagcccgccugccagcacccucagcacugaggcgucccugaacgagagccucacugacggcagcgagagggacgccagccuagagagcagcguggaugccgacagcgaggcuucggagcccgagaucgcuuccaagcagccugugcugcugcgguccaggggugauuccugcggacacgcggagcagcacccacaccucccacuggcaagugaauugccacaagccaaggagacgcaugguggcgaggaggaaauggcggaagcgauugcugaacuucauuugaguggcacuguaacuggcaauagagauuuccacagggaaaaacagccacuaaaugucccaaauaauuuguguuuuucagagggaaaacauacgaggcuucacagugcccaaaaugcuuuucagacccuuucucagaguuauguaacuacuucuaaagaaugcucaguccaguccugucucuaccaguucacauccauggaguuauuaaugggcaacaauaagcugcucugugaggacuguacugaaaagagacggaagugccacaaagaaaccagcuccgcagguaaacagcucauugccugcuuucuguguuacugauggguuggagguaacucgggcuuuacaguuccuuaaugggugacccaaguuccugggugccuugggccucuuggcccaggccuuguucuacuugggucucugaauucaggacacuggcugggcagaguagauucauucacaggagagauuacaguaaauggagagcaagaaguacacuucucugucuugaaacugcaaacccauuugcaauugaaucugagggaucuagcuguuuaaaaccuuucugaaauaucccuaaaacuuaugguugaaucgcuaguaggauuugaaauuacugccuccacaaaucuccccuaguuuucguaaguccaguauacguauugaaguucuuaaauauauuuaugccaugaaucuagugcuugcuugauuagagaaagaugagaauucucaccugaugaauuuucgcuaccaucagugaaugcaaagacuauuuuugguggcugcacuguugcuugggcuggggagagggcuuaguagauaauuaugcugaaacaggcagggagaggcagaugcaucuuguggucaacauagugagcuccaauacagccugggccaaauggugaggcccuagcauaaaaaaauaaaacgaaacaaaggaaaaacccaagguggaaaagugauuaugaaagcuaugugcgcacugucaacuuccggccuccacgugcauguacacaaugugcguuaccugugugccccccgcccccacaacauacauuuaaaaaguuucuuuaauauuuuuaaaacaugcuuuagcagguguugugggucacacuuuuaguccugguacauggaggcaaagacaggcagaucugugaguuugaggccagccuggucuacagacugaguuucaggacagccagggcuacacagagaaaucuugguccccuauccucuccuuccccaaaaaacaccccaaaacaugaugcaauacuauauaaauagguuuuuauaaaugccuaccauguuauaaguaauauaggcaaugaaauuuuacaaguaacucuguuauauguuauucagaaaagaaagcaggaggaguuuauaccaaugccaggaagcaacuccucauaucugccguuccugcuauccuaauccuucaucuuaaaagauuccaccagguaagaguccguuuagccacacuauagucagguucaugauauguucguagaguccuaaguccucugagagacuguuacgcuuuagaaagugcuuccuggaauuaaaagaauuaugugagauuucuuguccugggugagggggaagcuugacuaauauugaaagauuuaagugaugucucuaagugguguguggucacaaguaugucuuaauggagacuaaauguuacuaagaagacuuacaaggagcaaaaaggcaaagcccacacagcuuuugagcucccgugauggugucugagcuggccagugcugacgagagacuaagcaaaggaaggagggaggcccuacaccccacccacaaggcuucaacccagaugccuuuaguguuaaagaaaagauggccuuucuguaacuguuuaugauucaacuuuggagcuuguucaguggggguuuucuuccuuuuugguguuugguuuaaacaggauuuucuguuugcuaagcaggugcucugccacugacaucucgugcccuguuuuucuuuucucuuuuaaauuuaagagacaggagcuugggaaguugcccaagcuggucuagaauuuucugcguagccuggaaagaccuugacauuguaaucuugcucaggccuccuaagcagcuggauuaaaaaccuuuccuaaagagcugugucaccaucccuaacugcucuuuaaaaaauaauaauaauaauaacaauaaugauaacuuuuuaauuucucugggagaagaaauaaauauagaucucuuuuugaaaagaguuuuuuguuuguuuguuuguuuguuuguuuuguacuuuaaaauaaaauuaguaauugagagcuaggaaaacagcucauagcucaguugguaaagugguuagucaagcccuugggggaugggcagggggaaucauugugaguucaaguacagccagaagugcauagugagacccuaaacaacaacaacaaacacagaaaccaaaauaaucauaaaagcucaugauucuccauaccccauuuuaugggaacgugguagagagcuguggggucucaucucaucuggaugccuggugaaggugcgucuccaccaacuaugaacaaggaagggcaugccagaugcagaaacuaauuuguuuuguauuugguacuugcguccuuguuuaaccaacucaaaaaaaggggggggggagggaccuuguguacuuuaaaggaauuauuuaugaauacuucagucccuucuuauucugaagcugaauguaaccucaaccaagcccuggucuuguucccaaggguugcaaaugauagagaugaguuccuaaguaauaucuaccuuuguuucuuuguaucuuugaagucauguuuuucuauaguaacuuuagagcuauguuuagaaccauacacaacacggaaacgcaaaccucaacugaauagagaucauugucauagacauaccaacugacugacuguguaacuaugcagaucugagaaggaaaguguuggcuccaaaagaggaagaugcguagagcuucugaagagggaauacagauucaagugaacuacaaaauaggcccaucuuuccaagcaaauucaauauauaaaugagauuuccuuuuguaacuguguaauuuaacaaagauacagaauuauuuggggcuaaaggaagaccuagacaugcacaugugccaacagugggaguuugcacugguaacacugccuaggaagucaguaauuuauaucaggugauguuguaaauagagcaauuuuuuuucuuuuaaguaaagauacuucccuaaucucagcucuaagaacucgcugcacugaaauagagguguagccagcauagccacuucucuuacagauuaaaccagauggaggauuuagcaucuaguguauagggcaucugacuuauauuuuaauggcuagaggagaaucauucuguuaaaagaaaaacaaggugcaaaugacugcauacauaaagcuacuuucuuagaauuaucaccuagaagaggauucauccucuaggccuuuauagacgcuuucuauaaaguaguucuaaacagucucagugugacuggggagagcacacgucugaauaaucuuauugcugccauuggacacuuuccuguagaugaucuuguaauuucaugucagcucucaugugacucuucaugaucauccggggccuggggagacggcuuagcugaugaagagccugacauacaagcagaagcaccugaguuugguccuagauacauguuaaaaacaaaaccaaaaaccuguucaugguuuaugcuugaaaugucacgugaagggagguagucacgggcugaucagcccgcauagucuaauuggggaauugaaggccagggauagacuccaucucgggaaccaaaugaugauaccugcaaagugacauccaaacaaugacgcuagcaguuguccccuagccuccauacauacacacacauccccaguacaugcacucaugucugcacuugugaacaagugcacccacgugaaggaacacauacguguucacaggucacguggacaacauuaguuaauugguauauugugacuaaaauguuuuuauaaagaaaacccagaaaucaacugugagaaauucagugaaauuaugugauugguaugcagugcuaucaagaaagcccugugugaaagguggcaucggauuugucuguguauaccauucgcauugaaguaucuucucaccuuuucauuuuuauuacaguguguaucugugugugugugugugucugugucugucugugugugacucugugugugagugugugugugucugugugugugugugucuguguguguauauauguguaagugugugugugucucugugucuguguauuugugugugugucuguguguuugugugagugugugugucugugugugugucuguguguuugugugucugugugugugagugcacguguguuugugucucugugugucugugugugugucuaugugugucugugugugugucuguguuugugugugugugugagaguguguguguuugugugugaguguguauguguaugugugucuguguuucugucucugugugucugugugugugugucucuguguguuugugucugugucugugugugucugugugugugucuuugugugugugugagugugugugugucugugugugagcgugucugugugugugugugucugucuguguuugugucucuguguaugugugugugugugucucugugugugugugugucugucuguguuugugucucuguguauguguguguguguguguguguguguaggugagaggacaacuuuugagagaugguuuucuccuuucaccauggauuuuagguauccagccugggucuuaaggcuugcacaauaaacaccucucccugcugaaucaucucaccagcccucaguuacuuuuuguuaucaucacaugauggaaaacauacauuuuuuucaagguuaucuuugggaaguaaagagaaaaaaauaaguagaauuuucuuaagauuauaaagguucauuugacugauguaugcauaccauuuacuuuuauuaaaaaaaacuuuaaaaugcuuaguaaauauuauugaguuuuagaaacgagaaguaccuaauaagaucucuuuguacccauuuucuguugugaccucaaugagguugccuacauucaaguucauuuuuuuuuuuuuuuuuuuuuuuugguuuuucgagacaggauuucucuguauagcccuggcuguccuggaacucacucuguagaccaggcuggccucgaacucagaaauccgccugccucugccucccgagugcugggauuaaaggcgugugccaccacgccccggcuuaaguucauuuuuaacaagucauugcguuagguaucuuuaacccuuuguugacuacauuucuaugacaguauauaccaguggauuagcuuuuagcacauuaaauuuauuuuuuuccauuaauuguuguaaaacuacagagaagguaguugaucuaugaaaauuuagaucuaugcaaauaucuuuuagaauucuuuugguuuuaauuaacauauacuuuaaacuuaauuuguacuuuuuguuuuguuuugucuuuuuaaggcuggcuugagucuucguaaaguaaacagacauguagacuuuccgcuuacccuugacuuggcaccguucugugcggcuaccuguaagguaugagauauuaagagauuugauuaauuugcuauuguuuauuagaccaugcuuuugguuuuguuuaaauaaacuucucuucuugaaugaguaauuguggcguguuaauacaucagaugugacuuuuguucuuuggaagaugagcaagguguuaggcauggaccccaaccgucagagcugcacacucuuaguuaugagcaggugauauguuggcuuuaugccuuucuguuccucugcggaagccaaauaaugauuauaguuuuagcacuugugaaggucuguauguuuugcaaauaaacacacuacuggguuguuuuuaugcuauuucacaaauacugauagccauguaguuguuaacugaguacacuaggccuaaauugcugaugccuuacuaacaagguucauaauugcuugcagauacuuacauguaagacgugugugggcaaaauugaugagcauuuuauugaggaagauagauuuagggagaugaaugucaugcucaugauuacuggccucagggccaguuuuguggugucagguuacugacugagcugaaucuagcguguugacuaaaugagugcagcuuucuggugaauacaguuuauuagauguggaauaccagcuccgucaguuacuaacagucaucauucuuaggaguaacagauaauucagcaauaagaaggaggcuuugcaagcucaguguuuagguuuuaagaacaauguguuuuugaaagcaccuauuguaaagaauuacugaccuacuuagcauacuguggacagaacagugcaaugaacuuccauccuccauuccuacagugucaggucuguggucagucuuguccgucccccacccccaccccccaugcuugucuaugcuguccucuguaacugcuuugaagaaaguaccauuucauuauagaugccuaaacuacaauaaguacuguguuccuuuucuguuuuuguuuuguguguuuuccucuugagauaagaucuugcccagacugguccugaacucaugagcccucagccucagccgcucaagcaccgggauuguaggcuugugcgccauaaccaccauguccuuucuacuauggauugcuuuuugugguggguggggauggcaguugaacucaagacaucacauauguacugagcuagauauuucugggcccuucucuaauguuaacccagccacagugucauuuaacauguccuuuauacaguuaguguucauauuuccuguugucauaugcauaugauuuuuaacgugaauuagcauucaauucauuuuaaagaucaauacaauaauuacauuaauuaauauacaagcaaauugaugcuuauacuauguuaaaguaugguuucuucuuccuucuuuuggacucuuucuuguauuucacgauaauguagaauuugaugaugaccucugugauuguucucuacgugaggcaguugugagcagaacagagaggacugugugcgcuuggguuuguuagucccccucuuuguuuuguuuccguaaagccauuccauagaggacauuuugucuguuaacaagcacagaggaucucacuaugguucaagaauacauuuuucuuauguguuuuuauuuuuucaugagcuguuugacuaaauguuacccuuuuucucuauuuggaagaauauaagugugggggagaagguucucuacggucucuacgguauaguggagcacagcggcuccaugagaggaggccacuacacugcuuacgugaaagugagaguacccuccaggaagcuguccgagugcaucaccgggaggaagacugcagccgguacgccaccuaaggauaucuccuccuaaaagcuaaagauuuauucugacuuuuuagaaaaggagcuccaaauggauucauuuuauuaaucuuaagucugcuuagauaaucuucaagaaucuuaaucaucacaaaguaauauccuuuuaggcaauaugaauugacaauuuuuuaaaguuacuucagagacgcaguaguucuuugcuguuguuguuuuuugauuuuguuuuuguaaaaacaauaugugugugcaugugucugugucugugucugugucuguguacuggugugcacagcauaauguggcugucugcgaguaaauaccagcaguuuguucuggccuuccaucuuguuguccugauuuugccccugggcuguguaugucaggccuggggacuucugggcuauucucuugcugcugccucccaucgucccauaggaacgcugggauaacugacacauaucacugauagaugagugguuuugcccugguuguggagucaaauucagaucaucaagcuuguguggcuagugcuucuaaccacauccucagccacauuccccuuuugaagauacaccagcuaucagagagcgggacuuggaaacgugcuagcuauuacuguaggucauugaguuugcuucuccauucccuggauuccuuucuuuucaaaggguuuagauuuugucaaugggugucugcgugaaugugaggguguaaagugcacuugcgcaaagaguccagaagagggcaucugaucccuggagcuggaggugcagcgcuggcugcgaugcucgcaggugcugggaacugaacucuuaaucaucugcaagaacaguaugugccuagcaaacacagaaguggaugcucacagucagcuauuggaugggucacacggccccuaauggaggagcuagagaaaguacccaaggagcuaaagggaacugcaacccuauagguggaacaacaauaugaacuaaccaguacccgggagcucuugacucuagcugcauauguaucaaaagauggccuagucggccaucacugcaaagagaggcccauuggacuugcaaacuuuauaugccccaguacaggggaacgccagggacaaaaagggggaguggguggguaggggauuggggggguggguaugggggaccuuugggauagcauugaaaauguaaacgagcuaaauaccuaauuaaaaaaaaaaagaaaaaaaaagaaauuuuuaauuuaaauaaagccaucguugagccaggaaaaaaaaaaaaaaaagaacaguauguggucuuaacugaugagccaucucuuuuaccuccccuuuauuaguugugguguuguuagguuguuguuuuauuuugacauaggagcucacuauguagcucugucuaacuugaaacuuacuauauagauuaggcuggccaaaaaaucacaaaaacuaccugcuuuuaccucccuuauguuaggauuaaagguguguaccaccauguccaucucuguuauuagcuuuuaacauauauuuauuauuuguguguguguuguauguaugugugccuauguuuggcugucagagaacaaucucauguacucaguucucuccuuccaccucugugugggcucuggggauggagcugcugcccaggcuagcacagcaagccccuuuccucccugcaccaucucaccaguuucuccaccuucuuuuuuggugaaaaugaauauuucucugggaaacuaauuauuauaaggcuaauauuucacuagauuuuuaaguuaaaaauuuauuaacuggaaguaguuaucaaucuuagaucuuauagaucuuagaauuaaauacagcucauaauaacugugucaguguuuacaauuuagaagacauaaacacacuaacuguaaaauuguacuuucuguucugcuagguuugaaagaaccugauggugaauugggaggccacuggguccaugucagcgacaccuaugugcaggugguuccagagucaagagcccugagugcacaagcuuaucuucuuuuuuaugaaagaauauuauaauaucuguucauuguuauuuaguucauuuuuauuuuaaugcugaagucguaaccauaauauguaaugugccuucuuagucuuuaggaauagugcauccuuccagcguuauuuaacucuuucaacauguggugaauccuuuaaaaaaaaauuaauuaauuugacaggcaguugugcaugccuuuaauuccagcacuugggaggcagaggcagacagaucucuguuugaggccaacuagggcuauucaauaaaaccuugucuugaaauauuaaacaaaaaguuaauuaaugcuuucaaaucuauauucuuuuuuuuucuuuuuuuuugcuuuugugagacaggguuucucuguguagcccuggcuguccuggaacucacuuuguaucacuuuguagaccaggcuggccucgaacucagaaauccaccuaccucugccucccaagugcuggcauuaaaggcgugcgccaccacugccuggcucaaaucuauauuuuuaaauguaaaaacauguuuuauguuaauuuucauguccauggaaauugccccuacacacacacacacagaguugauaguaaagcaacccccucuaugauaugacucauccuuacaugcauucaaagaugaugcuaaauuggaucuuuaguauacuauuuccuaauguaauacaaccuuccugaguggauccaauauaucuuaugcuacaauuugcuuacuuuuuguugaagccuuuuuuaagcuuggcuguuuugaaucauacuucacauuuuuaugugcuaguuauuuuucuaguaaacauugaugugaguuuauaacuaugaaaggaaaaucauacauccuugcaccaccccacuuuaaaucaucucagggcucugcagugguguguguguuagucuauaggaaaaguuucuagaacagucugaacuagugccuaauguaacauaauuaauuuuucauauuuuaugugagucaguaguauaaaaaggagccauuguaauuuugguagugugaguuuacaaguaaugaauugauucgcuuauugcuuugaauauuugaagguauugaaacauuucauaaacuaaucauuugcagucuuugaaagauaauuuacaacacauaaaacugguaaauagaaguuauagucuauauaggaauauagaauacuuuaaaguuuaaggauaucuuugaacuguaaaccaccaaauuauauuuauaaaugguagagaucauauucuuauaaccaacaaugaauauauaauacuuuuuuacuucuauacauuaauacauguuaagcauaguuuugucuucauaagcauuuauuuaaaacuucagguggauaguuaggguuguaguucaauggcaaagcacuugccugguuccaucccuagcaaaacaaagaaaauauucaggugggcuuggcuacuuucaugggacacagacuugccacuucuguuccccuuaaauaagcaguaacacagaauaguuucuucuagcauucaaaggauugaacugugaaaacuuagcaugaaaaauauuacuaccaagauuuucaauaaucaaugaaguggcucacugauacauaguauugaaucaagauguaagggaacagguucaaugucuuagucaucagugccuguguuugauucuaugggcaaaugugagggagagaggcuguaaacuguccagaccuuuagccaggauggaaccuucuuaacauguguaacauaaaguccccaguguugccucuugauauguggcugggugaaacugauugucuaauggagacauuuuaagauuguggagaaauuuucaaugguauuugaauuuuuuuaauugaaggugaagaaauauauuuuaucuguagagcccaguuguguccucuaaaaagaacuuuccagugucuucuguuucaucagacauucaguguuauuaaucuauugacacggaagagucuagcaccagagcaaugaaugagaaaaauaauuuauuuguucaagcuagccugucauagcaguugcacccacacccccaaacaaaugcaagcggucagccuuuuuccccccucucuccuggaaaagauacuauuaagacauguacaaucuaagcagguuccaauaccgggcauaugauaguauuuuaugagccuuuaaaacagaaaaaccugcugagugaugguggcccaugccuuuagauucagcacuugggaggcagaggcagguggauuugaguucaaggacacccugguccacagagcagguuccaggaaagccaagacaacacagagaaaccuugccugaaaaaccuuggggaaaaaaaaaacacccuaaaaucuauaugauuuuauacauuauucuaguagugauguacaaauaaaauguucauuuauuaccuaguucugaggagauucuggaauguauuuuuuuuuaaugaccuaaaguuugaguguuuuucuugucaccugaaaauguaggaaaaugguuugauuugauaucuaggaauuucuuaucaagcuuauguaauauagaaaaaucacccagaucuacacuuaaauuuuuguucuuacuuugaaguuuuccaaagcacauuuguagaaauuuuaaauugugaggccacuguacuaacagauuaccucaggaaaccgugcaaacaaacaagaauguuuacagauccgcacaacuagucagugcuuuggcaccgugaauuugaaagguaaaagagagaaguuuuuaucuagaaacugguuuacaggguaccucuagccccaguucuccccugacuuucccauauuuaaaauaauaaaauucugaugaugugccaauuaugugaaugcuugugacauaaacaaauauacaucuguauuuaagauuuguuguuuaauguuuuaaaaaauaauaugaagacugcuuauguagguggucaaggggaugaucauauaucaacagagcuauuuuaccauaguucuuagcuugcaugugugauuaauuagugauuuuuauguaauacuugaauaagauauccugaagauaugaaaugucuucgugaaauguagcugugaaaugucaccgcacaucaaauuuuuauaguacaaaauaacauccugccuacuuucaugaacuuuauacucagcuuauuuuucugcaugacaucuggucauauaaaccuaaaccaaauaugugcgauaaaaucaagcuuucagcuagcauccauugcaguauuagagaaaugauuucugcauuaaaauguuuuuguucaugcagaaaucaucaauugaaauguguuuaaaagaugauuauuuuuagguaucaguaauacauucaugguaucauuccuucucuuucauccaguuuuacaguauuuuaaaaauaucuguguaacuuauugagcauuauuugaucauugcuguauguaaaagaucacaauaaauauuagauucuuauguuaauugauuaggccuagaguuuuugcauuauacauuguuagcagaauguuaauaaacauugugucauugccuau

SEQ ID NO: 1803 - RNA, 6595 nt, Mus musculus
ucuccaccccacuccccaaauuacauguugaaggcaaacuugaggcuagcagguguuuacuuaguaggguuuuauucuaaucacacagacuacaugguuuucaaauacuucauuugagaauuacagaauuucuuguaaagggcauuccuauuuucacaucuaccuauauuuucuuuauucaguuuacuacagucuuguuucuagaguaauuugauauuucuugugcaguucccaacucaaagacuuagauuuuuagugcauggugugggugcuaaaaacagaguucucacauuaaagggaauaagagaguuuauuguggagccacauuugaauguccauggcacaaggaacacaguuaugccaaauuucuuuuauaacacggaagugguuucaugacauuuuauaguuuuuaaagaacagacagucauaaaccaaggcaggcuuaagauacauugguguguacaucacagaagcuacagcaagauggggacacuuuuuacaucgcugcagaugcuaucugauaacauucuuagcucuuggguugguggaaacugggagucagcuaaguuaaaaaguuccaaaggcuggggcagugguuaauagcgcugguaccagaguucaauuccuaguacccacauggcagcuuacaacuaucuguaguccagcaacaagugauuugacacccucacacagacaugcacgcaggcaaaacaccaauacacauaaaauaaaaauaaauaaaucauuuuuuuaaaaguucuaaaagguuuuuaaucuauuagucacaggauuuagcucuaauauggggagguuggcaaagacuggcaauucguggguaaagcuagggccagauuggguaauuagccucuggacuuguaaaauuccaaccucuccacaucacugaagcuccaaucaaucuuugcagacacagacuuuuuccuggaauucuccuucauaacucuuuuuaguuacacugacauuucaagaaagucauuuuccaauauuuagguuaagaaugcuguguuucuuagaauuuuuguuuccuuuuguaauuaaacuccuagucuggaaaguugacauuuuagauauaugaacauuguucacgcuaaacaccuuuuaccuccuuucgggaggccaucuuggaguuuagguaaggaaggaccaguggaaacucugcuucucaguuacuuuuccuuaaagaguagcugagcgaaguugaacugaguaaauguucccaccagggggcgcgaugcuaggaggugaacaaggagaccuagcaaacacccugcuuccagaacucaggcucugcgacucaggccuggcacagugaguuccaaguuggcaggguuugacuugcgguccucuccguagucugaaagaggcaaagcgauucagcauccuucccaaagcggaacugauucuuagaacgcauuugcucuucgagggucuccugccuaaaguuuacuaaauuccguccauuguaccggaacguuaggcucggcuuugugcuggcuguacaaaugaaaaugugucggguaugacacgggcuucacacacaagaggguccaacucgagguggguuggguuugcccucaacaaaaauggcgcggacucgucccgucgguaagaucacauggucguaagccuggcugagaaucagugugacuucagccgaaaagcggauguuauuaucauucacuuccgggugagaaccaccgggcgccaucuugucuuguucaugaagaaguagaagcaucgaaagguuggagagaauuacaggaacgguggcgacagcgguauuccggaaccggagcggguaagcgacgagcaguuuaccccgggggaccugccggaggacuaaaguccucugggucaguguggcgaacggagcgggacucaggcugcguacgcugcuuggcgccaccgccagaaccucauuccggagaagcuccggcguccgcccgagagagugagcgagagagccgcugucgcccgaagggaaccgccuuuggcuaaggagagggcucacgacccauucuucgaacuaagaguuuccuuugagaaggcaagggacuaauuguugggcgccugagcggccguuaagcagugcgcgugcgcagugggaacccuugaggggcagggaguguggaggggcggaggcggcgggggccgggaucuggaacuucgacucugcgacucgcacuacgcaggcgcaaccgcuuucugcugcguccuagacaaguaucauuuaguugcuuaguuuugguguuuuuacccagugauggguauuauguguuaagcaucacugaggaaacaaguaguauccuauauuucaguuguuucguaguuuuguggauaauagugucaucuuaacaaaacugggcacugagcaaauuuugacugugcuugauuaaauuagcagucuuuaauacuucauuuaccuuuucucuuccuaacccuagauaaaacaaaaacaaucuuggauuuuuuuuuuuuuuugaguacauccagcuaaaaccaaaccagaacaguaaagacuuuauuuguggggugguuuucuaaagcaucaggggagacguaaugaguucucggauauucuuaagacacacaauuuaaaacauaaguaagcuuuauauuuaaggacuuuuuugagccucauuauaugauccuggcuggccuggaacuccugccuucgcucaugaaugcuggaauuaaauguauucacuaccacaucaagcccuagaacuuaauuuaauuauagaaaaauuaaacagcuaguguauaaccacguguuuuauuuucucaguaacauauacuuccaugacacguuuuuuuguuuuuuuuuacuauuaauggaacaauguuguuacauuauuaauugagggcaugcuccuauuuccuuaguuaaagaaaaaaaucauuuuuaaaaaaagauaguauuuuucuguggagauccccuggaacugaaguuacagaugguugugaguugccaugaggugcuggcaacuggaggcagguccucugcaagagcagccggugcuguagcugcugagccuucuggccaccgucucuguucaaugaaaaauuacuacuuuaugucuaugugucaguccuagcuuuuguuguccggauucuuccacuuuugaccauugcuaaaucuuucaggugucugcuguuucccaccagcuucuauuugauuggucgguguuuuguuucuuuguuacucuguugcaaagacuggccuagaccgcucagcgccuuuccugcuuuagcuucuuacaauugagauuaccgacucgggcuacuauagaacuuuauuucaguuugggggaaggagcccaggcuagccaccaacucaagaucuuaacugcuuucacuucugaaucccuuuaguguuaagaauacagaacugcuagguacaaagagauuuaaaacauauuucaauucucaucuuuuugucacaaucuguaaaugaguuuuguaaauauuugcggucauuauuugaagaagucauuuugaagucaauugaagcguuuuccuuuuuuccauuuaagauuuauuuuuauuucucuguguguguguguguguaaacauguguaugcacgcaugcuugcucaugccuguguugaguguguaaaugugcacaugagugugaggauauuugguccccuggaucuggaaugucagaaagucuaaguuguuugaugugaugcugggguugagcuugggugcucuguaagaacagccagcacgucuuuaagcagugagccauccuuuggcuccaggucuguuuguugucauuugcaguucuaauacagaauaauuuauagaaaagacugaaugauaauaauccuaguguuaguaucuggguuuacuguaacagauuacuacaaacuagguggcuuaaaacaacugaaauguccucuuuuaugguucuaacggcaaaaaguaugaaagcaaaguuugacagguaccuuccuuccuucuggguuuugauggcaccuaucuuucuguucuuuagcuuguagaguuguccaaucucuggcauuguaggcacaggacagucucagauacuuaugucuguccucaucugaaauuguccucauccuaaauugaguacuguauccacacagacacugguuuccaaauaaguacagguaacauggauuuaggacuucagccugucuuugggaagauuaccaguuaguccauaacucugguuuuaguuuuuuccagcaguaugauacuguugauaaucaagugcagucuuugguuauuggcuuuucuagucuucccaaauucaaguuguuuuucaagaaaaucacauuuaacuuuacccugugaaagaaaauuuugucaacagucuguugcaugaaucaucaaaauuagacuucuccaaaccugaaaaguugaugaucucugaaaauaagucuuaaaaggagacuaagcugauucaaucuuuuuuuuuuuaaagccacauuuaucuauuuuguguacguaugucucugugugagaacacacgugccuugacauguuuguggaggucagaggacuacuuucacgaauugguccucgucuuugaccaugcauguguguuacagggauaaaaugcauucagguuaccaggauggguggcaagugccuuuaccuacugagcuauuuuauggcucucaggauuuuuuuucuccuuguguuggggggacaugagggugcuggggaucauacauaggcuuugcauauguaagccaaguucucuacuacuuacguguaucccuagguccuagaaaucaaaccauggcauuaaauaaauaguaauauuaagauauacuuuuuguggcuaaaguugcauauuuaguggguaacauauaugagugauaaaugaguaaaauaccuaaccauuuaauauaaacacaauacaaugauagagcgagcacucaguaagguuuccucuguucauaaggaaaucuuugagcauucaaacauuuauucuacaagaacuauugcauauuaacuuuuaauuuauggagauuuucagacagugucugccuucaacaguuaacguuuuccaaauuauuacucacccaauauacgaccauaaguuuucaugguuuaaauccauuauuaaaacuuagugggucuguugauauaguucagcaguagugccuuugcuuaucucaagaaacaaaaaaaaguugaauuaaaaauugugucuguggaacuguucauauugaacauagucauguuuuccaaacuaaaaguccaaauacaggaccaaacucaacaacaagcuucaaaauacuuuacaaguaggagcagguacuuuuaauuuaaaauagguucuggcagggcugugguggugcaugccuuuaauccaucacucaggaggcagaggcacucaggucuccaaguuugagaccagcuuggucugcagagugaguuccaagacagccagggcuauacagagaaaucaaccuaucuuuaaaaacaaaaacaaaaauacaaaccugucugucaguggguuauauauuuauagguacagccaauugcagauuagaaguacuugguaaaguggaucuaguaagcauacucagauuuuuguuuuauguaacaaaaaugcuauuuuaugugagggagcugagcauccuaaaguuuugguucccuauggauauuacaucaaucauccacggauacugaagggcguaauaugcauguuuuuuugguuugguugugggauagcaucucagaaggaggauacagguugcuauggacauauggcccagcugaccuugaacucagagauuugccuuagugcugguucccguccccacccccagcacuguaaccugugcuuugauucuuguauaucaggagucagaguagucugcuuuagaaguuuugaauaugguaaguucuuuuguauaaagaucuuauggugaacgugaagaaaaagagaauagggcuucuaaauuuuugucaucaaauuaguuugcucuuuuguuaaguaauugguaaaacccuuuauaaguauugugcuggcccaaaacauauaaaacuauauuuuacauacuugauuaguuaauuauguuccuuuugcuuaucuguuuccuuuuuauacacuuaacaagaaucaaaguuuaguuuucaugaccagugaguuauuucaguuggauuagauuugaaauuuacucuaacuugugcuugaaaaugaacaaagauuaggugguuugucuuguguucagguggcucaugugugauuuuuuacuuugauaacaagucacucuggauuguacuuguugcuucccuugaauccauuuuuaaagcuaaaguauuucuaaaaguauacacacuaugaaagaauauaaagaauacagaaagcauaaaguggaaaucccugcuaacuauuuucugcuugccugaacuucaggaguuuugucauuugggucuuggaugcgugcuggacugugaauguaaguggggugguuugguggaugugugcggugagguauauugguuuuccccggugaguuugugcgucaguacaagccaguguaaaagcgguacuuuacucauuccaauugcuucacagaaguccauu

SEQ ID NO: 1804 - RNA, 1635 nt, Mus musculus
uaaagugacuuacccuucauuuuuuauuaaagaacuagaacacauugcaaauguuaaauggguguugaguuuucuaaaauauguaugagcuaguuuacagcuuguucauaaguaagacuggaguuacucuggaacuuuccuacaguaauggcuacauacugcauuacagucaccacaauuuuauuucugacacagcucaacugaacuuacagaaaagcguuuuguugcugcguggggggauuuagaggguucuuugcuuccuaccaguauuuaagcauaucacuuccugccuuugcugaagcgagacugggauggcuauggagcugugugguguacacuuaauguuaaguacaguccaugcacagaaguccuuaagaguguuaaccaugauuuuccgugggucugucaauccagcaaaaacaugacacuucaacuuguguauaaaacuuuccaccuucauuuggagaaauggccauauaccuccaaacacagggaccucugacagugauagagcagcugguuuucauacagcuuaugagguuaguauuuuagcucagaggaugagagcuuaguaaguuuccccgauuuaaaggacagcacugccugcugaaauguagaaugacgcccuaaauuuuaggaguuuacccuucuuuuuaugagggcauuauuuuuuauuuuguuguuuguuuuuuaaccguuccugguuugcuuuuaguugcugggauaaaacacugacuaaaagcaacucuaggaaggguuucuuucucuuuggcuuagagauccuaaucaaucauugagggaagucugggcgagauccauaaaugcaagcuucagauacaacccaguuccacuuuccaaagggcugaacaucaaucaagaaaacgccgccccacaaacacgcaguucagucuaaugaaggcaauucaggagagggucccuguuuccuggugaaucaaauuaaugucaaguugacaaaaaaaaaaaaaaaaaaaaaaacuaguaugaacuucauauuagauucauacuagaaucuuucauacugcuccguuucuacuuccaauaaacgucuaaacugaguguaaggaguuuucugcuacauacgguguauccugaacagaauaaagggucaguuucaaagaauguacuuuagauguggacuucuguucucugugauuacuugagcgcauugaaagagaauggguuucucggaaaaagcauuuccguacuugauuuuaagcauuagagucgguuuuccaagacugaggagauagcucguaaauacgaaaacagcacggcgugacucguaggacgagaagguagguaggucuucguggccuuuuauuaggaacaucucuuuauuucauugcagacauaauuugauagaggagcucgaguuaacggugaccacaaauucacauuaacuaaugcaaaugcaaaagccggcauccgcgaguguaggaggcggaacccuuccgcuggggauuuguugugaggagggaccggaaaaggaguaggauucuagucgcgauguggagagguggaaggcugggcucucgugggguucgucuccuggaaacgcuaggguuugggugccccagcgcggucgcccagccuccucgccuaacuucacggucg
